United States Patent 8,067,671 (METHODS FOR GENETIC CONTROL OF PLANT PEST INFESTATION AND COMPOSITIONS THEREOF) - sequence listing, part 26

SEQ ID NO: 36968 - DNA, 869 bp, Heterodera glycines
  misc_feature (52)..(52): n is a, c, g, or t
  misc_feature (778)..(778): n is a, c, g, or t
  misc_feature (801)..(802): n is a, c, g, or t
  misc_feature (807)..(808): n is a, c, g, or t
ttttattcatctcccctttttgatagaaaaagcatcagagtgcctaaactancctgtaaataaagttttgtgcgtttcagagcacttttctaaaaaatatttatgaattaattttgcaaaataataaataattaatgaaaaagtcagaatttcgaaaaattttaaaaacaacaagcgttggcattttttcaggttaagttagtcctttacaatggagaaggcctgcaaaatttgaagagattatatcgattttagtgcgctaggttcgatgaaactttttaaaatataagcctaaactttttggcctgtttaaaaaggaattaaaaatttttaaaatatttattcatctcccttttgatagaaaaagcatcagagagccttatttaacttttaattaacatttggtgcgtttcagagcagtttctgaaaaaatatttatgaattaattttgctaaaaaaataaaatagtgaagctttaaaaattaataaaaaattttaaattcagaattactggagttagcatcatagcagtgcttttccttgtctttttgatgctctcgcaaaatctggttcgcttctgatcagtttataaaaaaaaagttaagcctaaaatttttcgcatatttaaaaagcaattaaaaatttttagatttttattcatctccctttttgatagtgaaagcatctgagtgcctaaaataacttgtaaataaaatttggtgcgtttcagagcagtttgtgaaaaaatatttatgaattaattttgctaaaaaataanatagtgaagctttaaaattatannaattnntaatcagaatactggagtagcatcatagcagtgctttccttgtctttgatgctctcgcaaa

SEQ ID NO: 36969 - DNA, 666 bp, Heterodera glycines
  misc_feature (625)..(625): n is a, c, g, or t
cttttctgccaattggtttttgcattgcttatctaagttttttaggtaaaacaaaaattaaattattctcaataatttttcaacgcaaattaattaattaccattttttttataaattatcaaaaaattattacgaaattttaatttccctttttattgcagttttggccacatttttaccacacattgatcgttcgttaaccaacggattggcatctgctgcggaaaatttctcaattttattcggtaaatttctttgaatatataaatttaaaaaaaaacgaaattagtaaatataaataaaaacaataataaatattatcataattagttaattaattaaataatgaatttctaaaatttatatcattcataacttatcaattatcttttttaacattaaaaaaataatttttttatttataaatagtttaagaacaaccaatttgcaaaaatttaatcgtttcaaaatactttttttcacattagaaataatattttaattacaaatcaattttagaaagcaatcaattagctcctctttctcccaattgcctctaacccaaatttttggtcatcatcaaaaattcgctcaattttgagccttgacaaatgtccccacctncgtcctgtgagtctcgaggcgacaattgtctcttgacttgg

SEQ ID NO: 36970 - DNA, 459 bp, Heterodera glycines
gtaaatgcttctttattttttatgaaagaataatctgctaaaagcggcaacatgcatatttatgtccattggctatgcatgtgaagaatgagtgagtgtttcctttcttccccgcccccccccccctccctttttattctcatttccgtgccttggaccaaaagggtcattttaaaaaatatttttaaaaataaatcaaaatttaatttaccattaaataatttaaatacgcattttgcatttgattttgctttaatttgtgaaatttaatattccacaaattgaattttgttctgatttccgttgccagggacacttttgttacccgcccttttaacataacacaaacaaatgaatgggcacaattcccaccacccatccgtggaaagttgcgacggagtgaaagggtcacttcatcactcattgccaaaaatgtgcccgcgggggaggggggggggg

SEQ ID NO: 36971 - DNA, 935 bp, Heterodera glycines
ctaataatttcaattttatcactttttggtccggatgaatgtaagcagccaattgtttttgcctcccaaaaaattgtttcatataatacagtattttattccaatttttttaggtttttattttaatgataatttttcatctttttataatttaattttattttataatgcaagcaaaaataaattgacgcacagccgagaatgtttcttttcaatggaatattctcaatggatttttaattatatttttggataaattttgtggagaagtattttagtttaatttttattttcaatattaataccttattattactttagcacaatattgtcgtaattactgaacgaaaaacggaagagaaaataatacataaatattaagtggcgctcaacacctcccctaaaatttgattattaattaaatgatttatttaagaagcatttactcattcatctccaatttttaatattttttagattcgacttaatttttaatatgaataaattggtattatccattaaacatctttgtttctattaatatttttttaccatggcgactaaaatttcttctgttgcccttccttccagtgctatatttttaattagttgtttttattgaaatataatttttaatattctatacgaatttcttttaataaatttcgcatagtaattattttttctgtttgttgaatctatttttaattaattaaatataagttttctttttttagtaaaacattaattttttatcggtattatgtttctcttttctctcatgccttccaactgctcctattatttttcttgctccgaaattttaatatttcttgctaattaaaatttttaaaaaaaaatttgcttttagtttttcttcataatatggctccgtccttttttaaaagggtaagccttgattgaattccatttat

SEQ ID NO: 36972 - DNA, 891 bp, Heterodera glycines
  misc_feature (785)..(785): n is a, c, g, or t
  misc_feature (790)..(791): n is a, c, g, or t
  misc_feature (804)..(804): n is a, c, g, or t
  misc_feature (828)..(828): n is a, c, g, or t
tcattgaatttaccctttttcgtgactttttgaagaattgtgctattttcgagcgaaattctggcactttgcctcagtcattgctcgaattgttcgactccatccgttttcacacagaaaatgacaatgtatggatatcatgtaattgcatctaaattctaaaaatttcatataaaaaggaccgcgacctgaacgttttgaccagtttgagactacattttgccaagctcatttcactgatcatcaacggcacgccaagtgagagagaaaaataaacaaataattggaggttattaattctgttatcagttgaacaacgcgagaaactgttaccaccggaaataaaacgttcgctgttctttttgtttttgtcgtggtgcggcagaaccattggtacaatcgacaaaaggttcggttttcctgctgattaaagtcattttacttttatgattcagaaagggcgtcgatgttggcatttctgttgaacaccatgccattcgggcgatgtgcgcactcgccacccttggctcaatgttcgaatgtccgggcagaatttgtgaagaagaagcaatgttccgttggttggaaacacttctctcgtcaacgaattcaattgtcagaacaattagcagtgtcaattatcccatttttgtaaattaattttcacaggtcgatgaaatttgtgagcagatcctttgcaatattctccatttgaatgaacataatccggcgggtcggttttttctgccgttttggtcaataagccaatgccttttagcttttgnagttnngtgtcccaatgtngtacaccaaaaatgacttggtcgncatccgttgtttcatgcaaaattcatgcttttctcacaaaggttttcttgtcaatgctgcaat

SEQ ID NO: 36973 - DNA, 1283 bp, Heterodera glycines
aattttaattttattattataatttcagtataaaaaaacttaataaacgaatataatatatgtaataatttcgagagtgttattatttatgataaacaaaaaaaaacacaaataatttaaatatttaagaatataaatagcttacgtacaacaaaaaagcatgagttatttataataaagctgtttaaatattatattttttgcttccgatttgggaggaaattagtaaatcgtaaattttagtgcattcaacaaattaaaattttaacaatttttttgcggtgcattttttaagaaacttgggaaatgggcgaggggatagggtccggcggtgccgttaggctccaccggaaaaacattgtaattgttaatgcgaattgttaacagatttctgtaaaaaaatgacaactttgccacaaatcttatttttccttgataaaataatgacattatgccataaaaattcaaaattatgagtatgttttagatcagaacaaattgggtcactacctccaaaaataaaatattctgagaagaattttatataattattttattattattattattattattatttatcacttagataaattatttaatatgtaaaatgtaattttttttttacattaagtatagaaaaaaaaattaaaaaggctgacaaatcactgcaacagaataaaatatataaaaacgcaatattcaaaataaagcctaattaattattttgtaaatcttcatgaggctcggaatcatgagatttaaaagatgaaaaataacgaatgccaaagaattcataaacaaaaaaaccaaactttaaaaaatttaatttttaataaaccgattttatttttaattagcataaactaaagcaacataataatcattagtaattttaataaaaaatttgaatggagcaattaaaagacaaagaagaaaataaacaatttcggaaaaatacctttataattatttttgcatgttaaaaaataggaaaaaaaaactactaacaaaataattaatgaatatggatttataaaaacaacaaataatattatactgacaatttttcctctttgggccaaatttttatgaaatatagcaaaccaatcaataaaaaaatatatgtttaaaatacatttttataaaatatgttaaattaaactgtataattatttatttaatccttttatttaaaaaatcattattacgcaataaatccataacaacattagataataattatattaatatcatataaaaatacgcacatttatattaaa

SEQ ID NO: 36974 - DNA, 1131 bp, Heterodera glycines
tattaattaacatataatatattatttataaggatattgcctcataagtataattataatgatttatacacccaaaagtaataatgcagtaaaaatggatctaaggaataaatctatcaacgaaaattactgcataaatgaatacctgatatgatttcacatacatcgcgaagatactttaccactaattacattagtaattgatacatcgaccaaataatttaaaaaaaattaatttaattcaagatatataaatttaaagaaatcagacctacttattaaaagtgataacgagacttttttagagtcattttgccgaactgttcagggctttttggaaatcaagagtataagtttaactaaatttgatcattacaaatgccatttttaatataaaaatagttctttatataagttgtcaataattaataaataaatatgtaatttgtctaataattagtaaataaataatttttgaaatatgtaaaataattatatattaaaacgttgaaatttaaatagtagttagggcacacaaatccgccgggtacggtagcctcccatacctatgggaggggtgcacggccaactgagcgccagccatttgagcgccgccgggtgagcgcgggccaactgagcgccaaaattttcagtactgaaaccaaaacctattgcgcgacttttttttgaaagcccaaacctattgcaggggtgcgcgacttttttttgtaatttttctctgaaaattatttgtttttttattttttaaataataattttttattcgaaaaattctgccgcagactagtggactcgatcttttggtctgccaccaaacccaacacactaccactcggccatgagaccagttgccagaaaaaggataattgtccactatatgctgcaaagatgatgacgtcaccactgcgaggggtacggtaacccagtgaaaattcgcaataaataagtcgcagactagcgggctcgaactttcgctctgccaccaatccaacacactaccactctgccacgcaaacacttgccagaaaaaggataattgtccactatatgctgcaaagatgatgacgtcaccactgcgaggggtacggtaaccccagtgaaaattcgcaa

SEQ ID NO: 36975 - DNA, 909 bp, Heterodera glycines
ttcgcatgctaccttttgcgaaattttgcttttaaattgttatttcccgtttattatttttcggtactgaagtgtccattttcactgggactcaattgtcccagtgctcagatggcatcggttcgaatttataccttgtttttttatacttagctcatcaagagctctcgaatgataccaaatttgtgtgattttgacccttttaaaaggtcaggtgcctcccttttcactcaaattttcaagttttaaaccggttcaaaaaccggtttaaatgctttgccgcgcagttttttgatggtttaggcgttttcagcacctaagaaaacctataaaaatgtttttatgcgattttgagtttgggacctatgatggatatttactataacaataaattattaagttattcaaaatgacccaaaaaaatgttcagaaaatacacccctaagaattgtaaaatttttcaaaaaaattatcacaaaatttaatatttttttcttaataaaaattttttgtttaaaactttgttcatattcgaaaaaaactttaaataaatcatttaataatttcatttacaattgaaatatttaaagttttaacgtgttttgttacctaaaagcgttaataaaaaattttattttcctatttttgtgcctttttgaggatttttgtgcctatttaatgcctattttgcaatttttaaatgcctttttaggtgcctattttgcgttttttttttttttttgcttaaaaaaccaagccctagatataacttttgaaaggccaatttatttatttttaatttacgcactgttaataaacagggctgcaaaaaatatgcaaatgcatattttttcctggcttctccatgctctaaatagcaggaaaaatactttcttttttgtgtttgcg

SEQ ID NO: 36976 - DNA, 575 bp, Heterodera glycines
gtcattttgtgtaatttttacctttgtaaaatcgtatttcagctgtatgctggaaaactccgtggctatctgctaatgcctgtcgaactccctaatccaaatgatccaaatggggatcgttttagtggccatgggcatgttttgtaagcattttttgtgtctttaattgaccgatttatgaaaaggatggaggatttggtgtggcaactgagaggcaaaacacgcaacgcaacccatgggattattatgttctacgtaatcagcaacccataacgtttactttataaaattttttcaaggtgcaatatgtgaatcggatgctgtataacgtcaaatataacttttagcggttggttaaaaaatagacaatttggcgctagtgaaaaagtcaccacatttgaattttatgtaaaaatatagtggggcacgagccttgggtttatgatatcgttgttgctataaatcccatgaaaattgtattatccggggtcatagaggatgccgatcatcgatcacgaatctgatatctaattcaatggcatggagccataaactcgattgaatattctaaaatt

SEQ ID NO: 36977 - DNA, 1270 bp, Heterodera glycines
  misc_feature (1257)..(1257): n is a, c, g, or t
gttcaagtccacttgcctgcggcacatttattgcgatttttcaccggactacagtatccctcacagtggtgacgtcatcatctttgcagcatatagtggacaaatatcctttttctggcaagtgatcgcgtggcagagtggtagtgtgttagattggtggaagtgcaaaagttcgagtccactagcctgcggattatttattgcgaattttcaccagactaccgtacccctcgcagtggtgacgtcatcatctttgcagcatatagtggacaaatatcctttttctggcaagtgatcgcgtggcagagtggtagtgtgttagattggtggaagtgcaaaagttcgagtccactagcctgcggattatttattgcgaattttcaccagactaccgtacccctcgcagtggtgacgtcacaatctttgcagcatatagtggacaaatatcctttttctggcaagtgctcacgtggcagagtggtagtgtgttgggtttggtggcagagcgaaagttctggtctgctagcctgcggcagaatttttcgaataaaaaatttgaaaaaaataaaaaatattatttaaaaataaaaaaataaaaataataataaataattttcagaaaaaattttacaaaaaaaagtcgcgcacccctgcagtaggtttaggcttgcagaaaaaaagttgcgcacccccttcaataggtttagcttttcaaaaaaaagtcgcgcaataggttttggtttcagtactgaaaattttggcgctcagatggcccgcgctcacacggcggcgctcacctggctggcgctcagttggccgtgcacccctcccataggtatgggaggctaccgtaatccggcggtttggaagacactaactactcttaggtactcagttgtacgttttttcagtaccaggtcccggtccagtacaattctattaaaaacttccattgagcgtttcttaaaactgccacccccaatttaaaaatcattgaaatgaaattttttttatttcaataattctttcaagattttttaaggaaattaattgaacaaaatgctttatgaaaaatttcaaagaaaaaatttcagagaaaattagaacttttaaaagaaatatttcaagaacaaaaaatttaacacataaaaattcataattttgctcaaatatgactaaatttaagtttttaaggtaattcaatagctttaggtgttgtctatcggggagattaatgtttaattttttttaaagaangtataaaacgtaa

SEQ ID NO: 36978 - DNA, 1125 bp, Heterodera glycines
cagactcataagtaaataggagcattttaggacatcggggatatttttatcgccggcattcgcacgaaattgttgccaaaatgcaggccaactcaatggatccccttcaaaataaggccagggcatttttggaaaatttacattatcattagtgcttcctactctttggtcccgattatttcttctagaaaaattaattccaatttcattaattgatttcccaatttcattctcattttcctctctttttggttcttgatctgatatttttaaagatttgacactttcagctaaacttttccgtcttcatttactaaaataatatttattttgcttactgtttctcttccttcctctacccaatcgtaaaagtgccttcctctgtgagagagtaatcgatacctctcattttcctcattttgggcttctgcccctatatctctgatataagcatcccattccttatttttgacttcgattctttctaatagcccagtaaggagcactctttcttgtcttaatttatcaaatccctcctctgttctctcttgggcttctataatcggatgaacgatttccattctgtttattaatttttcaaccattgttgccaaagcagttcggattggctctgacatttgtaccaataatggaaatttcaaatgttaatatacgaatattagtattcataatttaattagttattgcgccgtttttcacctttggtcgttgcaccgaggggtcgttcttttaatatgatcagagggatcaggaagaccttccgtagtaaataagcataggggcacctattcttttttatataatacacagataaatttacagatctatttcaaatatatttaaattgtgtatcaatatcaaaattggaaatatttagaaggtaaggcaatctctcgatatataagatttgtccttagttagataaaggtcgaatagtcatcattatcattcttttcctcatctctttaatcgatgggcgaggactacccatgggagaagggagtgggaaacatcatttcggaaaattaaatttttagtagtataatttactctattaggttcagaatacaataaaaatagcatgcgcggagcgaaaaatggggt

SEQ ID NO: 36979 - DNA, 698 bp, Heterodera glycines
  misc_feature (647)..(647): n is a, c, g, or t
  misc_feature (652)..(652): n is a, c, g, or t
ctgccgactttccgcgtcgatgagtgcacgcggacgacgctcgccgctttcatcggactgtgacgaggagcggtcgctgagcggctcgccgagcacacgagcctgctgcggatgattgtggcgatttggagcgagatcaccggcagaatcggaactgagcgacgactcacgaccatccgaatcggaaaattaaaatggcaattaattaaaacgcaaaaaaaaagggaaaagcattaaaagcattgtcaaaacttctaaaataaataaaaacattaatagacaacatatttgttgcttatttatttatttttcaccttcctggcgaatattttgctcgtgcattcagttgatttaagaattgtttaaaaaatatgctttttgtttctcttgatttccaatgccaattaatttaatttccaaatgctttgtccgcatttgcttccgttggatctatcgtcctcctcctcctcctcctcccattgtgccagtcgcttttgtgttagtgtgccattatttttcagagtcgccatagataccgaatttattttattttctcgcggcattttgggaaatgccaattagggcttcgtttatttgcacaaacaaaagcgcggaatcggttaaatgaataaatgatacattaacanaattngcgccagccatcggaaaatgtgaattgaatttacaaacgaactatc

SEQ ID NO: 36980 - DNA, 1486 bp, Heterodera glycines
  misc_feature (48)..(49): n is a, c, g, or t
  misc_feature (63)..(63): n is a, c, g, or t
cggaagttcatttagggcacatctacaaatgagcagattttgattacnngaattaactttccnactcactttcctccatccagactggcttcaaccattgttcaaagacacctcgtgaattgggcaaaattcgatggcgttatatgcgccgcatcacgggccaaaaacgtttcacagacttttagaaaagcggctggatcgtgtcgggataaattgaatgccagtacgatagtgccacgtttgaaaaccgaagaacagtttttgggaaggggcggtgggggcaactgaaagggatagccaacatatggtaagcatcaaccagccgaacagttgtttttcaactaataatagcgcctgaaacacacctcgaccatttctgccccgtcgattcgtcgcggtaagcggccgcgccgacagattccaaaagtatgaaaaacatttcccaatgttcgctcgcgtgtaaattggcagcatttgcgcggaggagctgatggagaccgaaagcaatttgacgggagaacagaaacaattcgggtggtcgaagtgccaacagttcacagcccatgaaatggagcacttcgtcggcacaattgctggcgcggtcctggacagtctgctgattggaagccagtgaatctgaactaaaaatccaatttataaacaaaaaattaacgtttcaatttgtttattatcgatgccctgcctttgttcgtcacgtcgccccgttgttgcttgtgctgtttgtcgtcgtccattgggtccaccacaatcaccacgcatttgttttgtccggcaatgatttgctgcgattgcttttgtcttgccaaattcggtgctatcaccgcttccgaagtttgtttccccttttcaattggagttggtgtgaaatgttgtcctaaacggaagagattccgattggaaattctgacaagtggacacaaaggaacactccatcgcctgttgttcgtgagtgcctacggcaatattgcaggaaaatggcacttgataatgactctccagaatgatacttatacgttaatgacgaaacgctaatggcaacaaataattccctataaattgggagcagtaaatggccatcaaacgtcgctttggagaactgaagaaatcgataactattatgtgtataagacaattgtttttacacgtgatggaatggatggattgaatacaccaatcggagagtgctctaattgcttttataaattaggcgaatgtcaatgcgtacaaattagtctgatttggacccccgacaagacccaactttgctcttttgtttggctgccacaatgctctggtgaatatgcaagtctaatatggacgacggaaagtggtgatttttgcattgagatttgaaaacacctcgtcccattagcagccccggtgctattccgagtcgggccaacttaattgtgtcggaccaagcgcatgccgtacctgtttccgacatccaagaaatggtcgagaa

SEQ ID NO: 36981 - DNA, 444 bp, Heterodera glycines
atttagggaacactcagtttcgaagcgcatcccttttggacccgaagtaagcgaaaaagcgaacaattggggagcataaaaattcacaattcccaggctttgactacagcacaatgcgggaaaagacacccgaactgtacgaacatttggcacagtccgccctcgtcattttcaagggggacatgaactatcggaagttggtcggcgacagggcgtggccccaccaaacgcctttttcggttgctctttcttccatgtactcaaaatcatttcccccttctttgctccctttcaggaagctctttgcggcttttgcccaaccactcttttggcacttcgaacattaaaagcggaaaccgtcgccggtgttccgctcgaatcgctgcgcaaaaaaaaagaaaagttcggagagaaggacctcagctggatgagctctagcgaata

SEQ ID NO: 36982 - DNA, 1603 bp, Heterodera glycines
ttgagtctaaatttttacaaaatttttagttacacttttttgtaaaatttttgctagattttttaattacatagattgaaagagaatacatagagccatcgaccaataacaagattgattaatttaactaagttaaagctaaattatgagtcattctttagcaaataaatataaaataataattaaatttaaatatttcaatcattgatactttttggctcggctcagcacgattttgaccactttttgtacatattttttggcagccatagaaataaataatggaacataaaaaggggaaaaatatttggcgttttattttttatgttccagccttaactcccgaaagatttttaaaaaatatattacaaaatgccagacataaaaaagcaaagcaaaacgtttgaaatttagtggcctaaaatgaaaagctattcgaaaaagtaacaaaatgaattcaaatcattattgagaaaataatttaaaaaaccaaacttgtaatgaaaataaaataaatattggagatgattttttgagaaaattttcatttattaaggggtgtattttcagaaattttcgggccgattcttagggaaggtatttttggtttttattgcatttttgttaacaaatttcgacaaaacgccaataggcaaaaataggttctttcaaaaattctttaggcttttaggtctaaaaataaaagcttaggaaatagacactaataactcgaaaggtagctttaggctttatgtcttaaaaatccccaaaaataggctctaagaaatggaaaatgcgattttaatctccataatcttttaatcctcatttaattcttcttcaaattgtttcttccatttgaaaatggtccgttgattaattttcaatatttttgaaattttctcgtcactcatttttggattttctcctttcatttgccaatacattttcattttttccattttttctttctccgatattctttttccactcaatccaaattgtttcttccattgtccaattactccttggccaactccaattttcttcccaattacggcataatttctcttccattcttttgtcgaatattttcttcctttttgtttatattcatttctcattgcattaaatttttgcacaatttcaattttttgtacatccgtttttgatttgtggcatttatatttttgaagatttaattctttgatccatttgtaaatgtattttagatttgtgcccaatgttttcgctattttcaattcaattttattccattcttttgttgaatattttcttcctttttgtttgatcctttctttaatttgatagtatttttgaataatttctctctttttctgttcattttctttttcttcccatttttctccaaatatttcgtcaaatgttttttgttccaattttttcttttccgctacaatttcaagttgagcaattaaaaaggcaattaaaattgaaaataggcataatttcattgttgacaatttttctttttcttaaaaattaaatttataatttattcgatatgaaaaaaaggaataataaatataaaatatttctcaaaaatgaattttctcttcct

SEQ ID NO: 36983 - DNA, 820 bp, Heterodera glycines
gattttaacgcgtatttttgaaaaaaaattcaacttttttgttcgaattcgggccctgggttcggaattgggaaatccaagttccagattcgtaatcagcgccctcgaaaaccccaagaaactaattatgagcacaaaataaataagttaaattagaaacccccattcttcaagattgcccaaagactcccttaattctaatcgtctgcctaatttcagcccagaatttgctcaagacttcgattctgatgaggacgcacaacaagcggaagaagaagtggagacggacctcagacagcacagagaagagaaaagagaacgcgaacgacgtgagaaggacgaacacagacacagcagaaaggatgggaaaaggtaaacagcgaatgaaaacatttaaacatttccaattaaaacaaaggcatcgcgaaagacgtgaccagcagctggacgagttcaaaagggagctgaaggaggaagaggcattggcacttggggaggtggaggaggaagacgaacaaacgcgggaggagcggcaccaacgggcgatgttaaggcacagacggacggagcgggaggaagcgccgttggaacaggaggacttggaggaggaggctgacgaggcgagtcaattgaaatgtcatttcgatccaccgatatactcgttccgatttcagaaactttattctttcaaaccatttacatttactgatttaggatgaacggcagcggaggagggaattgctgaagcgaattcgccaaagacaagagggagaaggtgggaaaaatgaaaaatttatgaatttcataaatttcattttgc

SEQ ID NO: 36984 - DNA, 531 bp, Heterodera glycines
taatacaggtaaaaaatactgactaattctacagtagactattacagtataattcaggaagaagggcatttgaaggtccgaacctaaccaaaaaatatttacaaaaaaaactttcgacaactattgatatcgaaaaatattttaaaattttagcgaaattattaaaaaaaatggaaaaactttcaaaaaaaagcaatttaatcatgaagcttatcattaatgtttaccatgcttatagatgagatcaacgcgttacatgagatgatgatggcactggaagctgactttgaagaagcggaacgtgaagccaaaacccatccggacatcaatgggggcgatctggtgcacaacatcatctttcctgagccggacggcatggcatttgacgagtgtcaaaatggcactgccgctgatcagactgagaaggcggcggaaaacggagttgatcaggaagatgaagccgacgaagctgatcagttgaagaacaagctgaaacagaatttggagctgtttggagggccaaaggaaagg

SEQ ID NO: 36985 - DNA, 710 bp, Heterodera glycines
ctgttgtatcctagggagaagaaaggggtaggttatgcaccccaccacatcccaaaattctgacgttggtaggtaatggaattttggcgacaccaaccttctccagcaagtggtggtggtgattgtgttgcttgtactgctcgtagttgatgtgcctggtcttcaactgccgacgctgcttctgttgtcgttcccacagtgtccaccatcgccacttccgacgacgctgttgacggtgcagcggatgacgtcattgtcgtcgacgatgccgttgcccggcgtcgttccctcgtgccgctgcaactgttcctgctgttcgcgtcctcctccggaatgctgggcagcgggccggccggctcagcactgcccatgccggcgtccgaccgcttgcgcggtgtccgctggccgacggttggtgacgacgcggaggaggaagaggaggactgaccagcagaattggtgccatcgccgccgccggcagcagtgccacaatttgcatcaccgccttaaaaattaatgatgcaaaaaactcatgggttcatggcaaaagcatattcaacttggaggaatggcttataaaaattttaaagcgctagatttatattaattccacgcggatctttttgggggtgcacttcatttccctcttccccgccgttttccattttttactaagaaatttcctaagaatttttttacgaaaaatttgt

SEQ ID NO: 36986 - DNA, 839 bp, Heterodera glycines
  misc_feature (634)..(635): n is a, c, g, or t
tggttggtaagggaagaaggggagggggggcaaaaatgggccaaaatgggaggggctgtgaatctaagacaaaaacgggaaatttttgctataaaaatgagacaaattaatgctttccgtcgaaagagggtggcacaattggagagcaaaacgaggaaatgcatttttcggttcagagaaacgtcgaacggactacaaccggcacggaatgtgccggccagcagaggcggcgttcgcctcggcacaccgacggcggacagcgccggccgattcccactacgcccaccaccagtcccaccctttccatgctcatttccgttcccctttcggtcggtcactttccccgtccgttcatccgcttcttctctctccccgcttttctcagatattttccgtgaatttttcggcgaccctttgtcatcgtccgactttcatcgttcgccgtttttcgcttttcccgccaacggcggaatgaaacgtaagttgagaagaaaggacggggaaaaagaaggaaaccaaattggacagagaggagacggcatacgacaaatctattcggagacggggcatttggagcgcattttgcgggaaaagacgagaacaattggtgggcaattgggaggaggggaagggnnggggggggtaaagcaatttaataccggagagatgggggggggagactcaattactcaaacattaagaagtaagtttactaaagtgaatgaactttgtccatttagcgaattctccacggtgattcggttcagcacgagctcaaaggacccgggaaaaaagatcaaaaagacaatcacacaaactgcaagtttgcaacattacag

SEQ ID NO: 36987 - DNA, 962 bp, Heterodera glycines
aaatatgtacaaaaaaccccaaatatgtaaataaaattttttttaatggtattttttgggaaagaaaatccccgtaaaatatgaaatagccacaaaatgacataaaaattactttttttggtatttttaggcaacattttcaaacttattttttctttataaattttcaaaatatgtaaaaaaatgaaaatatatatgaaaaaaatccaaaatatgtacaaatatgtaagaaaatcccgaaatatgtaaaaatatgtaaatattgtcccaggtcccggtcccgtggcactctattaaattctataactcaatcttttaagcttttttcgtcaattttgacatgagttcagaatcggacgaacagagtgccgatgttaacggactctgttcgcaatcgcttcgatcagatgaaaaagtgtgtcccgacccggacacaattaaaatgtttattggccaaattccgaaggtccgacgaaatttatgaaatgtttaaataataaatgcgttcttttgaggcgtgggacgagttgcaactgaaggaatactttgaggagttcggtccgatttatcagctgagtgtgctgcgggacaaagagacggcctccagccgtggtgactcacccccccccccttaattaattaattataataatcaccccaattaattcattttggagccaatttccaatttaggctgttgcttcgtcacttattatcaccggaaggatgcgatcagtgcccaaaatgagcttcacaatgtgcgcactttccccggactcagtcacccgattcaaatgaaaccggcggatgtcgaaaacaaaaacggtaaggaaaaggcaaacttcacgaaattagtgacaattaatttaccagtgacagttccgtaaccagaaaatttcaaagggggaaatccaaagacttctgttcttcgaaccaaatttttttgtcatttttcaaaactc

SEQ ID NO: 36988 - DNA, 827 bp, Heterodera glycines
tgtaaaagtcaactaaattagacattcttggtgtcttatgtgatagccctaacatttctctattatatcacctaaatttcaaaaaatttggtcaaggttgagcaaagttatagccaaaagtacacatgtggccaggttttcgaatatttttggtcataatttttttgaagcctaacaaaattttttgaaattttgcaggctaatagaggacacatagggctatcgaatgatagcaagattattttaatttgttcattctaagaaagttttgatcagaatataacggctcagcaccgagggaagtgcgcaacttccgctcggttggcgagttcgaaattgaaatgcttctgtgattacggaaaaagagagttaaattggaatggtttattttgaattttaatatttaaagttaattcttattatgaaagcaacaattttttaaatcaactttcaaacactaaaaaagaatgataaaaaaggaacgaccgcggtaacgaatgaatgctcaaaaaaaaatttttttttttttttatatcataccaaggtaataaagcacgcaaagtataaatgtaatttaataaaaactgaagttggatgaacggaaaattaatttaatcaaaatgagttaataaatttatttatgaaattgaacactgacaaattggaaatcaaaaatgtcattttttgccgacgaaggcaaattttgccattttcggttgcgcaaaatggaaaaatgaatttggcgtcatgtacattaattaaatgaaataaatgtttgatttttacccaaagatgaaataatttaataaataattaatacacaatta

SEQ ID NO: 36989 - DNA, 1289 bp, Heterodera glycines
  misc_feature (17)..(17): n is a, c, g, or t
  misc_feature (91)..(91): n is a, c, g, or t
  misc_feature (124)..(124): n is a, c, g, or t
  misc_feature (1209)..(1209): n is a, c, g, or t
  misc_feature (1240)..(1240): n is a, c, g, or t
gtcagacgatcgattgncacgtcagaatcgcttcggacttccaccagagtttcctctggcttcatcctgctcaggaatagttcaccatctntcgggtctcagcgcatacgctctgtctccgccncatcgcatgcgatcgagacgggactatgttgcgccccaacaccgcagtgccagggatcacacatcagctccgtaagaagccttcactttcattgcgcctttgggttttgaacacccaatgacttgcgcatacgctaaactccttggtccgtgtttcaagacgggtcgaacagatgaccggcttttacaccgagaacgcacaactgagagcccgagctggaccgaactggttgctggtacgtgtcgcacgcgaccgccaccgacccccagctcgagtcaacacggacccgaaaccattgcacaattcacccagagtaaacagcactcccccgatccgggtaccagaccccgaaaggctggcctcaagaccgagctcacgcagctactccgagcatctcagcgcactccgcctgcaaatgccccattcgccactgaacagaaagaaggacagcaaaccccagtctggaggctagcagcccaacgtacagcaacaaacgggtgaatgcagaccagatacgccagctctgtccgtttccacctcatcggtttcacgtcctctttaactctctcttcaaagtgctttgcaactttccctcacggtacttgttcgctatcggactcgtggccgtatttagtcttagatgaagtttaccacctgatttgggctgcgatcccaaacaacccgactccaagacacgtaaagatgggtaggcaccgccagttggacaggtcttgcaccttctctggagccccggtcaagggaaacttgaacaagcgggccaacccatgctcacggtctatacgctacacctcgcaaccccagaggagctgcgattcagcgctggactcttcccagttcactcgccgttactacgggaatcctcgttagtttcttttcctccgcttactgatatgcttaagttcagcgggtgttcacgtctgagttcaggtcgaaaaatcaaagcaggaatgccagtaatccaggcactccgccacagcatgcgaagcattggtgcgcccgagttacggtccgtaaaacgcgaattagaaccacaagttcgcgcctgcacaccaaaaccccacagncgagccgagcaagtaacgtaagaacacgtancagtacatgatcccacgaaagcacgcacaagcagtgcattttatggtaa

SEQ ID NO: 36990 - DNA, 1688 bp, Heterodera glycines
  misc_feature (38)..(38): n is a, c, g, or t
  misc_feature (71)..(71): n is a, c, g, or t
  misc_feature (78)..(78): n is a, c, g, or t
tgacgagctctgattaattaatatctctttttatattnaagattaataaatatatacaaatcaatttcganttgtaanaattaatttgttgtatatttattagattcacctggttccttacgtatcacatccttcagttgtgttttgttggcaatttattattttttatatagtttaggatttattttaattttatgttttttatttaatttcatgacttgagatccctctttatgccaaagcattgaaatgattttaattagcaattatgctaacaaaatgatgaaatttttttgtgaaattcacattttttgaccagttttttttaatcaaattttcgccaaaaagttttgttccagaacagtgatagtttttgaataattttcttttaaatttgggggggggcaaaaaaacgaagaaattttcaattccaaaatacaaaaatttgagatacaaaaaatttttttggggggggagggcttatattttaggaaatacggtaatttcttattattacgagatctaaatggaaaaattacaacaaaatttattaattttcataacggtggtgcctatcaccatggcggacctgaaattcaattagatttttagaatttgagaaaagcaattttaaaaaatctgattttcttggtcccccatccaaaatttattcatgttacgggaatcaaaagaattgtcggtaatatataatttcaataaaattgtaaaaattcaaataacaatttattttttctatatcatttgatacttaattatagacatattttaatctgataaaagaatagaaattttcgattaggtatggtaaaaaatcctcaaatatatctaaaaaatgtgtaagaaaaaaatacaaaacatgtaccaactatgtacaaaaaaccccaaaatttgtaaaaatatgtaaataaacctacttttgttagcaatacaaaataaagagttttcctacaattcatcagataataaaaataaaatgtttaaaccttttaaattaataaacattgacatagaattatcagtcgccaaatgtcttacaataatttgaaataggtttacttaaattgatttcgaaaatttattattaaattcaaaataaaaaattaataacaaaagaatttcttttgtaaaatccttcgtaatctctatttaaaaaattaagcggatttaaaaactgaagaaattcaatttgtgcaaatcaaataattatttatataaatttataaaaaggattaaataaattaatacattaattcaaaaataattatattcataaaattaaattttaaaattacttttgaagaaaataagattttttaggtaaactacaaaaaagtaatattgaataaaataccaatatagaataatttttattgaatttataaatagtttagttattaataaacaataaaatttttcaagtagatccaaaattctcaattaaaatttatttactagcaaatttctttatttataattattaaataaatattatttcactttatttcacaaaaaaggaggactgtgatactgaagttgaaattaatttaacaaattaaactaattaaaatgcccaaaatacattcttatcaattaatataaataaaagatttaaaaaattgcaaaaaaatatattggtatgtataaaaatacaaaattttctcaaaaat

SEQ ID NO: 36991 - DNA, 790 bp, Heterodera glycines
tccaaaatatcttaaaaaattaataataaaataaattacatcttaataattcatttccttgatttataaattattgacacccgaacaacctgaacttcaggttaaatatacaatttatgaaaattaattattataagtaatttataaaaaacaacattatttaaaatttttaaagataattaacaaaaagaaaataattattactattagtggaattagaaaaaagaaatgaatattaattattaaatttaatcagtaatattaatagaaccccttaggtagaaaataaaatttttacttttttctgaaattattttaatttagaactaatataaataaatgttttatttctaacagtcgtctaagaatttatagatatgtatacaaaattgctatttaaataaaaccttaatggcagaaaaattaaacaaaataatttatttatattacaattgtgtaagaataattttatacttaatatattcaaaaagcataaaaattcaatggataatctaaacttaattaagaaatggtgaaaacaatatttaggaactcaaaagataaaaaatatagtatttttaagaataaaaaatgcagaaatgtgtttaagaattgaaaatttttctcaaaaagtttatttttttttgtgttttgcagcctaaaaattcttaataaaaaaaatttaatgactttttcgggattttataacttttcatgccttttttcaatattttggtgcctattttagtgcctttttcgcgctttttggtgcctttctttgcgaactcta

SEQ ID NO: 36992 - DNA, 902 bp, Heterodera glycines
  misc_feature (20)..(20): n is a, c, g, or t
atcatgaaatttgcaaaganaatgttaatgattcccgaggcggaatatttggctctacggagtgcgatgaatagtggtgattatctccaaaatgaaaaagcgagtttagacgcaaaaatttctcagaatttacaagaccccgacataagcgaggacctcaaggcgaagagacatgattggctctataaagaaagacgtacggtaaaggggatacttgaaaatagaccacagaaggtagtgattgagaaacatgtaccaggtccaaatgttgcaccatatctgggcctcaataaccaatccaaaccacaggagaccgaagaaccacggaaaataattattcctaggaaaagacttgaagagcaaactcctgatcctgaatcagataatgatacacttgaggagttaactccggagccccaaacaacatccacactcaaaacacacattccgatcaaaactattatacacccgacccttttaaacggtctttttaggtacgtgaaggaaaacaaagatttatttaaaattacggcggccggaaaggtacagtcgaacatgaatttgccgattgaaaacagtaattatagagatgttttgttgtatctcgcagggaagaaagatgaaacgccgcgcggtgcaaaatttctcaaagatcggttactgaaggatccaacagtaaaagacatggttgataaatcaaaggtcatgtggggacgtggaaggaaaaaggcaataaaatctataaaaacacccggcatagtgcgagagaagaaacccttcaaaccactaatatgggcaagactgtagagaaaattttatcaaaaatttattttaatttaaaatctgcggcaagttttgtgaaaattcaaaaaattttaaatgatgccaaaaagattgacccg

SEQ ID NO: 36993 - DNA, 474 bp, Heterodera glycines
  misc_feature (288)..(288): n is a, c, g, or t
ttttttttttttttttttttttttttgctcgccccccccccccccccccccacccccacaatataatttttttttttttttttttattaaaaaaaaaaaaaaaaaaaaaaaaaaaaaaaaaaaattttttttttttttttttttttttcccccccccccccccccgggggggggggagaagtatttttttttaaaaaaaaaaaaaaaaatatattttgggtggggggggggggcgggccctttttttttttttttttttttttttccccccccccgtttgtggggggngggggagggggggggggggcctcctcctttctcccctcccccccccccccccacccccccctttttttttatttttttttttttttgtttttgtgtcggcgcgggggggaggggggggggggtggcccccccccccccccccccccccaaaaaaaaaaaaaaattattatttttttttttcttttt

SEQ ID NO: 36994 - DNA, 1170 bp, Heterodera glycines
ttccttaatattttcctgcaccgaaggtactcactcggccgcttcgcggcctcgtggtgggccttcccccccgcccttcagagcacgacaaatatttcaacaaaaattttgaaaaattgactagagcaatcgaacgctaacggacgacctaatggaaaaaaatccccgaaggagagaatttaattaaatccattccttcgggggaccgtgccgggtgccgcggggtaagcagtgctggttcgtttcatcacggcaccgaaccttttggctagtcagcaatcgttgcttaacttgccagatcggacgggtgcgcatgattccactgttccaagcaccccaccaaaagcaaaacgatataaccaaaatataaggaaaaatttttaaaaaaatttttctccatctccctttttgatagaaaaagcatcagagtgcctaaactaacatgtaaataaaatttggtgcgctttagagcactttctgaaaaaatatttatgaaataaaaaaatcgatttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggctcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgatttttt

SEQ ID NO: 36995 - DNA, 1531 bp, Heterodera glycines
  misc_feature (779)..(779): n is a, c, g, or t
  misc_feature (843)..(843): n is a, c, g, or t
tcattcatttgcctctttctcctaattttccactttaatctgctccttcacttcaacaataagtgagctgccccatatttcgctgtacaaaatgccaaatttcctttaactccgtaattttttccctcctttaattacttctattaatccttcttttagcaaattcttggcacattaatctttaatcctccaaagcgatgcttttcttctgttggcttttgccattccaatagcgatggctccaactttttcgtcccatttggccattcaaattgaaaaaccttcgaaaatgctcccctctcccagcgggagggccccaattgtgatcagcgaattggacttcgagacggagtcgggcgaggagagagacgacttggaagagctgaacgacttcacctctctgctgatgccagccgcgagaaaaagtgcggcccgacgcctcggggcactgaacaggcgagttttggcattttgccatttgaccggtgcggcggtgcctttgagttggccttttattgcggaccgatggtctctttcagtccgattggcaggagagtccaagacggccaaaggcagcgccattctcagcgcaacagtgtgccggccagcaaatttccggtgattgacgaggacctgctgatgttggcgacgcggaagatcccagcggacggctgttcggcaattccgccgccaaatttgtgccgacttattacaaatgtgtccgaggcacggtggacaaacaaaagcccgttgaacatgcaaaggcaatgctggacacngagcacagaaggaacgaccgaaatccgtgggacattgccaattccgcgagggacaccccacggnacaagcccaagaagcgcaaaatattctgagaaaaaagcgaccggacttctgcagggcgaataatggccaaggcaatggcacaaataagcaaacgaagcgcaacgacgaggcggcactgagacggatgtcggcactgtccgttgtgtccagctacacagcgaacatggaggaagcagcgaactgcgactgcacttcgctcgcaatggcagctttccgtcccaattgggtggcggcgatgagacgcaaaaagtggcagcagacgaagcagaaaacgcgagagcggcaggccgacgacgcgtaccgcaaagcgtcgcccccacccattccaacgcgcgactcgtgcgccaacgactcgggcatctcctcctcctcctgctgttcctccgagtcgagtcggtccgcctctttggccgataccgtgcagcatcagtgtcgcctgctgaacccaccaaatccccaaactccgagctcaaactgttcacgttgtgggcttagcatgaatttgccgccgaaaagtgtgccaaatgaaaaaaagcgaattgcgaatcaaaatttgcaacaacggcggaggcattggctggcctatttactggggaatatgttgagaatgattgagaaggagaagccggacgaagggccgcggaggagaggggtgggaggcggggggacgacggtggattgaaactga

SEQ ID NO: 36996 - DNA, 497 bp, Heterodera glycines
  misc_feature (488)..(488): n is a, c, g, or t
tttgattttacattttttagggttcggataagtccgatcggctggttgatcacttcattcattggccctccttttgtcccctccccgacccttttacgagactcccgatttcttttttatttttttgtatttttttaaggttagtaccaaccagtatgatcggcattccgtcacaagccacgcttatccaaaaaataaaaattctcaaaaacattaaaattccgaggcttactgctgagcaggctacgattttaagaagcaagaagctaggtttaagataaagttatatcaaagtctgctgaataatttctttacaaaatatttacccatttaatttcaaatccacacaaaactcaccaaaaagttactcacttaaatttatgccatttcaatgtatcccaaacgcacacttacacaaattttttttttaattctcggaaatatttaaaaaattccgaggcctactgctctgaggagggggggggggnggagggggg

SEQ ID NO: 36997 - DNA, 756 bp, Heterodera glycines
tcagaaggaaactcaaaggatcgaaatgagtctgatcagaaggaaagacaaaggatcgaaatgagtctgatcagaaggaaagacaaaggatcgaaatgagtctgatcagaaggaaagacaaaggatcgaaatgagtctgatcagatcagtccgtatctttcaatttcccaagggaatgcccacctccgtcgatgtcctcaaccgttagagcctctgcaaattgctgcttccagctgtgggtgccaacaagaaagccgacattggcattggtcaccattttgtcgatgaaattcttgaactccttgtcctcagtgatcaaaattttgcagcgcgaatgttcccctgaacaatggccttttgtggtgccattcgtccgtcactgacccaaaatcggtcttccgtcgggctgtccctccttgggccccacttggccctttccatccctccattccggcgtgcccatctccacaaagaattcctccgacttttcatattcgtcgtcattaataatttcgatgtgaatttcggctctgcaataattccttttgcatttaaattgtccaaatgtgattcattcacactttgtctgctcattcagaaacagcaattctttctcgtgaaccctaaagtcttttcccgcttttgcgcttccttcggtcactgtgaagggaattcgaacggagccgcgtgccccgcggtgccgtcggacttcgagaatgaattggccttggggttccgggacacagaatacttccg

SEQ ID NO: 36998 - DNA, 1188 bp, Heterodera glycines
  misc_feature (1144)..(1144): n is a, c, g, or t
  misc_feature (1179)..(1179): n is a, c, g, or t
cattttgtattaaatgcttcttaagtgtggttaattgtaagtcgaaaataggtattgtaataagccgggttcagaagacccgttgaattttcttttattgttgttgtttttgttcaggttgcactcgaggcggccaaagtgttggacgacaagaccatttgggtggcgttgggcgaggccgcgctgctgcagggtaaccaccaaatcgtggagatggcctatcagcgaaccaaggactttgagcggctggccttcctctacctgatcacggggaaccgggaaaaattgcagaaaatgttgaaaatcgctcaaatacgcaaggatgtgcacggacagttccaatgcgctttgatgctcggcgacgcgcaagagcgcaccaaaggtactgctcgaacactatgtggttgtatttatgagtataggtgaaatgtagggggatgttggcccgactgcataccaacgaagatcaggagggttcgaaagacctccatttcatcccagtcattacaaagttactccattttcgcccccccccccctcatttttatttcactcctattttggaaaaaatttaccacttggagtgttcagactctacgccacccctccgcccccccgtgaccgtcccaggggtatagttagtcacaaatacaaaaaataatttaatctcgctgaaaatttttctttacggaagtctgtaattgactgtaaaaaatttgcagtgctcaaagaacttggccaacttccgctcgcctatttgtcctccgtgactcattcgcttgacgaggatgcggaacagttgcgtgccgagttggaacagcgtcaaattgcggtgccggaaacgaacacaagcgcaactccactgctgccgatgacacctctcaatccgctggtggacaattggccccagctgaccgtctccaccgggccctttgatgcacagcaactgttggccgcgacggcggcctccagcggtggcggcactctgtccaccgcaattggaaaatcgagtgagcgaattttaaagcgtaaaaaattgcttttcttaagaaaacgaatcagaataaaatataaccgggttaaaatggcattaggtcaacattaaatttgaacaaatgctctcgtctttattgttttttcaaanaataatttaatttaccgcccatttttgcccaaaantgtagggcg

SEQ ID NO: 36999 - DNA, 1082 bp, Heterodera glycines
  misc_feature (26)..(27): n is a, c, g, or t
  misc_feature (36)..(36): n is a, c, g, or t
agtaaatttttaatttatacactganntcatagaanttggcagagcggagccaatttcagctgtcaaaatcagacgaaaatgtgggtgtggattgtgaaggcgaaatttcttctcaagttgagtcaaccattcggttgccaaatgcacatttttcagcagaatccatcttcctgatcggcttgtcgattgcaacgctttgtccgcttgttcaaatccttcggctgacccaagtgcaattgacaaaatgtccattttcagctcaaatgcaaggtcctccacgcgattagagacgtcatagcctgtcgctgaacacaacaaaacgggcactttgcattgaacctttaataagagatgttttataagcaagtggtatcttacattttgtctgacctcattcaaaattatttcacggaggttaaccactttgtcctgttgcatgaattccgaaccaaacgccttcgtcataagcatgtgtgccgaggaaagcacctgctcaggaggaagggctgtgagctgctccaattcctgttcgtaggcattctctgcaccgcaacagcgagaatagatccggagcaaaagagaagcgagcagaatttgatcattgtgaagcattcctatggaaacacgagagtacatcaccttaagcaagaggaactattgtagcagtaaagtaaaaaaagaccgaaaagagattttgaagaatgattgacaggcgagcatcgtagtctttcacattcccaagttgtggtgacttgagaacagttgtgaaaatgtccagcaaaaagtccagagaataattgtagagcaaatgaatctcgtccaaacgatgcaacatgagatagatgagtgaacacgcattagccaacttgtagtatttttgtgagacaatttcgacctatgggaaattggcggtagaatttagaagaatcgattcgaaacgatcattaaaaaacgtctatacctctttcatgacttggtcagttttcgcagatttcttgctacttctgtgcttcatttctcagttttcccagcgtcgcgatcacggagtcatcgtccagtattttacccttggactcgttca

SEQ ID NO: 37000 - DNA, 797 bp, Heterodera glycines
  misc_feature (721)..(721): n is a, c, g, or t
tgtaacattaagaagaggcattcatgcttttgccagtctctgtttttagcattgactttttgaatctgagctcagatttttgtatcaaatacttggttttttgtaatactgcagaattgcgattccgactaaaattcaaaaatttatttttaaatttttcctggggtaacaaatgtgctgattacgaattaagcttccatttagcaaaatccaattttatttttaatttttatcatcaaatatgcacttgatctaatgtgaattttgaaaaaatttaaacagaaaaaaaaaatcaaaagattgaaaaattatagacaaagttaatggcatatatctaaattctactctcggataaattctttatatctttttttatttgttttagcaaaatccatccagtgataaatttgttcattagcttccaaattatttcacgccaaaatggccgaggaaatcggcaccacagaaattgccattgagcccctagtgacaacaactccaaaaacaacactaacaatgggtgcaaaactgaaaaaaccgttgctgaacaaactcaacaaaatggtaaaaaaaaattggttttacgaaaaaattaaaatggggttaaaatcaaaaaattggcatttttgaaattaccccaaaattcgaaggtattttaaaaaaaatttaaggatcctggcgaactgcgccatctcgtggccgacatgcagtcaaggcttgnccaggtggaggacacgaatgttgaccccccatgtaaggctcagcacaatgccgtagaggagcgtgatgtgagtggg

SEQ ID NO: 37001 - DNA, 683 bp, Heterodera glycines
ggggggggggggggggggggggggggaggggggggagaaaaaaaaaaaaaaaaaaaaatctttcccattgtgtgggttgttggcgggttccgcccccccccctcctcccctcccccccctcctttttttttttttttttttttttattaaaaaaataataaaaaaaaaaaaaaaaaggggggggggggtggtggtgttttttttttttttcttcccccccccaccccccccccccccccccccccccccttccttttttgtttgttttttgtttttttttttttttcttgtttcccccccccccccccacaacaaaaaaaaaaaaggggggggggggggggtgtgtttgtgttttttttttttttttttggggggggtgaataaaaaaaaaaaaaaacccctccccccccccccccccccccaaaaaaaaaaaaaaaaaaaaaaaaattttttttttttttttattttcacaaaaaaaagaaaaaaaaaagaagggggggggggggggggggttttctttttctctttttgctccacccgacacaagccgacaaaaaaaaaaaaaaaaagaaaaaacaaaaaaaacaaagggggaggggggggggggggggggggggggggaggaaaaaaaaaaaaaaaaaaaaaaaaaaacgccccccccctcttttttttttttttttttt

SEQ ID NO: 37002 - DNA, 728 bp, Heterodera glycines
  misc_feature (687)..(687): n is a, c, g, or t
acttacagatttgaaggtttcagacgcggtgtagaatcttaaaaaatgaatattatttaaatcttttataagatttacgagatacaaattaaggaaatagtaaagttcatgtgatcttgatagaaaaaagataatgaaaaggtggtttattgaaaaaaatggtgctaattcgagtgcaggatctataaataaattaatattattttaatcattaaaaatattttagttatataaatgataaatcgaaatttattaatgctctgataaaaaaatcatttgataatggattcaacagaaacggaaaaattagcactttgtggaaaatattttacttacagatttgaaggtttcagacgcggtgtagaatcttaaaaaattaatattatttaaatcttttataagatttacgcgatacaaattaaggaaattgtaaagttcatgtgatcttaatagaaaatggataaagaaaaggtggtttattgaaaaaaatggtgttaattcgagtgcaggatctataaataaattaatattattttaatcattaaaaatattttagttatataaatgataaatcgaaatttattaatgctctgataaaaaaatcatttgataatggattcaacagaaacggaaaaattagcactttgtggaaaatattttaattacagatttgaaggtttcagacgncgtgtagaatcttaaaaaattaatattatttaaatcttttt

SEQ ID NO: 37003 - DNA, 836 bp, Heterodera glycines
atgaggcgggggtctggggttcgaatccgcttggctgcggattattttttatgatgtttgatgaaaaatcatagataaaagtcaatgatttttaaaatctgagttcatattcgtgaccagcgtattttttaaccccaaattcattgctaaactttttttttaaataattcaaaaaaatcaattagttaacaaaaaaatcttggataaaaatcaatgattttcaaaatctgagctcagattcgtgatcagcgcattttttaagccttgaaaaaatatctgggaaatttttaacatttttcttagcgaatattgttttaataaatatcaacattcacgttgatatgtatttatttcacatagagtgccacgggaccgggccgggaattcccggtcatccgaggtcccggtcccgggttttgaaaagctcaggtcccggtcccggtagggcaaccgggaaccgggaaaaacaagcactggtaagaatggggtctgagtgaaaaattagtgaaaattggagtcaaagggaaaaataataattaatatattctttaaaagtgacactgcccaagtgtgcaaatggcctaatggctagtctccttgactttcccttcttctttcccctggttcaatccctctacagaaattaaattattttcaattttctttttgtatactcgtgggtttcctatagagaaaatatgattcctcatagtttttttttaaattgatacatattttatccttttttaaatgaaaatcctaccaattgagcttaataatcgcaaaaaccaaccctttttttgttgaaaatctgttaacaaattgcacccaaattt

SEQ ID NO: 37004 - DNA, 513 bp, Heterodera glycines
ctgactgacatatcacaacaaaagcattcatcaaggtaggcatttcctcccctacctggcatagttaacgcattcggtaaatcgatgagttaactgctgggtattgatgcatactgctcccgtcagcaagcacattgctcagagtctgctcggtaatgtgaggacgtggttttggcaactgcaatagaggcgttatcttcaaaagaatccgttttaaaagccatcgaagaatataaaaaaattggccgagatgaatttttaaaacaacatgaaataaaacgatttaaaaaatacacccttcattataatggcgagaagtacgacatccgaggcattgccgctagagcatacaatgaacagtatggctatccgtttaagggaatcaacgccgatagcggaacggaaaaagccatccaatttctcaaagatctcggttttgagatcgtcgaaacaccgcatccttttgactatttaaccgaaggtaaactgtatacacgcaaagcgcttatcgag

SEQ ID NO: 37005 - DNA, 930 bp, Heterodera glycines
ctctcgatgccaagctcatcgagaacgcctgagatggcagttcggtcctcagcgactcgctcggacggcttttgtttctgcgattcgggtagacccattacgacgacgcttcgccgacgctcatggtcttgaatgacctcttccatcattttatgttgtttgaaatgttggagttgatggtcttgttcggagatgacggcctgttgttgctggacctgctgtaaaagttagacacaaattttcaaaagttgtttggtgatggggtcgacactgttgttgtccatttgttgggaaattgccgcaagttggtcactaagagcggtatatgggtagtcagaggtggacttttttgatgcgttgtctgagagaggagaaagatgggaagaaggacactttccaaacatgacaaatgtgaattaatgacaaacatttttgtttaagccaaacgcatagattagtgccgttgaaagtgcaaccttttgacacttttgtccaactttttccagcaatttctgttcaaattaactgattaaataattaatgatgaaaaataataaaatatcatttatattgctaattattggtcttaccaaatgagcagctcgcctcgacacaagaatcaggaccccagcaaaaatccagctttctagggtcatatgggtataaatcttcgtaataggagagagtgtcatggctagggatgctagttttatcttaatccatatttttttcactagattcagcatagctcaattagtaggactcataaagtgcactaaagccgaatcttggtgattgttttttcgtctttgtagacatattagattaaaccctttttgtttcatgtagtaggaccacccattgatctcctcaggtggagatgattctgaaaaggatgttacgccgccaccacgaatgggccgggttcat

SEQ ID NO: 37006 - DNA, 299 bp, Heterodera glycines
attgccatgagtgcaacgaagctacccggtgtgaacacccgacgcgatccggccaacaccgatcacgaagatgcatcctccccctacccacttggatttatcgccacactgcatcgcattggcgcgggcgccgctgccgatgggcagccctggcccgagcgcaatctgagcctcgggcgcagcatgcagatggccgatgcggattgcgcgctgggtggcctgcgcgtggtggcggagctgatgctggcggcggagcgcacgcgacagaacggcaccgacgaagagtacgtgggggatcg

SEQ ID NO: 37007 - DNA, 833 bp, Heterodera glycines
ttatttgataaaaaaatcggctaagattctctgttgtcttagcttttgatcatactctcccccctccctcttaatcaactcttcactcctccagattccctgatcattctcggcccctcctcccccggcctttgatcaatcaatcccccctccggcttctatgatcattttcccccctcctccctcggcatctcttatcattctcgtcccctcctcccccggcctttgattatccatcccccctccggcttctctgatcatcttcccccctcctccctcggcatctcgtatcattctcgttccctcctcccccgggctttgattatccatcccccctccggcttctctgatcatcttaccgcccttcccccatcaatcacagagccacgctggccgtcacggcacgacttgtagttggaggacatgccaccagggtggtagaagatccgcccagcttctacacatgggtgaggattttgtttggagaatggtaaaatgcagagatgccatttaaaagtgcaaaattggtgaaagtgtcgcttaaatctcatgaaggaccgatcagtcgctgttcagattgcgatttatcattttgataattactaatcaattcatgattttcattcggcccagaatagtggtactcaaatattgtgtgccgcccaactgactgagactgttcagggagaaaccgatgcccgactgatggccaatggaagcggcgagcacagcgccgccgcatccgtccgccattgtgctgacgtccggcttcaagctggacaagcgtaatcggatgcaggactataaggggccaaaactaaaaatgtctgttg

SEQ ID NO: 37008 - DNA, 77 bp, Heterodera glycines
ctccgtcggcccgacaaccagtatgcgtatggaaagttttgaacgtgaatttattgagcagaccggcgtgaaactgg

SEQ ID NO: 37009 - DNA, 895 bp, Heterodera glycines
  misc_feature (48)..(48): n is a, c, g, or t
actagggcttccttttttagccacaaaatgtcgcgaaataggcattanataggcacaaaaatcctcaaatagacattaaaataggcaaataaatttttattaactatatttaggtagcaaaacacataaggcacaaaaaacttcaattttattaaaaaaatttttcaaataaggataaatttttaaacaaaaaattttttattaagaaaaaaaattaatttttgggattaatttttgagaaattttttccaattcttaggatgtattttatgaaattttttcggtccatttcttcggggtgtatttttcatttttaaatgcatttttgttaaggattttttcgaaaatcctgaaataggcacattaaaaaccccgaaattcttgcttatctacacttattaagtacgcaaaaattttagggatttgtttaaaaaaggaagccctactgatcactgattgactagcccttttctgaacattaatatcctctcgacagtgatctaatgatttattcaatcttctctgatcagtgatttatgcagatttttacataatatatgtgaaattttacaacgatagaagcatgtgactttcctagtattgtgatcctcaaatccgtgaagaagtatccaaatggaatgatttgctctggctgatcaaagtccggaaaaacaatgatcagtgtgcattttatgccaatcgagttccgtcagacccacctaattcttaaacaactttggtacttgtaggttttgctaccccccccccccataaaaatgtcatggccccgacaatggaaagcacttttctagggtagttttaggcgctgatcaagaatcagaagtcaaaactgcaaaaatctatgattttcatccatgtgattttgtcaatgatt

SEQ ID NO: 37010 - DNA, 656 bp, Heterodera glycines
cggcgacggaatgccgcgggggaaccgcgaaagtcgaaaagacaattggcacaatttcagtggcattttcggcactgaaaggacaattagtgagtttaaaatgtgacacgccggtcattaaaaaactgttaccgattcgtttttgccttttcagaaattccctcgtcttttccacttgcttcttttgtcccttccgccgttgtcgaactttgggttgatgttgtgttcaatgctgaagttcatacatgaaaagcggggggagggtcgacccccccccccccccccttcggccgcaaagtgccccaaaattggggaccccttcgcatctaggggggccggtgtaaaagggggggggaggtcgccgacgaacgagaaaagagggaaatttctgaaaatttttggctatttcttaacaaaattcattaaagattcttaaaagtttcacccggcggcgcatatcggcaccgcccccccccctaaaaaacctaatttttttcttataaaattagcccaaaatacacaccgttttcaatccagtgcccaaaagatttgcatgtgtgggcaagtggtttttggaaaatagtaaaaaaaaaaaccgatgaagggggggaaggttcgagccccttggggaacattaatatttttttttatttttg

SEQ ID NO: 37011 - DNA, 1116 bp, Heterodera glycines
  misc_feature (87)..(87): n is a, c, g, or t
aaaaaattcataactcccttcatattaggggtacaggtagaatttaatgatccaaaaaatccgtaatttttagctctacaaaaaagnttacttgcactatttatccatcacttcttcaaaaaaagttatcgcccgaaaagttgtttcgaatttcctgacgaaaggggagacccatttggttttcagatggacaaaatttttcttcaaaaatagcctgaaaatgatttttctgggctattttttggccactgatcatgaatataacatttattttgagtttcatatttttcttctggcgaaaaagtggtctgataactgttgcacctcttctaatcacttttgtacctcttctaatcactgctgtacctcttctaatcacttttgcacctcttctaatcactgttgtaccttttctaatcactgttgtacctcttctaatcactgttgtaccttttctaatcactgttgcacctcttctaatcactgttgtaccttttctaatcactgttgtacctcttctaatcactgttgtaccttttctaatcactgttgtacctcttctaatcactgttgtaccttttctaatcactgttgcacctcttctaatcactgttgtaccttttctaatcactgttgtacctcttctaatcacagttgtacctcatctaatcacgtaccttttctaatcactgttgcacctcttctaatcactgttgtaccttttctaatcactgttgcacctcttctaatcactgttgtaccttttctaatcactgttgtacctcttctaatcactgttgcacctcttctaatcactgttgtaccttttctaatcactgttgtacctcttctaatcactgttgcacctcttctaatcactgctttaccttttctaatcactgttgcacctcttctaatcactgttgtacattttctaatcactgttgtacctcttctaatcactatttcacctcttctaatcactgttgtaccttttctaatcactgttgcacctcttctattcactgttgtaccttttctaattcactgttgtacctcttctaatcaatggtgcacttcttctaatcattgttctaccttttctaatcactgttg

SEQ ID NO: 37012 - DNA, 946 bp, Heterodera glycines
tgcatttgaatcgattttgagcaataaatgtgaattttgttgaaaattgagtttttgactttttgttcgaatttgggttcggggttcgaaatgggtagaaatggatgtcggattcgtgatcagcgaccccgaaaacctatattttgactttttttacttagaaattaaaaaaaaattttatgggggacaactgaataagacgcgaaaatgtatatataaagaggggaattttcgtttacattcattcattcacattattttttataatgtaaccgtgtcgaccctcgtttgccactggacgtcaacactcagacgccgaaccgtgtcgaccctcgtttgccactggacgacaacactcagacgccgaaccgtgtcgaccctcgtttgccactggacgacaacactcagacgccgaaccgtgtcgaccctcgtttgccactggacgacaacactcagacgccgaaccgtgtcgaccctcgtttgccactggacgtcaacactcagacgccgaaccgtgtcgaccctcgtttgccactggacgacaacactcagacgccgaaccgtgtcgaccctcgtttgccactggacgacaacactcagacgccgaaccgtgtcgaccctcgtttgccactggacgacaacactcagacgccgaaccgtgtcgaccctcgtttgccactggacgacaacactcagacgccgaaccgtgtcgaccctcgtttgccactggacgtcaacactcagacgccgaaccgtgtcgaccctcgtttgccactggacgtcaacactcagacgccgaaccgtgtcgaccctcgtttgccactggacgacaacactcagacgccgaaccgtgtcgaccctcgtttgccactggacgtcaacactcagacgccgaaccgtgtcgaccctcgtttgccactggacgtcaacactcagacgccgaacc

SEQ ID NO: 37013 - DNA, 1600 bp, Heterodera glycines
  misc_feature (89)..(89): n is a, c, g, or t
  misc_feature (1459)..(1459): n is a, c, g, or t
  misc_feature (1537)..(1537): n is a, c, g, or t
  misc_feature (1575)..(1575): n is a, c, g, or t
attaggaaaaagatatgagggttcgaaatttgtttctcgaataactttttagttaaccctttttttgctttaaaaacccttacatttgnttcgtaatttttttctctatcggtgtgcaaaatttgaagaagatttaacatcagagaaaaaaggtaaacatcacgaagtgaattcggtttttctctattaacagagataaagaaatagtacgccaaaaagagagatgttttttttctctgcgctctctctttattggttcatctctcgttttttgaaacggtgtgaaaaggaaagaataacaaaatgtattttccaaagactgtgattaaatattgttttttcgactaataatacgtttatcaaagtgtaaaaggtaacaatttttccgtttctgtacacagtcccaggcacactgatctgaccaaccattaaaggctgttttgaaaggggtaaaaaaagtgagtgagtgatcagtgactgataaaccttgatcgatcactgatcaacccactgattcaatatatataccgtattgggtggaaggagttacggtggcttcgatgcaggtgccgggtttttgggcggctccgttccaatgaaaaattgacaattcttataaaaatatttattcggcaatgagaataaatagcataaaacgtacacatacataacagggtaaatataatacaattccaaattcagtacatggcatattaatacgaacaacgtccatttgtgtgagaagtacattcaacaataatatgccaaagagatacggacatacaaaaatgtacacatacataggatataatttgtccatttttatttgggattagtattatcgcgattgtctcttggggcagcattccttccgacttgctcattcatttttgattctcctcgtgataagtgcccgattcgtcggaatctgaaaaattcaattccatttatactcttttccccccagggcgctgatggcgcccggactgtttctgattcggagtcgaattcagcgccgtggcaccggattcaaaaagcagcaatattacaagatcatcatcatcttcaatgatgtcagcagccgacggcattggaaggagagcatttagtttggcaaaggtgccaaaattggcgtgtgtaggaaagaaacacaaagtgccatttcattttttaaatattttattcacaccattttcaaatttgtacattaaaaaacgaaataaatttaattatttttaacaaaaaaatgataatttaattacagcaattattaattcatattttatataaacacttcaaagtacagcttataaaaggaaagaataacaaaatgtgttttccaaagactgtgattaaatattgttttttcgactaataatacgtttatcaaagtgtaaaaacgtaacaaatttgccctttttgtatacagtccgggcaaactgatttggccaaccattanaggctgttttgaaagtgacaaaaaaggaggttatccagtgatcgctctgatcagagttcccaaggggctagacaccanagcgtcgacatctgaagcagcaacgagcacgaacatgncgctgatcacacctaacaaaatgca

SEQ ID NO: 37014 - DNA, 1112 bp, Heterodera glycines
  misc_feature (47)..(47): n is a, c, g, or t
  misc_feature (179)..(179): n is a, c, g, or t
  misc_feature (191)..(191): n is a, c, g, or t
ttcatgcaaaataataatctatagaaattctctaaaaaagtagttcntcgcagattcggggacgttttctataaagctagagacatatgcgctaaccataaaaaagatgaatcatttttgaaaaaatttatatagttcgactaaatttgcaaatcgatttatggtgtacaggatgttgntcgaaacatacntcgtcaggcctttaagatagacctgccattgctattcctgcaaatatgcagtctagtcagcccaatcgattgctattcgaatggtttggggtcgttggcccaaacaaaagttgtgctacttcttgcaaagaagacttagccaactgtaaacagcaagccatccaaatgcttcaatgtaaaaaaaaattacatttggatgcaacctttatttttcctcgcctctcttttcgaaaagaaaagctattagcaagcgtgtttggaccaattctaaaacaaatcggggtaattaatttaatctgactttataagataaatgggaatttaagcgaaggattcatgcaaaataataatctatagaaattctctaaaaagtagttcctcgcagattcggggaccgtttctataaagctagagacatatgcgctaaccataaaaaagatgaataagttgtgctacttcttgcaaagaagacttagccaactgtaaacagcaagccatccaaatgcttcaatgtaaaaaaaaattacatttggatgcaacctttatttttcctcgcctctcttttcgaaaagaaaagctattagcaagcgtgtttggaccaattctaaaacaaatcggggtaattaatttaatctgactttataagataaatgggaatttaagcgaaggattcatgcaaaataataatctatagaaattctctaaaaagtagttcctcgcagattcggggaccgtttctataaagttagagacatatgcgctatgcatgaaaaagatgaatcattttttgaaaagtttatatagttggactaaatctgcaaatcgatttatggtgtacaggatgtttgtcgacctataactagtcaggcctttaagatagtccttcctttgctattgcctgcaaatatgcagtttagtcag

SEQ ID NO: 37015 - DNA, 696 bp, Heterodera glycines
ttttaattttttatagttttaaatttgggatttttttgggctaccaaaatgtcatggaacctggctcttttattatcattcaaatcgccccaaattttttttgcagttgacataggccatattaagtatgatttccagaaaatctcgcatgaattctcatttttaaattttttatagaaaaatgtttggatttttttttggcttaccaaaacttcatcgaacctggctctttctattctcattcaaatcgccccaaattttttttacagcttaactaggccctattaagcttatttccagaaaatctcgcatgaattctcatttttaaattttttatagatttttaaatgtttggatttttttttggcttaccaaaacttcatcgaacctggctctttctattctcattcaaatcgccccaaattttttttacagcttaactaggccatattaagcttatttccagaaaatctcgcatgaattctcatttttaaattttttataaaaaatgtttggatttttttttggcttaccaaaacttcatcgaacctggctctttctattctcattcaaatcgccccaaattttttttacagcttaattaggccctattaagcttatttccagaaaatctcgcatgaattctcatttttaaattttttatagatttttaaatgtttggatatttttttggct

SEQ ID NO: 37016 - DNA, 853 bp, Heterodera glycines
  misc_feature (738)..(738): n is a, c, g, or t
  misc_feature (824)..(824): n is a, c, g, or t
  misc_feature (827)..(827): n is a, c, g, or t
aaaaaaaagtttggcacattgccttaaaaacaacaaaaattcttttaaaacaaatgtgctagcaaaaaacaaataaataaatttgttgattgtgagatttgaaagggagcttctctgaaaaaaagagaccaatttagcttctcaatttttaattttacttctaaatgtacttattttaaaattaattttttttcgccataatactatgatcataagcagggctggcagatgaaaattttcaaaaatgttcaaatgttatatttttgattgcacaagatcaatttgagcaatttttttttttttgaaataagcattttgtgaaaatctgagcacgaaaaatcgaagttgatttttttgcggcgcttttttcaaaaacttttggggaataaggggccggcggtgccgataggtgccgccgggaaaattttttgtaatttttaatgcgatttgttgagattggtccacaaaaatggccaaattttgtgattttcgagcaaatttttaagaaaacaaagtacttttaggggctggcggtgccgataggcgccgccaggggaaaaattgagaattttaaccatatttttagcagattttacagattttgggtaaaataattttaaagataacattaaaagacaatctaacaaacaaattcataaatcataaaaacttttctcagtgacgaaatgatagggagccgaaaactgaacctaactttccttctaagtaattactagnggctgggatttttatgtgctaaaaatcctgaaatatgtaataaaatatgtgctaaaaaatgctgaaatatgtgctataagcccaanaanatgactcattctttatcattttcgcc

SEQ ID NO: 37017 - DNA, 1335 bp, Heterodera glycines
caaaaggacacattgagcaccgctgacgagggacgccactgagcgatgtttttgatttcgccgtccttaacatttaaactattagtaaatgtaggtcatacgaacagtcattaaaccttaaaaatgctaatttctttggcggtggtgaagagcaccgcgccgcttttctcgtgcaatttgaagtcgtccactccgtccaccatttggccacgcattctttcgtaatgcaacgccaattcgggcggtattttccgaggcgatgcgtccgtcgaatgctccgcttcggttttatgcgaaaacagcggctgcaattccaaagtcggcctttgctttgtctcgtcctgctcgaagtcgtcgcccaaagaaatgtcgggcagttcggcttgcatgaccatttggacgtgtgccgaatcgcccggtgcagtcgcaaggccaacaactgccattgttccgtccgctcccttcaccaattggacattcgaaatggactcgcccagtgatcgcttcaccttaattagaggatttaaatgtttaattccatcaagggcaacttcgctgcgccaaaatttgatatgttggagatggccttcccaagtggaatcgaaaagcgaggacattgactcgaatattgtacaaaaaagagataaaataatttttttttttgtatatatgtgttaaacattaaaaaacaatttttacagcttatattaaattgaaacatcaatttaaatttttgggagattggattttttacaaaaccgcccgccgttagtgttagagaaagccggtagggccaggatttctgagcatatgcttgaatatttgtaagcattttaattttattaaatttggcatttaattattttgctttttgaattttttttttcaaaattaaagaatgtcaattaacgttgtttgtcggtttccgtttcttcgactgtgtttaggtatttcggtctgcagaaatggcttttgtaaattctttatcgtccaacactaaaacaattcactttttgaagaagtctttacttcttgcacacagtatgttctttgcattgttattttcaccaattttgttttttttaattccacaacatttttagattattgcactttttcgcgcgaatggtctgagatggaatatgaaaggcacgctgaggacactttggtggcactcactgagtatttggacacattgccggaccgtgtcgattgtgaatctgtaagcatttaatcagagacattttgatgtaaaataaaggccttcgatgtttcatattcaatgggcgttttgaccgcgcacataaggtacaataatacaataattcgggtact

SEQ ID NO: 37018 - DNA, 784 bp, Heterodera glycines
tttgctactttcaacgttttttattaatttattaattcaacctattttaaatcaattttctcattttaagcaaatgaaatcaattcgaacactaattgaacaacagcagctactgaaggcaccaaaacgcacaagaaagtcgtcagatttcgacgacaacagccacaattatctgccaaatccagtgtgcttccacgcagagcaaaaacgcaacaaaattaagaagacagcgatggaaaacccgcgccaaaatccatccaaaatgctggcggaagtccatgcagacaccaaggacgaaatctttgttgctatgggcattgatctcacactggcggcagaatgagaaggtgcgtctgcaacttttttagtcctatttgtttgtttttaggcagaaaaggaagatttacggcaacaggaccgggtaaaccctttgcatttttgctgcccgtgaccaattaatgaaggatggcgaaaacattgttgcacgacagcgaaggcaccaccaaaaagggagaagtaagttccgatggtccgtcccaattcaatggttttttcttcttttaagttttaggaacgtgaaacaaaaagaatcagcagcaattccgcattatttgaaccgctgaaatggagattgcgcgacaagttggctcagtcgcttctcgacggcactgaacaattgaacatgcagagccagaagattgaaattttataacctttattcctcataaatatcgttgcaatttagaattgtgtgaagcgccataaaagctatggaactgctttt

SEQ ID NO: 37019 - DNA, 680 bp, Heterodera glycines
agcaaatgatcatcatcataacaaacactgagcatgtgaaagtgatcagagagtggtattttaaatgtaaaaaatattccaaaacgaaaaaaatttttatcattattatatttaattttatggaccattatctttcaaggagaaaaagtatataagaagcttatcatcaatatatactcaaaaataaatgtaaaaaaatttgcatttttgtttatttatttcccatttcggtggccagcagtaaattttcctgctcaataagcggtggtcctccgtccgtcactgaatgatgcttatgtgtattgaaatgcagctgatgaatgatgagaagaaagaagcagcatcttctccagcagcagcagcatttttcgtttgaagccacgccggcggggatgtgacgacgataatggccacttctgctgcagcgatgaaaaagcgtcccccggggcgcctcgggggggggggggggagggtggagggaagacattgggatttaggacaaagggccccggggcggtgcgggggtgggaggatcaatgcctttccaccaaatccggcccattcaagtttaagaagatttaatatcgctttatttatttagaatatgtatggaagatatttcgggtgcattaagtgatctaaaatactacaatcattaataatacataaaactattgatt

SEQ ID NO: 37020 - DNA, 1328 bp, Heterodera glycines
caaagcattgattggagcaaagagtgggctaaatagctactatagaggggtaattaacaatgcatttacgaatgtttacagatttgccgagaggagacttatgttcgggtgcaagactcaggggatggccgaacggaagaagcgacacgtccgctgacaggacagagcaaaccgcgcacagattttgctaagaaagcggtggtacaaccgatgcgccaagagaagctaagcgtgacagaacagaagacccttttggcaccggacgaacaaaagattcgtgaagaggaagaaaggaagagaaaagtggaggaagaaacgaagaggaaggaggaagaaaggaagagaaaagaggaggaagaaaggaagagaaaagtggaggaagaaacgaagaggaaggaggaagaaaagaagaggaaagaggaggaagaaaggaagagaaaagaggaggatgaaaagaagaggaaggaggaagaaaggaagagaaaagaggaggaagaaaggaagagaaaagtggaagaggaagagcgtaagcaaaaattgaagcaagacgaggaggagagaaaggcaaaaaagaaagcagaggaggaggagcggaagaggaagctgaaagaggaagagcaacggaaaaaggcactttcggaagacaaatcggcacagcgcaaatcaacgctgaacatgcgagaagaggagcgtatcaaagccgaacaagcggagaaggtgagtcttcccgggatattaagcactttttcgccgcttttcaggagtcagctcggcaaaaagcgcgcgcgacgggagcagtcgaagagaagagcaagcagtacacgacgacaaaaacggaagattcattcgcttacaaacgatcaaaagcattggaaccgaaaacggtggacgaacagaaaaagcgcacttttcaaccaattcaaaaacctgatccaaaggctgaagaagcattcgaaaaacaggtgaagaaagaatggcaatggcagaatgccgtacctaaacccattcagatggccgaacttcgtgaacagatgcggcagggatcgcgcaaattacagagcgaattccgagacgtaagccaaggactgaagtcggcatcggatgaggcaaaactgaagacgaaggaggaacggcaccgaactgtcatggacaaagcatcatcagcatttggaaaagcggagcaggagagacgcagacagcgagagcagcaagagagtgaggcggagagagcgaagcgagaaaaggaggaaagagagagcaaagaacgtgaaaagagggagaaagaaaaggtgcattgggggggggacaacaggggaagagaaaaagag

SEQ ID NO: 37021 - DNA, 1293 bp, Heterodera glycines
  misc_feature (23)..(23): n is a, c, g, or t
  misc_feature (41)..(42): n is a, c, g, or t
  misc_feature (45)..(45): n is a, c, g, or t
  misc_feature (65)..(65): n is a, c, g, or t
  misc_feature (75)..(75): n is a, c, g, or t
  misc_feature (87)..(88): n is a, c, g, or t
  misc_feature (101)..(101): n is a, c, g, or t
cgttgggtgccttttgatcgccntgatgaacgccttacaannatncaatggcaaatggtgcattnttcattttanaaaaataaaatnntatgaacaatttntagatcaaacgcaaaataagcgagcgaaagggcactaaagggtcaagagcaagctctgcggcgtcaagttgccgttcgctgtcaccagtcagtagcttggccgcaacaacgcctccaaaaccagcagcaaaaacgccacagataacaccagcaacaaaaggcacacaagccaaaaaacatctggcaattgactcaaaaccaggaccatccaaccggttttctggcgaaagcgttgctgtcgttccaccaccagctcccaaagtccagcagaaaaagccaactgcgcaaactgaccagcacgctgaagcaacaacatcagcaacaacagcaagcaaagcgtttttgacacgtgccgaaccaaatggcaactgcttcttcaatgccatttgcttgacattgttcggatcagaaaaccacgcagaccaacttcgcaagcgaatgtgcacatttctccgaacaattcttgctgatcagcggctgtttttgcggcagaatcccaactacaacaccagggaaacatttctgactcgcattgaccgcatgttgcttcatgggactgatgaaggaataacaacattggaggagtatgctggacggagggagaaaaaccgggactgggctcaggtgaacgacagcatgctgttggccatgttgtttcaacgaaccgtcgttatcattacaccaaatctctcgcgacgagaaattgaacgacaaaatccacagtggaactatgctaaccaaaatttatatgtctacttcccggacggcgaaatgcgggtagataaaacgcaaataataccttttaatattaaaaattcatgtagcaatctctgcgcaatgttcctgtggatcagctccaaaagtttaccatggtccaagacgttggaacccatgtggacagacggcctgtcaacaatgcaattgtgctctactacaatggcctcaaccactttgacaccgtcacttttgtaatgcaaaattaattttgaaaattaaaatactaaaattttctaggcgccacgtagttctgtggaaagagccggaaacgaagtcgtctatgacgacaactacgtacctgcagcattgacacagctgccgcaatgggttctccagctcaaccacagccaacaacaacggcacaaccctctcgtgaagttttggacagcggaccacttaaaatggctaaacaaca

SEQ ID NO: 37022 - DNA, 878 bp, Heterodera glycines
tcccggtctcgatccgtgccgaactcacaaagttatggagtgaaatgtgaaatattgttttcaccacaaggcattttttctgaaaaccggattcaaaaatctggggtttggtataaccgttttagaaatagcgtagaaaacagcttcgatatcaagaaaccaagtcaagtccagaaaggaatattttaaaacgatttcgttttgttttggcattatgataccgaataactttcggaaattatggaaacaaaattggagaaattcgaataattttttgactgcaaatttttttccttttttgaattgggttcaaaaaaattttaagagaatttttgattattattttgaagtcttgaatttatttgacaaatccaagacttaaaactgggagaagcaaggggctgtggctgggggcctaaaatttgggccacattggagaattaattctgatttctgaaaaagtcccagaaataactattttttctttccataccttcttgtagagctcgagctgctctttccaatggtcttatcccggtctcgatccgtgccgaactcacaaagttatggagtgaaatgtgaaatattgttttcaccacaaggcattttttctgaaaaccggattcaaaaatctggggtttggtataaccgttttagaaatagcgtagaaaacagcttcgatatcaagaaaccaagtcaagtccagaaaggaatattttaaaacgattcgttttgttttggcattatgataccgaataactttcggaaattatggaaactaaattggagaaattccaataattttttgactgcaaagttttttccttttttgaattgggttcaaaaaaattttaagagaatttttgattattattttg

SEQ ID NO: 37023 - DNA, 1217 bp, Heterodera glycines
  misc_feature (50)..(50): n is a, c, g, or t
  misc_feature (62)..(62): n is a, c, g, or t
  misc_feature (69)..(69): n is a, c, g, or t
  misc_feature (89)..(90): n is a, c, g, or t
  misc_feature (95)..(95): n is a, c, g, or t
  misc_feature (99)..(99): n is a, c, g, or t
  misc_feature (104)..(104): n is a, c, g, or t
  misc_feature (110)..(110): n is a, c, g, or t
  misc_feature (118)..(118): n is a, c, g, or t
  misc_feature (166)..(166): n is a, c, g, or t
  misc_feature (195)..(196): n is a, c, g, or t
tttcatttattaaattttgcaaattattctccctccccgtgcgaacaaantaatatgatatnaatgaancaaaactccatagaaagggnnaattngaancgaanaaaaangagaattnaaaaaaaaaaaatttttttttttgatggtaatctttggatgaaaattnaaattaggagttttgaagaatgaagtgtnnaaaaaatttaagaaatgtggggggggggggtaaagggaatttattttgatgatgataattggtattaaaagaataaaaaatgatgaaatgtgaattggtatgttggaaagtggcaaaaaaaacgagaaaggccgcgaaagtcaaactcgcagcgagcagacgatcgcgaagcagtgaactcgcttttcgtccaggcgccttgcgcccttaggatgggggggggggcgcggggacgttgctgcatacataagctcggctaacagcgccacgtcaaaaaacggagagacgtgccgggttcgccccgcacgacggtctcgatgggagaaggccaccacacacatggtcagcaatggcgttggttaatcgcctgaaaggtgactagaggggcggagagcgaagtgcgggcatttatgcgctgcgcgagagtttcgatccaaaacttgctcccgggtgtaagatggcgccccccccgtccgcgaaaccttatgtccgatgcaaaagcgggcatacgggcagccgaagccgcggggtgttgcgaacccctaaatactcgtcccacgcccgggaacccacccccggcacacctcaagaaaatctcgcaaataggggttgaaagcaaaaccccaatgctgaaatactaacactactaagtcctcaccacatccaaaacaaaaaagcctcacaaactagattctaatccctccccctcacccaaaccccccaatccaactatagttgtcttttaaaacccccccccccccccccccccccccccccccaacccccccccccccccccccccccccccccccccccccccccccccccacccccccccccccccccccccccccccccccccccacaaccaaaaaacaaaccccctacgacacacaaaaaaacaaaaaaaaaaccgcccccacccccccccccccccccccccccccccccccccccccccccccccccccccccccccccccccccccaccacccccccccccccccccccccccccccc

SEQ ID NO: 37024 - DNA, 1013 bp, Heterodera glycines
ttcaaaaagcgcaaaattttgacggaaacatttcaacaaaaaactgaccaaaactttgctaaatccccactaaaattttaattcttaatatcattcgacagccctaaaagttctctattagtctacaaaatttcaaacattttcctcaaattttaacaaagttatgcccattactttttttgaaacttaacgaaactttttcaaatttttcaggctagtagaaaacacttatttgttagggttattgaatgatgcaagaaaataattttaaaaaaaatttatattaaaaagtttttaattataaaaaaataattttgaccattaaaaattctatgattaaaaactttcttataagcaataaaattaagtgatctggtcttattcgataattctaagtgttttctaaaagctgaaaaatttcaaaaaatttcgttaagtttcaaaaaaagttatgataacaagtacacaggaagcaggttttcaaacatttttggccataacttttttgaaacttagcaaaattttgcagagtaatagagaatattagggctatcgaatgatttgaataattaaaattttagcatggattaagaaagtatatggatagttttttgttggaaattgtcatttgatggtttttttttataaaaacatagcaccgttcaattgctttcccctcttatcaaatggactcaaaaaaagaaaagatgcttttttttgaaacctcaccaaccaatttgcacactgtttttggtgaaaatgatctctcccgtggctaaattgaggccacatccgaccacgtcgccacgagaaaaggacggatttccccttttgctagtgccgccaatacaaaagaggccattgcttgtgtaagcataagtgccggaacggctttgaactgttacgcccaattcgttgtgctttttggacacaaagccgaagagggaacgtctaaaaataatttgaaaaattaaaaatgcttttttattggaatgggaattgttaattaaaaa

SEQ ID NO: 37025 - DNA, 1715 bp, Heterodera glycines
  misc_feature (754)..(754): n is a, c, g, or t
  misc_feature (1058)..(1058): n is a, c, g, or t
ctcatttttaaattttttatagatttttaaatgtttggatttttttttggcttaccaaaacttcatcgaacctggctctttctattctcattcaaatcgccccaaattttttttacagcttaactaggccatattaagcttatttccagaaaatctcgcatgaattctcatttttaaattttttatagatttttaaatgtttggatttttttttggcttaccaaaattcatcgaacctggctctttctattctcattcaaatcgccccaaattttttttacagcttaactaggccctattaagcttatttccagaaaatctcgcatgaattctcattttcaaattttttatagatttttaaatgtttggatttttttttggcttaccaaaacttcatcgaacctggctctttctattctcattcaaatcgccccaaattttttttacagcttaactaggccatattaagcttatttccagaaaatctcgcatgaattctcatttttaaattttttatagatttttaaatgtttggatttttttttggcttaccaaaacttcatcgaacctggctctttctattctcattcaaatcgccccaaattttttacagcttaactaggccctattaagcttatttccagaaaatctcgcatgaattctcatttttaaattttttatagatttttaaatgtttggatttttttttggcttaccaaaacttcatcgaacctggctctttctattctcattncaatcgccccaaattttttttacagcttaactaggccctattaagcttatttccagaaaatctcgcatgaattctcatttttaaattttttatagatttttaaatggttggattttttttttggcttaccaaaaacttcatcgaaacctggctatttctattctcattcaaatcgccccaaattttttttacagcttaactaggccctattaagcttatttccagaaaatctcgcatgaattctcattttaaaaattttttaattgctttttaaatatgccaaaaaatgtaggcttaacttttntagtgaaaattcgatcactcatattttttgctaattgagcagaagcgtaccaaactttgcagggatactccccggtaaaggactaacttacactgaaatgagcgccgagctagctggctcaaaaaaattttcgaaaatctgagtctttcgtttttatttattttttgcaaaattaattcttaaatattttttcagaaagggttctgaaacgcaccaaattttatttacatgttagtttaggcactctgatgctttttctatcaaaaagggagatgaataaaatttttaaaaatttttaattcctttttaaacaggccaaaaagtttaggcttaacttttttttcagaaactgatcagaagcgcaccaaactttgcagggatactgaaaggaagagaaataacctattttaaatattatctagtcagttcatttaaataatttttatccaaaaaatttttttttgggttttcggggcagtccccctgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgat

SEQ ID NO: 37026 - DNA, 470 bp, Heterodera glycines
ggggggggggggtgatgtgttgtcggtgggtcgtcgttggaagcatttccatcccttttcattcaaatctctaaccccaacaattgttcaaatctctttctgccaatccctttgcgcattgtcaatttcatttgtccttgaattcttcagatcgaagcggaaatgaatttggattcagatgagtcgagtcgagttggggccataagattgtgccatgggttttctcattggtcgcaccaattcattccctttttgccacgggttgtctcacattccctttttctggtctttctccttttccgttcgtttgttctcttttttctattatttatgctataaacaattcgtttttctctttccttttaattaatatatattttttatttactattttgtttatgtagtaacacaaaactcatggtctaatatagtgaaccccccacaactgaatgcctggtaaagccgggcca

SEQ ID NO: 37027 - DNA, 854 bp, Heterodera glycines
ttctgacagcaattttcaaccgaccttttgtagggctcaaccgcagatagtaatgcgtttttggggaaaacccacatgtacaacggtgtagaaaaaaagagatagccattttctgagaatatctattcttctgagacagcaattttcaaaccgaccttttgtagggctcaaccgcagatagtaatgcgtttttggggaaaccccacatgtacaacggtgtagaaaaaaagagatagccatttttctgagaatatctattcttctgagacagcaattttcaaacctaccttttgtagggctcaaccgcagatagtaatgcgtttttggggaaaccccacatgtacaacggtgtagaaaaaaagagatagccatttttctgagaatatctattcttctgagaaagcaattttcaacccgacattttgtagggctcaaccgcagatagtaatgcgtttttggggaaaccccacatgtacaacggtgtagaaaaaaagagatagccatttttctgagaatatctattctgagaatatctattcttctgagacagcaattttcaaaccgaccttttgtagggctcaaccgcagatagtaatgcgtttttggggaaaccccacatgtacaacggtgtagaaaaaaagagatagccatttttctgagaatatctattcttctgagacagcaattttcaaaccgaccttttgtagggctcaaccgcagatagtaatgcgtttttggggaaaacccacatgtacaacggtgtagaaaaaaagagatagccattttctgagaatatctattcttctgagaaagcaattttcaacccgacattttgtagggctcaaccgcagata

SEQ ID NO: 37028 - DNA, 1352 bp, Heterodera glycines
cattacaattaaataaccaatcaggaaataaagtttctcggatttaaagctggaatttattggctaaaaggatttaaacggcggaagcacattgtaacacgaaaggtacaacaaatttttttgttggttttttagtataatttttagattaccaaatttgttggcaaaaaatgggcaaaagaccaagaaaaaatatacactgattcggcagaatttgtttctgataccaaaacactcattggaaaagaacaccctgatttggtccttaatacagaccaatcagggttcgaattagaaagtgctcttatatggcgccaaaaagaaacaaacaaataaaaagtgtcaacttaaaaatacaaaatgatgtaataaatgtgaaataaaaataaatcaaatgttaaattcacaggtgattattttaatgtaattgtggcacagaaatttcctactcagaactcattgcttttagtaaacccctgaattcccttgccttattaatttgcaccgctaaaactggaaggttattccagtttcttactatcctatggaaaaaattattttgagttttggccgtgtggcgctttacccgtaaaagtaaaggcctcctgagcctttctgagaaaaagaaacttttcccagcatcgaggctggtgaaccctttgattattttaaaagctgttgttaaatcattaatttttcttctttcttccaatttatgtaaactcgtgatttttagtctttccccatattttttgtacacaaaaccacattttctaagtgcttttcttgtaaaaaatttttgaacacgttcaattttatctatgtcttttttaagattagggttccaaacttcagtagcatattctaattgaggtcgtacaaaagttttataggctgctgttagagtttttatttccctgcttttcaacactctcgaaatttggaaaattctaagatatgcatttcgtacaatttttctaatatgttctgaaaaattcagtttcgtgtcaattataattcccaagtcacgaacattatccgattctgaaatcctttgtgagttaataaaatattcttttttcatattatttttcccttaatataaaacaaaacatttttcagttgaaatttctaacctatttatttttgaccatttttccaaagcctcaattgctttatccaactgattcgaatggtcatcattttcatgggcataatataatataacatcataggcatacatttttatgccaactgatgccgcttcatttgtaataaaggacggcagatcatttataaaaaattaaaaagagtgatggccctaagacacttccctggggcactcctgaaaa

SEQ ID NO: 37029 - DNA, 251 bp, Heterodera glycines
cggggccatctatggtactagatcgcgtgatctagccccgctctggccgctcgagcaggcacctgcagaagctagcttggtggggatcatattggcgtttcccgccttcaggttaaactatcaagagagggaggtggctggtgcaataacacaagggcgggggcagtatgatcatgatggccaatatggaggaaaagaatcagcacttaccaattttttttcacttcaatactgtaaatgtccgcatcgct

SEQ ID NO: 37030 - DNA, 797 bp, Heterodera glycines
gagttgacacatcgcataatgcaatggaaaccggaagtgcgtacaaaagtgattagaagaggtgcaaaagtgattagaagaggtacaactgtgattaaaggaggtacaaaagtgattaaaggaggtacaaaagtgattagaagaggtacaaaaatgattagaagaggtacaaaagtgattaaaggaggtacaaaagtgattaaaggaggtacaaaagtgattaaaagaggtacaaaaatgattagaagaggtacaaatttgattagaagaggtacaaatttgattagaagaggtataactgtgattaaaagtggtacaaaagtgattcaaagaggtacatcagtgattaaaaaacgtacaaaactgattaaaggaggtacaaaagtgattaaaagaggtacaaaaatgattaaaagaggtacaaaagtgattcaaagaggtacatcagtgattaaaaaacgtacaaaactgattaaaggaggtacaaaagtgattaaaagaggtacaaaaatgattaaaagaggtacaaaaatgattagacgaggtacaaatttgattagaagaggtacaaatttgattagaaaggtacaaatttgattagaagagttataactgtgattaaaagtggtacaaaagtgattcaaagaggtatatcagtgattaaaaaacgtacaaaagtgattagaagaggtgcaaaagtgcttagaagaggtacaaaagtgattcaaaaacgtacaaaagtgattcaaagaggtacatcagtgattaaaaacacgtacaaagagtgattaaaggag

SEQ ID NO: 37031 - DNA, 820 bp, Heterodera glycines
ttttttttttttttttttttttttttttttttttttttttttttttttttttttcttccttgtggtgcgggggggcggggggggcgggcgcgggggggggcgggggggggggtgggggggggggggggggggggggtggggattgtataaataattatatataaatatttatttttacaacaaaaaaaaaaaaaataaaaaaaaaaaataaaatatatttttttttttttttttttttgttttgttgtggtttggggggggggggggggggggccccgcccccccccccccccccccccccccccctccctcttttttttttttttttgtgggggggggagggagaaaaaaaaaaaaaaagaaaaaaaaatatttgtttggtgtttgtttttttgttttttttttttcttttcccccccccacaaaaaaaaaaaatatttttttttttttttttttttttaaaaaaaaaaaaagaaggggggggggggggccgcccccccccccctcttttttttttttttttttttttttttaaaaaaaaacaaaaaaaaaaaaaaaaaagatattttttttttttttttttttctttccccccccccaccaccccccccccggggcgggggggaggaggaaattttattatttttttcccccccccccccccccccccccaaaaaaaaaaaaaaaaaaaaaaaaaaatttctcttctcccttcaaaaaaaaaaaaaaaaaaaacccccccccccccccccccccccccttttcttttttttttatacacccccccccccccccctttttttttttttttttttttttt

SEQ ID NO: 37032 - DNA, 903 bp, Heterodera glycines
gttcagaaaaagcaaaaattatgtacaatttatttaaaaattaaataaaatattaaaggttaattaattaaattcgctcacgaagctaactctgaacacgatacttttcggcattaaaaaaaattttccatcgacttaacggcaccaaggctggacgtacttatgagttgtcgattccgtaattacggcagatgttgaagaaataaaaccaaaaaacgccattttattgtttttagtgctttgattttttgagtgccgatgccgtcccctgctgggctacatttgctttggtaaaagcaattttcaattaggtaaatagaatttttattaaaaatcataaatgtttacaaattctcgaatttgttggatgcaaatttttgatctgattaaaattattgtgtttatgtttcataaaataaatactatttgtgataaaaaaaataaaattaatattattaaaatttataggacttattttaaattataagttaataaactctgaaaaataaataaataaaacaggcactcgcgcaaaaacggagtaaaaattacaattacggataacaacaaaattctcggaattctctgttttgtaataaccaaattaaaataataaaaattttaattaatttaacataaaaataatgtttaaaataactgaaaaaaaaataataagataaatgtttataaataaattcaatttcttttctatatatttaaatgcatataaaatttattttattataccaacaaatctttgaaaataatttataataataaactaatcaaaaggaaaaataacaaaaacaattcgatggaaatgcagactgacagcaatcagctaagttgaaatttttgaataattatcaacaatatttttgcattctataaatattcatcata

SEQ ID NO: 37033 - DNA, 338 bp, Heterodera glycines
  misc_feature (25)..(25): n is a, c, g, or t
taatgaaagaccagaagtattaacncattaggctacatacatttgtacgctaatgaattaaaatgaatttatatttatttttttcacaaaaaaatctctcttttaccaccaatttccttcaaattttttcactcagacccccattcttaccagtgtacttttattcccgtttttgagaaaaaatttacgggaacgggaacgggaacgggaaaacgaaaaagaacggggcgggattcccgaacgggattcccgtcatttttcccgttcccgtaaaattcccgtcaggcaaaaaagacgggaaacgggaacgggattcccgtgttttcccgcgggaatcc

SEQ ID NO: 37034 - DNA, 200 bp, Heterodera glycines
atccttgtggtcccttcgctcaaattcgttgttggccatcactcggaaaagcatgtcaaattggcgttggtggaacaaagcgaaaagatacgcctttttgacggtggacgaaacggggtggcgcaaaaggcgaaggttttgcgcgaacaaatggacgagacgggcgccgtcctcccattggaacagacattggcagataa

SEQ ID NO: 37035 - DNA, 96 bp, Heterodera glycines
aaaaaagaaaaaaaaaaaaaaaaaaagaaaaaaaaaaaaaaaaaacaaaaaaaaaaaaaaaaaaaagaaaaaaaaaaaaaaaaaaaaaaagaaaaa

SEQ ID NO: 37036 - DNA, 1152 bp, Heterodera glycines
  misc_feature (30)..(30): n is a, c, g, or t
  misc_feature (56)..(56): n is a, c, g, or t
  misc_feature (128)..(128): n is a, c, g, or t
aattcgaataattttttgactgcaaatttntttcctttttgaaatggtttcaaaanaattttaagagaatttttgattattaatttgaagtcttgaatttatttgacaaatccaagacttaaaactgngagaagcaaggggctgtggctgggggcctaaaatttgggccacattggagaattaattctgatttctgaaaaagtcccagaaataactattttttctttccataccttcttgtagagctcgagctgctctttccaatggtcttatcccggtctcgatccgtgccgaactcacaaagttatggagtgaaatgtgaaatattgttttcaccacaaggcattttttctgaaaaccggattcaaaaatctggggtttggtataaccgttttagaaatagcgtagaaaacagcttcgatatcaagaaaccaagtcaagtccagaaaggaatattttaaaacgatttcgttttgttttggcattatgataccgaataactttcggaaattatggaaacaaaattggagaaattcgaataattttttgactgcaaatttttttccttttttgaattgggtttaaaaaaattttaagagaatttttgaatattaatttgaagtcttgaatttatttgacaaatccaagacttaaaactgggagaagcaaggggctgtggctgggggcctaaaatttgggccacattggagaattaattctgatttctgaaaaagtcccagaaataactattttttctttccataccttcttgtagagctcgagctgctctttccaatggtcttatcccggtctcgatccgtgccgaactcacaaagttatggagtgaaatgtgaaatattgttttcaccacaaggcattttttctgaaaaccggattcaaaaatctgaggtttggtataaccgttttagaaatagcgtagaaaacagcttcgatatcaagaaaccaagtcaagtccagaaaggaatattttaaaacgatttcgttttgttttggcattatgataccgaataactttcggaaattatggaaacaaaattggagaaattcgaataattttttgactgcaaatttttttccttttttgaattgagtgaaaaaaattttaagagaatttttgattattaatttgaa

SEQ ID NO: 37037 - DNA, 1416 bp, Heterodera glycines
  misc_feature (30)..(30): n is a, c, g, or t
ggtataacagtgattagaagaggtacaacnggtgattatctttttgtacaacagtgattagaagaggtataactgtgattagaagaggtacaacagtgattagaagaggtataactgtgattagaagaggtacaacaacgcgaaagaggtcaacatgatttaaaatgtaataaataaggaaattttttattaaatattaaaaatcgaatgcattttaattttaaattattaataaaaaacaacgttgaaaattaataatatttattttatttaaaatgaaattaattttttaaaagaggtacaaaagtgattaaaagaggcacaacagagattagaagaggtacaacagtgataagaagaggtacaacagtgtgagaagaggtacaacagtgtgagaagaggtacaacagtgattagaagaggtacaacagagattagaagaggtacaacagtgattaaaagaggaagaacagtgattagaagaggtacaacagtgattaaaagaggtacaacagtgattagaagaggtacaacagagattaaaagaggtacaaaatgtaaaaaattttttaaaaataatctacaacaaatcttcagattagttaaaaacattgaaaataacgtaaaaagtcatagaaaataatttacactggccggattcgaaactgccgccccccccccccccaaaattgggaattaaaaaaaattatcagcgattttaggccgcttccagtgattagaagaggtacaaaagtgattaagaggtacaacagtgattagaaagtgggcattcaaatagagcatttatggtaattaaggaattgtttttaatcaaaatagataaaaaatcgatgtgttatatttttcattttttaaaatataatacactttttattaatgaaaaacaaattatgaaatgtataataattgaatagttatttaaattgaaatgaaaaaaattttacaattaaattttaaaataatagctgaaattctttaattaaatataataaataatttaaatgaaaatcattattcatcaaaaaataatttaattaaactaaaaaaatttattattaataaaaccaaacatttaaatttattaaaagtaatgaaaattaacccaaaaaatacaaagaaaaataatgttcaccgtccggattcgaacctgctgccccccccccctcagaacatgtcccagaatccccaatcacacagggattctgagatcttgacgatgtcaaaagtaaaatctgatcacgtattcgtgatcagcggcccaataacgcctaaagacatgtttttggaagatttttggtgaaaattttttcacttaaaaccatgtgctcccccctttggtcccgatcccaaaagcctttttatttttgtatcttttttaaaaatggggtaaaaatg

SEQ ID NO: 37038 - DNA, 76 bp, Heterodera glycines
ccggatcgggtgggggccgcgcggccaacggcagttcccgactggccaatccagcccgatcaccgccgagacggcg

SEQ ID NO: 37039 - DNA, 798 bp, Heterodera glycines
aaaagggggtaatctacctaccctgaaagtttggttcggaagtcccaccgtcacttgggtacctctcctttgttagtgaaataaattgatttcatttttttttctcaaaatttgtcgtcctttaccccaatttttatcataaatttttcactcgacccaatgggcaatttttacaagaaaaaaataaaaaaatttgaaaaaaaattcaaaaaacaaaaaaatagaaagagactttttaattgatttttcatgttttcttaaaaaaaacttcgtttgactcttttttgaaatttgttttttttttaattttaaaaatctgcgtgttcatgcaatttgtctttttctttttaccttcttgaatttgatagcacgaagctgcggactgggacaggaacagcctttctcatacacaaattttccttcttcgcgtgcgccattacttgttgaactactgctgctgctggaacccattgttagtaggaggcgaaaaaaaaatgtaaattttgtaaaaccttaaaaaaagaaaatgaaaaccatttcaattggatttatgcagggttcgaaaaagataaaattttcaaaaaagacatcattaaatcggcaaaaaaaagaaatgattggggttgaaaaacatttttcatttcttatgtgtgtatttttgaaaaatttcgggtcgattttcaggggtgtgccaaaaagttgaaaatagtcttttttcaaaattttttaattttttggttgctaaaaaaaaaataattgctaataactcgcaaagtagtttaacaacacccgaaaaaa

SEQ ID NO: 37040 - DNA, 549 bp, Heterodera glycines
tatttctttctaacatttgtatgtatgtacgattttcttattttgcgatttatgtccgtattttgcagaattaaacgttaaagactaaaagaacttcatttgcacagctttgcttttccaacctgtccttttctccaaatgttgtttttatcgttgaaacattcataaaataacaaaacaaaacatataaaatgacagcgcaaaatgcaataaattttctgtttcactcattggacaatttaatgccctttttgcttttagcattttttatttgtataagtacaaagtgtgtaaaacaaaataaaaatgttttattcaaatattttcagatttattttttaattcgaaaaagttctttttatttggattaatcacatattttatctctcataatatcactggcaaaatcttttgggaaaaaagcgggtggggggggggagggggggggaaggtcaacaaaagtgctgaagaatctacgaaacaataaatattgagatgcaaaggccaacgaaaagaccgactaagacaaaagatgtcaacgaggctaac

SEQ ID NO: 37041 - DNA, 1028 bp, Heterodera glycines
  misc_feature (83)..(83): n is a, c, g, or t
tttcaaaaatatccagatcaggattctgtgaaaatcctgaggatctgctggtcctgttccatgctctaattaaataatgtatntaaggaaaagtgtgtggattaaattctggaaaaaaagtattcaaatcttccagtttggagtccccaacccgggatttggtcgtcgaggcgggaagggacatcgaactgatgagcaaagcgggcgaaatccaaatcaattcaatctttgacatcaatttgaaagcacgacaagtgaatagaatagagaaacaatatttcgcattaaaacaaattttcaaattaattaattccttacctaaaataattcatggatttgtatcataagtgagttatggacaaaggcccgtgatatgaaattaatttttcttttacagttttgctttaaaaatactttaaataacttttttctatttttgatttttagtttgtttatgcaaaattcaaaggaaaaaatgaattttctacttttgttcgatcttaggtttggattcaaaatttgccggaatagatgcgaggttcgtgatcagcgaacccgaaaatcccaggaaatacatatgtttccacgtctttaagaaaaaaaaataatattttttttaatggggcaaaacatactattacaaattttcatttaactattattcaaaacgacaattacacatatttattccacatataaattaatatgtataataataacaataataattttctccaattttggtacgcatttttcgttgttttacagggtgaaattcggctggactccagtgccattttcatttctggcctagagacaagtgctgggctaggctcggcacagtatcagttgggttttatgcatttttgcatatgccttatttccccatggcacagattgtgcgtgtgcctaaatgggcgactgttttggcaacagtgaaggcccgattgtcgtgctggatcgaagcatatgcttaatgaaaaacaattttctttttttattatatggttaataattaataattactg

SEQ ID NO: 37042 - DNA, 752 bp, Heterodera glycines
tctagagtcaattcgaaggcaaagcaaaaggaaaagggcctttgtttgttcttcggttggagttcgttcactcaacggaaacaaaagtgaggataaattgggacaaaaagaaaaagcgatggtaaggaaaagccaaatgaaatgccattatcagcagaaaattcccccaaatgtccgctttcaaatgccaatgggctgtggtcggccgatgaatgaatgaatgaatgactcacgcggtgtttttgtggtttgccccccccccccgcccaattgcacagaatgtgtctcggccgaactctccgttaattcgattgaaaacaattccccttcccctcccccattttacactgtttttgcgcatttccctctggcctctttgtgagctcgggacaatgccgccaatgatgtgcgagataagctcgctgcctaagcgcatgaccattctttcctgaggggctgcgaagcggaaggagaggcgccacgcgtacaaaaatagacccgaggggacgtatggagcgtaatgtagcggaatgaaggcgccccaggttacaaaaaacccgggaggtcacacggtgcgaaatgcaaggcgcggaaaggcgaggcgctacgggtcacaaaagacccgaggggacctaatgggcggaatgcaggagcccttggattacaaaaaaccaaggggccagaaaccgcggacgcaaaatggaaatagcgctaatgccaagacgccaccaggttaccaaaaacctgtgggg

SEQ ID NO: 37043 - DNA, 974 bp, Heterodera glycines
  misc_feature (44)..(44): n is a, c, g, or t
tttttgttttcggggcagtccccccgacccgatgcgcacagatntatgggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttccggaatagcttccctacagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgacccgatgcgcccagatttatggggagaccgaatcctgtcggaatagcttccctatagcctgtaccttatttctgcgttggatttttgctcccataattgtttgagtaccccaaacggaaacttgaaaa

SEQ ID NO: 37044 - DNA, 747 bp, Heterodera glycines
acactagaaaccaaattaccagcacttttaacacctaaaaacagattcctatgaattatttttgtcgctttttgttattttttgaattatttctcgctcttatattttggttttatttttctattagctttttaaattttaatttcaataatggaccaacttatcagtgggcttctcggaggtggcggcggaggagaagcaaattctggtgataatcagccgcagcagggcggcggaggcagtggcaatcagttggcagatatggccggggtaatgaacaatttttttttaaatttaacatttaatttttattcccccaggaattaatcggaggatttcttggcggtggcgggggaggaagcggcgccttgggaggaggcgcaggcggcggggtaaaataaccgtcgatttctaatttttagttcttagccatttcagctttaagcctaattgaaaatttaaaaataaaaaactgtcaaaaatgcaccaaaattggttaaaaataaacgaaatccaaaattcctattgacattaaatcaaagtactttatgcattttttaaatataaacaaatatgaataaaaatgtcaaaaatatattaatctcccgagagcgtagccagacccttggcttcggaggcttgagaaattgcttaaaatttcaaaaaaaaatttttactttgggttcgtgagggggggagagcggctttagccccctcaaacccccctcccccctggctacgcacatg

SEQ ID NO: 37045 - DNA, 583 bp, Heterodera glycines
atttaaaattttttattaatttttaaagcttcactattttatttttttagcaaaattaattcataaatattttttcagaaactgctctgaaacgcaccaaattttatttgcaagttattttaggcactcagatgcttacactatcaaaaagggagatgaataaaaatctaaaaatttttaattgctttttaaatatgcgaaaaattttaggcttaacttttttttttataagctgatcagaagcgaaccagattttgcgagggcatcaaaaagacaaggaaaagcactgctatgatgctaactccagtaattctgaatttaaaattttttattaatttttaaagcttcactattttatttttttagcaaaattaattcataaatattttttcagaaactgctctgaaactcaccaaattttatttttaagttattttaggcactcagatgctttcactaaaattttttccttatattttggttatatcgttttgcttttgggggggtgcttggaacagtggaatcatgcgcacccgcccgatctggaaagttaagcaaccgattgctgactagccaaaaggtt

SEQ ID NO: 37046 - DNA, 1056 bp, Heterodera glycines
ttttttttttttttccaaattttttattggtgaatggagaaaaattcagtcattttttcaaaaatttttaatcattttggttttttaaataaatatttttgtctttttaataatttctgttcgagaatgtctgttgatatcgagaattttaattttcttaaacaattttgcttttaaggacaattaagggtatattcttctgcaaattgagggaaatgcatttgattttcctactgattttgccaatcctttggccggccaaccatcgaatgccatggacaaaaagtgccaaaacattctgacaaaatgtcgaacgactcaagcaaaatgacaaaacactctgacaaagtgtcgaatgattcaagcaaaattcccacccaaattgccgtcgggacagattattttttgctcgaaaaatatggacaaaaaattctaggcaaaaatagcaaacacaatgaacaattgaagaaggacattaaagggctaaagaaaaaaagtaactattttaattgattttggaggtttggaggttcacacattaatcaaaaatataaaaaccgaacattgacccccccccccccccgaaacccaaaactcgcagacccaaactcgtactctttccatcactttgccttttgcggtctcactcctttcctctcttcacctccatctcccatcgccacactctctactcactctttccatcactttcccctccgctttttgccgtatctctctttcctctcctcacctacctctcccatttgccactctgtcttcctcactctttccatcactttgcccctccccctttttgcggtctcactcctttcctctcctcacctccctctcccatttgccactctgtcttttccaatgattattttggtttgcatcttttttgaaatgttcaaattctcttgttagctcgtatttaattaatatatatgttatattgacaaggagtttcgttgctaaaaccattttctcccggccgaaggccgggagcgccctgaaagtaatgcaagggccttacaactttttgaggagcatccg

SEQ ID NO: 37047 - DNA, 811 bp, Heterodera glycines
ttaattcttttactggtgctaatcttgttttagcaaaaattaaatatatttcatttgattcaattaatttcaagtaggctgtggatgcataggctgaacctgaagcgtcagaaaaaatgtgtagttcaactggttgaattaaagaattgctaaatggaaaacgtcttaaatgaatttccgccttacggacatttgcggacggacatttgcggacggacatttgcggacggacatttgcggacggacatttgcggacggacatttgcggacggacatttgcggacggacatttgcggacggacatttgcggacaattcctgagaaaaaattaaatgaaaaaaaatttttttgttataaaaatttctaatggaagagtgggcctcgtcagtgcggtgctcttccgaaagaaaacaaacaataagaaaaaaagtgtgttacggccctaccgcaaacacacaaaactaaagaagcacacatcgacaaattaaaaaatacaaggcaaaaatatttttttaaaagccataaacaaattaatttcgtaattatttaaatttctttattaggcttgctgaaggccccaccaacagccgtatttttacattctacaaaataattgggatgagctaattccactgaaccaacccattaaatgctaatcggaattgaagggccccttaagggattaaaccactttgttctggcggtggggttaggaactaatcaaattgcccctacctaaacccgaaaaccccatcgattttttgtacgttttgcttcttggaacgatacctaaaccccaatggtgggtcaa

SEQ ID NO: 37048 - DNA, 874 bp, Heterodera glycines
atcaatgaataaatattgaaatgatgagtcaccccatccttttaaatatttcattttatttttgaggggagagaacggacggacggcggagggccgacaaacggcggcaaaagggtggtggtgactcattggtaaaacaaaaattgtgagagtaaggagggacagatcgccaaaggggaaagaaatacaaccaaggcagaagaaaggacggccaaaaatgccaaacaaatgccatgtaatggatggaggatactttaatgaatgcaacttttggtcgttgatgggctaatcaatcttctttttttggagaatggtttctggatcgaggctgtctggtcttgtccctcacttttggcactttttagagtccgtatcttattttattaaaaaaaatatattaatttaaatgatctatcccctaaaactattttcacaccactggtggacctgagcttttagcttccccgccttatatttatttactcgttctgatcacgatcggtggggttgaaaagttgaaaatggtagcgcgcgttgctttgatccacagttttgatcactccggacaggattaaagccgcctctccgccctcaatttttgttagtgtcaggcgccgacagttcttttggcgtcatcgcccaaattttcgtcgccgcccgcccgatgactaagcaacaaaaaaagccaaggaaagctatgggtaaacaaacaaacaaatacacagtccgttagctgctttattgctggtgaacagtggccacgtcctgtggcaaatccacggattgtgaaaagtgaaaattggggggagggaatggaaattcaatcggacgcccggcgaccgccccgcaatctcagcgggcgccggctcggcta

SEQ ID NO: 37049 - DNA, 125 bp, Heterodera glycines
atggagcggagaatggggacaatgaatgggcccttggggggagagcttgtccaattttggaaggaccaaccagcgtcattcatcccctacggggctttgggagaggaggagggggggggggggaa

SEQ ID NO: 37050 - DNA, 1047 bp, Heterodera glycines
  misc_feature (599)..(599): n is a, c, g, or t
tgcttctggccaccattttcccctccattatccccggccctttgcgctgtttctcggcattttctatggccttttgcattcatgtacaaaatatttaattttttttattttgattttggaaattctaatttttcagggctttcaatgtttgcagaagctttgcgcttcggcgatcgacgtttttacgcggtttgttcgcacagaaaaagagacaaaccgaaaaattttggtacaaaatgtccaacaacttttttttgccgcttttttggcccgttctggcatttcccaattaaagtgccaaataataatggcacacatttcgttctccccatttagaattggtggagctcacggaacatggccgagtattatcgcaattggaatttggtcgtccacgactggctttatgcctacatttacagggacatttcaatggtaaaatgggccgaaaaatccatggggatttggcacccctaggggagcaattgaaaaatggtgaaaagcgatgtcgatcagtgatgcaatcagacacgtcccgaattcatattctcgacatttttttgtggggggggggggggggggtggggtcgagagcaatntggattggtaattactaaattctattcaaatttttataaaattcacttttaaatatcattaataataataattattattattcttataaatattattattttcaaaactttaaaatttttattaaaaaaaacggatctctgaaccttttttgggacgtttcaaacaaacaaaaaatgtttataaaaaggataaaccgggtaacacaatgggaacacggattaaataccgtatgaaaatttttaagaaattttcaaaattttttaagctcctcggcatgcgctggggccctgcggtgtcccaatgcctcgtctttttcctctcctccttcttccatgagtattggtttgcggtcagtttgcgcatgtgttatccggccatcttcacactttacttcatttttttcgatgggttaaattttgttggcataacgcccaagtttttgtaaaa

SEQ ID NO: 37051 - DNA, 152 bp, Heterodera glycines
ggggggggggggggaaaaaaaaaaaaaaaaaaaaaaaaaaaattttttttttttttttttttttaaaaaaaaaaaaaaaaaaaaaaaaaaaaaaaaaaaaaaagggttttttttttttttttcccccccccccccccccccccccggggggg

SEQ ID NO: 37052 - DNA, 607 bp, Heterodera glycines
  misc_feature (163)..(163): n is a, c, g, or t
ccccccccccccccccccccccccccccaaaatattttttttttttttttttttttttaaataaaaaaaagagagggttttttttttttttattttctccccccccaaaaaaaaatatttttttttttttggggggggggggggggggggggggcgcgggggnctatttaaaaaaaaaaaaaccctctttttttttttttttattttttttttctggggggggggggggggggcgccccccccccccgggccggggggggtgttttttttataaaaaaaaaaaaaaaaaaaacaaaaaaaaaaagggggggggttgtttttctcccccccccgccgcaacaaaacaaaaaaacaaccgctacctcaaaaaaaaaaaaacccccccccccccccccccccccccccaaaaaaaaaaaaaaaaaaaaaaaaacaaaacctatttttttttttttttttttttttttttttttttaataaaaaaaacccccccccccccccccccccccccccccgcccgcgccggggattgttcctcacaacaaaaaaaaaaaaaaaaaaaaaacaacaaaaaaaaaaaaaacaaaaaacccttcaggggggggggggg

SEQ ID NO: 37053 - DNA, 571 bp, Heterodera glycines
atgagaaagatgcaggctgttttatcaagactgttctggtaccaagtgaaaagctgcagtaccgtattgtggtctgggacacagaaacgaggcttcagcaaatggaacagatgggacagcaacgccacaaagtaaatcaactttcagctcgtatcacctgcacagagtgctgtgattctgaaagtggggcacggtcaaattgccaaatttgcattaccgagcatggggaaatggagcgaaataaagattggtcagtatgttggtaaaatttttccaaactgtggctttattattaataggagtgaagcggaagggcatgagccaatctccgagtttgttgaatggattttgagagcatggacgaacaaatacaaaacttttatttgggtaagataaatcgcttcgttgtcatgtttttgctcatttatcacctttttgtttatcaggcacacaatgcatcgcgttttgatggccattttgtgttaaaatatctaggcgaaacaaaacgacgtcctgacgttgttatgaatggtctaaaaatttttgagttccgcctgcagcattcgcgacg

SEQ ID NO: 37054 - DNA, 518 bp, Heterodera glycines
tgggaaatattcacaatcctagacaaaatcactttggagtcagaaaaagctgaatctacgtggcgagaattcgaaagatgcaaaacttttgaccaggcaacaaaactcgaggaacaatcgcaaattctttaatggaagcccgaagattaaatttcgagtcacaaagggtgcagagccaaatgttaaattatgaaaataggccccaaacaattgtttgggagcatatgggtatataagaacaaaaaaaactaaaagggcaacactcaaaatggatgggtgttctattgagacaattcatgaggacttaaaatttggctttaaaaaatataaaactaaattttattttaaaaatcatttcataattaatgcgggagaaaattttaagatatcctcgcatcaataattgaagaaaattataaaaagaagcaaagaaaattcagaagcattttgaagcttcttttggtttgaatcatttattgcccctctagatacctagcgaaacacagccgaggctttgt

SEQ ID NO: 37055 - DNA, 1376 bp, Heterodera glycines
gcagttttagagcttaaaaatcccatccctaattattactaggatgagatttaaaaaattaaaaaaaatattatttatttttagtgccaattatttgttcgttgccggccattacccaatttattccattggaaagcatggcttctacaacaattgcttagccgaaatggaccacctgatgcgcaacaacaaagtcacggtaataaacacttttctgtttactgttaagaattttatttctttttaaatttcagaatttctgtaaattaaataaaatttgagtatcttaatacaaacttaaatttgtttttgtgtttggaagatgagccaattcatagaataagcatacatttggaaacgctgttaaaaataaaaatcaaaaataattaatttttggcaattgtttaaatttcttcaatttatgtacaaacttaaaaagaaaaattgatttaaatttaaatttatttgttttaatattttccacaggcttacctgagtggtcatgaccacaacctgcaacatttgcagctgaccaagccggacggcaacacgttcgactacataatttcaggcgctggcgcagcgacggaccgaagccaagaacattgggatgaattcaacaagacagccgccgaaatgaagggcaaagcaaaagtccttctccagtaagaaaagcattaaaaataatttaaaaataaaattttattattaaaaaggaaaataaacaaagataattgcctaatttaaattggtggtaaatttaaattagaaaaaaacaacttcttttctatcaaaagtattcatgaaaacttaaattataaaaaataataaaaatgagcaattattcttcattttgaactttaaaattgtgtctcagttttccgtccgcccattggtggattaaatttgctggcgaagaattgctaagttggacaaccggcggctttatccaagcgcaagtgacgccggacaaaatggtgctgaatttctattctggccaaggtaatttagcatttaatagaagatttgaattttctgtgtcaaagtttttgggaaaaaatattttccaaaaaaattttaactgttaaaaacttttcccaggctctgtttgtcttgatcaaacgccgcttgtcggaagtctgcttggcaaactgccatttgtcaaccacaattgcaagagtttgtacggcaccacaacattgtgtccacgggacaaaccaaagtgccgggaggaagcggctgctcaggacaaaactggatggttcagtgggccatggtggtgtatgaagttgtgctgatcagtctgaccaagacaatttgtgatcgggcaattattaattaaattggtcgcaccgtattaatattttttattgctt

SEQ ID NO: 37056 - DNA, 761 bp, Heterodera glycines
cccattccaactggccggtgctaatacgaccgtcccttacaaaaatttatagaaaactttttcacctttgacatttttcgcgacgcattcacttttttgctctaaaaaataattaaagattaagaattataggaaatttttggaattttgaaaatgtttttttgattttgatacaacaatctatataatttgtacatatctcccagagagtcccatgtattcggtattgtgtttccatattttgagaatttttttttttaaattatagcccacgagatgatgaaaatgcattttagcattttcttatcaattaaatttagaaaaaaaaaaaactttttttttaacgatataactagggcatggattcttaagtgttaaaaatcccgaaataggtacttaaatattgctaaaatagttgccaaaaaatggaacataattgctaaataaatacaaaaatttctaaaaatttaataatggtgaattttttgggaaaacatatggggtccggtggtgctgataggcgccgtcggtgaaaatttggaaaaatgaatgaagatttgtgcgtaaattttcgattacataagccaaaaatttcaaaattatttatttattttcataactattttttacaagaaaaaatagtagtttttaaaaaagttcacaagccaaaatagtcgttaaaaagtttcataagcgaaaatagttgaaaatagttgcttaaaagtcgctctaaaaaatggattgaagaaaatgtttttttt

SEQ ID NO: 37057 - DNA, 977 bp, Heterodera glycines
  misc_feature (865)..(865): n is a, c, g, or t
  misc_feature (867)..(867): n is a, c, g, or t
  misc_feature (874)..(875): n is a, c, g, or t
  misc_feature (884)..(884): n is a, c, g, or t
  misc_feature (911)..(911): n is a, c, g, or t
atatttcttcaaatgcttttttgttcaaattttttcttttctgctccaatttcaatttgaacaattaaaaagaataatatggacagtttcattgctgatatatttttttaattaaaattgatatttattcaatataattagagatataaataataatttatttctcaaaaatatttttatatttttctcttttctactgattggtcgctagacaataattttaaaaaatagtgaaataaaaaaatttcatcgttaattaaaattccaatcctactgattacaagaaatctctgagcgttttcattaattttcaatatttttgaaattttctcgtcactcatttttggattttctccttttatttgccaatatattttcactttctccattttttctttctccgttaatctttttccattcattccgaattatttcttccattttctaattactccttgggttactccaattttcttacaaatttcggcataattttggtgccattcttttctcgaatattttcttcctttttgcttatattcatttttcattgcattaaatttttgcacaatttcaattttttgtacatccgtttttgatttgttatggcatttgtataatcctaattctttgatccatttgtaaattttgtttcgatttgtgcccaatttttttccgattttcaattcaattttattccattcttttgctgaatattttctctctttttgtttgattttcgctttaattttgttgaatttttcaacaatttctctctttttctgttcattttctttttcttcccatttttctccaaatatttctttaaatgttttttgttgcaattttttctttgccgctccantnttcattnngagcattanaaataatacaatttgaaagaatattangcacagtttcatattttctaaaaaatttcattttgtattttatttaatagaccgaaaatgaaaagc

SEQ ID NO: 37058 - DNA, 793 bp, Heterodera glycines
aaagcatcagagtgctaaaattgacttgtaatcattttggtgcgctttagagcattttctgaaaaaatatttatgaattaatttttcaaaaaataaataaacagttaaaaactcagaatttctaaaaaaatttaaaaccaattacaattgtcattttttcaggttaagttagtcctgtaccggggagtatgcctataaaatttggtacgattttattgattattgaaagagctagaaccgaagaaaatctttttaatttaagcctaaactttttggcatgtttaaaaagcaattaaaaattttattcatctccctttttgatagtaaaagcatcagagagccttatttaacttgtacataaatttgatgcgtttcagagcactttctgaaaaaatatttatgaattaattttgcaaaaaataataaacagtgaaaaactcagaatttctaaaaaactttaaaagttatttctcttcctttcagtatccctgcaaagtttggtgcgcttctgataagtttctgaaaaaaaagttaagcctaaactttttggcctgtttaaaaaggaattaaaaatttttaaaaattttattcatctccctttttgatagaaaaggcatcagagtgcctaaactagcatgtaaataaaatttggtgcgtttcagagcagtttctgtaaaaatacttatgaattaattttgtaaaaaaataaataaataatgaaccctcctccttaataattttcctgcgcccaaggtctcactcagcctcttcgcggcctcgtggtgggccttcg

SEQ ID NO: 37059 - DNA, 908 bp, Heterodera glycines
  misc_feature (40)..(40): n is a, c, g, or t
ggaattaaaaatttttaaaaattttattcatctccctttntgatagaaaaagcatcagagtgcctaaactaacatgtaaataaaatttggtgcgtttcagagcattttctggaaaaaatatttatgaattaattatgcaaaaaataaacaaataatgaactctcttccttaataattttcatgcaccgaggtactcactcggccgcttcgcggcctcgtggtgggccttcgccccccctccgcccttcaaaattttgaaaaaaaaataaaataataggagactcagaattttgaaaattttttataaaaactgatgacaagctaatgtgataaaacaggttaattcttttcctttcagtatccctgcaaagtttggggcgcttctgataagtttctgaaaaaaaagataagcctaaactttttggcctgtttaaaaaggaattaaaaatttttaaaaatttattcatctccctttttgatagaaaaagcatcagagtgcctaaactagcatgtaaataaaatttggtgcgtttcagagcattttctgaaaaaaatatttatgaattaattatgcaaaaataaataaaaatttctaaaaatttgatcgtccataaataatttgtaattgatcaggggctcaccaaattttgcaggaatacgtatcggaacactacaaatgcttactaattttcctagattttttaaacccggtgaaaatattttgcagacaccaccacttttgcacttaaaaaaatttcaaaaaaatttaaaaattcatagaaaatttaaattcataggcactactgctaaatcaccacgcatacccctttccttgacctttttaggccctgcaaaaactagggagcttctgatcactactcgaaaaaggaaagattgaatttcagtaa

SEQ ID NO: 37060 - DNA, 1201 bp, Heterodera glycines
agggagttgctgctgctgatgccagcgaaacatcggcaacaaccgaaagcagcagccgccaaaccttcagcagcacagaaagcacagcgacaagttcaagctggtcaacaacggaaacgacaacgacgacaacggcaacagcagtcgagtcggataatgagtcgtccttgctgatgcttgactttttctgaatgcttttctcagtttataacgctttattgaagaatctcgagagtgctcttgattggggcttaatgggtttgaaggattacaaaataaaaggcctcccgtagctaatcggttagaggcattatttcttggtttgaaagggaggactatgggttcgactctcaccgggcgtgttacccatttaatttatcctactccagtcccatgcttggcattcattgatctcaataccgagtttttcgtcccaaatagagcacggattgggtccccgattcgggtgcactacgtcccccccccggcatgcatctttcatgcgcatattccaacccttttttttgtacataaacatagtcacattttgattttattctcattttaatattaaataaataataaatgttttttctctttttacaaattatttggctattcattttaaaacacaacacatacactcgaatagagcagaggtacaatagcagtgagaatgaaagtgaaagaaatctttgcgtaacttttttgcgacccgttttttgatgataattatatgattaatgatatgcctaatgatgataataatgataatgatatgccccgagggaacagagcaggaattgatcgatcgcttaatttagggaatcgagcaggaattgatcgatctattcatttctctgactctctactctcgatgaacccatattcctgccctgatctctactctcgggatcggctcatctctctggctttcgacatcggccaatacccatcccatttctgctctcgaccgatcagtctctctctcgaccaatgatccgttcctgctgctctgatcactgctgctgttgctattgctgatcactccacaatgtgtgtggtggtgatcagaccacctcgtactgggttgggcttctgtgatggtggtgttgagccaacaaaagttgctgtgccgacgacgtagacggcatttgctgatgatgtgatgctgccgccattgactgatgccgctgttggt

SEQ ID NO: 37061 - DNA, 818 bp, Heterodera glycines
cacttgaagctccaacattttaatttgcatctttttacattgaaaatgtgctcagcggacgttctcaggcggatgtgtattatttgcagtgtaacagttgccaatggacgagccgaacttcggaaggggccgagcggaacatggccaaagagtcgtggacagagccgaccaatcccatggagggcgaactgggcaaagtgatggctatcatgaagagactgagcaacttcgaacggttcgagcgcgaaatgaacagacggtctggcatgtcaaaactcgacaaatttggcactttcgaacgcgaaacgccaacgaaaaggtaagaaaagcggacgaattggataggcatttgaaaccattgattggcagaatgtcgggccgaggaatccttcgaaatgatcgcttttctcttcaaaatgcatacaactcacgcagaaaagcgttacaaaaacaagacgacgtggacgaagtgttggagttgttggctccctctgccgatgttcccggtaattgacaaacccaacaattgcctttctaaaatactatcgttcaaatcattaaataattggttccgaattttaaaaaattttgaggtcgccgccgcgggaatgtcgcctcccccggaaaaaaatcattcattccctttcacatggaataaaatcgttgccagtttttaggggaaaagaaaggttcttttcaataattgactgaattgaataaacttgataagtgtcttctatttgcctgccatatttcattatttttcaaaaaaaaaaaataggccgtaacttttttgaaacttaaccaaatttcaaact

SEQ ID NO: 37062 - DNA, 950 bp, Heterodera glycines
ggcaaagatttaattaactaaatacctgataaaatgtgccgttagtgacaaaattgagattgttgcctgagatgatgtccaaatatccgtcgtaagtgaaatgcttttttgaacagaaaggtcatttttaacacgttcaaaaagttcgtcgtaaatttgggcaatttcttgcgtaaaaaatttacgtcctctgaattagaaatgagaaattaaggataaactaatgaaaatttaatactttggttcataattaggtgccaaaaatttcaaaactctctggaaaccagttttttcaacgcatctaattggcagtatgtcaactgcgatcatttcagcaattaatcgttccaatttctttgttttttcaccatcaggcttccattgagctggaaataatatattaaaaaaatattagattttgttgggttacaagacattcctggatcgtttgtgatccgccggagtgaattcttgatcttttttccgggattggacttcctgattcatcatttctgttcgaagttgggtcagaagaggcaaaattggttatttttggcagcactgcgattgcgttctctctcttcttttttatttcgtcaacagaattttttcgcttcagttcgtgttccttatgtttggcgcaaaggtgtctgatgagattcccggtagacttgtgagaatcctgtggaaaatggcactgcaatatttgcagcgaattgcgccatttataggacgatggaaataaaaccaaatggaatcaggtttttcagccatttgctttgcttaaattcaagaaattcatacaaaatatctttagaataaggataataatgaacaacaacaaatacaaaattttcgattccattgaacacaatcgtgtcaaaaaaaaattctctatttccttacctaattttcacctagacccctttgttaccagtgcttagttcgac

SEQ ID NO: 37063 - DNA, 1196 bp, Heterodera glycines
  misc_feature (1180)..(1180): n is a, c, g, or t
caattttttctcatttatcaccacttccaattctgccataaatcatttttcaccgcttcaatttgcttagccaaacctttcaaaaatgattttgttggcctaaaatgcaattttaacaaattttaaatataaaaataagatccaaaacacttgaaatttcatttttatatagaaacatattcatttcgttacatgaaatttaaatttgttttattaaaaaagtaataaaatttatttactcttttttggcgttttttgcagatttttgatcatttttgcaaaatgtggccaaagtttggttcaaattaaccccgcaaatttgttcaaattcggcaaattttgcccaaaattcgcccatttgtccctcaataacattcattttgttcattaattcaatgttctgctcattttctcttcttttcttttttctttaaattttgtagaaatttttttcggtgattccctaattgttgccattatttttttcggtgaaaaagttcctttgtctttgttcgttttgcttgtcgtcgctttgtcctccttttttgtattgccatttccttaatgccattgctcaattcttttttgagagtgccaatttcttcttcaaacaatttcatttgacataatttttgccacttttcacttgtctttgcatcaagtgatgatagaaagcttttaaaacgttattattattttttttaatttattttattaataacggcggtaccggtactaaaaatttttgtccgttatataaataaataaatcttgtcgcgctccattgctcccgactctcgctcaacggatatgataataattaagctagggttggtccccttaatcgacgcgggcttgttttttctaaaaattgccccccccgtcgaggggtttgctcccctatattttttaaatgcttcagccatgcccgataaattttgtcgccgaatttcatcaccaattcccgactttctctccccaagaatcggggaccaaccctaatttacactttcaattacccttctgttttgcctaaatccaaaaatatgccggcatcaattcgcctttcctccggcactttgccaatcatttcgttcaaattttttatctcattgtccaaaacgtgtttttcctctccaactttcttgattttggcgtcaatttctgttttttcttccanaaatttgatctctttc

SEQ ID NO: 37064 - DNA, 891 bp, Heterodera glycines
  misc_feature (792)..(792): n is a, c, g, or t
aaaatttcagatttttcgatatcgcatttttagtctatgatatggtttaaatgtttttttttattgaagcattcatgacttttagttttgtttccttgtatttaagtcgggtttgaaccaaaaatgtgttcggaaaatttgaaatttcgacttttggttcgaattcggatccaggctgcggagttggtcgaaattgacgccatttcgcatcacttaccctccctctcttttcttcatttgctgttggtgctgttacctctccattctctttcagcgcctttttgctgcaactcacctcactgtgctgctgttctgccgccaatccgccccgatcgccgctgctgcggtgtgtgactttttgtgttgtgttcgactcgactccgtccgtccgcaaatgacaacaacgacgaggaccaacaccagggacagcccgagacgtgtgctgatgcgccagttcgaaatgctgctgcagaactcgaacgccaacagcggattccgtgcgtgtctcaacgatggcaatgtgagagaatcagcggccgaactgatctgatctgatccgcttttccgttacgcatatttcagtcccatccctttaaacagatcttcaaatggcgcgttttcatcgatggtcctccggaaacaccatagtgagtgggcggcggcggcagaggaaaagtgcaaatcaatcaaattaattgtttccccattaatccctcctctccccttttttagcgcgggatgcacgtttacggcactgctcaattcccagcttcgttcccgttttatccgccnaacatgactttcctcaccgacattcttcatccgaacagtaagaaaagcgcgcatgaattcatcaaatcccagcaaagcccccaccgttcccttttcagt

SEQ ID NO: 37065 - DNA, 1198 bp, Heterodera glycines
tccttcttatgagaatgaatattaagattgtttaaaactcttctagcaattttaaattaaaattttatttattctatatgcagattctcttttgcttaaaaaaaataaaacgaatccaattaatcttaaatgaactttttttatatatattctttaaagttttatatttgtaagtgaagagaatttttggtgttttttgtcaatatattttggaaaccgatcgataagttttattttttatctcaatatttggttaaataatattcttgtctaataacattcctttcaatgtgaagcataattgaatatttgagattgatacgattcaaacattatttattatactgaaatatatttctttctattcttattttgattttttttattacccacctaaattattctttacggataataaattataatttttgagtcacttaaatttatcgactctcttttgttactattagtgtgacttgtagaatagtataaattgcgaaaacaaaattgaattaccgccattaatagtagttttatttttgtaattttttgtgattactaattttttacactaatttcaattaaagatttttattggcattattcttattttattaagagtttgaatgatattcgatatatattatttttacgcttaatatattatcatttttctagactatttgggtttattgactcgtttttgtcactattagtctagtttatatgggagaatttttatagcaaacaattcttttctatcattttctctttaagcattaatttaaaaaattaaattaaagttgttttcaaattttctaggtttgtaaataaattatatttcaagattttcttataattcaaggattgactcacaatttcttttttaatctttattttatttcaaaaatgttataataaaaataataaatttatttatatgtatgtaatatttaaaatttatcttctttaataatctattctaagaatattatatttatcattattttaattatttaaaaaaaatattctaaaaattaatattatctttattttatgaggcgcatcttcatttaacagaatgaatttaattatttttaataaattaacttcagctttaataatttttgaatatcaaatcatcatcttttgtttatataaattcagttacgcttaatattattgatttatttttttt

SEQ ID NO: 37066 - DNA, 1020 bp, Heterodera glycines
  misc_feature (902)..(902): n is a, c, g, or t
attattaaaatcccgaaatatttaaataaatatttaacgaaaaatgccgaattattgaccaaaacattgaaaaaagtccgaaacattgagcaaatatttaagaaaaatgaaaaaatttgtggtttaaaaaataaacggctcataacactaccaaaaaatgtattcattgattattttaatttttaaatttttttaaaggaagaaattgggctaaccccgacagctgattaccaaattcaatcattgatgcttttctttctttaaaattttaaaattaaatttttttcccatcccatttgctaacactaagcctcaaaataactgactttcaatctcgtatttcaaaaattcgatcatcttataattgtcttgttcatcaattaggtccttgattcctttgatgcgttgtccattttggtcttcatttttgtccgtgtaacttttcacacaaatattttcaacaacatccgcctcaacatcggcactagattgcgtcatatttgtgccatttaaggcgtcctataattagtttttgaaaacctggcacaggaatttttgaatttttaggacataaatattttgaaaaattaactgaaagcttgttataaatttaaatgaattaccgttgtaaaaattttcagtttggtttctttgaataacattgtcttaaaattctgttcaaataacacatctcttcgtccattaatgaaatatgcttaaattttaatttatatttccatccttctcttgtgaaaaaggcttttactaaaaggtatagccaaaaaccgggattccggggctattaaaaattaatgaatcgggaattggcatgatcttccagaaaaacgtcaggttttcgaattggaattttgtgaattgttggttgactttaatttttttanaagttttccaaaaaaacataccaattttcctgtctgatttgcaattggagggtagcaaatttgaaaatgattgcgaacgccttcaatggctttaaaacgttgcaattgccttgatttt

SEQ ID NO: 37067 - DNA, 1722 bp, Heterodera glycines
gtgttgtaccacgtgacgaccagcgccgcgtcggcacctttcgcggccgcgcctgccacgccctctggaatttgtttgcaattttgtttttattttcccttttttttggcattttgacatgccctgcagccatcgcatcatttggtccaggaaatagtcgccgttggaatcgcagcgcacgtaattgtcggacgcggccggacacttgcgaaagcgaaagccgaagaagctggactcgggcatggtgccaatgtcgggcccaatgtttgtggccgtgccacggccaaagatggactggcgcatgatcagccggtagtaaatgccagccctcaatgccacgttgctgctttgcggaatctacggcatttagtcagcgtatagtaatgggcttgcaattagaattttattgcaaaaacttaaccggcattttggggaccaaaatttgtgattagccatgcttttcaattggagatttaaattgaaaattaaaatttctattttaaaggaataaaatattgctggtcatttaaaaaaatttgataaaatgaatttttttaaaataacaaagctccaaatggtcgaaaatatttattaatttttgccttttctgacccaattttgacaatttttagaaatttccttaaaattaattataaaaatattgcaatccttcggtttcttttaaattcaaaaaaacaaaaaatgaactcaattgaaaatgaattcaattcaaactaatcatttcaattctaagtaaggcaaattttgtttttgtttggctaattaattcctttaaatagattaattctttgtttaataattttaatatcattctgaccagtaatattgatcagcactaattacatattcatttacctgctgtttgcataggtaaggcgcgatcattgccgggtcctgctgtcgtggccaatctgtcgcttcggggcccacattgatggtcggcccctggtccaacacagtcgcaaaagccatgtacccgttgacggaaagctggcaaattaggcaataattaattttaatattaaattaatattttgcctttcgaaacccgagaattcattctttatgaagtctaaactcttctaccaactccaattttaaactcaggtcccctggcttttcaaagtatgataataataccgtagtgtaattgtaaagaccaccgtagtaagggaaatacatgtacagatctgagaatggcatgtgctttattttttcatgccattggcatgaatcacttgccgattgtttgccctgcggtcaaaaagccggggtgcactttgtggtcgccaacctcgggaccaaatggcaccaaatttactgtaaataatgccgaattgagcatttcaattttttttggacaaacccccgtaaagcaaattgtctgtgccaccggtgaaaagcgtggcaccaccgccgggcccaatgtttggcccggcgccagcgacgggtgggacgccacctaccccggcgggcatggcaccgggcccaattccgccggcgccaaaatcgccgccggctgtgccaccgagcgacggattttgcgggtattgggcaacggcaaattgcagtgggagaaaaatgagcataattaatgaatttgttatgaagagcaacagcataatgtgcagaaaagatatacaagggaagggcgaaggcattacgtaaattagtcacgggaaaattaccttaattaatatg

SEQ ID NO: 37068 - DNA, 810 bp, Heterodera glycines
tcagcttaatctcatttatatttctcttctcctcatctgtccactcattttaaaattcatttgtttaattaatttttccatttatttccctttgtcttttcccaggagggcggcactttgttggcgcccgaccgcgccgcgtatttgcgccatttcaatgtgaacgtcgtcggcaccgtggccaccaccgccgcctttttgccattgctgcgaaaagcggcggcaacaaattcggagggccaaacggaggagcagcaggcggcgcccgttgtccgcgtggtgaacattggcggagcgttgggatgcattggcaaagtgttcttaaagccatcggagtgtccgtatcagaacatggcctatggcatgagcaaggcaaaaacaaaggggcaaattgatggaagaagagacaatcttaagaaatggaaaaaataatttgaaataaaagcaaaaaaataaaataaaggggtgaaaattaattttcttaaaatgattattgattttatttcactaaaatttccaaaaagaaacgttttactattgaaaattttttttatttttttctccgattttcaatcaccaaaaaacttctgcaaaactttttaaaattttgcaaaataatataggactcttggggctatagaatggataccaagaatgtttaatttggatgattcaaaaaaagttatggtgcattaaattgccaaattattttatggtcgtgtgaactgaaacagagccaaaatttcttggtaatagtgcattacaaccaattgcattgttatgtaacatgctacaaacagcagcaatttt

SEQ ID NO: 37069 - DNA, 859 bp, Heterodera glycines
aattacgtcgcgcataaaaattgaaaaaagataaaactttaaatttaaatgaaaattgctaaaatgtgaaagttcaaaaaatgccatctcatcatttcacattaaaaagcataaattcgcctaaaagaaactaaagtttccaaattattttaactagataaaattccaaaaaaaaaacgctaaaattctcccaaaaagaggcaaaaaaaacataaaattatctattttatatacataaaatgccaacttttggcttggtaaaaaaaatggaaaatgccaaaatcccacaatagaggcaaagaatacaaattttataaaatgccaaattttgcgtgagaatgaataaaaattttcaaaaaaaacgtgccaaacaaattttgaaaaatgtgccctcaggcgatgccaaaggcgacaaaaaagtgggaaggattgattaatgccgtgccgtcgtcgtcgcccttttggctgcaaaattggttggtaaacgcactcattgactgtcttctgtttgtggggctgcctgttggaggtggtgggaccttattaacagtaatttatggtgccggagggcaaaaagattggcaccccccggggggaggggggaagccccaggggagaaattggggccgagaaacagaaaattattaaaatttctttatttttattcgaaaacagcattaaaaaggcatttatatgatgatgaatggcaacttatacaatcattttatttgttcgttgtttaaactttttttcaaatttaaaatcttttaaaaacaattaaataaaaaatggcaaaaaattatttgaatgtatttaaaaaaaaaaaaatttttttcattaatttaaaaaaaataattat

SEQ ID NO: 37070 - DNA, 459 bp, Heterodera glycines
  misc_feature (244)..(244): n is a, c, g, or t
ggggggggggggggggggggggggggtgttttatttaaaaaaaaaaaaaaaaaaaaaaaataaaaaaaaaaataaaccccccccccccccccccccctcccctctttattaaaaaaaaaaaaaaaaagaggagggggggggggggggggggggtggggggggtgtgtcccccccccccccccacaaaaaaaaaaaaaaaaaaaaacaaaaaaaaaggagggggggggggggggggggggggggnggggggggggggggaccaccccccaccacttattttttttttttttttatgtgtataaacccaccccaccacccctctctttttttttttttttttccccggcggcggcgggggggggggggggggggggggggggggggaggaaaaaaaaaaaaaaaaaaaaaaaaaaaaaaaaaaaaatttttttttttttttgctttttttttttttttttt

SEQ ID NO: 37071 - DNA, 1127 bp, Heterodera glycines
gaaaaaggaagccactgtcaattcgagatcgggactgttcgttctgccctcattctgtcgccgagccgtgacctggcaatccaagtgtttgaacaaggacggaaattgtgcaatggtgggcaccgtcgttccgttcgatgcctttaatcgggttttttctgtttaggttgcgatgtatctatttcattgtcttacggtgaaacagtgagccgcgaaaacattcgcaacatttccatcgatggctgcgatattctcgtcggcacgccggaccgtacttgcgattttttccagtccaaaaatgtcagaaaattgcttgtttcttcgaaataattcgtctactccttccttttagctcatgttcgaccttttgaaggtgctcgttcttgacgaagctgacaaactgttggacgaaagtttcattttggatatgcgtgtacttggcagtatgccaaattggcctacggtatttcataacaaaatatttgtttttttaccaagatatttgcaatgtccccacctcctttagactgagttgcgccagactctttgtttctccgccaccttttcaaaagatgtgctgaaatgggccgatgaatttatgcgccccaaccccgtgttagtctccaaaggaaaaatcacacccaacaaacgcatcaaacaaacatttgtccttgccgaaaaagccgtgaaacggcacacactcgtccgactgttgcaactcgagaaggaacagaacgaacaattggacagtaagtggacttttgaaaaagtgcatgttcaaaacaaaacgccaagttttcaggttccaaaaaactgcgtagcaccatggttttcgtcaacacgcgcatagataccgaaattgtgtgtaattttttgacctctcgagggttctctgcgaccacaatcagtgggtgcgttctctcattctctgctgaacttcactttgtctgattgcaaatgcttttttagtaggcgtgcccaaccaacgcgcgagaaggcggtgtgggacttccgaacgggcgaattcccaattatcgtcacgacggacgtttgcgcccgtggccacgacatcaaaaatttggagcgcgtctgttaatctaccatttattaagagggtggagggggag

SEQ ID NO: 37072 - DNA, 1192 bp, Heterodera glycines
  misc_feature (828)..(828): n is a, c, g, or t
  misc_feature (843)..(844): n is a, c, g, or t
  misc_feature (852)..(852): n is a, c, g, or t
  misc_feature (861)..(862): n is a, c, g, or t
  misc_feature (890)..(890): n is a, c, g, or t
  misc_feature (968)..(968): n is a, c, g, or t
  misc_feature (1001)..(1001): n is a, c, g, or t
  misc_feature (1046)..(1046): n is a, c, g, or t
  misc_feature (1050)..(1052): n is a, c, g, or t
  misc_feature (1055)..(1055): n is a, c, g, or t
  misc_feature (1059)..(1059): n is a, c, g, or t
  misc_feature (1085)..(1086): n is a, c, g, or t
  misc_feature (1093)..(1093): n is a, c, g, or t
  misc_feature (1099)..(1099): n is a, c, g, or t
  misc_feature (1129)..(1129): n is a, c, g, or t
  misc_feature (1144)..(1144): n is a, c, g, or t
cttccactttctcttcactttctgttcctcttccactttctgttcctcttccactttctgtttctcttccactttctgttcctcttccactttctgctcctcttccactttctcttccgctttctgttcctcttccactttctgctcctcttccactttctcttccgctttctgttcctcttccactttctcttccactttctgttcctcttccactttctgctcctcttccactttctcttccgctttctgttcctcttccactttctcttccgctttctcttccgctttctgttcctcttccactttctgttcctcttccactttctgttcctcttccactttctcttccgctttctgttcctcttccactttctcttccgctttctgttcctcttccactttctcttccgccttctgttcctcttccactttctcttccaagaattattattttaatatttaaaataaattatttttaataaactaaattaattttaaaaaaataaaatcattcaaaaaatttaataaaataatggatgaaaacacccagaataggtgggacccgaaccgtcgaccaccaccaccaaaggcaaaaactaaaaatgtatgctattaaaacagcaataatttagttggaaatatttattgaataaaagtaggagcagtaaaaaaggcacttcccggacccggatccaaacaaatcgggagaaaaatagtaaaaagaggggtaaaatggaagactcagagctgtggtcgaaaatttgtcaaaatttggagctaatatttaaaaatcttcgggagtttttggcgcgggcggtgccgatntgcgccgccgggtgnngttttttngggtttttnncgttttttgttggggggtagcctggttntttgggcctttcctctttttcccttcgttagcctgccgcccctccccctttttatgtgtgttcgttggggctcgtggnggtttctttttgtggtggctgctcttccgggtngccgccttgggcgtgttcttgggttgccgtgccgcctgttgcggntccnnnttncggngtggtccctttcagccgtggcccgtnntccgtcnctccgntggggccgtcctttcaggggcccgtccttncgtccagccctgctncgggcctctaaggccctccccccgcgaaaaaattaaataaaaattaga

SEQ ID NO: 37073 - DNA, 57 bp, Heterodera glycines
gtcctgagtggcaacttgatggccgcgaccgatgattccggcgaaagactccaaatc

SEQ ID NO: 37074 - DNA, 1168 bp, Heterodera glycines
atttattgcgatgtgaagtttaaattaaaaattgttttatttaattttattaattattgttctgcattttgtttgagcttaaaacttattttaatcatcgcctaaagatttacaaatttcacaatttaacttattttttgatttattcatttaatccatttgaacataatttaattaattctatttgcaactagtcgcattgccgcttagatgacgatattatttcattatattatctataattcatttcaaaataattatgtaaaaaatcgaattattatgcataattaattttgaaaattatttttcattaaaatttaaaataaaactcaaacgctatccatataaattatataatttaaatgtatttcttaagtgaaatttcctttcaatatttataaagttctttttattaatcattgcaatatgtccgaccttattcttctataaaaatggtgttttggtaattaatcctattaaaatgttaataatttttaaatgcaattactagagaaagtattgtcacacattttacaactaaaaatgtagaacttacttatatatgcattttttaaattaattttcattcaatttttatttatatcataactttccttatttattctctaagtgtagatcaaggcaaatattcacaaataaatctaaatattctaaatttttccattttttcaaacaataaatttgcagtcaatttaatccgaaatccatcaatcaatcaataaacaatcaataaaatcaatcaacctttatacgcaaaagcgcgacgccgatatgagatagttataattaatgttatagtgctttgttgaatgataaataacttatatttttcgttatattcatgttttaggtttcatgttatttagaattctgagttcattatttgatttattcatgaagtttttatttaaagttagaaaagctcaacaagtggatccgatttttttataaattaattttatttttatttcatatttttcagcatattttttaatataattacattttggtattattacacggcttttaaagtattataaaattaaatattgtttttctattttattgactaatttagacaatttatttcatgagatacaatttaatttttataccaattttttttcattagcaaaaaagcatatgc

SEQ ID NO: 37075 - DNA, 922 bp, Heterodera glycines
agcttcacatgaattatgtgcataaaattactgcaaaattatgaccttaaaggggattaaagaacagagataatttgtttaaattctttttttttttgttcattcagcagaattctgaccccaaaatattttctcatatacgtagaggctcaaagaaaatgcgtaattgcatcaattgaagtgcgtcagcagaaaatgcttaagtaagacagtaatttttaaaaattaagaatttttagaaattaaaaaacattttctttaaactatgtaatttttgtttttctgttttggtaaattctaaaaattatcagcaggtggagtcacagtcggacttgatttttttttttggcaaaatgaataatttttgatcgaaaaactgttaaatagctggtgcccaaaaagttttttcaaaaatacgccgcaacaaaaagttgttaaaatttaaaggattcggaaatataaagtttaaacgttttttgttcgaattaatttataaaaaatttatttgaagcaattttaaatcaatgagttctgagtaggaaattttctctgccacatttaactatatttaatcacctgtgaatttaacctttgatttattttgtatttcaattgtattacaactcattttgtatttttatttggtcaaatttatatttgttttctttttttggcaccatgtaagagcactaatgtgcctttggtttgctcgataaattaaattaaataatattataagtttttcattaaaattgtttatttttttcattttatcgagggcacaacttgccttatggtcgccatatttgttaattttatacgaaattttgcttttttaagcgaatttaatttaattttcaatggctccgcccgtcgaaaaaaagaaaaagttttcttccgccgaccatttcttaattccttc

SEQ ID NO: 37076 - DNA, 833 bp, Heterodera glycines
attttcaatgaaaaccaatcaaattgatatttttaacttttttaattgaatgatataaattgatttaaaaaaatatatacaattgttgcgatttgaaatcaatttatttgcacacagaggtggagccgtcccgggtggagcagttggtcaagggagacaaggcggacatgttgctgtaccaaccgcagtttgcggagcgtggcgtcagttttgggagcagtggtggctcaacagtcggtgctagcgttacggcaattgtcaaattggtgccccatttttttgggatttttgttaggcaaattaaaattttttttgtaggaaatgccacccattccgatcattccaagcgagcggacggcacagccccatcagcaacaacaacatcggattgtgccaccgcctccgcctggtccgccgcctccggcaacgcatggctcacaaagcggcggtggtggtggggctggcggtattcaccatcaaccgagtttggaggtacaattatgtagggtttactcgtcattttttgccatactatgctattaaaatgtacgtattggttggataattaatgaaagattgactattttttaacacatttgtgcggggtttaaaaaaagccatagttacccattaatctctttttttcaaaaagcggtttttgactattatctgttcttacaagcacctttttcgagttagagcccctgggctataatttggaatccccctcaaaaaggggctttatttcaggggggggggttgtttcaaggatacgatatataccaaagattcctaccaattcaaacttcgaaaccggtgattcgcgaatgtgt

SEQ ID NO: 37077 - DNA, 1161 bp, Heterodera glycines
  misc_feature (1149)..(1149): n is a, c, g, or t
atcaaaaacctttttaattttaccattttattcaacaagttcaatctcaaactaaatatattcattaagtgtatcataatttttaagatagttcaggattaaaatacttttcagttttgaactatagtcaattcgtacggaacttgtcgacaacgcctgttcaccagcgctttaaaaatcaaacaaaaatactgataaattataaaatagtcttaattatcaaattaattacaatttgtaaggaataatagccagtatatcgtttgcaaaaatatttatatttttgttttcaattttcttcaaatgcaaattttatatttatcataaaaagctactgacataataaatcaattttattctatgtaattaataaatatttaaatgaaaaattttaaaagcatcattcttaaaatataagttagttattattttaattgtattataaattttgctactcgaataaataaattcgataaagatgtgtattataattcattgagttatagtaaaaaataatattcaaatacttacgctttgaattaaacattttttttttgtaaaatggaatagatcattaaaacaatgaatataaattgaatttatatataattaaagaataaaattttctccagtaactaagcatataagaaataaatatggataagacatgaaataaatcaatacaaaatcaaaataaatactattaaatattaatgaaaaattaaaagaaacaaatgaaaaaatttacttaccaatcaccgatttgaatgttgcgaaaaaatgttgaagaacgttttaatgaaatctaactaaaaatttctaaaagtacgtgtaaaatatgacctttaatagaaattttaaatttaaaaaagaattgaagcatataaaaatagttttcgcgggttcggcaagtttttgaaataataaacacagaatcaagaaattaaaaaatagcgtgattaattttattctacatttttaacctttaatagaataataaaattatttttgttccaaaacaatttacaaataaaaaaatttgaacaataaacaaaaaaagaatatcaaaaaatgaactttgctcattaattaaaaatattttttaaaaaatattactaaactgtattaatataattgagtgcaacaaangtttaaaaggtt

SEQ ID NO: 37078 - DNA, 1000 bp, Heterodera glycines
gtatttggtgcgtattaaactcaaattaaaaacctaaaatatattaaaaaataaaaatatagaaaattttattactaactaacataaaaaaaataatacaaaataaaaaccaacgaattccgccaaattttgccacattttccgtacttccgtctgtcttgagcaattcgcaaaaattctatttaagcaaagtaaagacgaaggcaaccaatcaagctacaaacacattcattcatacatcatacaaaattttctgcgtttcctacgcttctctgctgctctccgccttcgccattgtctctctgctatgccaatgtttcacttcgccaccccttaaaaccatttaaatttaatttgaactttggcaccctttaaaaatcaatttcacagatttgctttagtgttgaaagcttgcgtaggaatttaaaagtcagctgagcttaatccccggctgtcgcagcgacggtggcagtgaatttgtgaaggaatcaacgcgagtctgccccaaacggacggtaggaaagtgatcagcagtcatttactgccactgattaaacatttgttgcttaagtaatatttcctctttcttttcttccgtccttattaaacgaattaacgcactaattgcccctttaatggccatttgacagcaaatgagtgctcgcgcagtctccgattcgtccgtgccatgttcgacgtcgccgcttttcatgccgacaatgacagcgcgtggggccaattggcggcccaatttcggcaccaaacccaactgattgacttaaaattgacgcggcattggcactggccaagtgcactttagcaacccgaaaggtaaaagtatttcaaagtgacgtgaacagttatgtttaaattattttttagctggaaatcacgcgcaagtgcccttggtggacaatgtgattattgcccgcccttcatgggcggctctcaccgccatgacaattaattagaatttagtaaactaaattattttttatat

SEQ ID NO: 37079 - DNA, 759 bp, Heterodera glycines
  misc_feature (750)..(750): n is a, c, g, or t
aggaatatatttttaaaagcattgatgacgctgaaagtaaaggagcacctattctacctgaggtcctcaataaacttcaaataaatagtcttcctgatcatgaacttaaactcaaaactaattgtgttacaaaattaataagaaatttaaacgtaaatatgggattatgtaatggaacacgtttacaaattcttgatatcgaaaaaaacgtattaagagttatgatcttaacaggagacagaatcggagaaattgattttatccctagaataagtttaatagaagataaaaaattccgtatgtacttaaacgacatcaatatccattaaaattagctttttgtatgacaattaatagtgcacaagacaaacttttgagaaaattggtgttgatctaacacgagatgttttcgctcatggccaattgtatgtggctttatcaagaacacggagctgggaacgaattaaaatcaaatattccaatgaaaataatgaaaaaaagcaaagaatatcgtatggttggaaactttaatataaatttcgatttttataaatttaaatatttttatgtttttaaaggagcaaataaaggtaagttaatcgctgcattaacggggagagtgcagcgtatgatagggcgggacataagttgtccctttaactatcatttaaactcccagctcctttggtacccaatgctttggtgcgttctcgccgcgggtatcgttagtaagctttatgctgaaactanatccaaagc

SEQ ID NO: 37080 - DNA, 1599 bp, Heterodera glycines
  misc_feature (1381)..(1381): n is a, c, g, or t
  misc_feature (1462)..(1462): n is a, c, g, or t
  misc_feature (1500)..(1500): n is a, c, g, or t
atctcttctttttgtaactgtcatattttgcttagttaccactcatcatcgtttgcgaccgccatgacatggtccaagatttggtgctctatctctaccgcagcaatctcatgaagtcaattgaagtttttgtcagcaaagtgaatcccaaacgactgccaattgttgtgggtgcattgctcaacgttgactgcagcgaagaccaaatcaagcagttgattcaaatcacacgtggcaaatttgacatcgatgaactcgttgaggaagtcgagaagcggaatcggtcgggcttttggattacatcctaccggtttaccttttatttttagtctgaaacttctgaactcgtggttggagagtcgtgtccatgaaggaaaccaggaccaggcaacccataacgcactggcgaagatctacattgattccaacaacaatccggaacgctttttgcgtgaaaatcaattctacgactcgcgcgttattggcaaatattgcgagaagcgcgacccgcattacgctcttttggcatacgagcgcggtcggtgcgattctgaactcattgcggtaaagaaatagttacaatttggttgattggtttcctttttaaaggtttgcaacgagaattctttgttcaaaaatttggcccgttatttggttcgtcgtcgtgacagtgacctgtggggtgttgttttggcagaaagcaacccgcaccgtcggcagctgatcgaccaggttttgccgtggctgaagtttagcaattaatttgtccttgacaggtggtgcaaacaactctttcggaaacctctgacccggatgacatcacaataacagtccgtgccttcatttcagccgatttgcccaatgaactaatcgaacttctggaaaagatcgtcctcgaaaattcggcgtttaccgagaaccgaaactgcaaaatttgctgattttgaccgccatgaaagcagactcatctcgtgtgatggaatacattcaaaaattagacaattacgatgcgcctgacatcgcaaacattgccatcacggacaaactgtacgaagaggcatttgctatcttccgcaaatttggggtcaatgcgtcagcaattaaggtaacattttatagtaatcatattccatcactcgactttaatttaggtgctcattgagaacgcaaaatatgggcgaagcaatttcggattggcttggacagagacggcgctgtggacactgtcggatgtcggcggtgaatagatttatttcttttcattttgaaattccctttttagttcctgcgcatcttcaacgcgatgccgcaaatcgtcttccgcacccttattgatgtgatcagcttgtctcatcaaataatcttcagatgaagtgtttanatgaggaggacttaggaaaacgatggagggtaatattatagatggtggccattttttgaaggaaaatttgttctctataanaagtcgtgaaaacgtgttcatgggagtttctggcttgnagaacctaatgctaacacctattttgacaaatttttgagtccggacccgaattcgaataaaaagtcgaaaactcaaattcattttatattcccatctgc

SEQ ID NO: 37081 - DNA, 1103 bp, Heterodera glycines
caattgccatggcatggatgacaccaaattatgtcagaaacaatgccaacaacagaaacaataacaatgtgccacagcaacaaagaccagccggatcagtgtgacaacgatcagtaattactgatttgtgatcaatcacatgaaagatttttgctgattaaaaaaaaattaattctttggcataatgtttcaatctcaaatttcaccaaaaacatttttagattttttccaacatttgcttaactgtcccttatttatgtatttatttccttgtaattttttaaataaaattgttttttattatggaatattttctttctttttttccccaatggcacacaaggacaaattcataccctgatttatttacaaaaaaaaattaaatagctcaagaatgttgtgcattatactggcaccggaaaacaaaaaaaaaaaaaaatttttttttgaaaatttccatgattaaattggtcgggatgaggcaacaaagtctgttggatgaactttcatcatgggacagcagggatgtaccagggctgaaaaattctctgaattgtttgaaaaccgataaaattcttgaaaatctgctaaatttggcatttttttttggattttcaaaaaatttaaacatttttttgtcgtagaaaaatctattttttttcatatatatatatatatatatacattaattgtagtttctgcatcttttgccattttcttggtgcatcgattttctccgtttattctcaacattctacgccgagcggtcgttccgttacatccattaaatttgtcacctcatttttagtaatgatgcattcattttatacacccttaagaatctacctaaaaaaatttcaaaaaatacacccctaagaatcaagctaaaatttttcaaaatatactcctatgcaatgaaaaaaaattttctcaaaaatttactttcttggcaaaaaaatttaattttaaaaatttttttaggtaactattttgggtttttttgtcttaaaaatcccagtcctacgcatttgcaactgcaatcagtgaataaaaattatttttgatcgatttttggctgaaaattatgtcactattcgtcacta

SEQ ID NO: 37082 - DNA, 979 bp, Heterodera glycines
cacgtacacgtggttaggtgagtggtatttggggtaggaaagcaatacttcgtaagggatttggtggacatcttaacaggggaaagatgggcatttggccatggagagaaagtcgagagtgattctcgaatgtggcttttcgagactgactcccgggtggtttatatgaattttcgagactgattctcgaaatgcctttgctttttgtccctcaactgaccctcgagtccgttggccttccatgtttccattatcagatcggccacctttttgtttgcttctgtccccgtgacgtgcggcttctcagcgaatgcctccaaattggccgctattttatccgaattgatattggcgaagatggacgaacggatatcttaaatcagttcacttacaaaaatacattttccatttcatttctgaccatctgtcccaaattccttcggtttttgctcatattttgtcgcaatttgcgtgacgagaattgcgatgagaagggaaattatggtgatcagactgagaacgaccaaagcgacggaaagaagggcttggcaacgcgaaagtcgaaaagaattcattttggagaaaccattggagaaaaaggaaataattagaaaaaattagaaaatcgaatgattaattaacagaatgattagttacggaactgtaaaataaagtggcaaatcgaaaaatgaatcgaagacaacaattgcattttgtgtgtatttattaaaaaatccttatcaaatggctgatttcttagtcggttgataattttaattgagtttaactgcagagattaataataaattcatgaataatgaaaaatactaaaaattgaataaatttcgttttgaaattaagctctagagaacagactgatttttaggtttttaaatatttttttacggatagggtgctaggtcgtttcgtaaattccaccgccatgggcgttttcgtaaatccgcccaaggggtaaaaa

SEQ ID NO: 37083 - DNA, 947 bp, Heterodera glycines
  misc_feature (8)..(8): n is a, c, g, or t
  misc_feature (887)..(887): n is a, c, g, or t
  misc_feature (922)..(922): n is a, c, g, or t
aaaaaaancccaaaaggactattttttctcaataaaaatttttgttttaaaaatttgttcttatctggaaaaaacttaaaattatttaataatttcatttacaattgaaaatttttatgtgtttgctacctaaaatttgctgtttttttctgcctttttaggtgcttatttcgcgattttttgtgcttaaaattgaagtgagttatgaattttcaaatattagcgtaaatttccgaggcctaaaaattaataatatattcttctttttttacaaacctcatgccgtaaaaattttgttatggggaaaaattttttggcggggggcttaattcgaggaggctttatttttcaacagggaggttttatttcagaggggggctctaattcaaggggggggggctataattcaatgaattatgtggaattgaataattatttattttttgttgcaagataaaattggatcaattaaaagccatcaattttgctcctccgttttttcagcgcattttcgcctgctatgcaattctctaaccaatgagacttataatgaatgaaaagcattttgaatttcattttgttaaacctttatgtagccactgtttaaagacaatattttcggcaaaaaccaattttggcacttcagcagcaattgaaaaaagtttgaacaatttttagtggttttcctttatttctatgccgcatgcactatttcttccgacatcctttcttccctttctttgcttctctgcttgtttcagcagctgttggcggcgttagcgtaccattgttgtcgttattgtgcccattacagtatttttccggcacagtaagcgaaggttcggttgttgtctgcttgctcaggataacataatcacgaccatccngtccatcatggccaaacctgtgtgaaagaataaanaatttacagtaaaatctgaattact

SEQ ID NO: 37084 - DNA, 972 bp, Heterodera glycines
atttggctgtgtatcaaaattcagagccctgcgcaccccttttggagtctcgggtaactgtgtcttttatgagaattataaaatgccaaccggagttttagggcatatttcccagcaaattggtccaacgcatattttcatgcatccttttttggtgccagacttaaaagggaaatgaaaataaaataaatttaaaagatattgtgaacagtggttgaagcacagaagaggagcaccaaagcgaggctaaccaagaaaaaggagcgcatttttcgacttttcaattctaaataaaaaattggaaaaatgagtgactttttggatgttaattgatcattattatttcgtgctatttatagtctcacatttgctcaaaaacgttcttcgcatatcaattcgacattaattttttggaaaaataatacgaaaatgtcagaaattaattcaatggaataaaggacaaaattaaaacacaaacatatttcaattatcctcacaaaatcagcaaatcgaaaattggaatggaatgaattattttcatagtgaaggcgttgacaaaaagcagaaggatgcggaaaataatttataaattattatttttaccatttttattaaattaatggaattagccgaaaacgaaattttcgaaagtgttaaaagaaaaaataagtttgatcgacaatttatttccaaataaaatattttttaatgttattgtccgcgttatatttcatttgttttattgtacaaattaaaaaaaaatgattttttttataaaaaaaattaaatacatagtataataaaaaaattagggattcggaatatcaagaaaacaaatttgaataatttttctagcgattttttaaaaattttatgatgaattactaattgtttcaaagatttttctcaaaaatcgctgaaaattaattttttaaatttaaatttacttcccctcctcacaagaaagcccag

SEQ ID NO: 37085 - DNA, 75 bp, Heterodera glycines
cctactttagcggcgcgttgacggtgaaccgtacggtggcgcgcgtcggcgggaaaaaactgatgcaaaccggca

SEQ ID NO: 37086 - DNA, 1378 bp, Heterodera glycines
  misc_feature (48)..(48): n is a, c, g, or t
  misc_feature (51)..(53): n is a, c, g, or t
  misc_feature (69)..(69): n is a, c, g, or t
  misc_feature (72)..(72): n is a, c, g, or t
  misc_feature (98)..(98): n is a, c, g, or t
  misc_feature (108)..(109): n is a, c, g, or t
  misc_feature (115)..(118): n is a, c, g, or t
  misc_feature (120)..(123): n is a, c, g, or t
  misc_feature (126)..(126): n is a, c, g, or t
  misc_feature (129)..(130): n is a, c, g, or t
  misc_feature (136)..(136): n is a, c, g, or t
  misc_feature (140)..(141): n is a, c, g, or t
  misc_feature (145)..(146): n is a, c, g, or t
  misc_feature (157)..(157): n is a, c, g, or t
  misc_feature (160)..(160): n is a, c, g, or t
  misc_feature (163)..(163): n is a, c, g, or t
  misc_feature (184)..(184): n is a, c, g, or t
  misc_feature (190)..(192): n is a, c, g, or t
  misc_feature (196)..(196): n is a, c, g, or t
  misc_feature (199)..(199): n is a, c, g, or t
  misc_feature (201)..(202): n is a, c, g, or t
  misc_feature (204)..(205): n is a, c, g, or t
  misc_feature (211)..(212): n is a, c, g, or t
  misc_feature (216)..(216): n is a, c, g, or t
  misc_feature (240)..(241): n is a, c, g, or t
  misc_feature (248)..(249): n is a, c, g, or t
  misc_feature (257)..(258): n is a, c, g, or t
  misc_feature (262)..(264): n is a, c, g, or t
  misc_feature (267)..(267): n is a, c, g, or t
  misc_feature (269)..(269): n is a, c, g, or t
  misc_feature (272)..(272): n is a, c, g, or t
  misc_feature (278)..(278): n is a, c, g, or t
  misc_feature (285)..(285): n is a, c, g, or t
  misc_feature (290)..(291): n is a, c, g, or t
  misc_feature (294)..(294): n is a, c, g, or t
  misc_feature (300)..(300): n is a, c, g, or t
  misc_feature (314)..(314): n is a, c, g, or t
  misc_feature (326)..(326): n is a, c, g, or t
  misc_feature (329)..(330): n is a, c, g, or t
  misc_feature (336)..(336): n is a, c, g, or t
  misc_feature (338)..(338): n is a, c, g, or t
  misc_feature (344)..(347): n is a, c, g, or t
  misc_feature (357)..(358): n is a, c, g, or t
  misc_feature (363)..(363): n is a, c, g, or t
  misc_feature (366)..(370): n is a, c, g, or t
  misc_feature (376)..(377): n is a, c, g, or t
  misc_feature (381)..(382): n is a, c, g, or t
  misc_feature (384)..(385): n is a, c, g, or t
  misc_feature (391)..(393): n is a, c, g, or t
  misc_feature (396)..(396): n is a, c, g, or t
  misc_feature (403)..(403): n is a, c, g, or t
  misc_feature (406)..(407): n is a, c, g, or t
  misc_feature (409)..(409): n is a, c, g, or t
  misc_feature (413)..(413): n is a, c, g, or t
  misc_feature (433)..(436): n is a, c, g, or t
  misc_feature (440)..(440): n is a, c, g, or t
  misc_feature (442)..(442): n is a, c, g, or t
  misc_feature (445)..(445): n is a, c, g, or t
  misc_feature (448)..(448): n is a, c, g, or t
  misc_feature (451)..(452): n is a, c, g, or t
  misc_feature (454)..(454): n is a, c, g, or t
  misc_feature (460)..(462): n is a, c, g, or t
  misc_feature (475)..(475): n is a, c, g, or t
  misc_feature (484)..(485): n is a, c, g, or t
  misc_feature (490)..(490): n is a, c, g, or t
  misc_feature (497)..(497): n is a, c, g, or t
  misc_feature (499)..(500): n is a, c, g, or t
  misc_feature (504)..(506): n is a, c, g, or t
  misc_feature (508)..(512): n is a, c, g, or t
  misc_feature (518)..(518): n is a, c, g, or t
  misc_feature (523)..(525): n is a, c, g, or t
  misc_feature (531)..(531): n is a, c, g, or t
  misc_feature (540)..(549): n is a, c, g, or t
  misc_feature (557)..(558): n is a, c, g, or t
  misc_feature (569)..(570): n is a, c, g, or t
  misc_feature (589)..(596): n is a, c, g, or t
  misc_feature (600)..(600): n is a, c, g, or t
  misc_feature (603)..(603): n is a, c, g, or t
  misc_feature (609)..(609): n is a, c, g, or t
aattgttttttttttacattttaaagaaatttgatccttaaattgccngannngcgcaccacgaaaacnaangggcccttaaaagagagcccacaaanaagaaaaggnnacaaannnngnnnnggnganngcaagnaaanngaanncaccaccaccnaanganggccaccaccaccacaaccangaggannngccngangnngnngaacannggcnggacgacaacaacaggggacgcannaacaaannggacaaannggannnggngnggncagacngagcggngacannganaaagcngaaaacgaaacggngaaaacggaaanaannaggacnanaaaaannnnaaaaaagcannaaaancannnnncgaaannaaanncnncagaannnggnaagaacnaanngnaaancccacaaagaagaagaaaannnnaagngnccnagnggnnangaaggnnncaacgaagaaggnggcaaaagnncgaanccccacngnnacannnannnnnggcaancaaannnaccaanacaaacggnnnnnnnnnngccaacanncgacccaaagnncaaacgcagggaccagaannnnnnnnaagnaanagcagnggaaaggccaatcacccaaacaaaaaccaaccgatattcaggccaatgcttgagcaacaggacagcgtgctgctcggcaagggaatggacgtcgtcgccgctgtcaacaatcggaggaccaccaccaccttcgggggatggggtggaggaggaaggcgatgaaatgagcagcacaagcggtgccggatggtattggccaaatgtgccacctccgcctgcactggctgcttcttcggtggccccacctaagaattacaaaaaaaaaaatgaaaaagcctgtaatttgataaataattaagaagctgtgggaatccaaaatagaaaatttgttgtcgagcgccatttccaagggtgcacatcgtacaccgccccacccccactcccctctccaaacacaaatatcggtccctttttaggtaaactttcttgacaaatttgaccaaagattcaaaattttccccggcggtgccggacgacaccagttccggttgcccctccacgaaatagttttttggatacgggactgaactcactcaccattcatccactcaccattcatcagcgagttgcgtcgttggcgacgcctgcgcaacatttgttcggccaagtaattgagcgtcctttcaatgttgtatttggtgcgtggaacggacttaaaaagggaggaaaggcattcaaaacaatccattttagatgttcaaagatatatggtcaaaaaaataagcaaaatgtaggaaaaaaagaaccgaaaatggacttgaaattggag

SEQ ID NO: 37087 - DNA, 960 bp, Heterodera glycines
  misc_feature (37)..(37): n is a, c, g, or t
tttttttggacaaatttttctttttaaaaaattgagnaactcaacactgatcggacttattttttacctttttgaatgaattttgtcattttacaccccctaaaaatgaggttttttaaagcccctattttcaattttttagtgcctatttttggggttttttagagcctaaagcctaactattttggcagttttttagagcctaaaaattgcatccctacccgtaatattaaatcatacatcttcattgcattaatggttttcttttattttcgcacaatgtttgaaacttttttttattaaggattgttttcgcgcaatgcatctttacacatattttagctataattgcttcagtttatttcgaaggtaaattttttaaacaatttaaaatacttttttaatttagtcgttggcccttactacccgtggctttattttatcgcctcattcacatgttatgcggcaattgcactaaaattggcatggattaagggtgagaaagccatgttaattaggttactgatcaattgtcaaaaaacatatagccaaatatttatattaacttttaaataaaatcaagcgtctaatcgcaattggaatacaaatggaacggcacaaaattcatctacggataataatagtgtgcggatcactgcgctttgctttacggcactaattttttcattgtgtgttacattgtataatttggcaagcaattccgaatggtacaatgaatttttgcactgtgattcccatccaattgggcaacagttgtattacccaatttttatgttcctgactttgcattatgtgttggatgaggcaagaaagcttaaaattatgttaattaatttcttggcataacatacactcaaaattggcatttctaattcaagcaaattcagctccttttgatggcactctgtagggaaatgcgcgtggaatttttgcgactta

SEQ ID NO: 37088 - DNA, 1138 bp, Heterodera glycines
  misc_feature (1109)..(1109): n is a, c, g, or t
ccctggtgcgggtcgggtccctcgaaaaactttcacaaaagattatcgtaaatatcaggcagccctgacctgactcccacacccccccccccggccaattgtacgtcgtactggaatactgctggttgaccccttacacacttgtggtcataatcagggctaaaaattttaaaaattagtattttaccgacaataaacagcaattggggtcaaagagcagcttataccccttgaaaacagcaaaatgctgataaatcagcagagttgagagccctttgatcataatgaatagggatgctaattttatgtaaatgtgccaaacttttttttaaaaaaattctcagtgacgaaacgatcagtgacgaaatgatcgaccacccatttttgttggacaaaatctgttcagaagtagattaaattttcaaaaaatttccggtgggcatatcggcaccgcctgaccgacaatttgaataaaaattaattaattcattttatataaaatgcatgctgattacattggcgggtttataaaacgtcagcatgattaattaattcccatggctcgaaattccaactcttttaccggcatataaattaatcacctgttgatacgtttcttatcgcgagaaaaagcaataaataaatgacaactgccattaaaatgaacaaattgactactgtcatactgagtaccataaggaaatgaattccctgaaaaaggataaaacattatttaaaaaaaaagaattttttttacaaaaaaaaaccttaaaaaaatccgcataattgccagtgatcatcaggtcaccgaacccttttacttcttggtacattgagacagcgaaaaaacatccgaaacacacacaaataattgtaatcactgccaaatactgtcgcttttttagtttatcgtaactaaatattatttctgtaacaaagaattacaaaaataacaagcatacatctccgaaaaagcaactgaaatcagtctgtcgatgccaatgaaaagaatgattggataaacgcctcctgaatttgaaatatattataattattttatttaaaatttaaaagtccctaatttttccttcgatcccaaacatatgaanaaaattatccttaaattttattgtaaaaa

SEQ ID NO: 37089 - DNA, 969 bp, Heterodera glycines
  misc_feature (887)..(887): n is a, c, g, or t
ttttgagccgataccgtattcggcaattttacccccccgtattaggcttgaacctggactatgaagtcacggtcccaacccttcgccccgccggtccattttccaagtcccggtggtgctggtgcgtttcttaaatccgccaatgggtttggaaacaaaaaatgggtaatatttataaatttgtagcttggctcaaattccaccaaattaatcttaagtgatattattcaatagctttaactgttctctttcagaatataatttttcaaaaatttttccttaagtataaaaaaagttataaagcattgaacatgctatattttttgcaagtgtcatgcatatataatacaaacatttaaaatttaaaagtgtttaaaatgcaattgtcgcaaaattattttatatattcgatagcactaagaatctccatttgcctctaaaatttcagaaaatttcattgagtttcaaaaatgttctgggcaaaaattctgatttaagactttttgaaattttatgccataactttttttatttaagtaaaaaattaaaaaaaattctattcttatagagaacacctagagctattgaatggtaccatgaaatattaatttgagtgaatttaagccaagttatgaatttatttgtgttacccatttttgttttcaaacccattggcgggtttaagaaacgcgccagcacggtcccggtccaggcaattcaaaacttacgtaatctaattttaactcaaattttcaaatttttttaagttccggattccggtcgaaaacccagatccaggtccagtaaagtcccagtacggttttgcaaaaaattcctggtaccgtaatgctctagttgtgttcaatcggacgacacccaactcgtcnaatcaacattgttggtatccttcgataacctaagtgtcctctattagcctgcaaaatttcgaaaatctcgtaaggttcaaaa

SEQ ID NO: 37090 - DNA, 928 bp, Heterodera glycines
aatgaatttgagcccatttgaattatatatattattgttctttttgttgcggtatcaacttttatttgtgtatgcatttaggataaatttagtgattttctgaaactgtaattggctaagactgtttaagaaactgccaaataggaaccgtgttttcagatcctaataaagctattctgagaagcgtttcggacccctgaccgggttcgaaccaaaaatcagaaatcaaattttcgtcaaattatgcaataaaaagcacattttttaaaattaatttttcgtatgtcatatacatgatcggcacccccacaaagtgtccaagccacgaaatgtccaaaagaataaaaacccacgaaatgtccaaaatttttcaaaatttataaaaacaaaatgagtctaatttaggatttttagggttttcggggtcgctgaatacgaatataccatttatattatgagacttggacatttcgtgggctggacattttgtgggtcagcgacatgatcagaaaccctggaagtgtgatttcatctgtgtaagcacaacgcatttatagaacatctttaattaaatctataaaaaggcaattggaatgttgagaaagtgcaaaaatgggaattaattaattaagcagttggaatggttgaaaataaaaattctttttgcaatttttgtcggaggcgtcagtcaattctttttggcactacgcgcgtcagtgcacgcctggcgaatccactgggcatgagggccacgaaaactgtccaggcaggtggacagacagtcgcgcccggccgagtccgggttcttcagcggactgaactcctcgtcggccgacaccacccacatgagcacattcctaaacagaaaaaagcaataaaaaactaaaatagaattattaagccggattaacttgccaaatatttttaa

SEQ ID NO: 37091 - DNA, 1011 bp, Heterodera glycines
taatacccctggggagaagggagtgggaaacatgatttccccccctgaattttttctagtctaatctactcaaaacggctcagaattcaataaaaataacattcacggtgcgaaaaatggggtttgacaagtttattggggaaaaaagactttacaaaataatacccctgggagaagggagtgggaaacatgatttcaaaattttcaattttttctagtctaatctactcaaaacggttcagaattcaataaaaataacattcacggtgcgaaaaatggggtttgaaaagtttattggggaaaaaagaatttacaaaataatacccctgggagaagggagtgggaaacatgatttcaaaattttcaattttttctagtctaatctactcaaaacggttcagaattcaataaaaataacattcacggtgcgaaaaatggggtatgaaaagtttattggggaaaaaaagactttacaaaataatacccctgggagaagggagtgggaaacatgatttcaaaattttcaattttttctagtctaatctactcaaaacggctcagaattcaataaaaataacattcacggtgcgaaaaatggggtttgacaagtttattggggaaaaaaagactttacaaaataatacccctgggagaagggagtgggaaacatgatttcaaaattttcaattttttctagtctaatctactcaaaacggttcagaattcaataaaaataacattcacggtgcgaaaaatggggtttgaaaagtttatttggaaaaaaagactttacaaaataatacccctgggagaagggagtgggaaacatgatttcaaaattttcaattttttatagtctaatctactcaaaacggttcagaattcaataaaaataacattcacggtgagaaaaatggggtttgaaaagtttattggggaaaaaagactttacaaaataatacccctgggagaagggagtgggaaacatgatttcaaaattttcaatttttt

SEQ ID NO: 37092 - DNA, 891 bp, Heterodera glycines
  misc_feature (878)..(878): n is a, c, g, or t
tgcgtgagcccttcgggtccaactgttgcacaaccggcgccgcctgtggagtggggaaaattgaattggttacacatattttctattcaattcacttattttcccatgcaaaattatatttatgataagggcatggccagagccttggctttttttgttttttgctcttcgtcctcttattttttcgccacgattttccacaaaatttttgaagggtacggttaagcccaccggaaaaatttaggaattttgcctacttttaataaatttttccaaatttggcgctttctgggtcaagtaaggcccctctctcccgaataagtggtcttaaaaagtgtggtggggccacaagttttcttttagaaaattcattaaaaaaacgaaaaatttaagaattctgggattttttttttgaaaaacaacctagtaattcatcataaagttaaaatccgagaaatttttttgtttaatttggaaaacttggccccggttgaatgaatacatggttttcagtaccacaaaattaaaaataaataaataaattttgccttttcactccccccccccttcggcattttcgctgttgtgttcaccaccatcaccaacctgcatcatcgtttccgatgtgtatatgaccaactcaaagttggggtagccgaccatgtcgagaaagtagtcgagcgcgggtcgcttcacaaagtaatggccctttttgtactgaagcaaaattaattaaattttcaaatggaaaaatgtagcggaaattttttaataaaaattttttgttttggtggataaattttaaaatcaaatttttgaaaagaattaataaaacagacaaaggtttgagtgtttggcactaactctcattgatttgngaggagaattttc

SEQ ID NO: 37093 - DNA, 1520 bp, Heterodera glycines
  misc_feature (802)..(802): n is a, c, g, or t
  misc_feature (835)..(835): n is a, c, g, or t
caaattggacgaagggctcacaaaaaagctaatcgaatctttcagagaaaacaatctaacagaagtgggtgattaattaaataattaatagggactccatttttaggcataaaggcacctataagtctgaaaaaaattgcaagatatgcattaaataagcacaaaaataggcaaaaaaattctttataacttttttgggcagcaaaacacataaaaacttaatcaaaatatttaaatttggttatatttcattgtaaataaaataatttaaatatttcaaattttcgaataaggccaaattttaaagacaaatttttatagagaaaaaaaatatattaaattttaaaggatcaatttttgggaaatttttttcaattcttgtgggtgtattttctgaattttttggtcgcttcatatggggtaattttttgtaagcataaaaaccccgaaatagacaaaacttgcctaaaaatggagtccctaataattaataaaaagtaaatcattattatttccacagacttctcaatggctggaaaatttgtgccgaatggaagcggcggttgaattgacaaactttggcatttttctgattttgccaagccacacttggcaaagtgtcggggccgaacgtcccaacagcggtgaatgacttattcgaaacaattggcaccacagaaattttggaacaaattaacgatccctgcgacacaaattgcattgatcagatggtgaagcaaaagttggagctgatgagtaagccattaagccgaagtttaatactgcgattttaattcattanaagactaaaacataaataaaattttgtttttanaaatagcattttcctttgttttattcgggttcgtttggccatttggatgtcattttcgcgatcatcgccactctaaaaatgccataaaaccttcattttttaaggccattcatattaaatttcagaccatctgaaagacaatccacgatgactgaactaaaaggacattgtcgaaggaaatgattgtccaagtgaataagtgtcttacagcgacggagaatatcaaaaaatatgccaacgaaaattttgctgttcctcgggattttgaaccgcattctcgacagattgaacagttcggaatttgcagaaattttgctgccaaaattgtcaatggaaaaggccaacggcgatcaatttctcaccaaatgtcttaaagctttgagtgccgattatgaatcattcgaaaagagtgttcagaaggaattggccgatttggcaaaactgcgcaagggccaattggaatgtgtaccgacaaaaaactgaaaatggccgaaagaggggacaaccggcacagaaaagccggccaattcagttatccagcaatttccatatttaagggataaatgtgttttttaatcctcttttctttatgttttgttgtctcattgattgataaatttctcccaagaattaaaaaaaataattaataggataaattttaaattataaatataatgtgccaaat

SEQ ID NO: 37094 - DNA, 896 bp, Heterodera glycines
ttctttattaattagagcaatgatttcttactaatggcgtaaattgcctgtttaaaaagttcccacttggttggatttaattaaattttcttaactgacatataagtaaaaattgttgaaattttaataaattaagtttgggtgattttaaatcactgcttcaacattatcacatttgtagataattagtgatagtatcttaaaagcgttcctaaattaaaaataaatttctactcaagactcacgatgtgtggtgggtgatataatctcttcacatcaataaaatttaaaccttttttgggcatttgccctaggttttggcgtagttaatttttttttttattaatttttgtttttaaggtcactaagacttctttctttttagaaaatttctgtaatttttctagtttttataaaaatttcatttaatgagaatatcttggaatgagtttctatgacttctttttttagaaaattattgtaatatattttttttatttataaaaatttactcctaaaatgagagttttgtccccatcattttttaaattcctcccatttgtctgggaatttcctgcctgatccataacttatctccccgaagctcgggacgcaacaatagattagaattcatttgtttaatttatctttttttatgaaatctgattttatttgcaatttatccattcttggccaactgtttttcttcaaaaatttctttcttaaatgacacgacatttcatttctattattttctctcaaaaaaattctttttgtttcaagactctcgatctgccctttctgcatagcagaattaattagaaatgatagccaaaagtcccaatatttgaattttgccccctcccctaccccattgatgggagagatttgttgat

SEQ ID NO: 37095 - DNA, 968 bp, Heterodera glycines
  misc_feature (934)..(934): n is a, c, g, or t
gctgtagattcattttgaatgctgtgctttacttgctcattgtggtgatcagaatcggagccacaacggccaatgccccgcggggccaaactttcccatttaccgccaaatcattttgcagttgtcgctcgaccactggaactgccgggaacattctaagactttcccgaatgcagcggtccatgtagcgcagttcgttcacatccgctggcttaaacgaaatttcctccacaattcccttggcattcatttcttggcatttggcatcaatttcggcatggataagccgttggtattggggatgacacgcaatgcaccacaatgtccagatcagagcgtgggatgttgtgtcgtggcctaaatgaaaaagccgaatggaaaggaacactttaattaccctaatcggggaaagggtcagcagaaaaatctaaacttttgatgccgaacatgataataatattaatcgttttatccaattctttaccttttattttttgattcatctttcacacttttctattttgtgtcccaaacatttgtttctctcctaatgggcggttctttgatctcctccctctttaattacgccgcccgggatctttctctcgatcactcttaattcacatcggtcctttccgccggcattctctgtttccgagaccgaatcgggtagaatggcctaagaattgtatccttccccggaataaaggcgttactgttggatactgtaccatggggcataatgggacacaaaggacgctccagtaatccaagacattcaaaaaatagcaaattttccgggagggggccgaatggacctgcgaacatgaacgtgtccacctgctcccgcaactcttccggctccaaagtgtcgttgccctccatgtccaacaaagtgtcaagaaaagagtctccgctcttcttagccctttcnttttgtcaatgctttcgctgctgcgctcgaattt

SEQ ID NO: 37096 - DNA, 793 bp, Heterodera glycines
  misc_feature (101)..(101): n is a, c, g, or t
  misc_feature (122)..(122): n is a, c, g, or t
aaaaatgcaataaaaaatgaaaaaatacaccccccctagggatcgaccttttttagaatttttttgagcgatcaaaagcagctttatcgggattttttcgngatggggaaaaggggacgganttaaaaatcaaaagtaattttttttttgattaaaaaaaaagtgtttaaaaatgtttttaggtaaattttgtaaatgagaaggaattcgatgttgaggaattgacgaaatttaacgagaaagcgcaagagctgaagtcgaaaaacggaagaagcaatgacaagccaaaagtgatcggaaatgaaaagactgtgcccaaaacggacaatggcggacagaaaagaggtcaaaatggaaaaagatgggcagaaaaaagttggcactggggcatcaacagtgaagaagactagaaaaggaaccgatggcaatagcaaagagtgatcggagatgaaacagactgatcacaaatcaaaattatgctcagagtatattattgttcattttttgcaaattggtaccgtacaaaccagttacagtaggaaactaaatcaatttttactgattttgaatatgatgatgacgacagtgcattaatgatgcctcaactcaacatgctaattgttatcaaaaatgaggcggcgaaatattagctaaaaaatcgcccgatttcgatcagcgttttttcgcttccattttctgctggtccttctccgctattttggtgatgttcatctctattcggatcatcattttgatcagcagtagcagttgtacggcagacccaaccccaaaa

SEQ ID NO: 37097 - DNA, 240 bp, Heterodera glycines
tgcggacatctacatttttgaattgaaaaaaaattggccttactctttctttttctccatattgaccatcatactcatactttccccaccctttccttctccaaccctctcctccctctcttgatagtttaaactgaaggcgggaaacgacaatctgatccccatcaagctagcttctgcaggtcctgctcgagcggccgcccggggatcgatccccgatctagtaacatagtgacaccg

SEQ ID NO: 37098 - DNA, 502 bp, Heterodera glycines
ttgaagatttggggatttgatcgaattttgccgatttaatgggggccattgagtcagcgtttatcatttgcatctttttaatcacagtgtgttcattaaagctcatcaaatcggtcaattgactcacggcacattcaaaaagactctttttctttttgtgatttgggtaaacattgacaaaaaaggaacgacgaagaagaggaaaaagacgagaaaggaggaaagaaagatggtgattatggtggtgcacttttgatggccacttttggccgattacccttaaagtgccccccccccaccgccgcgccgtccctttctttgtaaggtgacccctccccctcttcccctcttttgtaagcaaaagaatttgccggccgaattgttggttggttgggattggtgctgctactcttgagtggtcgagcgggacgggcaccttttcaagagttgagaggggtggggggaggggaggggttgattcaacagtggaggaatgaatgct

SEQ ID NO: 37099 - DNA, 999 bp, Heterodera glycines
ctcctccgtctttccctccgttccgtccctcttcacaaaggtgaccaccacctgctcgtttccgttctcgtcctttcctcgcttgacttccatctttccgtcccctccggcgccgttcgtcacttccacctttccattctcattaactctcacttccggcactgtctcctcctccttcgtcttcccttctttcccttcgtttgctttctctccgcctgcccattcggtcagtttgtcctttctcagcttcacttcctttgcttcttcgttcatttcgaccatcgcttccaaagcttccaagaaaagtcccaagtcgaattgtggcggtgccttcggcttttccttttcgatggtctccaattcccaaaacattttggccagtgctcgttggggctctgtcagctgtgagtcgagtgatgccaacgaattgcgcgggtccttccattgttccagcgacgaaatggccgaatcaacggctttcacatccgattggacggactcatcttaagggacagccaatggaacaaagcaaagggtgaggggaattacctgggatattttgcacattgagaagcagaggaaggaggaggagaagggcagagagagccatgccaatggaaaattggcagaataattatatgggggcaaaaagaggtataaataagagttcagaaggggaggagcgaaagaaggaaaagcgggataaatccaataataggggctaaatcaatggatggatgggcaaatgagtggtgagtgggtgcatgcccatcaaatgtgcttggattgtgttttttccattcggcgagggattgtgtgggttggctgcacacacgacactgctggtgacttggcaatttcaaaatgatttcttatgtttggcattgttaagcgggggggggggggaaagcgcatgaaaaggtgagtcatgccaatgccatgccaaatgatcccatgaccttcggcaggggcctgcacatgcattaaaattttatcgaa

SEQ ID NO: 37100 - DNA, 1033 bp, Heterodera glycines
agaaggcgaatggccgggccgaaagtgcaaaagaggtgggtgtagggagagagatacactgagggaaagagccgaccgatctgaggcatttggaaaaaccaattgctgatttgcgggagggggatggggatgaatatatgatcagagtgattaggctttaatgatcagaaacaataaatgagttaagcttttctaactgtccccttggctgatcaatggatttgaaccttcttctgaccgttcattctctgatcagtataaattttttttcttcttgaccaccgtttttctataactgattctacctaacgaaaaatggccaacaaaataaccgcaggagagctggacaactttgtctcctgctgatcaccattgcttttttacaaatctgacacatttaaacatttcaaaattcactcgtttccccatttcatccggataacaatttcttgaaggcatccaaaaatatgccgcaaactccaaatccatatacagattgattatccaaatcaatgacttttctaatcatttcccccggtcatacgatcccccacaaatccgctcattccaactgattagcattgcgattgttacgccttgctgatgatcattttcatcaccgtctcatcaccgctcatccgtatcactcttttccaccaaaacactaattagttttgccttatgcttaattcaatttgtcttcctttgatccccccgcccctcccccgccaataaatttattttagccgaattattggaatattttatttcttttattcccccaccgacacatagcattaacctcttctcttttttttttgctgtccatccctccaaaaaatgcggggaattgggtcgaaatgtttgttccgttcattccatcattttggtgatccgctaaataatgcaatttttctcccatttctaatgacttttttgatcgaaccgcagggcgatgcgcaatttgtttaatttgctgtccgttcaccgccccccccccatcccggtcgaatgatcagtttgattttatgat

SEQ ID NO: 37101 - DNA, 740 bp, Heterodera glycines
tttagggaggagagagattgcaaatcaacattgtgaaactctcgtaaataaatgcagaaaaaacaaaaattacggggttttcttagaatatacgccctggggagaggaagctatgcttcgtcttggttttacgtctcataaaatttaaggcacctattaatatcaagacaaaatttagtacggtataacaacactcgcttttaacctatttttgacaacatggcgcccacaccttgctcactgttgcgctccccccgaattccatgcttccggtcaacatccgttgcagggcggccactgggccttgatgggacactgaaaaagaaaaatatttattgataaatttcatcgttttataaaaaaaatttggtgattggaatagaaagtgccaaaaccccaaaacgcaccgatcaaaatgtcgccgtagcatttggcgacaattttgcggaaggtgtcctcaacacggggaaaacatccatggacgcctttgcctttctggaaaatatttgaaaaaatatattgtaatgtttcgagttccgacttcgctttccggaggtgccaagtacatcggttcgtactgccggttgatgttggtatatctgtgaaacttttttttaaatgtggcgtatcgttttgtgtccccaccgctgtgccaattctttgcccgtctgaaacgaaattttctgtacaccggaacgatcgcagatcagattagatgactaaaattcattagaaccatg

SEQ ID NO: 37102 - DNA, 1065 bp, Heterodera glycines
  misc_feature (45)..(45): n is a, c, g, or t
  misc_feature (48)..(48): n is a, c, g, or t
  misc_feature (64)..(66): n is a, c, g, or t
  misc_feature (68)..(68): n is a, c, g, or t
  misc_feature (93)..(93): n is a, c, g, or t
  misc_feature (95)..(95): n is a, c, g, or t
  misc_feature (97)..(97): n is a, c, g, or t
  misc_feature (121)..(121): n is a, c, g, or t
  misc_feature (136)..(136): n is a, c, g, or t
  misc_feature (140)..(140): n is a, c, g, or t
  misc_feature (143)..(144): n is a, c, g, or t
  misc_feature (146)..(147): n is a, c, g, or t
  misc_feature (149)..(149): n is a, c, g, or t
  misc_feature (153)..(153): n is a, c, g, or t
  misc_feature (158)..(159): n is a, c, g, or t
  misc_feature (173)..(175): n is a, c, g, or t
  misc_feature (179)..(179): n is a, c, g, or t
  misc_feature (194)..(195): n is a, c, g, or t
  misc_feature (198)..(198): n is a, c, g, or t
  misc_feature (204)..(204): n is a, c, g, or t
  misc_feature (211)..(211): n is a, c, g, or t
  misc_feature (234)..(235): n is a, c, g, or t
  misc_feature (237)..(237): n is a, c, g, or t
  misc_feature (239)..(239): n is a, c, g, or t
  misc_feature (242)..(242): n is a, c, g, or t
  misc_feature (247)..(248): n is a, c, g, or t
  misc_feature (253)..(253): n is a, c, g, or t
  misc_feature (256)..(258): n is a, c, g, or t
  misc_feature (263)..(265): n is a, c, g, or t
  misc_feature (270)..(270): n is a, c, g, or t
  misc_feature (284)..(284): n is a, c, g, or t
  misc_feature (295)..(296): n is a, c, g, or t
  misc_feature (301)..(301): n is a, c, g, or t
  misc_feature (305)..(305): n is a, c, g, or t
  misc_feature (311)..(311): n is a, c, g, or t
  misc_feature (317)..(318): n is a, c, g, or t
  misc_feature (321)..(321): n is a, c, g, or t
  misc_feature (325)..(326): n is a, c, g, or t
  misc_feature (331)..(336): n is a, c, g, or t
  misc_feature (342)..(343): n is a, c, g, or t
  misc_feature (345)..(348): n is a, c, g, or t
  misc_feature (353)..(353): n is a, c, g, or t
  misc_feature (356)..(358): n is a, c, g, or t
  misc_feature (362)..(362): n is a, c, g, or t
  misc_feature (366)..(366): n is a, c, g, or t
  misc_feature (370)..(370): n is a, c, g, or t
  misc_feature (381)..(381): n is a, c, g, or t
  misc_feature (386)..(389): n is a, c, g, or t
  misc_feature (396)..(396): n is a, c, g, or t
  misc_feature (402)..(403): n is a, c, g, or t
  misc_feature (422)..(423): n is a, c, g, or t
  misc_feature (426)..(426): n is a, c, g, or t
  misc_feature (448)..(448): n is a, c, g, or t
  misc_feature (453)..(453): n is a, c, g, or t
  misc_feature (455)..(455): n is a, c, g, or t
tgaggtgaattgcgctggctttctgatggatcctcttaacggaangancatccatcccaaagcnnnanccggcagcttttacacccccccccncncnaagccacacccaaagaagaagcangagaagcacccccanaggnggnngnngnaccncaggnncggcccccacagcnnnaaanaaggaagaaaaaacnngancacganaaagcanaaaagggaaagaggaaggcaggnnanangancaaannaaaancgnnnaaaannnagggnaggagacaaaaccnaaaaaaggccnnaaaanaagngacaangcgcanncancggnngacannnnnncccaannannnnaaacnaannnaaanaaanaaanaaggaaagaangacgnnnnaagccgngggcanngaaagcaaggcgccgaaannggncaaacacaaacccacaacaaancaggngnaaagcgacggattaagcttaaccttcccgactcctttcagccgatcggaggatcagcagctttgactcggttggataattcgaaggcattttcgagcgtccatccaaaacctgcaaacatttcgcattaatgtgacaaaatgtgaaaatgtgcaaaaaatcggcaacgatatttctaaaattgtttttcccaattttatttttcgtcaaatttacaaaatgccaacaaacgatggaaggagggaaccgagtgaaaagtgagaagcaacgaagccgcgcataaccaaatcctaatattgtcttaataagcagtaatggcggaatgcgcgaacgaacagatgacactgcacgtccaattcaacgaggacactttgcaaaacggacggttcaccgattggataatcgtacgaagggaatgccaaaatgggaatggaattatattttgaaaataattcaaaataaaaattgaaattgaaaccccaaaaggtgggaatgacaacgcgacccgaatgtcgcctgaagggaaacggcgaactccgctacatcgtgcaaattgccgttctgaaggacccatgggccaccaaattaatggcccctggcaataaattgaa

SEQ ID NO: 37103 - DNA, 1016 bp, Heterodera glycines
  misc_feature (10)..(11): n is a, c, g, or t
  misc_feature (812)..(812): n is a, c, g, or t
  misc_feature (949)..(949): n is a, c, g, or t
  misc_feature (958)..(958): n is a, c, g, or t
  misc_feature (963)..(963): n is a, c, g, or t
  misc_feature (968)..(968): n is a, c, g, or t
cttttcacannttctttttgaatttaaaaaaagcattggctaataaggaaatgttatttttcatgctttttgaaataaaaaatttgtcattctgatacatttcctcgtgaattatttaatgaattatcgtgttttaaaatttcaattttaattgataaatattattatttaagcggttttaaaaaaagaaattcctttttcggtgaaaaagtccattttacgtaaggctatttttaggagcacaatttcgagaaatcctaactgcttttgttaggttacttttcgagttcaaatctaccactaaaaatttttatataaaagttttttttacaaataatttagaatttttcaataaaaacagccaaaaaaatgttcagaatattaaaccaattagttcatccttgtaaatattaatcattttcactaaattagttcatatttttgtatttttagactttaaatgggtcatcataattcagcgacgttcctttttggcttacttttaggtaagaaatttaaaattatttataaaattataaattcaaatattatttttcttttaaaggttattttttgcccgaattggcggcacagcttagcaaagatgagcaggattattgcgtcaaattcagcaacaatcttcgcagcaatgtggccactgggaatcagcagaacaaaggcggcggcaaattgccatcggccacgaatatgttggagttggcatataacgagacaattggccaaactgcgcaagtgagcgacaattttttattgaggccttgtggagatattcgtgctttgtcgtttcttanattcagccaagggccacgaatgattaaaaaaatgcaacacataaatcacaagtttaagcaaaatttttttaaaaaatttgaaaatcaataatctactagtgaattcctagagctatatatatgtataatgatactantaaatattnattangtagntgaatttgatcaaaatgaattgaaatgtgtacattttttagtttttat

SEQ ID NO: 37104 - DNA, 665 bp, Heterodera glycines
tttttttcaataaaaaaaaaaaaatatataggggaaagaagtttgtggggcgaacccgggaaggtcaaactaaggggttccggatatgccccatccttttcaacaaaaataacaatccaattgtgcggaacatccatccttattggtacgaagtcccattataggaactgctatggcgccaaaaaagggcaaaataaaaatacgcgtaaagataattaaaataaatttttgaatgcattcgttccatagaccatttaagcgaacccaagcaggatcagttgaccataacaacaatcagacaaaattccaaaagacgagtcgaccgctccaatgagatgccaaaatgtactccaagtaatgttccttaattttctacattatatcgctcacctatcatataaaacaaagataaaaagcagtcaaaatctcaaacgttcgcctttatatggactaaatttggttcacaccaatcatatatcagccacataaaattttggtcgaatggctcaatatagtcaccgccggaccccctgtaccccaaaaatttttttgcaaaaaccgcgccacataaaaaacgggtgtgaaaagcaaaaaaaaaaaaaaaaaggtcgtcgcccggggggaggtgccccccccccaagccaaaatcctgggaccgtccctga

SEQ ID NO: 37105 - DNA, 1080 bp, Heterodera glycines
aaacatcatctgggacatttcaccaacgaatttgttgaccaaatacttggctgtcgaccaaatgtccggcatggcgaacaaaaaattaacttcaatttttggtaatttttccaagattgggtcatgtagaccttatgtcaattctgtgacaatttgtcccatacacagcagggacattttaccaacgaatgacaatttgccaaaaacattacattttgagtgaaaaattagggccatttggataaaattgtcggaaaataaagccccattttccaataaattctgcttctcttgcaccggatcaaataaatccatcataattttttgaatttgtctcccccccccccttcctcatctttttgaaatggcgcgccaaatgcaataaattcaaaaatttattggactctctctgcccccaaacacctgccacttgctcctgctgctgcggatgctataactttttgcaaaatttgcctatcattgtggggaaatcgcattcatccgcttgctgcttgctctctgatgaatgggattttgccccgaggcgacacggcggtccatcttttccccgcaaaatttccccgaagcaaatgattcacttttgcctatcttacggggtgactcattaatgttgcgcggaagaagattgagaataaatttttttattatatttattttttaaaagcttttgatcgcaccgccatctcattttcccctcctaatttccccgaagcgatattccccgaaaaaatcattcatttttgcctattggacgggctggtgactcattaagttgctcgggggcagggggggggttgaaaaaaaaagttatttttatatctattttttaaaagttttaattgcatttgtcatctcctattccccgcaaagtttccccgaaagtttttcccggaagcaaatcattcacttatagccattttgcccgaggcattccgtccccgcaaatgattgccttaggcgatgtttttaaaccgaaccggaaaaacaaattctcttatcattatttaaaaatttcaattttttttgcttttaaatcggatatattattctggcaattaa

SEQ ID NO: 37106 - DNA, 856 bp, Heterodera glycines
  misc_feature (766)..(766): n is a, c, g, or t
acaaaaggaaaagactaaaaggacaaaaggaaaagcctaaaaggacaaaaggaaaagcctaaaaggacaaaaggaaaagactaaaaggacaaaaggaaaagcctaaaaggacaaaaggaaaagactaaaaggacaaaaggaaaagcctaaaaggacaaaaggaaaagcctaaaaggacaaaaggaaaagcctaaaaggacaaaaggaaaagcctaaaaggacaaaaggaaaagactaaaaggacaaaaggaaaagcctaaaaggacaaaaggaaaagcctaaaaggacaaaaggaaaagcctaaaaggacaaaaggaaaagactaaaaggacaaaaggaaaagactaaaaggacaaaaggaaaagcctaaaaggacaaaaggaaaagactaaaaggacaaaaggaaaagcctaaaaggacaaaaggaaaagcctaaaaggacaaaaggaaaagcctaaaaggacaaaaggaaaagcctaaaaggacaaaaggaaaagactaaaaggacaaaaggaaaagcctaaaaggacaaaaggaaaagactaaaaggacaaaaggaaaagcctaaaaggacaaaaggaaaagcctaaaaggacaaaaggaaaagcctaaaaggacaaaaggaaaagactaaaaggacaaaaggaaaagcctaaaaggacaaaaggaaaagcctaaaaggacaaaaggaaaagcctaaaaggacaaaaggaaaagcctaaaaggacaaaaggaaaagcctaaaaggacaaaaggaaaagcctanaaggacaaaaggaaaagactaaaaggacaaaaggaaaagcctaaaaggacaaaaggaaaagcctaaaaggacaaaaggaaaagcctaaaa

SEQ ID NO: 37107 - DNA, 1158 bp, Heterodera glycines
  misc_feature (139)..(139): n is a, c, g, or t
atttcgggattttgaaaaaaatttaaattttttaaattaaaaaatagagtatgattatgattgaatcaattctctcattaacccataatttgtcaaaatctccttttttaaaaacatggcttctgctttaatcctcttnaagctgaatatatgaaaaagtgccaaaatccaaaccgttaaaatttatttaaatgattgggcccctaaattatcgcaattgactccattccaggaccatcttgatcgtgaatattctcgtactgatttttcgctggacgatggtgaacagatgttgcgacagcttgactctgtccgtgaatacatccaacaattgcatgcgcgactcctttcactgaccgacaggtgagcaaaagcctaacattttttggcactttttttgccatggcatgtcattccaatttttttttaattaattttttttcaaggtgtgcccaaatttcaccgctttggcaacgtggcgaacgcatttcaaaaccgctgccggtgatggcactttgcgagtacaagagcaaggacaaaattcacatcagacaaggtgagaaatcattttttaatttattataattaatgaagcaaataaaataaaaaatatgggcaactaaatgcaagtccaatccatttgtttcgtagtccagtggttgttgtttactttgttttgcttaatcacgagcgttggttcggttccgcccggaaaatttgacgttttttaacgatataaaacagcgccatgaagattttcatttaatcaccatctttcggctgagaatttatgatggagtttttcttatctgagcgcttgaaaatccttttttctcaaatgcctatataaatattttttaatgtctattatttataaataggaatgaaatttttaggcacaaaaaaaaacaggcattaaacaggcacaaaaatcctttaataggtataaaaaaatgggtgcacttcattttccccccgcatcgttccccccccccgagaaattttttaaaaaaaaatttctcgggggggggggtggggcgaacgattcgggcgaggaaacgagctgctccctaaaaaatagacattaaattttttaaatttttaattagcaaaaaggcaaaacattttttgtttgtttgaatatatgtatttctattg

SEQ ID NO: 37108 - DNA, 714 bp, Heterodera glycines
taatatctgacggcagagaaggtttacagctgaaaggtatcatcattgatcggttgctcattaactgatcactttcatccccccacaaggcctttccctggagatcaaacgcgacattcttctcgaggcggccgcccgcgactcgcgcttctctctgctcgccgtgttggatgtgtttctcctcctctgcttctattctctcagattggcctttcgcgtatggccgtgactttttcaaatgatcgcgagtgttctctgctctttgggcttttacgcaaaattcatttttctttttcctttttttgcccttttaccggaccatttgtttgtccaccgcatcagcgctttttctccgccgaattgccccttctcaatttgatcgccctcgttttgctaatttccgttggcgccgatggcgcctttctcctcctcgacttattccctgcgacggagaagctttgcttgcgaactttgcactgctgccttaggcacaccgccaaaacgatgttgtctgacccaattttccaccgtaaaacaaaacggcactttctgccaattgcgaattcgttcacactgtccctttctgctcaacatgtttctcgagtgtgttcgcctttcggttgcttttcttgtgtcaatcctttccattctaaactctttcagctccttcggaatatttgctggcctcactctcttcttcaattaccttcttct

SEQ ID NO: 37109 - DNA, 962 bp, Heterodera glycines
aaatcgattttttcaagtgtccgtttggggtactcaaacaattatggggagcaaaaattcaacgcagaattaaagtacaggctatagggaagctactcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctactcccgaaggattcggtctccccataaatctgggcgcatcggttcggggggactgccccgaaaacaaaaaaatctattttttcaagtgtccgtttggggtactcaaacatttatggggagcaaaaatccaacgcagaattaaagtacagactatagggaagctattcccgaaggattcggtctccccataaatctgggcgcatcggttcagggggactgccccgaaaacaaaaaaatcgattttttcaagtgtccgtttggggtactcaaacaattatggggagcaaaaatccaacgcagaattaaagtacaggctatagggaagctactcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctcccccataaatctgggcgcatcggttcggggggactgccccgaacaaaaaaaaatcgattttttcaagtgtcccgtttggggtactcaaacaattatggggaagaaaaatccaacgcaaaaattaagtacaggctatagggaagctatttccggagagattcgctctcccccataaatctgggcgcatcggt

SEQ ID NO: 37110 - DNA, 857 bp, Heterodera glycines
  misc_feature (711)..(711): n is a, c, g, or t
  misc_feature (800)..(800): n is a, c, g, or t
ctctctttttataattgtcttagtgaattttggcggatatttggcggcggttttgttcttttggctcatttattcgctaattgaaaacccaatgtttttgtggtgcgccacacaaatcatttcctttgtgtcaggcataagtaccatgtcaaatgcgccaattctctattttacgaggcattatttttattttaaaatatttttaaaaaactttttaaattaatttagcaccgactatcgaaaggcttaccaaaaacaatttgcatttgtcttcagcggcacatcgtcgacagtgaccccactaaactgatgctgttggcacgagccatttttacaatgttataaaaatgtgtgggttcttaggtttcatttgtatttacctgttttttatttaaattatcacggaaaaaaacatttttagcccggaaaatcattattaaaacggaaccaaaagaagaaatgagtaatagtgatattaaaaagacaattgacatttggattggagaagcagaaaagtcagacctccagcaaagggaaatttgggtttttataggagttgaagaaaaatttgtaattgagggaaattttggtaagaaaagtttgaaatagtagaattatatattgttttttttgaagaaattgttggcggtctggcagaactcagaactatttattgaaaagattggcgaatttaatgttaactttttttanaatgaaaatttgtctagtaatataatatataatgtataaatgaagaatcaatatattcattcaatccagtgatctattccatttgtggntagacgaaacgatattacatgcaaagctgaatagggcatgaatttatatttatgaaa

SEQ ID NO: 37111 - DNA, 108 bp, Heterodera glycines
ctctagagtattttgcttattcgccattacattatcattgttaaaccgtgtccaccatttccgccaaaacattaattagcattcatttcaaagggtgagggtaagggc

SEQ ID NO: 37112 - DNA, 1021 bp, Heterodera glycines
aaaaaatgaaaatttgaaatcatgtttccactccttctcccaggggtatattttgtagtcttttttccccaataaacttttcaaaccccatttttcgcaccgtgaatgttatttttatcgaattctgaaccgttttgagtagattagactagaaaaaattgaaaattttgaaatcatgtttcccactcccttctcccaggggtattattttgtaaagtctttttttccccaataaacttttcaaaccccatttttcgcaccgtgaatgttatttttatcgaattctgaaccgttttgagtagattagactagaaaaaattgaaaattttgaaatcatgtttcccactcccttctcccaggggtattattttgtaaagtctttttttccccaataaacttgtcaaaccccatttttcgcaccgtgaatgttatttttattgaattctgaaccggtttgagtagattagactagaaaaaattgaaaattttgaaatcatgtttcccactcccttctcccaggggtattattttgtaaagtcttttttccccaataaacttgtcaaaccccatttttcgcaccgtgaatgttatttttattgaattctgagccgttttgagtagattagactagaaaaaattgaaaattttgaaatcatgtttcccactcccttctcccaggggtattattttgtaaagtctttttttccccaataaacttttcataccccatttttcgcaccgtgaatgttatttttattgaattctgaaccggtttgagtagattagactagaaaaaattgaaaattttgaaatcatgtttcccactcccttctcccaggggtattattttgtagtctttttttccccaataaacttttcaaaccccatttttcgcaccgtgaatgttatttttatcgaattctgaaccgttttgagtagattagactagaaaaaatgaaaattttgaaatcatgtttcccactcccttctcccagggggtattattttgttaagtcttttt

SEQ ID NO: 37113 - DNA, 881 bp, Heterodera glycines
ccccaaaaacaaaaaaaaaaaattttttcaaagggtcccgttgggggtcctccaacaaattaggggggcaaaaatcccaccccagaattaaattcccaggttatagggaagtttttcccgaaggattcgttcccccctaaatctggggcgcatcggttcggggggactgcccgaaaacaaaaaaatcgattttttcaagtgtccgtttggggtactcaaacaattatggggagcaaaaatccaacccagaattaaagttcaggctatagggaagctattctcgaaggattcggtctccccataaatctgggcgcatcggttcggggggactgccccgaaaacaaaaaaatcgattttttcaagtgtccgtttggggtactcaaacatttatggggagcaaaaatccaacgcagaattaaagtacaggctatagggaagctattcccgagggattcggtctccccataaatctgggcgcatcggttcggggggaatgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattgccgaaggattcggtctcccctaaatctgggcgcatcggttcggggggactgcccgaaaacaaaaaaaccgatttttttaagggcccgtttggggaactcaaccaattat

SEQ ID NO: 37114 - DNA, 1157 bp, Heterodera glycines
  misc_feature (926)..(926): n is a, c, g, or t
  misc_feature (941)..(941): n is a, c, g, or t
  misc_feature (1027)..(1027): n is a, c, g, or t
  misc_feature (1034)..(1034): n is a, c, g, or t
  misc_feature (1054)..(1054): n is a, c, g, or t
ggcggaattggaagaatggacctgacaatgggccaaggggagggggacgaagaagaagcattggatcaaaaacaaacgagaaaagctcaggagaatttgtgccaaaaatgaatgagtcgggagtcacactttttgctttgtttctgttatttcgcttcaaattttacgaatacataaataaagtaatttgcaatctttggtcttccccttttggtgggttggcactttgccatgccaaatggcgttggcagaatcgatgcccccgctgctgctgcacttttgggccattcccaagggattgcccccgggggcatcactcattgccttccctttgcttttccctttcttctctttgctttgctttttcgttgcatttttgtgcttccttttcttccccattcatttggttaacttttgtttgtctcttgtttatttgcatatttcgcgttttgaaaattgttttcctttttcgcattttgccacttaaacacaccgagtcaaaaaacgagacatgtgtcaatagagagagatcaattccatttgaattgaattgaattgtaaataaacttcactggttgcgatttctcacaaaagaattttcttttggcagttttttgtccaaataatcgcccacttcaaaaatatttaaatatatattaaaattaatttgaattcacacaaaaataaatatttaaaattggacaaaatgaaattagagtcaattaagcaaaacaaaaaacatttgccacctcatttagcaaattatgtgctcaatcattgatgagtcacccgtcgcaattggcaatggcaaagtcggcacagaaacacagctggtcagtgagtatggtggttcaacagaagaggcaatcaaaagcataagcacattcaatatacaaatacagcaaaagtgccaaataaataattanattacccataattanattaccgtatttttctaattatccctccggggggattattaagcaaattcagctgaatacctggcaacattttatttgacaatggntcttttnagttagctctagaggtttanaagaatttttttcgaaaaattaaaaattccatttatcccccccaggagataaatggagacagtgcataatagagtaaataccgtacccaaaataaattcattt

SEQ ID NO: 37115 - DNA, 197 bp, Heterodera glycines
ccccccccccccctccgggtggggggggggttttttttttttatattaaaaaaaaaaaaaaaaaaaaaaaaaaattattttttttttttttttttttttttttttttttggtggtgggggggggggggggggggggggcggcccaaaaaaaaaaaaaaaaaaaaaaaaaaaaaaaaaaacccccccccccccccccc

SEQ ID NO: 37116 - DNA, 768 bp, Heterodera glycines
gtataatttacaaattccctaatgatatttatacttccgattttgcttttgagaagttctcaactttcttccgttatgagtttttggatgatgtccctggacacttgactagatttcccacagatgatacacggtcatgcaacagcgaaagtacattgatgactggctgaacccatcactcaattctttgactttatcatttgttgccttctgccctttcagtcatttttctgatgcataccaatacatacttccctacttcccaattaacaacacatgtccacagaaatgctctcccgatagcgcgccaatgaatatctaacagtccaatgactgaattttacgaacctccatgtgtgtgtgtggttgcttggcaaatggaaaatggattatcggctattctagtacgcaaaatttcatctggatattattatataacgagagattaccgcgccgctctggacgcccacacaatttgattgtaccactctgaactcttccacaaaactcatagcaccagatgatctcaaactatgtatacattaattgctaaatgtgtagaactgtaggaagaagacgaatccccagatatgaatcatcacatatggcatacttattgagaaatgtgaacaatttggccctattagcccatcacaaaaaattgcattgaaattggtcaaaatgcggcaaattgggagagcaatgaactgtagcagtactccaacggaaatgtgtgagggatcgcaatcaatgcatgcaaatggcttg

SEQ ID NO: 37117 - DNA, 1276 bp, Heterodera glycines
tctgctaattcactacgattaagaacgtcttattattagtaggacaaaatttaaaatagttcatggacaaaaaatagcgaattaatgtcagaaacatcaaaaataaacagatatgagaagaaaaaccaaaaaattttttccagaatcctttgaaggccctcaattgacatttaaaaaacacgcaaacatgaattaaaattaaggattaaaataaatgtaattaacttacaaaaaataaaaataatttcataaggataaattaaaattaataacaaaaatgtaacgggaaaatatcctgatttattccatgttgatctgttttaaaaatgtaaacaaaaaataataatactccttatgaataccgtaaattgatttgcattgaaaaagaaaattcaactttgtgtaatatataatttaaataatttatattaatcgaattacttatttctattttattgaaagattattaataaaaatgataatttaaatgcatattcatataatctttattggctctataaaaataatttatttataaatatttttacaaattaaaaacgcaacatttcaatatttaaaaataaataataaataataaattttacatttatgaaataaattttaattaaaatttttgaaaagaaattaattaataaaattaatatattaaaatatccgtccaattcaaaaccgaatcaacaatgggtttttgtgtcgcagagcaagcaacgtcatgaaggacagctggcaaatttgaataaatataaaaccccctatattcatatgaaaaaaagataaataatttttgttaatgaaacaacagagattaaatatattcagagattttaagcaattttaggtaacttttgcgctttgaaatcatcctttcaaaaagaaaatcatccttaccactcgaaatcatcaaaataatgataaatcatcactagggctgccaatttgatgtaaatacatatttttttttcctggcttctccttgctctaaaaagcaggaaaacactttccttttttggtgtttgcgaacaaaaccccgggactttttatttaaatattttttacaaatttcggggttttttaaacttattaaaattttttcgggctttttaataatattttgggaaaatattttggaattttttccttaaaaaatttttccttttttttttttaaaatttcgggaaaaatttttttccaaaaaagatttgggaaaaaatttcaaaaaaaaacccaaaaattttccggcaaaattttttttttt

SEQ ID NO: 37118 - DNA, 896 bp, Heterodera glycines
  misc_feature (14)..(15): n is a, c, g, or t
tttttgaattcccnnttttttggaaaaagacattttcctatcgaaaaatctgttttgaaaaccttcgaagaaatttagaaataaagtcgaataatcgaatcccgaattcaggtgccactttctcctcgtcctgcggcaaccttaacccaaggtgccgataggtaaacttgaacaatttggtgaaacttgttttgcccacgaaataaataattttgaagctgatttgtgagttaaattattagtgtcaagaggaaaagctaaaaaaaaaactcaatatattaataacaaaaataattctttttaatcactcgaaatattttttcaaaatgcaaaagataataattatttttaagaagtcagatttgctgaacatttaattcaatatttaatggattggaacactttttaagttttcacgattttttccctttctattgtcattgtgtgtacgatgtcggataaacgacgatcattaatttactgaaacaaaacgtaggacaatgtccaatttccatggttattcgacgaattcgtcgggacgatgaattgaaataggaatgtctaataccgaaagtttaattgaaacatgaaaaatgacatgtaatgagagtacctaaatcatattggagatacgacgcaaattgaaattggacccgccggaaaaacggagacgaaaattagcgtaaatgggcaaaaagcgaaattggcacgggcagcatttgttgcttcatctccattgcagctgtaacccttctttcgtgatgattaagatgaagcgggcacatgcgcgtttgattggttggccgattcttttggctccaacgaaacgtgaaaaatccaagtgaaaatttgcgcgtcggtcgcaaaatgacaaattgtcacatgcgagactatga

SEQ ID NO: 37119 - DNA, 959 bp, Heterodera glycines
ttcgtttttatttattttttgcaaaattaattcttaaatattttttcagaaagggttctgaaacgcaccaaattttatttacatgttagtttaggcactctgatgctttttctatcaaaaagggagatgaataaaatttttaaaaatttttaattcctttttaaacaggccaaaaagtttaggcttaacttttttttcagaaactgatcagaagcgcaccaaactttgcagggatactgaaaggaagagaaataacctattttaaatattatctagtcagttcatttaaataatttttatccaaaaaatttttttttgggttttcggggcagtccccctgaaccgatgcgcccagatttatggggagaccgaatccttccggaatagcttcactatagcctgtactttaattctgcgttggatttttgctccccataattgtttgagtaccccaaacggacacttgaaaaaatcgatttatttttgttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgaaccgatgcgcccatatttatggggagaccgaatccttcgggagtagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttcttaggtgggtaattgtttgagtacccccaaacggacact

SEQ ID NO: 37120 - DNA, 980 bp, Heterodera glycines
tttaattattaatgtatgaattaatttaatttattttttatgcatttattcaatagtttagctatttgatcatgaattttattatacgagaaacttccgttatataacttgctgccgcaattttaaaggatctttcttaaagtttttttaggtcaattattattgttttatttatgattagatatccttttaaatgtatatctgttattttattttatttaaatattttgaaatttattcaatcatacctttttcattatttttttatttatttttttaatttaaaatcttttctctttttatacttttatttttaataaccaattttagtgtagaatcattaatctttctttgaagaattttttatttgttagcatatttattttttatttcatataaatttctattttgttagattttgatttttcgagacacaatattattaatttataaattcttcattttgttgttttattgattgttcatttttctgataaaaaaaataaatatcattttcttttttttcttattccattcaaagtttgagtatttgttatatattaattccacgaatagtttatttgacagtttatatttaatttattctcatattattgaatattttgaataataattgaactctttgttttttaattatgctctttatttttatattatacctccataagaattttaattaaataattccattaattattttagtttttttagtaataatttttatttttagtttacttggggtaaggagtgtatttccgagtatatactgcttgaaaattgctaataatttaatttatatattttaaaaaattatattttttcgtcttaagatagggaattttcttaattttaaataaaattttttaataatgattcttattggtttattttttaaatgagtttttaaaaagattgctctcttgactttttgcacatgtcaaaaccaatcccttattctg

SEQ ID NO: 37121 - DNA, 998 bp, Heterodera glycines
ctagtctaatctactcaaaacggctcagaattcaataaaaataacattcacggtgcgaaaaacggggttcgacaagtttatcggggaaaaaagacttttcacaaaataatacccccgggagaagggagtgggaaacacgatttcaaaattttcaattttttctagtctaatctactcaaaacggttcagaattcaataaaaataacattcacggtgcgaaaaatcggggtttgacaagtttattcggggaaaaaagactttacaaaataatacccctgggagaagggagtgggaaacatgatttcaaaattttcaattttttctagtctaatctactcaaaccggttcagaattcaataaaaataacattcacggtgcgaaaaatggggtttgacaagtttattggggaaaaaagactttacaaaataatacccctgggagaagggagtgggaaacatgatttcaaaattttcaattttttatagtttaatttactctaaacggttcagaattcaataaaaataacattcacggtgcgaaaaatggggtttgacaagtttattggggaaaaaaagactttacaaaataatacccctgggaaaagggagtgggaaacattatttcaaaattttcaattttttctagtctaatctactcaaaccggttcaaaattcgataaaaatcacattcccggtaagaaatatagtttattaaatttttttcgtggaaaatattttttcattaaataatccctttgggataagttagtgtaatccattttttaaaattttttttgaaattttttttgttcttttaagggcctgggaagggggggggcgaaggcccaccacgaggccgcgaagaggccgagtgagtaccttcggtgcaggaaaattattaaattttaaaaattttttaattgctttttaaatatgccaaaaaatgtaggcttaacttttttagtgaaaattcgatcactcatattttttgctaatgag

SEQ ID NO: 37122 - DNA, 829 bp, Heterodera glycines
cccgaaaaaaaaaaatcgattttttcaagtgtccgttttggggtactcaaacatttatgggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggctcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaattgattttttcaagtgtccgtttggggtactcaaacaattatggggagcaaaaatccaacgcagaattaaagtacaggctatagggaagctattcccgaaggattcggtctccccataaatctgggcgcatcgggtcggggggactgccccgaaaa

SEQ ID NO: 37123 - DNA, 1016 bp, Heterodera glycines
aaaattgggctgaaatttgagaatccggccggacatggagaggaaggaggccgagaaaaaggatgagaccagcaaaaattcattaaattttattgactttcatccaaatggacaaaacaaaattatcacatctatgtagatatttaaaattgattcttatatataaaatgcgaaattttaaaatttatttccttttttcgggacccaaaaattttcaaaaatattttgtgcaatttttgggattacacttcctaaattttctccttcgccctttgttttcttccgtcctccacccccattcattcaaaatcctaacatttgcattatttccacctcggcaaattcatcggcagatagagaccgcaaaattactcattaagaaagcatttttacagtgaatttggaccccaccccaaaatgctcgtccatttaccccccacatcctccgcaactttttgctacgcttaaaaggtcacaaaacaaaaggggcccaccccaaaaagtttttagtaaaaattaaaaatgccctcgggcatttgatggggatttgcctgaggcgcttcttaagtgccgctccccaccccaggttgccgctggagggtcagaaaaaagttcaattagccccgatgaccaccaccaccaccaccacagacagcggagcggagaaggcacaggtcgagaatttctcgagcggaaattgtaaaggaagcataaaagaaaaattcgagaaaattttgaaaaactaattaaaaacgggacaaaaatatttattttcttttgaatgtaaaacttttgaaaattaattaatttttgtgcaaaaaaatgctatggaaacatatacaacgcatttaaaatatttttaataataataacgaaaacaataattgcatttatcagaaatattttctaattaattttttttttctcatcagagtacaataaacgagccgttttctcacttattttcccatcatttctcaacaacaaaaaagtttgacgggcctgaaaaatgaaaa

SEQ ID NO: 37124 - DNA, 649 bp, Heterodera glycines
catattcaattttgtaattcagccttttctacttttctatttataatttatttattttggctaattttattaatttaataaataaaacaaaacttactgaaatataatttagattcaaaaaaatgtaaaaattttattaaaaatttctaatttcttaaaaatatttaaaaaataaaaaataaagtatctttagtgcaaaatatgttactaaatcgggtcattttcagattttgtcgatccataaagaattttggattcatagaacgaattgagcactttaaatttcaatttctgaataaattataaaggaagtctatacttttgctaataattctcttttttaaaaaccaaaaaaagatgaataaataaaatttgaaacattaaatagaaaattaaaattgcaaatagctaattaaaaatgcgattgaagaataaaatacctaaatcaatacatcttaatttagaatatttaattttttaaaagacacgaataaaataatatttttaatgcaaagaatttcaaaactgatatattagggtgcctgaaaggttattaaaaagacaatattttatttaaatttgttgcaaacagataatatttaacaaaaggatatttcacgcgtattttcttttttatttttattttcat

SEQ ID NO: 37125 - DNA, 1526 bp, Heterodera glycines
  misc_feature (60)..(60): n is a, c, g, or t
  misc_feature (90)..(91): n is a, c, g, or t
agtcacacaatttttttatctacaatttcataaaatgcattgcgcctttgatgtttttgntatcagaatttttctgagaaaaactgactnntagaattgattaaaaaaaatcaatcaatttatataattaattttattaaatttcttattaaatttaaatatttgtaatctttgacttatgtattgggtgtataataaaatttagtattttatcattttgatcattgcctttttgcagagatattggtgattttctacatgcattttattaattaagtttcataaatttttttaataatttaatcttaaataaataagaaataaactgttcttttcattaaataatacattaacaagcatacataaataattattgtgcgaatgagaatagtttaattatataattagaatatcttattgtagtcttttgcttttatggactgtaaagatttatgatttcaacttttaatttattttatattcattaaataaaaattgacactaaattaatgcatcaccgccgctgatttctgcattatatgatgtgaattttaaaggaatttatttttacatatattttttatatttatttacataaattttcattttattttattgaaataaaattataaaagttaataataaatctctctcactcacattacataaatcaaaatcctcgctatactaaaaacattacgaatttctccattattatgattaggcaccttttcatttagataaatttgtatttaataaattttaattatttcatgaaacacatttaataatgcattatttaactctaattctaaattagcttgaaaacgtggcgattatttaaagtgcataaaccttttcatgtgcattcccaatttttgttgtattatttatttttctatttttagtttttgcataatttttcataagaatctcgtattgcttaattttttttttcgtttttatctcgcaccagttcaaataacaaaattttgaattttacattatgagtcttttcaactatttgtagatccttccttttattttaatttattaacaaaaacacagaaaatatagttaaatttttttattatatttttcttttttttgtattatttttatttaaaaaaaattttcaaaaaaattttttatttatctataattcaaagttgctaagtgaactaacgcttctcagcaaattttttactcatttctttttcttttcattttttcttttcgtctctcattttaattatgtttatactcaattattaattatttatatcttaaaattttttatttttttcttattttcatcgtctattgaatattcatcaatttcaaatttcttataactatctatttcaattatttaaaattgttattatacagtagatactcgtaaaaaatatatatctatctataggctaccttctttatcaatttttacttcaagttttgtctgtattcttacaaattttgctgtatccatgcatcgaacgtggtgtagttctgcttcaaagcga

SEQ ID NO: 37126 - DNA, 1136 bp, Heterodera glycines
aaagagcaaatcctggcattaaaaaataaattcaactttttcgaggataattttttgtatattgcatttagcaaaaaataaaattatacaaaatggtgattcatgggacgcataaaaccgaccagaacctttgcggcacagacatttacgcctatgtacaaatccggcttcaaattacattttttcattccatgattgccttgaaaaaatttaagtttgaatccgatttttgacataggcgcaaatgtactggacgaaaatgtctggacacgacaaattgcattaaaattctaaaaaaaatccctacgacgcctatcggcacaagtggaccacaatttccctttatatttaataaaatttagctaagaaaacctcataaaatattcctcaataaatgatgctttttgacagttaaatgatgcttttgggccctattctttttccgattttgctttaaatttgaatgatcacaaaattagttttctgtttcttcctttttattataatctgctccgtggtcgccttctgtttccgcatcggttgcaacttcgcgggcattgccaattcatcaggtcaatgtagggctgaaaattaacgaaacggtcaattcccttgcttcggcacgtccctgccgtagatgaacaaaacatgcacattcataattattattttaaaattcttttcttaattagtttcaatagtgttttttctgcccacctctctcccacaataaaacaatcggtcgggacattcggtgcccaaatcttcacaaactcccgggcaaacattgcacgttttcggacagtcgcgaaccatttggtcataggcgatctgttgtttgatattcaaattatagtctaattaagattttattatacggtaatatcccattaatgagtgaaagctgaggatagagagaaaaagaaatggcaagagagtttgagaaaagcggagaaaacagaaagttagtgaaccgacgagagatcggatgcgatgccacccgttaataggacaagaaaatgcgcacttcatagatgcaaagcttagctcgttgttgacagtcagctgccacatcttcgcaaacctcaattttgaagataaaaatggcaatgctttctcaaaaataacaattgcat

SEQ ID NO: 37127 - DNA, 827 bp, Heterodera glycines
cagaaaataacaattcgtcagcctccaaaagatgctttatctccctcccgataatttgctcttttgtccccgcttcattctcactcttcccacgttctctcaaattcgtctccgattgaaatgggctaataagaataaagcttatctgctttcgcttcagcgttcgtctcatcagtcagtcccaaaatccgaccattccctcccttcctcccccaaattgccgttgttttttgtttttttcctcaacatgttcactccctcagcagttttataatcaatccgctttttctctcctgctgctgttggtcggaatgcgcagcattcattcacttcgttgtcgttcgtttttttaatttcatcaccaaaaatgctataaaagggaaaagctaagaacaacagaaaatgaagagagagagagagagagagagaaagagagagagagagaaagagagagagagacagagacagagagagacagagacagagacagagagagacagagacagatagagacagagagagagacagagagagagagagagacagagagagagacagagagagagagagacagatagagacagagagagagacagagagagagagacagagagagagagagagagagagagagagagagagagagacaaagagagagagagacggagagagagagagacagagagagagagacaaaggctgagagagagacaaagggactgagagagagacagagagagagacaaagggactgagagagagagagagagagacaaagggtctgagagagagacggagagagagagacacagagagagagagagaga

SEQ ID NO: 37128 - DNA, 893 bp, Heterodera glycines
  misc_feature (12)..(12): n is a, c, g, or t
ctccccataatntggtttgagtaccccaaacggacacttgaaaaaatcgatttatttttgttttcggggcagtccccccgaaccgatgcgcccagatttatggggagaccgaatccttcgggaatagcttccctatagtctgtactttaattctgcgttggatttttgctccccataaatgtttgagtaccccaaacggacacttgaaaaaatagatttttttgttttcggggcagtccccccgaaccgatgcgcccatatttatggggagaccgaatccttcgggagtagcttccctatagcctgtactttaattctgcgttggatttttgctccccataattgtttgagtaccccaaacggacacttgaaaaaatcgatttttttgttttcggggcagtccccccgaatcgatgcgcccagatttatggggagaccgaatccttcgggagtagcttccctatagcctgtactttaattctgcgttggatttttgctccccataaatgtttgagtaccccaaacggacacttgaaaaaatcgattttttttgttttcggggcagtcccccccgaaccgatgcgcccagatttatggggagaccgaatccttcgggaatagcttccctatagtctgtactttaattctgcgttggatttttgctccccataaatgtttgagtaccccaaacggacacttgaaaaaatagatttttttgttttcggggcaagtccccccccgaaccgatgcgccccagatttatggggagaccgaacccttcgggaggagctttccctatagcctgaacttttaattctgcgctggattttttgctccccataattggtttgagtacccccaaacggaaaactttgaaaaaatacgattttttt

SEQ ID NO: 37129 - DNA, 1233 bp, Heterodera glycines
ttgtggatttgctttggcaatcgaaggtatagagaagatcatcatcataatgatggtcatcatcattccgctggttcatgcggtcttttgctgtttggatttccctcaaccaaaaatggggtagagtttcgctgctgaaggtcagcaacgccctttctttctctatctaagccaaagcccacctttggtggtgggcggttgcccttcatcggaaagcgtttaccaatgaatgccattgccattcaattgtcgacactgaccattcattcccacacagaaaatgctcaaaatcgacggaatgccgcgcagcgtttgagaattgggctgagattgaggggagagcggtgagagggaaattagtgggaaacggaaggaagagaagggaaagggcgggggaggggaaaaacgcatggaagtgacggggagagacaacgaacgatggatggcctcgacattcgatttttgaccactgatgcgaggtaaaggaagatgaatgaaagaagaatgaggtgaaaaagttgggaaggaaaatgaggcggaataaatgcaaaaaataaaataaaaaaggagagggaggggggggggaggtgccaattaggaccacaatttgtgataatgtaatctaaaaaagcattgaccaattaagtggtaatgcctttccatttgtggctttaactttctttgctttggaaaagtgccgtccttttcaatttcgttttggaattacccaaaattaattagtaaagggagaaaataatataagaccaattcaaataagctctgaatttgtgatgcaaatgaataagtgaagaagtgattcgccaacccacccattttcattctccggaagttattcattgaaaggattcgcttttttggataacactttcggagattggcatcaacacagagaatgtgggaggtaaaagtgacccgaattcggcaagtgacggagtgtcaaataaatgaacgaaagtgccggaatttgcattcctccaactcattgtgccgttgttcaaattcgctttcaaagattggatattgagattcaaaaaataaaaggctgaaagcattgctcaatcaacgaattaattaatgaatatttcgggttccgagtcccggcactcccgaaaacgtattttaatatccaaattctttttcctgcttctttctgctgattacatctctatcggcttttccttctgtccaatcattttcataatttcataatta

SEQ ID NO: 37130 - DNA, 1032 bp, Heterodera glycines
tttttctccctccctaggacaaaagtgcaacgtcgctcacgattatgacaatgtgctgtttttgttccgccgaattgagcgtttgcgtggcgatacgccactgttcctccattagctgctcgacccggaaagttcgccaatgtgagaggcagccggtcggcacaatgtgctcgtcattttgacaatggcaccaccgggcgacgaaaacgatggcaaaagcaatgcccaaaatgataatgctgctttcgatgacaatgatgatgccatgctgcgacgggattgtgagggacaaattgcgaggtatatatgttacaatagggagcagttcgccccctgccccccttcaaaattaggaaaaattcaacgaaattagagatttatcaaaaaacatttttttttaaatttttcatttggaaaatttttttttaaaaaaacttcatataatttgaaaaaaatgctgaaaatttttttaattataagattttgttcttgaaaaatttctaattctgggatggtgatgatccgagagggtggcaaacgaatatgactttttttcagagtgtggcataactgaaaagtaccctgatttttgccgtttccctccgccccaatgtgtgataagaatatgccaccctgaaagaaagaaaaaaacaagcactttttcaaacccatccaattttttatgtctttaaaaatgtgcatttttcagttcactgctgtccaattggcactccgatgcggtgacagaggaccaaatccgaccaattgtggccagaataagtgcaattccgttgtgtgtcttttgaaaatgacttttgaaaccatcacaaaatcgatgcccaccattttttttgtcatttgactttacaccatttttatcgaacatatatatttagctcatttaaaatattctctaaaaaaataacctcataccattgtaaagacaaagaatcctaagggcgtaaccatccaaaatctatcccgaaatttaaaaaaatgcactaaaatttgacaacttttagtgccaagatg

SEQ ID NO: 37131 - DNA, 795 bp, Heterodera glycines
aatctcagtgaataattaaataattaattttaattatatagaacgtgtcactgaattaattataattaaatttattttataccattatatttcaagataaatttaaaaagaacaaataaaaatttgtcatttttgttctaattttttgcataaatatcttttgtcatttgtggcaaaaaatgcaaaaaaagggtaaacgcacaccaaattctgctgaaaacattactgaaaatgccaaatctcgaaatgaacgagacctgatcagtgttgggctcataattggggcagtgactgccgtgttgacaccaataatcatcggcagcgtggttgcaggatatgattttacaaatgagtttctttttgagcaaattgaacgcataaccaaaaatccaagcatacagagcatttgcctgcacggtgttgttttactatttgcgtataattaattaaaaatgatcagaattcgatcggttttccgtttgcaaaaaaaagaacattccttggaattccgattaaatttcattgatatattaccagaattagtagtaaccgaatactcaaatagagataagaaaaaaataaaaattttatacatttttctaggttagaataatattataaatatatattttttaaataaaattcatatgtatattaattttgcagttacaggcagcgaaaattatttaatattgagtgttattgatttgacacatgaattttgtgaagcgcataatataatacaaaattattattattcactgagttttttgtggatcgactcagcacggaaaa

SEQ ID NO: 37132 - DNA, 1463 bp, Heterodera glycines
agagaaagaattgtttgaccttttgggaagggaaattgactgacaaatggaaatgtttcgaaaaacaaaacaataccccaacttttggctcgtgactcttcttcacttttctcctccaacgatttcttttccgtctcgtcacctgccaacttttcttggcgctcagttccaatttcttgtctggggagttttcgcatcgatggaacatcggtctcctcatcttcttgagtttgttggacttaaattaaaaatgaaattaccaggttttgccaatacaaatccgcccatttagttcgggctgttcagacccaccacctttcccttccgctgaagtggatggttcttcctgttcttctctcatccgttccatctcattgtcctcatgtttctgtttgcgtttgctcagtgctgtctttgcaatttcacgcgcttttttgcacggtccgacagcagcgatcattcgcaactcttcgtctttgatgttttccgcctgttccaccgaatccaatgtgccaaccaaattcaagtccttgccaagcgccgtgtgcaataactaaatttggataaaatccaattaacaattgggtaaagaataaatgtttacctgagcagggtcgagtttgtcaaagtcaccggcaccaggcgtaacttacaattaaaattaagtaaaaaaaataattaggattgtttaccttcgggaacaaatgactcaattggtacgactaattcatctttgtccggctcgtagtcaaacatgtaatagtcgccagaacgtttggctataagaaaaaaaatatcacaaaataaaaaagttaaaagcaaatccaagggaaaagtcgcattaataaagcagaaaggcaaaagaatagcagaaaagtaattactgtataaggaagggttacaaaataaaacacattagggcaattgccaatgttcacaaaccaacactaataacaaatattattatgctacttaacgagaattttaatagtcccctaaataacaaaattaaatattattccaaagaaacaaaaacacagcaaacgaaaaacaaaagcgaagtgcgggaaagagagcgaaagtcgagcacacggaagaaggcaatgcaaatacaacaaaccagggacggaagacgggacagaaagtcggaggtcgtaactcggtaaggggtcgtcttcgtcaaaagtcggaagacgctcgacgagtgaagaaggactgtgccgaaacactgaggacagacaaaacatacacaatcagtggaacaccaacgaaaccacccatttgggagtaatgactaatcacccaatttgaaagcaaaagagagagattggacgaatgattagtgatggcattagagaggaacgaaagaaagtgtcagaaaaagactgcagaccatcggaacgggtcgaataatacgaaacagaaatagaccattgatcaaaacaaattaaaacgaaattaaa

SEQ ID NO: 37133 - DNA, 856 bp, Heterodera glycines
aaaatccggagcccatcccatcattttcaaccaaatagcagaaagattactaatgaatatgggaatgtgtgctttaagtttttatgatttaaatattttgagattgaacttggcgatttattaggggcatatgcatttgttgtgctgtgcaatgtcattttgttgagcctccatcgatgatgattggttatcatcacttttgctctgttaattccatcaaatattcaacaccaaattatttacatattcatcagaatcacaaatttgacggtcaatgaaaagaaaagagaaaaagatttttcatcgttagtccacaattttcgagccataagcaatgagagcattaaaacccaacaaaaaagcaagccgagactgcgtaaatatggacgaaagtcttggcaattttgttttatttaatttaaggcacaaacatttacaggcgattagaattaaatagaaagtcatatgaaaattaatggtcgatgggcaaaataaacaaataaaattagtgtgcatatacgaagctattcagagaagtgcgaatgaaacggtcaaaatgggataatgctaggcacatttaaggggaaggcggggggaggagggaaacaccgtcacgacagcgagcagtccatcaatttttagtctaacgaaggtagtcgccaaagtcccggagaagggccaattgctcgttggtgatgataaagtggagccggtacttctcgcgcagggcacacagcttctcggtggggtcgagaaattggatgaccttgaaaatgggcggggaataaaaaaaacacgggagtgagttaattggagcatattcaaagccgtgggattttatgaacaacaaactgga

SEQ ID NO: 37134 - DNA, 545 bp, Heterodera glycines
actaaattctacaatgattttttatgctttaataaaccaaaaaaaaatgttggaaatttggaaatattttaacaaaaagtctatatgtattattgcacgtgtaatatctgtgccaaaaaaaattgttcgaaatgatggttcgatgatggacatgtggaagcagtctgaagggctcccggacaatcggacagtgaggacaatcggacagaggtggacaatcggacaatggacaatcggacaatggacaatccgacagtggacaatccgacagtgaggacaatcggacagaagtggacaatcggacagtcaaatataaaatagataagaaaataccggtcgccgcaatggaccgattgtgccatatcaagaaaaaacaaaataggcaaataaactaatgttctgggaatgacctagaaaatgtaaaatgatgtgaatatgagctgataaaaatgtgtgccaaattacttacaagtataaatgaccaattaatttcccgtgcactgcccaaattgaccacttccttttccttcccaaatcttcacttg

SEQ ID NO: 37135 - DNA, 839 bp, Heterodera glycines
cgtccgtctctcttctcaccatcgtcgcaattttctgtttgctgtgcaaatgttgcatttcggcaccgcgtaattaatccttccttaactgtaattaaatattaattaattgcttttcaatagatccgtgctgtcccggcagccaaaaagtcgtttcgctgatggccaattacgttggcactttcgcccattccttttccaagtcatcgctttgttcggatgccaaaagtgttgcgggcgcattgaaaggccaactgatcggctgctcgaagggcggcgacgcaactcttttggccgacatcgaagcatctcttgccaaccattcttctggtattgatggactaatggatcaaatccattgccaaattagccaattaactttatttttaattattttaatgtttttcccctttttgatgagtgtgcccacagcctcggcttcgtccgtgccatgttcaccattgccgcctccgcttcttcccatgccagcaacaacagtgaatggcaggcattgagtgccaagtttggtcagcaaatcagtgaaattgactcgaaatgtgccgagtttggcattagcattgccaaagtgtcttttgagggccccaagggtaaaaccaattatggagaatatctcattatttatttgcttacaattcaaggagaccactcccaacgtaatgtgcctggtacgaacaatgtgattgccatgcccggattgaccggctcacacaaacaatgaactgaatgatgagtgactgaatggaatgaaatgatcgtggagttcgtttttgattgttgtccagcaattagctgttgtatttttaaattagcaataaaat

SEQ ID NO: 37136 - DNA, 1107 bp, Heterodera glycines
  misc_feature (4)..(5): n is a, c, g, or t
catnnttttgaaaaatgggaggccaaaatcgcaaaaaatattaattttttggcgaaaaattttgtaaaatacaccctagggatttcaaaaaaccaaaaatacagccctaaaaatcgacttaaaaaggaaaaatacacccctaaaaatcgaatttttgacttcagccccccccccaaagccaagagtctggctactcccttggtgtggattaccgttccggttggtgaatgcgcaacgaactgtactgcgacacacggccaatgggcaccagcggttcgggccaggcatccttaaagattgaattaaataaaaaattgttcttgatttttcattggaaaaatcaggttcataggtatacttatatatccagcagttttcactatatttgagaagggttcgaaattttggaattttttttttattattattatagggcttgaaatttcatattctaatacgttttgactcaaaattaattcttgtccaggtttaggttagctcaagtattgagctcagctattttccaaaaaaaaaaaaacgggaccgggagctctggcaaatctcagcttgaggtcttgtctagtccaggctcttctaactctctcatttctaagcaactacttaccatggcgcaattcacagaaactttttaaaattttttttcaaatttgcgtcagcaactgtttgtatgagatttcaatgaaattggcgcttacatagcgtcgccggacacgatcccgcactgctcggaattgttcgggcgcaatttgcttggacattcgccgttcggcggaagtgcgacggggttggtcctgcagccatggatggtccaatgcttggtgtacgctcatgcgctcttttgggtccaaaattagcagtcgacggatgaagtccttggcctcgtccgagatgccttcaaatgttggttcctgtggaatgggagacaaattttaaaggaagaaaccctatgagatggaaaatttaaaaaaaaattaaaataatggaaacatacatgaaaaagggggggggggggggtcgaccaaaatttttgcgaaatggtccctatacgtgtaaatcgacgaccttttttttttttttgcttttaaa

SEQ ID NO: 37137 - DNA, 1483 bp, Heterodera glycines
cgctgactaattagctaacatttataaagaaagtagaaatttgattaaatgcatatacaaaatattcttttttaaatttgtataaagttcctagtcgtatgtgctttgcgttggttaattggcgtgggtgagtgtggtggttgggccgtttttgcgatattgtggctggaaaaaagaagcgatttcgctgtggggagcgcggccgtctgggtttaagtgcttgcttgcgcttgtgctcggcattgaacggtgatggctgctgctggggtgccacctttgtcgtggcctcagtttctccagcgattggcagctgtcgaaatgaataaaacatgcagctcgtctgtgtgttaaagaaatttggcgagttaattgatttgtgtaaatgttgcctaaggcacaaatgctgtggggaactcagcactggggatgctgaacctaaagttggtggtggtgttggtatacgagtgagtggcgtattgccatggttgacaagccctatgagttcgtggatcggaactccttgcctggggaccagtgtgcttgcattcgaaaaaacacgagacataagcgcccgaaggcctttggcctgaggaagtgtcctaaccgggaaatccggagtgctcgtgtgagtgcctgtgcactgccctcggagctgtgtccagcggcgagatggttcttcccaagtccgggaagctcggatgcctggccagcgctgtgtcattaccacttgctcggtcgccttcgccgcccatgcgcacgcttgcgctgaacggagttgtttctgctgaaactatccgtctttacaagacggctgtaatagcggcgcttggcaacgctcgctagcagctatctggttgatcctgcctgaactgatgtgttcatttcaaagattaagccatgcatgtgtaagtttaacctgccagacagggaaactgcgtacggctcattacaccagctataatttacttgaccttgacttcttacttggataactgtggtaattctagagctaatacatgcaccaaagctccaatctccccagagcggagcgcatttgttcgccacaaaaccaagcgccctccgggcgtccagtgttgactcagaacaactaagctgatcgcacggtcttgtaccggcgacgtgtctttcaagtgtctgccttatcaactttcgatggtagtgtatctgactaccatggtgatgacgggtaacggaggataagggttcgactccggagaaggggcctgagaaatggccactacgtctaaggatggcagcaggcgcgcaaattacccactctcaacgcgaggaggtagtgacgagaaataacgagaccgatctcttatgaggccggtcatcggaatgggtacaatttaaaccctttaacgagtatctatgagagggcaagtctggtgccagcagccgcggtaattccagctctcaaaatgcatagaattattgctgcggttaaaaagctcgtagt

SEQ ID NO: 37138 - DNA, 1225 bp, Heterodera glycines
cccacccccacaacaaaaacgggtttccttcggtccatcacaatccgttaacccaaacccaaacaattatactaatcaattccggccccctagtccccctcgatttcaaaatagaaactggcatcaaactcccaaccagaccccctcatgttattattgtaaaaagcctggtcatgtaatcagtgaatgtcggatcctcgcctataaaaatcaaaacagaaattcgcaaaattggacgtctcagcctcctatgttcacccatagcaaccccaacagtattccaatctcccgaccccctccctataacagtggtagaggaaatcaacctaatcaaagaggcacatggcggaaccaacagtcttttcatcatgatcaaaggggtgcatggagaaatcagcaacccttccatcatgacaatcggaattggaatcgctacccaaatcccaaccagccttatggccgaggacgacaaattaattcccttaacacctatgattcccttctcccagactcattccaaaatctttcaatgtctgataatggtccccacccttcatttaacactcttacattctctgaccaagtccaacaacccgttactgcctcaccatctcaaatcaaagaacagctcgtgtgctctggctctgctgataagcaaccaaatctcacggatgctttaaaatccgaaccaaagcctgtttcccccactcctattgtcacaaattgggaatcacacccgcgcagctcaaatttttcaatagctccatttctaactcgttttaattttatcttgtgtatcattaatctttctctaagtgcttctttggtctcatcctctcacagtcaatcatccttaaaaatcctccctatggtttgtcagacacacgttgagggcacaatttggtctcttcccatttggctaccatgtccaaaattaaagcatactccttctgacacccctatcaaacaacctattcgccttttccgaccgaacccattcgaacaaaaatccaaggcatgggtgtgcaggaaggtaaagaaatccctgattgagtacaccaatccatggaatgatttaatcattaagcaactcccgtccgaaaatctcccagtattattggatgaatgtaagcaaatggttcaggaaaagtcatgttccgaagggattctaatccaaagtggggagctccttttctcccaataatcccaatcgagctatgaaaaa

SEQ ID NO: 37139 - DNA, 961 bp, Heterodera glycines
  misc_feature (945)..(945): n is a, c, g, or t
cttttaaaatgcaactaaattttttcctaattttacataaaaagatttttttcgaaagttggttcttatgagcaacagattgtgaaaccaaattaaacaaaactttttataaaataaatcttaattgtaaacaaattaaaaaagcatttataaaatttaagtaaatttctcattcgaaggattcaaataaatttaattgttattttgttaatttgaaagatcaaaagggtcaatttagcagagggagccgttgtaatagaggttttttgggaaaaatgccagaatacagacataatgccaaaatagtgacaaatctaaatttttaattatgtaattagtaattacagggtgcacaaaattttgactattgtaattcattctaatgctttaatcaaatattatacaacgaattaattaagtgttattctcaattaacaattataattgacatccaactcattgaatattaatatactcaactcaaattgatcaaagggtcaatttagcagatggagccgttctaatagaggtcttttggggaaaatgtcagactatattcataatgccaaattagcggcaaatttaaaatggttaattatgtaaataaagggcgcataaatgaaaatggaaagagttttgacaaaataggtaaattattaaattaattatgattactctgattgggtaattaattaacggaatgacgaaagaaatggtgaaaaaataactcataaaaaaaaatatgacagtactcagatgtcactcatcatttgttcaattattgaaaatgaaagctgataaaagggtaaaattaaataatatttaaagggtcacataaattaaataggttttgaaataaatttataaattaaatagaaaaatgcctataattgattaggttcaaattagactagtccgggtccggatatatgggcaaaagccggncgccgggtatgggtta

SEQ ID NO: 37140 - DNA, 1138 bp, Heterodera glycines
ttcaaaatgtcggacgttgacaaattgtcggatcggatgaagcgtttgctgtgcacgggtgttgatgcggatgtgcactttttggttgggcaggacgacaaaaaagaggcgagttcggatactgaaaatgttataaatacataagaatgggatgaatttaggcaaaatgcctattttctcatcagctaactttgtataagagttgccgcgagtcggtaaaaaagtcggatcagattcctgtcgatagtcccgcaatttcaccaaacaattcggaattgcctttttgggtcccgcaaaatccggcccatgacctgcccccgcaccgatttaatctgaaaaactgagtcgggaagtcatgtcaggaatatcttgcctaaaaattcttgtctaaaaaatccacatttagttcaattttttttttgaaaaatcaatttttaaataattttccaattaaacaattttaacccaataaaatatctaatttttgaatttgattaatttaattaaagcttctaccagcgcataaaccgattttgagagtttcgtccgatgttttcgacgcaatgtttcgatttgacgagcaaaaaagtggaaaaaataattttaattatttttcattttttaatataattttttttaacattgtcagaagggaatgaagaccctattgaaatcccggacgtcgacattgaagcgtttaaaactatgttgagctttatttatacggacgatttgaacggagtgaacggagacaatgccatcgaagtactttatgccggtaacaagaaaaaaaatgattagaattttttttaaatttagctaagaaatacaatttgccatcattgatcaaagcatgtgttggcgttcctattgcgaagctggacaatgtgtttattgcttttgccaaagctcgtcttctggccgaaaaagtacaaaataaagaaataagcttaaaactcatttatttttccctcatttcatgattttgctggccgttgtttggcttacattgatcggaatgcggaaactttgatcaaatcagaggcatttttggaaattgatcagaaattattgtgcgaaattctgggccgtgatcagttggctgtcagcaaagaaattgccatttgggatgccgtaa

SEQ ID NO: 37141 - DNA, 1485 bp, Heterodera glycines
gtataccattgctgtttatataccgtataccatttcttcataggttttgtgttctttttttgtatttagtgcctacggccggtgacaaagcaacatgtctgctcaaattcgcggaccttccgtccatgttgtactcccagaacacgggcacaaatcaatgcttggaattgtggcaaaaatggcgtttatcggccggctcaaatctcacacaaagttacgccgaactgattgagttcagcaacaaaggtatgaactccgttttggccgttgtatcattcattaattgcgtgttttgaggtgccaaattaaacggttactccgacgccggtgccatgtggcgttccgtctatgagcttccggcacaattcggcttttactcggccagccaaatcgacatcagccgccagatggaccttttgtacagccaattggctccgctgtaccaacaactccactcttatttccgcgcgcgattggcggcagtttacgcgcaaaaagcaaacgaagacagtgaaaagggagggcagcaattgagcaggttaaacgggtgttaattagggtaattagggatcgtaaacaaaaaagcatttttagagatggtccattgccaattcatttgctgaagagtttgagcggcgacagttggacagtgcattacgaacagacaaagccattccccgaagaaatgccggcggaggaacagaaaattgccaatgaaatggtcgactcattccgagcacaaaattacactgttcggacaatgttttccaaggtattctaaggatgttcaaacatcattaatttttcatttttttaggtgtaccgtttcatgaaattcgttggctttgaacggcttccccgcactttttggacaagttcaatttttacgcgtaattggagtaaggacatgatttgtaacccggcaactgcgtataacatggtcaaaaaccacggcatatgttcgaattcccctgacactgttttagatgaacggacagcaggacgattaccgggtgaaagtgtgtgcccaattgagtgagcaggtgcaacaaaacaccaattaattaattaaacgttttttgtccaacaggactttgtcaatgcgcaccgtcttttggccaaactttactatcagtacggttcacgaacacagcccattttgttgcgggacgcacccaacccaaggtaattaatcaaaaaatgcttatttaattatttgaaaattaagcctaagcgcggcactcgccggtgcctttggcatcgttgcgcttcatccggattatctgagagcacagaaattggtgtcggtgaaaaccgagcgcaatgccgaggcagaagtgaatcgattgtacagagaagcgctggaagacattgtgaagctgccatttgccattgtagcaggtgaaaatgaggaaaaaattaattaatatggtaaaacaaaaaatggcattcatttttagacaaatggaggtacgcggcatttga

SEQ ID NO: 37142 - DNA, 925 bp, Heterodera glycines
tacttattaatcttgttgaaattgagtcaaaaaatgtaaaatctggtcaatttttgaccaagaatggttttgaaaagcaaaaaatagttaaatttatggtccattaacagatttgattctagatcctctttttaccgtctgatacattcggaaaatcttagtcgccaatgcatcccgctatcccctaaaaatttctttttcaaaatatcattattttctcttttttggaaattttttgaaatttaattgaaattttttcaaaatcccgcaatcccgcgcgggatcccgcaaattttaaatgcgggatttgcgggattaatcccgcgggatcccgtcccccaaaaaattttggattccaatcccgcagcgggatccgcaaatttgaaatttccggtctctagtatcgacccaacctaccgtttaatttttcaaaacgcgccattatgcgatattaaaaatacaaaaaatttatgaccagtatgcaggcaattacaatataatacataaataattagtgctttgagggaatgcaaataaaaagattgcattcctggccgtggtgcgacttttggggatttgcaacttggggacccgacatttggggacccgacacttagagaacccgacatttggggatcgaacgtcttttggggatctgacatttgaggaactcgacatttggggatcgaacgtcttttggggatctgacatttgaggaactcgacatttggggatcgaacgtcttttggggaactcgacatttggggattttattaaaacaaaaaaaaaattaaaaaatttatcccaaattagacaaatttacgattgctttagccagagttaattccattgcaagaacaaacgaaataatttattataatgaactttcattacggactctaaaaagcagagaagatgacctcgg

SEQ ID NO: 37143 - DNA, 830 bp, Heterodera glycines
gggtacgataagttggaaatggacggcacattcaaatcgttctgacattacagggcaaaggcacgtcaaaggaaaagggaatagggacggagggccaaaaagggaaagatttacccaaaatggcattttaacataatttggcaactgcagattgttttacgaacatgacggggaccagtcacgattcgaccgcgtctttctgctggcagaaagcgaactgcgcgaccccggcgggggcaaagggcacccgcccattaccttttggctgcacatttcggtggtgcccaacaacagtcatgcgccgcaactgctgcagaatttgttcggcgtagcagtgactcaccaacaagtttgaacagttcatcctttgcccgtgccaattggccaccgtcccacagattgacgtgcttctgaacgacgagcgcactctttggccttcgcttttgccgtggatcgatttggacaattcgcagtggccttccctggagcagtcgctgttgttccccgtggcccagcagcacactccgctcgccttccatctgatcgattctacggtttcacgtgactttgtgatttatgccaaaagtgcgccagaaatgccgctgagagacttcacggagaagcagctaatggacggccaattggttttgcggcatttgggcagcccccgggaggaggccatcgttcggtcagtgcttttttaggagggggaagtgatttgttggcacaatccattcactcatttaatgttgactgatcaggtactccgtcagtgatgggttgcacagttcgccctccctcttcgctctggcctccttcctcccgcgtgc

SEQ ID NO: 37144 - DNA, 228 bp, Heterodera glycines
cccccccccccccccctccgcgcgggggggggggggggggggggggagggaggagaaaaaaaaaaaatatttttttttttttttttttttttctttttttttttttttttttttttaaaaaaaaaaaaaaaaaaaaaaaaaaaaaaaaaaaaaaataaaaaaaaaaaaaaaaaaaagtgccgcccccccccccccccccccccccccgcccccccccccccccgcccc

SEQ ID NO: 37145 - DNA, 848 bp, Heterodera glycines
atcccagaaaaatgtctatctctttttttgagaaattttatacctcacaaaagcgcttgcgtatgagtcggagggctgtgcacaatcgccattttatttcacagaggatttttatatttagaggttatcccagaaaaatggctatctctttttttgataaattttatacacatacaaatgctctcgagcatgatagggagggcggtgcgcaatagacattttatttttgagggaatttttatatttatactctatcccagaaaaatggctatctctttttttgagaaattttatacctcacaaaagcgtttgggtatgagtcggagggctgtgcacaatcaccattttatttcacagaggatttttatatttagaggttatcccagaaaaatggatatttttttttttgataaattttatacacatacaaatgctctcgagcatgatagggagggcggtgcgcaatagacattttattttagagggaatttttaaatttatagtatatcccagaaaaacggctatctctttttttgataaattttatacacatacaaatgctctcgagcatgatagggagggcggtgcgcaatagaccttttatttttgagggaatttttaaatttatactctatcccagaaaaatggctatctctttttttgagaaattttatacctcacaaaagcgcttgcgtatgagacggagggctgtgcacaatcgccattttatttcacagaggatttttatatttagaggttatcccagaaaaatggctatctctttttttgataaattttatacacatacaaatgctcaaagagcatgatagggagggcggtgcgcaata

SEQ ID NO: 37146 - DNA, 640 bp, Heterodera glycines
attttccccggcggcgcctatcctcggcaccgccggaccccctttcttccccaaaagttttttggaaaaagcgcgccgaaaaaaagtgatgtgaaaagcaaatctgcatttctaataatattcgatcatttagtccaaaaatgattaattgtttgaaacaattgaaataaatttggtttttttttataaaataaaaaaccaaaaaattatttcagtttttattgtatcccggtcccgtacaactctaatttattggcataattagaaatttcattgccagtgccgggctcgaaaattttcgtgtaatttttaaagtaagattcacatttttgtgcactactaaaaaaggtgccaataaatagcttggtattacacttaaaaccttttaaacttaggtgagtaaccaaataattctgcaatttttccaaaataaatttttttttttttttagtttagaggaatgtaaaataatctcgatctcgaaaatcgagatccaaaacccgagacttatctcgattcgagactgagacccttgagcatcgctagtgtttatgagcaaaaaaatcaaataacaaagtccaacaaaaggtgacataatgatcgcatcaatcaatcaaccaaacaattcacttctgatgtt

SEQ ID NO: 37147 - DNA, 807 bp, Heterodera glycines
gatggaataagggggccacttcaaaatcgaaaagctaaatatgttcgacaggataacaatctaagagcaattgtcgaacagtttgacgatcgcgagccgcttgcgtatcttcgagccattgcataccatttacatttttaaagggaattagaaagaaacaaacatttaaaggcaataataagcgtcatttcaaattttggcattaattttttaaaaataactttagtgtcgaaattactgtgtcgaaaatgaagtaaaacagtgaaagttttgaaaatagttcagtgtcgaaattactcagtgtcgaaaatacacagtgtcgaaattacccagtgtcgggattaccggacacggtccccctctttcgttcccgctctccttaattatcaaaagaaattattagaagggtaatgcattaaattaccgtaaatccgctatttgaaggcccctctctgatagaaggccccctccaattaaaagcccccctaaaacacggtttttaatggaaaaacgatcaattttattaaaaaaaaaaataaatttgatcaaagtcgtacagtcgtaataaaatttgattttattttgctaaaaagtgcttggtaatcccattatgcaacaagtgagagaaaataaatgaatgaatgcggataatcggatgggtgggacgacttccaataatgggcttatctgctccatctccgcttaactccgcctaacgagcgcaattgataattctcaggcgccgcgaatttcttcgtctcacttttctctctcttttggcctctttctctttttttggctctaatt

SEQ ID NO: 37148 - DNA, 907 bp, Heterodera glycines
  misc_feature (865)..(865): n is a, c, g, or t
cgaaaaagcggaaaattttaaaactccttaagtttctgaatgttaaattgcattaggtttgtggttcactttatattcctgctaaattcagaagaaaaaaataagtaaatttcctaggggattgtgcttatttttaagaacggaattccacgttttgtcggccttaaacttgacaaaatgggaattgaataatttttattttttggcgtattgtttatttttagaaatttaattctgaaatgctaaccaagcgcatattggtcacattttctggccaaaaatcacctgtgccaaaatgtcccgtcattagcggcagaaaatttttttcctccgatgcattcaatgtgagttgcattatggatagcttattaactattaataatgttttaataattaataaatttaattcaacgacttttaaaggttgaccgaaattgcacgcgccacggcggcgaattggtggccaatgtgctgaaggtaattgaatgcataaagctcggtcttgtcacaacatttgtgatgaaaataaattcatttatttccgttaaaaaatacttttttaatatttttaaatattttaactttatcctacgaattcatttgtgcccggacgggactaagatcctttgcatgattttctcaggatggctcttgttttcctagtcatgttataacaagatttattcctgttcattctgtcctgctggtccaactcggaaatcatttgtccggatttattcaaaaccgcgctcttcaattcccgaaagttccagttctcttttttttaatctttgtcaagctttttgaaaatttataagtattttgttgaaaattaaatttttgtctctattttttttattattanaaattgcataattttgtccatttttggcccacgacgtgcgcg

SEQ ID NO: 37149 - DNA, 1015 bp, Heterodera glycines
tacatccctttgtcaatgggaatgccggcacgcgtcagcagctcttctgcgtcacgcccatgttgctcctgatgacgcgcgtactccgtaaatgctgcacggccaccgccaccagccattctcgtttcgtggtcccgcagacccagaaggacggcacgcgccaggcagagacggtcgtttgggttaacgacacgcaccaatgattgcacggtgtgcgaagcatggtgttccgcctccaaatcacagccacctgtttttttcaatgtaattgtccttgaaaaaagaagaacaaacctcctctttgtgggtccgcacgaatttgctcgagtggccacaccgccagaactttggcgaccgttgtcccagcaagcaggtcaatgccggctgccgattgctcattgagccgctcaatggctgccgccagtgccgctgcgttgttctgctcgggcgggcgaagtcggatcacgtacggccgatcaaagcctggtgggtgcagctgcagaccaaccagggatggcggcgggtgaccgtccagcacacggtctagcagatgttggatgagcacctccatcaacaagtcgggccgctgtgtgtcctccagcggcaggaagcgcagttcacagatctcgccacgagtgttccgtggcacattcctcatttgcgtggtgcgctcaatgacgaaactgtcctcaatcgccttaacagagaacaacaaaaaatttattcacggcaataaaaatttacaaacaggacatgagcgctgaatcctaagccatggtacaatacatggggcatgaaaaatatggaaacaatggagtgaggtggcaccctccccactcacaaaaggacacatgcatatgggacaggaaaggcatttttcaacatgaataggtgaaatgtcaaaggtgggcagtgaacgaattttacgggcaggatatggcctttgggtttccgcgcccgaaatttcctcaatatcgggggacaaattgaagcggaccctcaaacgaaccggttc

SEQ ID NO: 37150 - DNA, 1183 bp, Heterodera glycines
  misc_feature (1116)..(1116): n is a, c, g, or t
ctcctgaagaaaaaaacatccaaggttaataatgccaactgtaaaatatatcgaaaaaaggagactcacttttggcaacaatgccaagtgattgttgcttatatcgaggctaaaaaaaacaaacattgacaagataaaagaaaaaagagcacactccctccccctttctgttgatccaaataaactacctgatcagattgacgaattacctgatcagattgatgaactgtgccaccaacggggggacagtgacaaaatggttgtgagccaaattaagcagtgaaatggcggcatggtctttgtaagttgcatgttcacccagaaaaaaagaagagggaagtgagtcgatgaacctacgcaaacagaacatggatttctgccctttcagcgccaatatgtattaggttttctaagttaccgttgagacaggtcaacggtatgcatttgtctctcatcctgctgctgttgaaaagacgcgcttaatcacaagggttttgttcggtccaggggcgggcacgacgctgtacgagctatttggacaaactaccgaactttaagagtgaccccccttctgtgtcccaacaaaaatgggcttagaaaaacgccctaaccgtgctgcatatataattaggatagactgacccttccgtcagaagcggcggtgaaagccgtttggaaggcgcaagggtccaaaaaaggaaattgtccatttttacccggtccaaacaaattgaatatgcctggaattgtgctatttatttcaaatgggtgggttggaatgcccttggtggcgtctctccatctcttccctcttcctcatcacaaacgtcgtgcacacccctggatcaatgaaagtgatatcagcggaacggtgccgcaactcaccgattctgaccattaccaagtgcattagcactgtcttctccggtccctatttgggggttttctccaaatgccgtttcttgttctctttcgctactcgtcattttcagtaaaatatttcgaggtgatagtctgttttgctgagagatggggtggggaggaattggtcaattcaaagttcaatgagagactaatagcccaattaataataatgggctgagaattgtattttgnggacactttcatttcttaagaacaaatttttgttgatatcagcgccgaaagtataaaaagtgatcat

SEQ ID NO: 37151 - DNA, 1116 bp, Heterodera glycines
cggagaagcgcgcatcgccggagtcagtctcccgccagccgtgagcatccacaggaggagacgggagtcgaaacccgtgctcatcaaatcgagagcgaacgtcacgaagttcgagcagttcagattcccgcagccggagtctcgcggttcggtctcagtctcccgccagccggagcatccgtcgcaggaaacgggagttaaaacccgtttcatcgagtcaagagcgaagagcaactcccgcccgttcggagcagctcaaagggtcggacaagcccccttcacaaccaatcttgtcgagcaactcccgcccgttcggagctgctcaaaggggtccgacaagcccttcaccaaaatcttgtcggtggtgccgttaagcaagcagcaaatcgctgtataacatccaacagtaccagttcaattttgtcacccctcccccctcccattctcgtccccctttggcgctgatcggatcggtcagcagcatcagacccatcaggacgaacggcaaaagaggggaccattccctttacggcacagcgagcggagtgagcagagaaaaaagggacgagagcggtgaagaggagcgggaaccaatcccgcctcagctgggccaagccacacacttggcccgcacgagtaaaagattggcgacaaatttatttattgtttttttcatttttaatacaattttatcaaaagctgtcgttgattaattttgcgtgcaattgtacactagaaaacgtggaattacaataatatttcccttttgcgtgcaattgtacacaagaaaacgtggaattaaaaattcatattttctggaattacaataatattttccttttgcgtgcagttgtaaacgtgaaattacaattcatatttcccttttacgtgcaattgtacactagaaaatgtggaattacaataatatttcccttttgcgtgcaattgtacacaaaaaacgtggaattaaaaattcatacttcctggaattacaataatattttccttttgcgtgcagttgtaaacgtgaaattacaattcatatttcccttttacgtgcaattgtacactagaaaatgtggaattacaataatatttcccttttgcgtgcaattg

SEQ ID NO: 37152 - DNA, 777 bp, Heterodera glycines
ccgccctgataacacacgtcaattgctgtcgctgagtacggacaccgccggcagtggggcggcggagagacccctcttttttcaccctttgccccctcccccctccgggcgatgtgataatgatatatttgctgatgacgacaccacattaaattgcaagaattttttgttcctttcctccaaagatcgctcttccccacccacattgacattggtgtccatgggctaagtaaggagctaaaatttgccatttttagggattttttaaaaaaaaaagttcggaggtattttttgaggtccccttttaagcaggtttaatgaatatttttagtgattgccttaacttgttaagggaaaacgctgctcaaaacgtggaaaatattaatgtagcctaatttttgttatttatataaaaatttcgaagcatttatttgcgaaaaatttgaaaattttaaaaaatttcaattataaaggttgtcaggaaaattcagccctcacctgtccagggttggttggacctaagaaaagcgccttgcctctgatttttgagcaaatcccaaatttcatggactagcctagcaaaatgagtgacactcgtcgggtcgggtcgggtcgggtcggcgccggctgttgttttttgtctggccctcccccgcccccgagggcacatgaaaaagccatagagtgaaagactaatgatggtgaaagtgcaaaagctgcacgctatgtataggggtagcacaaaattcattacctgaacaaacactgatttatggg

SEQ ID NO: 37153 - DNA, 145 bp, Heterodera glycines
cggccaccgccttcagctggtgcaggtcttccatcgtggccttgccggcgacgatgcgctccagcacgcggtgcatccagccggtgccttcacggcacggggtgcactggccgcaggattccttgtggaagaactggctgatgcg

SEQ ID NO: 37154 - DNA, 114 bp, Heterodera glycines
cttcggtatcggcttcggcgcctacgccgcagtgatggtgccagtgaatctggtcagcgtcgccgccaccctgctggtgctgtggctgttcttccgccgcgacattccggcgcg

SEQ ID NO: 37155 - DNA, 515 bp, Heterodera glycines
caccttggtctgtggagtgcacctacattcattcaattcacgcaaatatggaatgagttataccgcgaaaaccgggctggcgcccagtcgtaccggcccgtagtttttaacaaatttcaagtataacatttggtaaatcgcaatttttttttgtaaatttcgtttggaaaaaatgaattctctctctcttttcgctgccataaaaattcggcacattttttgaatgccctccgaaaatggattcgttttgcgatgatttctgaatgccccggttcaaaatgtctcaatttgcgatgatttctgagtgccccaattcgaaattagacaaaattcggcacattttttgaatgccctccaaaaatggattcgttttgcgatgatttctgaatgccccggttcaaaatgtctcaatttgcaatgatttctgagtgccccaattcgaaattagacaaaatccggcacaatttttgaatgccctccgaaaatgggttcgttttgcgatgatttttgttcat

SEQ ID NO: 37156 - DNA, 219 bp, Heterodera glycines
cattctccccccaccctttcttcttccgccaccctttctcctccttcattttaaattcctttccttctccaaccccctcctccctctcttgatagtttaaactgaaggcgggaaacgacaatctgatacgcgatcaagctagctgctgcaggtcctgctcgagcgcccaaaagggggatcgatccccgatctagtaacatagatgacaccggacctgca

SEQ ID NO: 37157 - DNA, 513 bp, Heterodera glycines
tataataacgctgcggacatctacatttttgaattgaacaatattggtaattactctttctttttctccatattgaccatcatactcatactccccccaccctttccttctcccgccctctccttcctttcctggttagttaaactggaggggggaaaccaccatctggttccccttcaggtaacttctggagggcctggtccagcgggcggccggggatccattccccatctaataaccttaatggccccggactccaaaagattccccgggaaccaactccaatttctaatcctgggccttactggttcctggggggaattggtattcccttcccatttccccccacattccaacccgaaacattaaggggaaaggctgggggggctaatggatggacttacttcccttaattggggtgggcttcctggccccttttccagccggaaacctggcctggccacttgattaatggattcggccacccccggggaaaagggggttggggattgg

SEQ ID NO: 37158 - DNA, 87 bp, Heterodera glycines
  misc_feature (75)..(75): n is a, c, g, or t
  misc_feature (77)..(77): n is a, c, g, or t
ccgttctctggaacacgcttacagcaaggacggcggcctggcggtgctgtacggcaatttcgcagaaaacggacncnagacttcccc

SEQ ID NO: 37159 - DNA, 299 bp, Heterodera glycines
  misc_feature (50)..(50): n is a, c, g, or t
  misc_feature (90)..(91): n is a, c, g, or t
  misc_feature (93)..(93): n is a, c, g, or t
  misc_feature (96)..(97): n is a, c, g, or t
  misc_feature (106)..(106): n is a, c, g, or t
  misc_feature (110)..(112): n is a, c, g, or t
  misc_feature (139)..(140): n is a, c, g, or t
  misc_feature (210)..(210): n is a, c, g, or t
cggtgtcatctatgttactagatcggggatcgatcccccgtttaggggcncgagcaggaccggcagaagctagcttgatgcttttcaganngncgnnccccgcctncagnnnaaactatcaagagagggaggagagggnnggagaaggaaaggaaaaaaaaaaaggaaggaggagaaaggggggcggaagaagaaaaggggggggggagnatgagtatgatggtcaatatggagaaaaagaaagagtaattaccaatttttttcaattcaaaaatgtagatgtccgcagcgttattata

SEQ ID NO: 37160 - DNA, 213 bp, Heterodera glycines
cgcagcgcgcgcaactgggcctggcggcgcagcgaggacgtgccgacacgcgcaccgatcggcaacgcctccagcgaggcatacaggttggagacgaaaccatcggccggatcgtggcgggtcagcatcgccggcaacgcaaacggcgcgtccagctccatcggtacgtccttcagcgaatgcacggcacaatcggcctcaccgcgcagcatg

SEQ ID NO: 37161 - DNA, 934 bp, Heterodera glycines
  misc_feature (879)..(879): n is a, c, g, or t
  misc_feature (913)..(913): n is a, c, g, or t
  misc_feature (920)..(921): n is a, c, g, or t
attgtaaataataattttaaaaagcatgaaataattatttatgtaaccttttagaatgtttttttaaattttatcattatggtgtatgcagctttgtaactacattgaccaacgaaatttaattttcgtttaatgatttcttttagtgaaaaaaatcttatctataaaaatgatgtaagatttattataacttttaatattttttcgtaatatatttgtcattttaaactgtttaaagcaaattttagctcgtttcccgcttagcttcaactaacttttctcaagtttaaatgaacaaaattttttgaaaaaactactaattggaaagcattactcagagcaaattacataattggttaaaacaaatcaatataacaggataaaaaaaacccattagtaaagttataattcacaatttttacgtaacatattatttttaattttttataaacatttatctattaataaatttttattattttatttttaatgattaatttatgtttggaaaattaaaacaagtgtgaaaacttgcagcggcgatgtgactctgacacaaattataaaattacgaaaacattgaaacgaattaaaagaatatcaaattaattataactaatttctttaaagtattttataaaaataaaatataattcattaagagctaaatataaattactttaaatttacataatctaaattgaagagggctgagtctgtctcactgaataataaattcaaaaattattcaaaaaatttacataacaaattaataatttctgttgctgttcgggttgttccgccttcgtggacacaaaatttttgtgctgcgtgataaaatactaaactaaaaaattgaatgtaaaaatgttatcttanacgacaaaataaactaaaaattgttatattccanataatannatatatttactta

SEQ ID NO: 37162 - DNA, 1751 bp, Heterodera glycines
  misc_feature (297)..(297): n is a, c, g, or t
  misc_feature (1054)..(1054): n is a, c, g, or t
  misc_feature (1111)..(1111): n is a, c, g, or t
  misc_feature (1118)..(1118): n is a, c, g, or t
  misc_feature (1138)..(1138): n is a, c, g, or t
  misc_feature (1200)..(1200): n is a, c, g, or t
  misc_feature (1265)..(1265): n is a, c, g, or t
cccccccccccccccccccccccccccccccccccccccccccccccacccccccacccgccggcggagagagggagaggggggggggggggagggagggagggggaggcgggggggggggggggtggttttttttttataataaaaaaaaaaaaaataaaaaaataaaaaaataaaaaaagccccccccgccccccccctcccacacaaaaaaaaacaaaaacaaaaaaaaaaaaataaaataaaaaaaaaaaaaaacaccaccccacccctccccccccctcccctctccttctnttcttttttttcttcttttttcttttctcttctctccctccttaaataaaaaaaaaaaaaaaaaaaaatataaaggggaggtggggggaggggaggtgggttgtgtctccccccccccccaaacacaaacaagaaaaaaaaaagaaaaagaaaaaaaaaaaaaacaaccccccctccctccccaaacaaaaaaaaaatatttttttttttttaaaaaaaaaaaaaaaaaaaaaaaaaaaaaaaaatttttttttttttttttttttggggggggggggggggggttttttttttttttttatttttttttttggtaaaaaaaaaaataaatttttttttggggggggggccccttttttttttttttatttttatgttttaacaaaaaaaattttttatttaaaaaaggttttttttttttttttttatttggggggggggtggaaaccccaaaaaagtttttttaaatatttttttttcacccaaattttttttttcaaaaattttttttaaaaaatttttccccggggccatttttttttttttggcgttttccccggggccattttcccttaacccttttcctgcccgcaattttttaaaggtgctttaactgacctgaatatttttgcagagttaaaaccgtagggttatttttcatgttaatagggtcttggaattaatggaataagattaattccttaacctcggacttcttggacgagtcctcatcagtggtttcagtcaaatcaattcnttcaaggagtctataatcaaaaattttaaatgtaaagcttaaaccattttgtcatcnaaatttnacttacgatcttagttcacnttcatataaattacgtcgccaccttcttgcgttttcttttttccaataatctttttttcacntctaaagagataaaaaaattaattaatatttagaaagcgtttagcgaatcatatattattgcatntaaacaagattttgaaccgaatcgaaaatatggaaaatggacctttacagaagctttaaaaggccaatacatttttctgaaaatttgttggatttcgaataaaataattaaaattcactgaatattgaataaaatcattaaccggaatagtttgaatttttttttaattttgaagttcaatagcgcctataattttcaaaataaagcctaagcacagacctagcccaaaaaatttagctagagttgaacggatacatttacattttagattcattatttttgtgatacaagaaaaattttagaacaaatgtgaattgtttctaaatggcgcctcgtggcgatcacaattttagagaagcctcattttaccaaataaaatttttgtttttaaccacacgcaaaataaacaaattattacctgctcggttttgtctttgatttctgaatgttgaagtcgagcaaccactgcacattttctttctgtaa

SEQ ID NO: 37163 - DNA, 624 bp, Heterodera glycines
aattttaatttttgcaaagttttggcgttctgattcctaaataaataatttacttatttgcactgggagcccaaaattgaatcgccgtgttgagtattgagaaaaaaaataggcgctattattaaattaataaagttatggatttttaattttattaaaaaccaaagggagctaaaattatttgtgatatacctataggtataccgtatttcctgtaatataacctccggaggttctatttttcaacccccctcaaaagggggggttgtaattcaggggggggggtactaattcagggggggggggttatattacaggatatacggtacctatctcattagttttgatgtcttataaaatgagaaactgatttttgattttttgttacttaattacaatttttaattttatggagcaaaaagatgaaataatcttttaagactcttagtggtaaacgagaatttgtatattagttcttttagactgtctgattcatagttaatttcaaaaaattccaacattgatcaagtcttgatgacgatgaaaataattctgaaaaataccctttttctatttttgagccaaagtattttcttttgcaaaatgtcaggtcacttacacaat

SEQ ID NO: 37164 - DNA, 1170 bp, Heterodera glycines
  misc_feature (1152)..(1152): n is a, c, g, or t
tgtgcaacaaccgcatcatgtcttctcgactgagcaacctgaccaaccatgtgcgccgtcacgcctcgttgaagcagtaccggtgctgccattgccaatattcgcacaatgaaatggccaaagtccgctgaccgattaatttacccacaaatccttctccatctcctcattcattaaggtgcgtctgcacatgtcccacaaccatcaggacttcaccagtcagccgatggacatgctcagttttgagatgcaactccaatggggtcttttgatggagcagtgttttcccgagcattccaaagtgaacactgtccattaaatgctaccaaattgaatatctcacttttctttcattagcgtttcggcccctccgccgcaaattcgcagtttcgcaatttggaagagttacagaaatatgtggacatggaggtcgaattgacaagacaatccgtcacaccactcgcacttgtccatttagcactcctacacatgcattgaatgtggcgaagtgttgacgggctatcagctggtcacccacttggaggatgtccaccgtcaagagtgtgtgccatttgcgtgtggccaatgcggttaccaggcgagcaagcacaaatgccagcagcagacagcccacccacattcaccttttcattcacagagctcgtcccaatggaaagttcgactgcacatcagcgtaaaacacccggagagagcggcagagataacggtggccactctacccgcgggaagcaatttcatgctctttttgcagaagttttttgccgaggtgttttttctaatccgaaatgccaacggatcaatcaaatccatttgatttcaggtgcatatccctgtggaagaggatgaagccaaattggttgctgaactccaagaaaagaattcgaatcgtttgttggccgcaatgaattcactcaatgaggaaacggatggcattggaaacgaagaagaatgtgaggagagtgacgaagagaaagagggaaaatacgaaggaagcgagcgaagagaagcaacggcatcacaatcaccagcagagaatccaaaaggagaggagaaagaacgggtggagggcaatgaagaagagaacgaggaagaagtggagggagagggaatggagtgccaaaaaggaagggngaaaggacacgacggact

SEQ ID NO: 37165 - DNA, 1044 bp, Heterodera glycines
  misc_feature (57)..(57): n is a, c, g, or t
  misc_feature (989)..(989): n is a, c, g, or t
atatgtgaactgcaggaggagcacacgcaagaagtccaacgcattccgggaaacctntaaaagcaaaaagaatggaattataagtcaaaaattacaaataccacgtgtcttcaacgtaagatttgccggcaaatttcagatcggctccatttactgtgatcagattaaatttctcggctataaatttttttttaaacatttaaatttattttaaataaaacttacgaacactattcttgaacacttgaacaacggtctcaaccccaagcacagtcatgttccaatgttcaaatgcctttgggctgaccacattttttaaggccgatgccgttgtgaccgaatgcccacaatttctgcataataaatcagcactgacgaaacgaaatgctgaaaaaaagcaattaaaaacaggattttatgtttttaataggtactaaccttgtacaacaaacaaaacaagcaaaaacaaaaatagtgacgcatttgttttactttttattaacaaagacatttcgaaagtcagaaaacacttaataataaattaatttaaaattttgttttatttttattgtgtgtttttaaaagtgttttatcttaattttttagccaaaacctaaaacaacaaaaaaatggcactaaatgaatcggaaggaaccgttgtaaatggaaaactaagcgcaaaggaattattcacgcgatgcgtaaatgaaataatcgcccaattaattgttgcacaaaaagagggaagagatgtcaatctgaacaagctaaaatgcgaaattgcatccaaatacggaataaaaacgcagccgaaattagtcgacataattggggcggtgcctcctcagttcaaggcaattatcgaggaattaagagatgccaattaatcaaacattcattaggagttgctgctgcccaaactcaaagcaaagccggtccgaacagcttcaggaattgtaataattacttttaattggatgttcatttanatgcaattcatttttttctttttcaggtgattgttggcggttatgtgcaaacctc

SEQ ID NO: 37166 - DNA, 1452 bp, Heterodera glycines
  misc_feature (1275)..(1275): n is a, c, g, or t
ccaaggccaagaaagtggaatgggggggtttgttttctccgggtttgtttgtcgtttttttttaaacgaagagaagccttttgttaaggggaggaagttttactttttcgaatcaattaggttttttttgcttctggaacatcatttaaattttgctgtgcttttcgttttctgttaactggagggtgtatggggatagccggtggggggctggttgaaatggttttcctgtgaacttctgctggaatttttcttctcttcgccatgagactggcggcagttttctcctttgtcttttagctattttagaggaagaagccggctcatattgctgtatgagttgccgcttagctccctcttcccatgaggaatagtactcatttgctttccttttatgacccctatttacagcttggaagggtggagagtctggtagtaatggcatttcctcatcgtcgtggtaatggtgatgagaccggcgctgtctgcgaatttgtgaagcagggggttgtgatctttctggtcccaaattaaaaatttgttcgtcttcatcactctcatctccctttttgattagtgccttcaaccctttggtaatttctacttttgatggttgattttggtgttcatctctcaggtggagataacgagacaattcttggttataatgaatattttttgctgtcacattctccctctttctttttgttctttccaacccatgtttagcaaaatccaagtttatgtttcccgaatcactgctttttaagccatgataaatttcttcgggtacgagaacaaactttgaagccatgataaaatgatcaattgtcgctctttgagcttgaatttatagcagagcgtgccaaatcaataagaattggagtgagcagagctgcaaaaactcctccgagcccacttccggtttgaactaggaccttccgtgcccctctttcggtcctacgacgagcaagacttcgaacaaaatttgcgtaaggtagcaaacgctttctttggcgagttgttaatttaaagtgtgaacaaagaatatttaaagctatttcaattagtgttaacaattgatcggcatttgcacgttttaaaatttgcctcctttttttcatcgatttggttttggcgagtacacgaataaaatcaaaatttttatgtacaatttctccaattttacaaaaggccattttttggaatgaaaatgatcttttttccttcttcttcgtcgtctttaaatatgccgctccttaatcgcagcagggnggtttgaagcagcgtgcatatcaacaaggagatagccatacagtttattagtcgcaatccgataggcagaaagaaataatccagttttcccggaaaaagtgcactccaatgttccgaatcgccagcgcggaattcggagctcgcattaataccaaatattgcgcattctgtctcgca

SEQ ID NO: 37167 - DNA, 924 bp, Heterodera glycines
  misc_feature (865)..(865): n is a, c, g, or t
attcatcctttttacgaggcaatggaaggacctcacgcctgctgatgaacttcatcatgctgcgccgtggacatcatgcccgagaaaaaacgtgatgaatattacaagtggctggaggagcttcaaacaacaacaacattgagccattcataaagttcatcagcttccaccagcaatatgctcaagacctggagcccgcgccctccctccgctcctcttcctccgcttcaatcactaacacatattgtattattcttatgtatatattgtacaaaaaattcattaacggttgttaatttgaatgtgtatttatgtatgtaaggttagaaatttgtgaaaattagtattcagtagtctcaataaaattaacttgttaacgataatggtatcacttttccgattttaaaaaacctaagcacaaattttgaataacccatgaaatttgcattatttccttcacaaccttcgatccaaccttccttaactcttacaatcagcatcattaaattggtgcacaccagggatggaattccgaggcccaaaaaattttcggaagtcggaattccgtgccatccctggtgcacaccatttgaagaaacatgtaaattgaaaaggaatttaaaaaaatgaaaaaaacaccgatttgcttgtaaaaaataataaaaaagtaaaaacagaattgtgttagaaatgtttacattactttaattgaaatttaattaataaataaaattccaacttttattttactttcatttttaaacagtctaaaaacccattaacaaaaaattaagagattgtcaatttattaaaacaataaaaattctcaaaaaaatttttggcattgaatcttttggaattttanaataataggcagtttaacgaaaatattttttgcccattaaataaaaaatactcaatcat

SEQ ID NO: 37168 - DNA, 799 bp, Heterodera glycines
ttatgggggagcaaaaatccaacgcagaattaaagcacaggctatagggaagctattccggaaggattcggtctccccataaatctgggcgcatcggttcggggggactgccccgaaaacaaaaaaaatcgattttttcaagtgtccctttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaaatctattttttcaagtggccgtttgggggactcaaacaattatggggagcaaaaatccaacgcaaaattaaaggacaggctatagggaagctattcccgaaggattcggtctccccataaatctgggcgcatcggttcggggggactgccccgaaaaaaaaaaaaaacaaattttttcaaggggccgtttggggaactcaaacaattatggggaggaaaaatccaacgcaaaattaaagtacaggctatagggaagctattcccgaaggatttggcctcccccctaaaactggggggaatcggttcggggggactgccccgaaaaaaaaaaaaacaatttttt

SEQ ID NO: 37169 - DNA, 694 bp, Heterodera glycines
ctttgtgcgttcgaatgatccctaaagatagggtttgttcgaacatgaacaaacttaggttttatcaattgattggactcaaaaaatgcgattggacttgtatattttaaggcatacctattttatgtttcttcagctacattgaccattccgtgatcgcatttctgcgttccaacatggaaatttttgaaagaagcggcaccaaattggatttgaatctgttttcatgcacaactaaggatgaccaacagctttgggaacaattctcactgaacttgaccaattgaattcaatcgattctgacaatatgttccccgctgtgatcgctgatgattatgggccggatgcaactgctggccaggcgttgtccaagtggttacacactccgacgagaaaagatggccaaccgaaacggctgttttgcaaagattttgacgatgaagtaaacttagattgggtcaacagtttcaagaaggcatgtgtggtcatattctcataaagttgggttaatctatctatggtacccctttttgggtaatccttcggaattggtgtcccgacgcaaaaaaatatatataaaaattttcttacaaaatcactttttctaggctaaaaaaatgcactagctcggattttgcacaatcattgattctgtccatgattttttcatcaagtactttgtgaaaattttttt

SEQ ID NO: 37170 - DNA, 1031 bp, Heterodera glycines
catttatattatatattttttgtaatctgatcaattgtcttggcattttttcgaaagaattataaacaaaataaaatttgtttgaaaatcagaaaaacaactaggtttctccattataccatatgatgctctacttatggtggtgtgatgaaaaaaacaaaatttggccaatttattcactgtttttcatgacaaattctgctgatggacttccgcccgactatattcaattaaaaatgatcttttaagggtaaattatttgtttatttgtttttattttttgattttccacgtcaaaaagacgaaatatccatccattccctgaacaaattcattcaattcatttgcccatcccatcagctttatgtcacttccacctaattattaagtattattaactattcccatttctcccgcccccacaaaaatattgggtccctttttaagagtgggagggtgaaaatcggcaaattggcggcaaaaacagaaacaaaattttgttttggcaaattttcccctcaattttggtcgtcggaattggcaaagcagggggggggcatctcatctcatctcaatcacaactttccccggctccctcttcaatttatctccgaattttgcccacgttttgcgtttgtcgcttttcccgtaggcattttttgctttgttttagttttttgttcccaatctccggcatttttttaccgcaggggacaaatgccgacaaagcaatgtaaaataggggggggggggggggaagagattcgccttaagcgttgggacaaaattactgaacccaaattccgctgccctccgagtgcccggaggggaaacaaaaaagggtaattttaattgaggaataaatatatcgtaatttgggcaaattactataccaatgattccaatcctaaatttttctataatggacaaaatcttattttgtttattactacgcatatcaacggatatccgaccagcagataaatatttaccgaaaaaagtagcatttttttgctggataatgatcgcta

SEQ ID NO: 37171 - DNA, 1093 bp, Heterodera glycines
tgctcttgctctccactttctgttgctgttgtgttcctctctttcgccgtctcgtcaccccgccgtcctctcgtttcgccacagtctctccccgctgctctgcttgtctgatcacaacaatttgctgcttcaccaccggtggcaccccattattattattcttcttcccgccattagcagcaggcacttttttctgctgttgtccattattacgagcagtgttcgcacgaagtgccggcacatttcgttcgtccgccttggcacgctcatagagagaaatcaactgaaaattaattaattaagtgattaaaactaattattttcaatcaaattatgagatagaaaaagttaatgaaagggtttttttaaaaactgttacccgcccactcacttgaaaaaatccttgaatatttaaagaaattgagggaagattttaaaaattttgtaaaaatttaaagagaaaaaaaatttctattaaaaattatttgtcgatatttttaaaaattaaaccttttaaaaaaaagaaatttttctttatcaaattctaattttttctatgaaattcttattggtcaaaattttttttatgaagtttcaaaaaaatttatttttcatttttatagtattttcttaattctttaaagatttttcaaatttttaagaatttttcaagtgagaggagtgggatggaagttttaagaaactcggaaagcacgaaaactatgaaaaatgcaaataatgtgatcaatttaattgaagccagcccttaaacaaagccaaaaacgcacataatcaagccgaagttcgagctgattcagcgaataaaagttggcaacgtcatccgctgaccatttacccccgagcgatgcggcgatcgcttcgaaattttttccttccgccacaaacgcttaattttggaaaaaatatgaaaatttcacaattaaatgctggtcttggtaagatcaaaatcttggattatggcaagaccaaacaatctgaattttgcccaagtttttaggccttttgaataggttcggtcggattgttttttgaacgcttttgagttgggagcaggacaaaacggcgccacaat

SEQ ID NO: 37172 - DNA, 1498 bp, Heterodera glycines
tcatagacattgagtttattaaagccccttccaataaaaaacaaatagtaaaatcggaacaaaacccgttctaatcccttttaaatattcttaatagccccaaaggaatattaagacccgagaaatatatagaataaattcgaaaataactaaagaaaatatgagtaattattattgatacataagtacacacaaaaatgctagtgaattttttattttagtaattggaaataattaaataaaaacattgcttaaacagaaatgacaaaataaaatttatttttatgaaaataactgtaaaaaacgaaagttcactcatccttatttttatcctaaaaccagaggaacttgaatttttttcaacttattatcattaaacagaatgtgctaattatgatataatacaaattcagcaaaaatataaatataaaaataaaattacattacatttataataataactgtatctttgtagaaacaaatatttgaccagaaaaaaataaaataccaattaataaaaataaagtgcagagagttatatggtttcttgaacaattcaacagaaatattttcattatatcatttgaaattaaatgctccaaatattaatggccttaaaatagaaaaaattaagaatattttgtaaataatgaaaaaaatcatttttttgaaaaattaacagcataaaatgttataaaacaaaaaagaaaataataaaaccacagcatgtttgagattctgatgatcattggctgaccaagatgaactgaaagaatatgttaattagttagaaaagatttttttattaaatcatgttaatgacattttttaagtaattggtgatatatccaaataaaataaaatttattttaaattttatgactcgaatactaaatttactaaaaataaaaaataatctaagagagggggtccgcgccgacggacggcggaatggtggggaggggtccgtcgaagagagggggtccggacatttgctgaattggaaggaagagagaaactagaaggaagaaccaaaaatagaattttttagtaattttttaagataaaggctttttacaatcccagagagaaattccaaagattttcatttttatacttgagatggaagcgaaccctagaccttttttgttcaacagcaatcggcttatcacccaaaccattcccttttgttctctatgcctcggctttaacgcagataatccgtccactggcccaatccttacaatattttagttttcttttaattttcgtgggattcaattactgccgacaatgcgagagaattttaaccagtccgaaatttgcaacaccaattaataaaagatcctagaaattgcctgcgatatctccacccatccattgccccggtccgccatttgaactgttttcaggcatagctataaatgaaaaaaaaatccgaatttctccaaatttctattataaatttaataaaaattggctcaaattccaattaaaa

SEQ ID NO: 37173 - DNA, 1324 bp, Heterodera glycines
cctacacaaatttctttcatcttttctgtctcctttttagcttcgaagagttggcccatctgagcggccttcccattgaccaagtgttgcaaatcgtccgccactatttgctgtgggcccgtgccatgctcatctacccaatttgcaccacaaatgtgtacgccaacgcaccgcaacagccgcacaatttcagaacgtacttcggaaccaattaattagccactattattatttataatcgaggataatttttgtcgaaatttgacccaataatctcggacatttttgttctcgaccatttcgagaatttctcgagacgtttttaggtttttggtaaatttattacaaacatcaccaacatagaatattctattgatgtcatttagtacagttttgacgccatttttagtttggaggcacagtttggtgaccgtttcggctccgattgctgtcccatggccgatgtgttggaggcgttctcgcccccgtgctcgcttggcacctttcttcaggacatgaccatctacgcgggatgtccctctctgcacatgtgtaattaaaacccgataattcgacatgtcgcaaaattattgcttttaaaactcattgcactcaaaaaattgtcaaatttcactgggttttcccactaattttcaaatttccagctttaatggtgtttctgctgcgcaatcagttgctggtccaactgcacaccttcttcttcctgctgccccttccatccaatgacgccaacgacaattgcaaagccaaccagcaacagcagcaacacaaccacagtcaaagggaacgggggaggagggacagcggagcctcaaatgatgatgccaaagaaggcgaggaggggggagaggaggacggtacagaaacagcagcagaacaaccacaacagcaatgggttgggccgccaccgccccccgcggcggagttgggactgtcgccagaggtgggagtaggcaaatttatactattttggtcaatcaatttccctcaagacatgctcgttggtccacgattcgcgtgagttcattcccgtggcgctgaagtcgcacattctgaccatttgcgcgcgcgccgtacatttggtcggtgtgccggagtcggaggtgttcgacatgctcgccgcatttatgaccattgtgccattcatggacggacgccatcacttagagggtcagtcagtcgaaattggtgtctctctgcttttattccatttttgtttgtcgttgttttttaattgtaatgtggacacattccaaattgtgtcactcatccaataacttcagacattatgtaccgcactcag

SEQ ID NO: 37174 - DNA, 704 bp, Heterodera glycines
ggcataatgccacagcattggttgagcatttttcgcgctggctttttaggcaacaaaatgattcacaccggtgtccatctcgggacaattgaaatatttcggtcaatcaattcaagaatttatgaagtacaacaaatgatcgttgactgtgtgagtaaccaatgcgctgatcagcctgacaattgccaagagatggtcaaggtggcaaaagcacagctgagtgtccgtctgctgatcacaatggccaaatacattgtcgaaaatagagttttgtaccaaatttacaacaatccgttacaaaaagcccggctttgccaatggtggtaccgattcaggtaaaaatgtcatcaaaaaacaaataattcttgtcctagctttgctttaaagtcgcagtttacggtagttgacaatatttgttttgattagttcaatttctgatcaaaacataaatatcacagatactccgttgctgagtcggccattaaatttgttgacattggcacttcaagtcaaattcgtcttggcattttgcaatattatttgtacacacagtcaaaattgaaggcattaattgcccaatttgacagtaaaaatgcatatttggctactgtactgtcaacattggacagtaattcggcatttttgaactttcgaatgaacacaaccgatgcagagcaagccgagtttattccatcatatgaatt

SEQ ID NO: 37175 - DNA, 986 bp, Heterodera glycines
agtcaatctggaaattgaaagaagcagttactaaaaacaaccttttgattgaaactgtaaacagaataagagctgatccctcaacagtgacgaatgaagtacaaaaagattaatttaaatgtttaaattaattatttaaacattcctatttttactcttcttttttacaacattttctatatattttttgtttttcttatgtagttctttcccgagagtgtgttatatatgcattcggatgtgatcatggaatggaaagtgcgcaaagaatttgtagaagtggtggccaatgcgatgcgaaattacgcggccataagccaagcgatggactcggaagagatttccacgtattttaaagtgagtgctcttaacactcaaagcaattagcaaccgttcgtttatcacccggcaattaaactcaatttgagcatttcttgagaaaattgcacagttttgaataatttttggcattttcgcacaattttagcgtttgttttacacattttttaaatttttaagtatttataaacccgttctgtgtttatttatcacttaatcttttcgcttggtgaattttaagcgcattgaaaattaaaaggaaccttaaaattcaaatcaattaaaaaaacaaatattttttacaattgctttaaattaaaagcagcaaattttgtgtttcagatttggatttttccgtggaagtaaacaattgaacccggaaatttcaaatttgcgttcctatccccctgcgggagtggaactcaacattttttgcgggacgggatcccgcgggattaaccctacaaattcccgctttttccagatggaattgtgtgattttgaaattcgaattttgactttaaataataaaaaaaattctctaaaaaaataaatataaccaattttcaacctttttttgccaaaagaagtgcacaaaaggtaaaatcaagaatagaatcctgaaaagatttaaataaaattcttat

SEQ ID NO: 37176 - DNA, 829 bp, Heterodera glycines
ggggagcaaaaatccaacgcagaattaatgcactggctatagggaagctattcccgaaggattcggtctccccataaatctgggcgcatcggttcggggggactgccccgaaaacaaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctactcccgaaggattcggtctccccataaatatgggcgcatcggttcggggggactgccccgaaaacaaaaaaatcgattttttcaagtgtccgtttggggtactcaaacaattatggggagcaaaaatccaacgcagaattaaagtacaggctatagggaagctactcccgaaggattcggtctccccataaatatgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttccggggggactgccccgaaaacaaaaaaaatcaattttttcaaggggccgtttgggggactcaaaaaaattatgggga

SEQ ID NO: 37177 - DNA, 1041 bp, Heterodera glycines
  misc_feature (135)..(135): n is a, c, g, or t
ggggaaaagtaagatgatactgatgattagcgttcttgttcgattttgcagctagtgcgatatttatactcatgtttctaggaaagtactcaggaagtatttcgatgttagtaaaccatcagctgatataaaganaagcattgttgtctgtccttttccaattatattgccatttcggcatcggtctaacaaagctgcgcatggctttgggaaattcctcaggaattaattttcgttgtctaaagaaatgcgctagtgtcgggcattttgacattaaaaagccattaaggcaccgttgtagcaatgatgcacgtggtccttggaaattcctcaggaattaatccctgaatttcttctattttcttatcactcacaaatcactgggggaaaattaagatgatactgatgattagcgttcttgttcgattttggcgctagtgcgatatttattctcatggttcttggaaagtactcaggaagtatttcgatttttgtaaaccatcagctgatataaagaaaagcattgttgtctgtccttttccaattatattgccatttcggcatcggtctaacaaagctgcgcatggctttgggaaattcctcaggaattaattttcgttgtctaaagaaatgcgctagtgtcgggcattttgacattaaaatgccattaaggcaccgttgtagcaatgatgcacgtggtccttggaaattcctctggaattaatccctgaatttcttctattttcttatcactcacaaatcactgggggaaaattaagatgatactgatgattagcgttcttgttcgattttggcgctagtgcgatatttattctcatggttcttggaaagtactcaggaagtatttcgatttttgtaaataaaccatcagctgatataaagaaaagcattcttgtctgtccttttccaattatattgccatttcggcatcggtctaacaaaactgcgcatggctttgggaaattcctcaggaattaattttcgttgtcttaaaaaaatgcgctaagtgtcgggcatttt

SEQ ID NO: 37178 - DNA, 1123 bp, Heterodera glycines
  misc_feature (7)..(7): n is a, c, g, or t
  misc_feature (58)..(58): n is a, c, g, or t
gccgtgnacatttggggatttactattatttggacctacagccacactcaaaagtatntggagcaaaaataattttttttaaatccgactttctcaaagcctttgcttacactttcactgttgcaaacttttttcttttagtgaaatggttgtcgaaattggagacaaataacttttttaaattaaaatcctaaaaagttaggtattttagcgaatattcttcaaaaaattgccatttttgttgggttttttaaaaagtagagcccccctgaaataaaatcaatttcctgtgcgttttttatatacattacaaaataatgataaaacaaagtttttatgaatttgtgagcaaaaatttaaattgtaaaatccaacatttagttcataatctaaacgaatcaatcaacaaattcattctgctggttctgatcactgatcaccactcgtcccgggggaacggtcgagaagactgaaaaccaaaacaaaaaataaacatcggatttaaaaagggggaggggtgcattttacaggaatttgttgccagaaaatttgtcattggcgcctccgggaaaatttgggtgtgatttgttaagagaattgctgaattttaaaattttaaaaaaatttacccatttttgcttgaatttttttcgcatttcaggcggaggggctttagccccctcagtccccccccccctcccctggctacgcccttgctacaaatccaatttttacgtgattttaatgcttctaaatccgatgattttgttggcaatggattttgtgggattggcaaagcttttccatcagaattggtaattttcatttcctttgtgccattctctctaattcgtcctttaatttgaatttgattctccaacgcccatcgtcgcgttttgaagtgttcgtccacgcggcggtcaaatcggcggctgatcagtgcaatatcaaggccaagctgagagggcggcaacaaatcgaacactttgagccaacagtcggcagagatgaagctgaaagcagataatgatgatgatcatggcaattcagaatttaaatagttaattgtttacatcgctttttccatttgtttctccgattccttcggattgtccgacatttt

SEQ ID NO: 37179 - DNA, 1263 bp, Heterodera glycines
ccctcgcggcgacgacgaaaatggcattaaaaatgccacatatgaaaatggtgtcaccaccacctccacggcttccacgactgccggagagttgcgccaactttggcatcaattctatgccgaaactgccatgttgccgaacttcaccagccccggggcgcccattggtgacgcgacagccgcgcgttgtgtcgcggaatttcgcccaaccgaggcggtggggccggcggacggcacggtgtacccggccgaagaagtggtgtccaaatggcactcattgcgcttcccgagggtgggcagcggtggacgaagctacgcatttattggtgtgtgtttgttttggcccattccgaatcccggactcgaattcgaacaaaaagtcgaaaattcgttttttaaaagaattttcgtctaaaatcaaattaaaaccagcaaaaaatagtcaaaatggggtcgtatctgggaaaaagcactcggagagcttcttttgttaaattttaatgaaatacggtaaaaaatgtgcaaaaatttcgaaaaatttgtcccttatggccattcaaattttttaggctctttgtctaacattgaacgcgctttgttggactattccttggactttttgtatgaacggcttcaacatgatgagcaaggggttgccagtgtggaattggtcgatgttgacgacattcttccggcatgttttattttgtttttattttgcctctcattttttgtccattccaagcccatacccccaggggtcccgaaatgaaaaatgaaatttttttcctgaaaaactggtaatttaaaaaaaacatattggtaaattgaccctaagttttctaaattttttcccacggcgcctaactccatctccggatccctattttcccataatttttccaaaattaagtcttaaaatggcctagattgtcccgtttttttctactgcgccgaaatttaggtcaaacaaacacaatgagtaaaaaaattttttcccggagagcaaaaacaaaaaaaatttctttggttgtccctccaaatttttgttttctggttacaggcctggtcattcctcaattttatactcattttttccgtagttgtccaccacgcgggcttgcggagtccaacagggcggctacgccattcccccgtcctccatgcagtaccgggtgtttcgagcggatcagctcccgaattgacgacccgccctcatacacccccacaaatttgcaagttttattttatttatttttaatt

SEQ ID NO: 37180 - DNA, 745 bp, Heterodera glycines
ttcttgggattttcccttgtaaaaatggaagagccgatctcgagttaaaaacttaagtttcacaaaataaacttggaatcgttagagggggtcaaaatatgggcctatgcaaaatttcaagaaaattggtcaataggaaaaattttttttcaaggacaacaaaatcaaatttatttgcaacatttttagcattaaaaatggtatctacacgtaataaaactggaaaatttatgaagctaagcaattctgggactgaagcaaatcgaaagcgaaaggaatggcgccaggagcgtgctcgaaaaggcggctcgacgccaaaaagtgacgaaaattgaccaaaattaattttatttgaaaacactgcatttttcagcgctaaagcagaccgaagccgaggcaacagcagacggagagggtacatcgacccaagccgcagaaagtggaccatcaacgtcagctttggaccttcgtaagtcaaaaaagtcactattttagaagcaaaaattaaattaaggccctcgttcaagccctaggccattgtcagcaactccgatcaggcgccatgtgggtgtccgtccaaaaactaccgacaaagcaacgaacatggaccttacaactaccgacaatgcaacaaacacggatttgacaacgatggacaaagcaacggacgtgaatttggctgatgatgacgccgcgacacttaccgagcaattggacagacaggtgacggaggaggaacaaacga

SEQ ID NO: 37181 - DNA, 247 bp, Heterodera glycines
taataacgctgcggacatctacatttttgaattgaaaccatttggtaattactctttctttttctccatattgaccatcatactcatactccccccacccttttcttcttccgccacccacctctcttgatagtttaaactgaaggcgggaaacgacaatctgatccccatcaagctagcttctgcaggtcctgctcgagcggccgcccggggatcgatccccgatctagtaacatagatgacaccg

SEQ ID NO: 37182 - DNA, 982 bp, Heterodera glycines
agcttttattttcttttattttggaaaaaatcaagtacctgataaaaagtcccctacaaaatcaatgctaaacaattctacacaattgcctataaaacaaccttttcaaaatgttcaatttcatccatcgttttcatgccaacccaaccaatttgtgctgtttccgtatctatttacggaacattgataaataaaagatataaatttaaaatctccaaataaacaagaaaatatttcaacatatatcatcaattcatgggctgttttttccctcctccaccggtgccttttccgtctttttctcttctcccatcgtttccattttgagctgattgttgtccaattcctttaagctttcctccatcgcaatgagttcggcctaaacaaaatatttgtttgatttgatggtcgaaaatggaagattaagcggagagggaaacccaaaattgggtgcaaattgacagtacttcttgatactaacctctaaattttcggtcttttcattgtcagttccctccaacaattttggcgaatcgataatgttgatcagcggacaggcggtggccaatgccgggtccaacagcagcagggaagaatcatccgtaacggggtatggaacaacgccggcaagggcagagatgtctgaaaaagggggggggtgaaacttgggaaaaagaaaagatgttatagaacaaatgccataaattttatggcgtacggccttttatagtcggacaaattgtttaatgtaaggtcggataaactgcagtttagccgcctttcaattggaaaagcacgttgcaaaagcggtttaaaacccaaaaaaaagtcgtcgatttaaaaagacgaacccttatttgttagcaaatttccggttgaaccccccccctcccctcccctcccgcaccctttttcatgtactaaattcgattgacctctctgctcctcgtcagtgtgttcttgcgactgtttgtgctgctgc

SEQ ID NO: 37183 - DNA, 679 bp, Heterodera glycines
  misc_feature (615)..(615): n is a, c, g, or t
atgaagatgcatttcgatggggggggggcagcggacttttaatatttggggaggagataaaaagaggggggctggggccatgctggacaagacaaaatctcgacaaatcccgactctctcagatataaaatgggacaaaatattgatcagcagaccaaatccctaaagttgaatggaatgtcgagttaataatggacaggtggaggaagagataatgaagcttagacgaacattgatccgagatccgaggtgaggggatgcgaaaaggaagagaaaaattccgtttaatatgagagcgacgggaggggagagagagagagagaaaaggggtgagggatggacatcacaaaacgaatgacggagtgggggggggggcgaaggaggattggaaaatggggacaaaagtgggaatgattagcagctagcagcagcaagaaaggtgattgggagggcggaggggagggctataggaaccgaatggatgctaggggagacgggtaggggtcagagcgggcagcaggggcaggaaatgcagattcatataggggatgggggtgggggacattgggaatcggaaaaacgaatcgaatgaatgctggggttggaaaatggggnggggggaggcatgggtagggagatggggggaggaatagggggatggaaaaatgtagattttcaa

SEQ ID NO: 37184 - DNA, 1220 bp, Heterodera glycines
  misc_feature (1201)..(1201): n is a, c, g, or t
ttctcctgtcgtttatcagcaaaccaaaatcgggccgctttgtttccgatggaattgtggaacatgtgagatcggtaaaataaccaaataataagtaaatgaattttgtaaatgatagggtggaaggcgacctctacagaaccaataacagtgttgaagcttggcacagaaatctgaacgcgttattccgttcaccatcgccacgtctaagcatttttcttcggaaagttcggcaagaagaaagccattggcgtcagcaagttaaagactttgcaaacaacccagcaaatggaatacgtggcaagggaatgaaacgcaagcaaacttatgtggaccaagacatgaatcttaatgagttatacgtcacgcgaaacaatcgccatcctctgcaatattagcgcaatttcccaccgaatggcagaacctctttaggacaaaaatcaatgatttttcatgtttatagtttttaaaacgtaactaagaacctctttaggaataataattgatttatttttcatttttaaaattaaaaataatttttaaaaatttaattttggtgtcgtattttccgggtgtcgcattttctgtttttttataaaaaaatttacggtgtcgcattttccgccggtgtcggattttccggtgtcgcattttcagggagccattcgtgtgggggtagagcgaacgaacgtcgtaatatttcatccaccacccctccggcaccttttatttattgcatttattttgtttacttaaaaaatttattctacctaataaaattgctgggtttttctctaattctattgatcataacggttgactttgtgcttttagattttagatatattgagaatgctattttatttattttatttttggtatatattatgaaaattttttggaaaaataaatatgaatgaagattataattgtgaaaataaattcaactatattattatttaagaattaaaattaatttaaaaaatttaaatgttaaaaactttttaacttctctcataagcatcaattagatggtgttgagtccgttatcaaatggaaatttcaacaaaaaactgtccataacttttgtcaatatcaaccaaattagacatttttggtatcattgtatagcaataagtgttctctacaagttcatcaaaatttcaaaaaatttggtcaagttttacaaagttatagccanaaagtacgaaagttaccaa

SEQ ID NO: 37185 - DNA, 691 bp, Heterodera glycines
atagaaaattgtcctaaaaagagatagccctttttttgagaattaattcccaattttcgccactcttgcggtaatggaaaaaattttgaagaggctttgcggaacggattagcatcggggttacgagatagaaaattgtcctaaaaagagatagtcatttttctgagaaataattcacaatttccgcagctcttagggtaatggaaaaaattttgaagaggctctgcggaacggattagcatcggggttacgagatagaaaattgtcctaaaaagagatagccatttttttgagaattaattcacaatttccgcagctcttgcggtaatggaaaaaattttgaagaggctctgcggaacggattagcatcggggttacgagatagaaaattgtcctaaaaagagatagccatttttttgagaattaattcacaatttccgcaactcttgcggtaatggaaaaaattttgaagaggctctgcggaacggattagcatcggggttacgagatagaaaattgtcctaaaaagagatagccatttttaagagaattaattcccaatttccgcatctcttgcggtaatggaaaaaattttgaagaggctctgcggaacggattagcatcggggttgcgagatagaaaattgtcctaaaaagaaaaggagccattcttctgagaattaatccgcaat

SEQ ID NO: 37186 - DNA, 216 bp, Heterodera glycines
ccgatgatgcattacatccccggcggcgcagcggccaagccgttcaccacccaccacaacgcgctggacctggacctgtacctgcgcgtggcgcccgagctgtacctcaagcgcctgaccgtcggtggcctggagcgcgtgtacgagatcaaccgcaacttccgcaacgaaggtgtcagtacccggcacaacccggagttcaccatgatggaactg

SEQ ID NO: 37187 - DNA, 189 bp, Heterodera glycines
cgacctgcgcttacgatactgtcgccttctccttcggagcgtgcgcttctctactcacgctgagtatctcagtcggtgaagtcgtcgctcagctggctggtgacgacccccgtcagccgacgctggctattcgtactatcgctgagtcaccgtaaacacactatcgcactgcacagcactgtacagata

SEQ ID NO: 37188 - DNA, 166 bp, Heterodera glycines
catcgccataggcatcgcgcggttgggcgcgcacgcccggccgattactcgtgtacatgagccggcgcgacgcatcaggtggcaattgccgcggttctgccgcatccgccagccggagcagattgagcaccttgctcatccggtgcaaccgatgattgggatgcag

SEQ ID NO: 37189 - DNA, 324 bp, Heterodera glycines
atcgcgctcgatctgcgggtattcggcgctgcgcaggatctgcccgcgcaggcgcgcgaagctgtccagcgccggatcagccagggcgtccaccgcctcgtccagcgcggcatcggccgggatggcggcttccttcagcgcacgcgcgcgcaggaacgcatacggtgccgcccacgccgcgtccatgggcgcctcgcgcagtgctgcgcggccggtacgggcaatgcggctgcacagccccatcacctggtccagcgcctgtgccggccggagaacgcgcgcgttgcgggcggcctgcaggtgcaggtatgcttggacctgcat

SEQ ID NO: 37190 - DNA, 520 bp, Heterodera glycines
ttcctttttgcagaattttctcttttatctttaatctccttttaatttctttcaattttcgtttttttctacacgtttcttccaaggatttcgtcaaatgatttcagttggagttttttcttttctgattaaattagactaattagaattatttttaaacagaataagaggaataaattctttttttaagatattctcttttaatgttgataattttcttataaaaaagacaaattatttgtttttgattatccatggcagggatgacattcctaggccccaattattttcggaaatcggattccaaggcccaagattttttctgaaacataaattccgatcctatgtcggaaatcggaattccgtgccatcccaggccatttatttatttatattcgaaataaaactgcacaaaaacaaattttctaaattcaaacaaacggcaaaacattaaaacaattttctgagttattcgaaaaattttttttattgaaaacaaaaaagtacgaagcggttgggc

SEQ ID NO: 37191 - DNA, 714 bp, Heterodera glycines
ttagagctcggcctggacctggttccaggcctggatttttcctggctccaggtccatgccatttttctgcaacctgattttttcctggacctggatttttgtccaggaaattgacctgcgcttcaagaaaacgcgtgccatgcgcagagagttgaacaagcatgagctttcattgaagacacacaaacaggtgggccgccaaaaatcatagtttttgatttttgggaaataattggaccgatttatttgggtttagagtcctgtaatttttgaaaaaaacctaacaatgagccagggtcaagttttccgagatggacccggatataggactcttggtccactggcatttttcgtccgaataaagtgcccgatcttttgaaaaaatggaaatcccggtcccggttttgccagtcccggtcccggcgggactaaataagcactggtaagaatgggggtctgggtgagaaaagagaagggaattggtgagaaggggaaatctttgagaaaaaattaattatttattttatttattgccttgtttttcacatcgttatgtggtctagtggctaagccttctgattttcattatttttcgcttgggttcaattccccacttgaacagaatattttttatattttctttaccatttttgtaattgaaattttaattaataaataaaatattccaagtttatttttatttaatttttaaac

SEQ ID NO: 37192 - DNA, 142 bp, Heterodera glycines
gcttgatgcctgaggtccaccatctggcacagctgctttccggtaagctttactcttcattgcgcgaaggcgggaaaaaagttttctctggcgtgccgccaattaaagagccgctcaaacgcaccgaagaacatattaaagg

SEQ ID NO: 37193 - DNA, 421 bp, Heterodera glycines
gcttaacttcaactcaacgagctcctgccccgcacccccctttacccgtacccgatactgtgcgtctttgcgcagtgggagtatccagtgtttctccgctcctgaggcgctccagtgatggaggagtcccagcgcataaaaacctttatccagtatcgtcaacgagtgctccggtgtctgttcagccaactgtgcagcaaggtcaacctcactggtttccgagacgctgccgaagctcacgcctgtcagcaagtgactggtgacctccatctggcagaccatgcgaagctgcggccagtcggaacgcgcgtgctcattggcggtgcgtccgaaggctgcgtcattttcgggcgtatcgggcgttctccacaacgtgccatctacagccaggagtgtcaggccattccagtgcgataacggg

SEQ ID NO: 37194 - DNA, 964 bp, Heterodera glycines
atttctcagagaatttttaaatttatctatactgcaagaaattgactatctcttattttgagaaattttatacgttacaaatgctctcgagcttgataggaagggcggtgcgcaatcaccatttaatttctcagagaatttttaaatttatcttatatacaagaaaaatgtctatctcttattttgagaaattttatacgttacaaaagcgctcgagcgtgagagggagggcggtgcgcaatcgccatttaatttctcagagaatttttaaatttatcttatatccaagaaattgactatctcttattttgagaaattttatacgttacaaatgctctcgagcttgataggaagggcggtgcgcaatcgccatttaatttctcagagaatttttaaatttatcttatatccaagaaaaatgactatctcttattttgagaaattttatacgttacaaaagcgctcgagcgtgagagggagggcggtgcgcaatcgccatttaatttctcagagaatttttaaatttatcttatatccaagaaaaatgactatctcttattttgagaaattttatacgttacaaatgctctcgagcatgataggaagggcggtgcgcaatcgccatttaatttctcagagaatttttaaatttatcttatatccaagaaaaatgacctatctcttattttgagaaattttatacgttacaaatgctctcgagcatgataggaagggcggtgcgcaatcgccatttaatttctcagagaatttttaaatttatcttatatccaagacaaatgactatctcttattttgagaaattttatacgttacaaatgctctcgagcttgataaggaaggcggtgcgcaatcgccatttaatttctcgcgagatttttaaatttatcttatattccaaaaaaagggctatcccttatttttagaaaattttatacgttccaaa

SEQ ID NO: 37195 - DNA, 108 bp, Heterodera glycines
aaaggcacaaccgcatggtccagaggaaagcgttctacagctgcagaacatgcgatcaggtcgttgtgtttctccgagaggctgataaagccgaagcccaggtcatac

SEQ ID NO: 37196 - DNA, 204 bp, Heterodera glycines
cggtgtcatctatgctactagatcggggatcgatccccgcttggccgctcgagcaggacctgcagaagctagcttgatggggatcagattgtcgtttcccgccttcagtttaaactatcaagagtatgagtatgatggtcaatatggagaaaaagaaagagtaattaccaattttttttcaattcaaaaatgtagatgtccgca

SEQ ID NO: 37197 - DNA, 104 bp, Heterodera glycines
taaaattcgaagctgcgatcgagatcgctgacggcgagcgtcaggtgattgaggccggtcaacatgcatgcatttcctgggcgctgaacagagggaaaagtgta

SEQ ID NO: 37198 - DNA, 155 bp, Heterodera glycines
cgcttcactgttcaaatgatttatgatgataaattgttggcatttgctgctgcttctgcgctgatgcgcactttcccaaaattattgcacaacaaatggccgcccagagaacaaaaatccctaagggataatttcgccccgtcgttaatcccccg

SEQ ID NO: 37199 - DNA, 56 bp, Heterodera glycines
ccgacgatcatccgggactgtccgagctcggcctctgacccgcggcgctacggcac

SEQ ID NO: 37200 - DNA, 50 bp, Heterodera glycines
aggcattggaattttgcctatgccgcccgccacacattgcgcataatggg

SEQ ID NO: 37201 - DNA, 73 bp, Heterodera glycines
caacggtgcgaagcgccggcagcagcggcggatgccgctgccaggcgcgggcggggcatgcgccgcccgcgcg

SEQ ID NO: 37202 - DNA, 1292 bp, Heterodera glycines
ttagtcgaaatcgacatgaaaatgtcaaaatccaaaaatccggatttcggatttcggatatttccgtaattcgaaaaatcataaaccattttttttattttgtttaccttttttcccattaatggtttctaaaattttcagcataattgtgttattgggcggctgatcattcagcattttgtcagttaacaatcggagcgaaatcacttggtttgcctcagaaatgttgtcgagcgacatggtcaatgtctgtgtccccattgtcacagctaaaccgtaaccacttttacagtatacgatgactcagacaaaaagcgaacttttttacaaaaagaaaaaaaaaaatccaatttcggttatcaaataaatatacaatcatttttaaacaatgatttaaactagtatcttttcggttgtcaagtaaacgatgaaattttgtgaaaaaaaatttagtcaaagttttggtgcatcttagcaataaagttttttcccccattggccgcgagatttattttaatgccataattagccaaagttttgatgcatctttgctataaagtcccaccccccgtcggcgaagaatttatttttaatgccaaaataatttaaaattatgctgcgagtgtgggatttcctccaaaagtgtagcttttatattttgaaactttgtgccacagtttctcgatgtataatttatgcatcaaatttcatctgaatgccgaagaatatggatgtaattaatttatttatttttaagctatgtttttattttttattttggcacaattggatttggcctgagaatcaaaaaatttaaataccgtaccgatcctcaaagcgtcccgtgcccatcgatgcctctttgggatcagttggctccgaatcggatggtcgcaaaaactttatttaaaaaaagtgattttggcatttcaatttttgattttggcattttttcttacccatgcttccaatgagcagttgcagtgccggatgacgaaaagtctcatccgttgcgcatcccatgggatcatgtccaagccgagcacccaaaagcccacaaaatctctcaatttggcaccacttaatgacttattcttatactgctcaacctttgcatcttcaacttcaatcacttcttctaaaatattattaaatatttttaataaaaaatttaaatgtaaaactaattttaaatatttttaccatcgaccgtaatgtatgaagaaaaattgtttttgtttcccaaatgaactgttgaatggacgaaacacttcgggcacaatgtaactaaa

SEQ ID NO: 37203 - DNA, 909 bp, Heterodera glycines
  misc_feature (903)..(903): n is a, c, g, or t
tgttgctatatattttcatcgggataattttcgacttgtcgaacacccgatcaaaagcctcaatcatgtcctcactcttctttgacttggccggtgcactgaagatcattcgactcagcacgtcgatgcataccaacagatatttgtaaccgtcgttatcgctttttcgactggtcaaatatgcacaaatcacactgccaatcggtatggaagccactcggtatcgcctttagtctcgggaatcttttccttatgggcttgtgaatcgtgtaagttctctgtttttcgagaaaattattaacgtctccggtcgtgatttccgggtcaatctttttggcctcaattaaaattttttgaatcccagcgaaacttgccggagattttaaattaaaataaatttttgataaaattttctctacagtctggcccatattagtggtttgaagggtttcttctctcgcactatgccgggtgtttttatagattttattgcctttttccttccacgtccccacatgacctttgatttatcaaccatgtcttttactgttggatccttcagtaaccgatctttgagaaattttgcaccccggggtgtttcatctttcttccctgcgagatacaacaaaacatctctataattactgttttcaatcggcaaattcatgttcgactgtacctttccagccgccgtaattttaaataaatctttattttcctttacgtacctaaaaagaccgtttaaaagggtcgggtgtataatagttttgatcggaatgggtgtttttaatgtggatgttgtttggggctccggagttaactcatttattgtatcattatctgattcaggatcaggagtttgctcttcaagtcttttcctaggaataattatttccgcggggntcatcg

SEQ ID NO: 37204 - DNA, 799 bp, Heterodera glycines
atctaaagaattttttttcggcagaagggacaagatgctctcgaaaaaacaaattgaatttgccggtgtttcaagtctaaaaactcgagaacttaatgaatttctaatttttggggaccattccccatttaaaatattgtaaattgaacttgtggtggacgaattttgtggcgagcatccaccggcaaagctgctgctgctgcccccgtcaaaatcgttgatggcctcgtcaatttcgaacaaatttttgctcgttgtgccattttggtgggcacgacgtcgttgtggttgtggtgttgctgctgcttttgccgctcctcctccaccaccggcactttttcgtgtgttggtggcactcttcggaatggtcgccgacaaatcgctcatcgccgcttccatcattttctggggtaggtggaaaaactggcggtttggaatgtgtatgtgtgtgaatttttttttgttgttgttgttaaaatagtgctgaattgatcatcgccatttcaataatttcattcgcagttataaaaaataattttttttttggaaattttgtatgattttttgaaaattttaaaagtaggttttcaaatttttccaaaaaacgctcaaaaaatttcattggttatccttgacatataaccattttggcatataaaccccatccccaggtagggagggcatatatcatctccaacatagaagtcatggcaatgagtgtagtccccaccaccaggggatatgtgccgacacccctcaaaatttcggtaatcataaattggcattctgacggcccaag

SEQ ID NO: 37205 - DNA, 264 bp, Heterodera glycines
caacatgacgccgccgccggtggtcggcgttggcggtgctatcagtgtgcacgaccgttcaccagggcctataatgtataacaaacagatcatgatggcaaggaatttgttggcatttttttttgaggaaagacgaagaattggcacatggcctcatgaaaattcccccccccccccccaaaaactttccaggccggtgcctattggcaccagcgtgtgcggaacaggacaaaacacagccgagacataacacagccaggaata

SEQ ID NO: 37206 - DNA, 992 bp, Heterodera glycines
  misc_feature (42)..(42): n is a, c, g, or t
ttttcccataaattctaaaggaatttgtaaaattattattanttttttggtaaatacaatattaaattatttaatattaattatataattaattataatattttttagattattataatattaagaaaagttttttttttgcttatttcacctatttgcagctttttcggttccggatccaccgcaatgatattctttgctccccgttctttgcatcccaacatcacgccaagtccaattgcgccaatgccccaaatgcccaccgtactgcccggcactaccggtgccacgttgaacggattaccgtacccagtggtgaagccacagcccaacgccaccacaatatccaatggcgcttttggattgatctgaaaagcatttttatgttttttgattaaataatttaattttaataaaaaatatttattttaaaaaagtgccttgcaaatgcaactctccaacaccacagtgtactcgctgaatgtgcttgttccaatgaaatgatacacatcttggcctcggcatttaaagcgtgtggtcccatctagcattgtttgtgccgagattttacaactggtggaaaactattttttaatttttttaaaaaaataaattccgatccttttttccttaatatgtttgtgataagaattttgtttttaaatataataaaagatataaataaaataatatttatttatgctttattggaaaaccaaattttaacaatttaaaaatgcgaaaaaatttaacccgttaattaatcaaaataaataatcattattaataatccgctaattaatgataataaataattattactctggtccaaattgaaaaagtttgcacaaatttgactccggcgcgtagcaatgttcacagctacggcattgcgggatcggtgccgggatcacatggacgccggggcaaaacgccatgcactcctgggccaaccgactcaacaatgtcagttgcctcgtgaccagcaatca

SEQ ID NO: 37207 - DNA, 1186 bp, Heterodera glycines
  misc_feature (73)..(73): n is a, c, g, or t
  misc_feature (164)..(164): n is a, c, g, or t
gtgatggtgatgaagtgatgaagaaaaaaacatttaaaaaattgtctgacgcgtgcatctctcccttcccacnccgcatcgttttccttgttaaatttttataaaacgaaattttttaaatttttttcagaattcattaggagatttttcaaacattcaatttntggagagtgttgtggcgggaaaaaagatcagtgatgtgatgcgatgcgattgccaaaacacaaaaacgcgtcaaaattttacaaaaaaaaaacgcagcccgcacgatggcccaaaacacggtcaatcctcccgagtttccgaaggccaaattgatttcaaccttggaaaggggggcggggtgattagctgctccggtgcccgggaacagcggcttctgccagcatttacaataatgccaaagttgttggttttcctaaacgactcccctccccctctctctggcacagctgtacccggacatgacgccggacggactgcacaactttgagaagcggcgcaaggagttcgaagtgctggccgaaattcgtctgtttcagtccgccgcccgctcctacaccatccaattggaccaggcattttgcgtgtggttccactttttgccggcactcaacgagaaggaatggtcagttttgctgagaggcattccacaaattatatcattttttgcctgttcgcatatatgaacaaaaagtggatggggtcaactgaaattattgcaaaaaaagggcgcaggcaaagggattcgaacccttgaattgaaaagatccgatcatgcaaatcgacgaacctttttttgtttttaaaaatgctttttgcggcgcgctttttttttgattttgattttttaagaactaaaaattgtgcaaaaaaacagaagagttccaagagcaaaggaggagtgccaatgatgagagtgaagttttatgtgtgggtcaattaaaatttattttcgtaattgaaaaaaaattctaaatacttttttgattgatcgttttcgttcaaatttaaaacccaaatcattttttcccattcatcttgtcatcttaaaaattgaaggaaaatttaacaaacaaaaaaattatttatgtagtagtaattaagaggtaattagtagggattctttttttatgtaagaaaaatcacggaatatgtacataaaatatgtatgaaaaatgctaaa

SEQ ID NO: 37208 - DNA, 1436 bp, Heterodera glycines
  misc_feature (856)..(856): n is a, c, g, or t
aaaaatgggtgttgaaaagtttattttgaaaaaaactctttacaaaataatacccttgggagaagtgagtggaaaacatgatttcaaaattttcaatgttttctagtctaatctactcaaaacgtttcagaattcaataaaaataacattcacggtgcgaaaaatggggtttgacaagtttattgggggaaaaaagactttacaaaataatacccctgggagaagggagtgggaaacatgatttcaaaattttcaattttttatagtctaatctactcaaaacggttcagaattcaataaaaataacattcacggtgcgaaaaatggggtttgacaagtttattgggggaaaaaagactttacaaaataatacccctgggagaagggagtgggaaacatgatttcaaaattttcaattttttctagtctaatctactcaaaccggttcagaattcaataaaaataacattcacggtgcgaaaaatggggtttgaaaagtttattttgaaaaaaagactttacaaaataatacccctgggagaagggagtgggaaacatgatttcaaaattttcaattttttctagtctaatctactcaaaacggttcagaattcgataaaaataacattcacggtgcgaaaaatggggtttgaaaagtttattggggaaaaaaagactacaaaataatacccctgggagaagggagtgggaaacatgatttcaaaattttcaattttttctagtctaatctactcaaaccggttcagaattcaataaaaataacattcacggtgcgaaaaatggggtatgaaaagtttattggggaaaaaaagactttacaaaataatacccctgngagaagggagtgggaaacatgatttcaaaattttcaattttttctagtctaatctactcaaaacggctcagaatcaataaaaataacattcacggtgcgaaaaatggggattgacaagtttattggggaaaaagactttacaaaatatacccctgggagaagggagtgggaaactgatttcaaattttcaattttttctaatctaatctactcaaaacgggttccaaattcaataaaaaataactttcacggtggggaaaaaagggggtttggaaaggtttattgggggaaaaaaaaattttaaaaaaataaaaccccctgggggaagagggggggggggaaaaattgaattttaaaattttttaatttttttttattttaaatttaccccaaaaagggtctcaaaaaatcaaaaaaaaataaaaatttttcgggggggggaaaaaagggggggttgggaaaaaggtttttttggggagaaaaaaaaaaatttttaaaaaaaaaaaaccccccccgggggagaaagaggggaggggggaaaaaaagaatttttattaaaaaatttttttttttttttttt

SEQ ID NO: 37209 - DNA, 1331 bp, Heterodera glycines
tttttctcactttcgagctcctcctttacctgaattattttttttgcctgagcaattgcctccattaacgtatttggtttatccaaaaagaaaagttttctttttaaccctgtgggtaaaccatttacaaaataatgaactgtttcagactcttgcctctttggtataatgcgtacttggcgaggcttgttcaacaagttctatgaccttattggcaaattccgtgacactttcgtgtcccatcttaattctggcaagcactttttttgcatacattggaccatcaatttttttgtttgatcagctagtgcttcagtcatttctcgccacgttttctttttatctgatggaatattcatgaaaagttcccggggttccccttctaaaaagagtgggagcattcggacacagtccgtcggatgccatcccgacgctgtcgcgattagattaaattcttttaagaattggtgaaaatctcccgtagcatcaaatttgggcatacgcaccccgtgcggtaggttagttgagattttgttagtcattttgtcctccaactcagttaatttaacctttaaggcgtcgtattttttcctaatctttattaggatccatatttattacgtattcttgaggttcttgagtctctcttttcgtttctcttttccttcctttttaatctttctgtattactttgtgccttatttttgaaccgtttcttcaaatattcaggtgtctcaactgaattggatgacagtttgggtacgattattcagaattagttattttttaacagtcaaactattgtaaatacattcatgcggtattttcgtctccttttacaatacagtatttaataccgtaccttcaaatttcaaacgttttctcttttttgtcgttgtttgattttcttctgtatttacagtattgactgcttggttatttcacagttgccactttaattttcagattcaccaaacaataaatggcaatatttgaaccaatgtgttaattctgttccttttgccaggaatttagtaaccttttttcacttttgtcagccaattcgatattaaatctgacgatttaaacaaatctcagacacttgctttttaagcaatggcacttttcaaaagtacccaattttaataccgtactcgcaccaaatgaatggaaaatgaggaaaattctaccaccttagccttttcaaaaatgtttcccaagataacaaaaatccaccttctcttcttgttcagtctattcctcgtttgtgtccaataagtttttgtccttgatcgcaatgtgtctgcgcgtccgaaatgtcgtgccaatct

SEQ ID NO: 37210 - DNA, 711 bp, Heterodera glycines
  misc_feature (15)..(15): n is a, c, g, or t
gtccaggtcaaatantgaaaaaaaatccaggtccaggcaaaacacgtaaaacctggattttcctggacaaaattttagaatttattatttcaagtgaccgatgtttttttcacgttttcaaaaacagattaaataaatttaaaaacatattattattatttattagatatttttagatgcttctaagcaaataattaattttttcaaacatttttttgatttttaaaataaatttcaaaaaatccaggtccaggcctggatccaggtctcgaggagcctggatttttcctggacctggattttactggatttttgtccaggaaatccaggtccaggtccaacatggaatccaggtccaggtccaggcatttttcaaaatgtcgagctctacttatgtctatcaatccaaaaacgcacaaaacaaaaaattcgttagttttttcgcggtttgtgagtcaatttaatgcagggttcggatctgttctgatttatcagaaaggttctgatttggagggtccaaatctgataaaataaaaatgttctgatttgtcagaaatgttctgattttggggtagcgaccaaaatttgttctaatttcttaaacaaactcataattttaaaattttatggcctaatgtcactattttacaaacaaatataaaatttatggcaaaatttggtcattttttggtgaaaatctgttaactaatc

SEQ ID NO: 37211 - DNA, 912 bp, Heterodera glycines
  misc_feature (825)..(825): n is a, c, g, or t
ttctgtccctcttcctgttcccctttctgttcctcttccactttctcttcctcttccaatttctgttcccctttctgttcctcttccgctttctctttctgatcctcttccactttctgttcctgttctatttctttttctgttcctcttcctctttctgttcctcttccactttctcttccactttctgttcctcttccactttctcttcctctttctgttcctcttctgtccctcttcctgttcccctttctgttcctcttccactttctcttcctcttccaatttctgttcccctttctgttcctcttccactttctcttcctctttctgttcctcttctgtccctcttcctgttcccctttctgttcctcttccactttctcttcctcttccaatttctgtttctctttctgatcctcttccactttctgttcctgttctatttctttttctgttcctcttcctctttctgttcctcttccactttctcttccactttctgttcctcttccactttctcttcctctttctgttcctcttctgtccctcttcctgttcccctttctgttcctcttccactttctcttcctcttccaatttctgttcccctttctgttcctcttacgctttctctttctgatcctcttccactttctgttcctgttctatttctttttctgttcctcttcctctttctgttcctcttccactttctctttctctttctgttcctcttccactttctcttcctcttcctgttcctcttctgtccctcttcctgttcccctttctgttcctcttccactttctcttcctcttccnatttctcgtcccctttctgttcctcttccgctttctcttactgatccttttccactttctgttcctcttctatttctttatctgttc

SEQ ID NO: 37212 - DNA, 759 bp, Heterodera glycines
tgcaggtcgacaaacattctgtacaccataaatcgatttgcaaatttagtcgaactatataaatttttcaaaaaatgattcatcttttttatggttagcgcatatgtctctagctttatagaaacggtccccgaatctgcgaggaactacttttttgagaatttctatagattattattttgcatgaatccttcgcttaaattcccatttatcttataaattcagattaaattaattaccccgatttgttttagaattggtccaaacacgcttgctaatagcttttcttttcgaaaagagaggcgaggaaaaataaaggttgcatccaaatgtaatttttttttacattgaagcatttggatggcttgctgtttacagttggctaagtcttctttgcaagaagcagcacaacttttgtttgggccaacgaccccaaaccattcgaatagcaatcgattgggctgactagactccatatttgcaggaatagcaatggcaggtctatcttaaaggcctgacgagttatgtttcgacaaacatcctgtacaccataaatcgattagcaaatttagtcgaactatataaatttttcaaaaaatgattcatcttttttatggttagcgcatatgtctctagctttatagaaacggtccccgaatctgcgaggaactacttttttgagaatttctatagattattattttgcatgaatccttcgcttaattcccatttatcttataaattcagattaaattaatt

SEQ ID NO: 37213 - DNA, 1138 bp, Heterodera glycines
tcccccccccctccttatcgtttaccccccggaaattttttttaattttaaaattagaaatttacaaagaaaaatcttagtaaattatttattaagaaaattccaaataaaaaattttcagagattttttcaaaatttaatgttcttatattaaaaatttactgatttttttggaaaaatttcaaattttgaaaattaaaaaaaaaattccggagggcagggggacggcggcgggtgggaaactagtgcaccctgctggtatcctttggtgagaaacaaagttggggatcgggaaggacatgccccgaaaaaattagtcgggaatggctggagaaattaaaatttatgtggatcaccactctcgccggggagtaaattttcattaaaaattccgcaattgtccccgaggggcattttcgggattttattgattatcgccaattattgatcgcttttttgatacagtaagcactggaggcaccactgatcactgccgatccaccatcaccgatgccgatcaccatcaccagccagtgaagaaaatacggcgccgacggcccaaagaggacaagctgttgatgccgcgccgggcatcgttgccccagggcatcacggtgaaaagtgacggcacaacaaccaccaccaccaccaccactgatgccttgggcgggccgtgttctgtcggctcgattactgtaatggacgagatgaacggtggcatggtcaaaatggtgagtcatcagcgccataatttttttttttttttgtatgtaatttgtgggttgcgggaaattgattctgttaacggatctcgacagtgtcgagagttggccgtccatatgaaaaaaaaagttcaaacgttttttcttcctctcaaaaacatactttaaaaagcgaaatttttctttcaaaaaatttaaaaaaacattttaatttttttttgagaattggtcttttaactttttaaaacaatagaaaattttatgtttttgaaaaaataaaaaataaaatttattctcttttttgtccatcaagtttcaagccaaagcccaagctaaagaaaacatgtttttcgtgtgttttaggcctccacagtctagaaaaatatatggattctatatattggcagccatactga

SEQ ID NO: 37214 - DNA, 1021 bp, Heterodera glycines
ttcgaatttgtcttcacttgcgttagcccatcaaatggtgggaaaacccaattaaaagcaacaagatttgaatttataatttcatagcactcacagacaaaactgttctcaactgtaattggcgtacacagagcatatgaaacctccaaaatggtcaaaaaaataaacaaaaaaactctgtctaaattatttaacaaaaaaaagtatcgggaaatgcgaatgcgaacggcattagtgaacgaagaagaaaagttgaagctgctgcccctcgaaagccaaacaaatcgcatcgacggagtttggaatttgagcagcgatcaggtggagggaagtgaagcggaaaagagaagaaagaatgaatgatcacaagcacttaagggaaatttgggagtgatggtaattacgaacattcgggtcgtatggtatgccgcactgaacctgcaggtaaacgggaaacaaagcgatggaacaaaaaccgggagaaataaatcgagaaaaatgattggaaacatggcatttggactgagttaatatgaaaggtgagtggtgcctctttcagtacaacgtgtccattccgttcctgcagctgcgaagttgccgcattcgcgactcgcgctttggccatgcgttggttttggagacgtcgctgagggtaatttggagagattgacaagcaaaaggaaaagcatttgaagagcggcgagtacattcttggctttcaaatcaaaccagaagagcgcctggaattcacttgcaaagccgtccaagcccttctcagtgcttttcaatcgtcgcccattttcggagttcagtacagtcgccaggaagcggccttttcacaacagcaggaacagcgacaagcgatggtgccgaacatcacggaggagaaggagccggaggaaaaggcattgcgagtggacgcatttgcggtgcgactgacagagagtgccaatgagaggggggggggggggtgccgccgaaaagaattttccaaaaattcaaaaactttttccaaaaatat

SEQ ID NO: 37215 - DNA, 937 bp, Heterodera glycines
tattgccaatctaatttcttgcagatttaaagccatccattgcctgctcggttctcggcacagcaaagcactaatagggtgtttgattcacttcaaaaaataattccttacacaaaagttttttacaaccacttattgccaatctaatttcttgcagattgaaagccatccattgcctgccggttctcggcacagcaaagcactaatagggtgtttgactcacttcaaaaaataattccttacccaaaagttttttacaaccacttattgcaaatctaatttcttgcagatttaaagctatccattgcctgccggttctcggcacagcaaagcactaatagggtgtttaattcacttcaaaaaataattccatacccaaaagttttttacaaccacatattgccaatctaatttcttgcagatttaaagccatccattgcctgccggttctcggcacagcaaagcactaatagggtgtttgattcacttcaaaaaataattccttacacaaaagttttttacaaccacttattgccaatctaatttcttgcagattgaaagccatccattgcctgccggttctcggcacagcaaagcactaatagggtgtttgactcacttcaaaaaataattccttacccaaaagttttttacaaccacttattgccaatctaatttcttgcagatttaaagccatccattgcctgccggttctcggcacagcaaagcactaatagggtgtttgattcacttcaaaaaataattccttacacaaaagttttttacaaccacttattgccaatctaatttcttgcagatttaaagctatccattgcctgccggttctcggcacagcaaagcactaatagggtgtttgattcacttcaaaaaataattcattacccaaaagttttttacaacaatttattgccaatct

SEQ ID NO: 37216 - DNA, 504 bp, Heterodera glycines
gtcgggcaatggaaatggcacagatttgcccatgacaaagagttgtggcattccattgtccttttgaattgtgattgttctccaaattgtcaattcggctttgccattgaaatgtttgttcaccagcccatgtgacgaaagaagtgccaatttgaggccgagttgggcgcggtcaaaatgagggaaaatgtccatcaaaatgtcgttgcaaatccatctgaaatgtggggaataattatagtgacaaatatatacaagaggtgggtacaccccaaaacgtcgccgccgaaacgtcgccgggacataacgtcgccgcaaaaaaaattaaaaatttttcaaaattttaagaaaatttaaaattattttagcttttctaaaaatctaagtgttaataaaaactaaatttgttgatttctaagaaaaaaatcgaattaaacttgaaaaaaaattttttcccctgaatttcttaagaaaaatttattttttgaatttttccaaaatttt

SEQ ID NO: 37217 - DNA, 1242 bp, Heterodera glycines
  misc_feature (4)..(4): n is a, c, g, or t
  misc_feature (1099)..(1099): n is a, c, g, or t
  misc_feature (1157)..(1158): n is a, c, g, or t
  misc_feature (1176)..(1176): n is a, c, g, or t
tttncatatttcacattttcgtccatatttcgccatttttactaaaaaaatgaaaaaatttatctaactaaacctgaatttttagaaacgtctctattttgtgtcgagaccggacagttggacagtagacacctggacagtgggggcgtttggacagtaaagcatatttggacagaagtggacaattttgtgcagtgcacactacgtaagtaaatgcaaataaaaaaatagaatacaaaggggttgctgatacaatataatttgaatatgagcatttttttagcttactttgcgcttccaagttacattttttgtccatattttttatatttaggtatccatttttcacattttgtccatttattttccatatttcgctattttttacgaaaaattaaaaaaataacatgtttaaatctgcccttataatttttcacgatattatgacagatctcaaaaaaatagatttttccaaataaatgtttataagaatttgcgaaaagtgaattttttgtccatttttaggtaattttgttcatatttttcctagctctaaaaacgattaaatacttcaaatctgatcagcattctgtaagtgtttgtgcgcaattaggttaaaaatggtgattttgctattatattcaaccttttgtcctgtgttaaccactccagttgagctatgtgtggaaaaactttaaagacgaaaagcaacacttaaattgaatagtctataattttacaagcatcttcatcatggcattatgggagagtaatgctaagaaaaacggtaataccgtgctttgtcccccctcctttttcgatgaaaaattcttttgacctaaaatttcatgaaaaaacatgtctaaggggtttttcgggtcgctgatcacgaatatgacatccatttcgaaccccggagccgaattcgaacaaaaaaaacgaaaaatgattttcaaaaaaaggactgaatggggccatattagtgatcagcgagctcgaaaacccccttggacatggttttcatgaattttaaaggacaaaaaatttttcatccaaaaatgggggacaaagcgcagtattaccagaaaaactccatacngtacgcaccaaagcttgactggtaatcgcctctttttggtctatgcgcgcatttgttnnaagaaatgcccatcaganttgaaataatttttactataatgaatcagaattcagcatagctttgtactcccttccttaattaat

SEQ ID NO: 37218 - DNA, 1030 bp, Heterodera glycines
aaaataaagaatttttttaggtttggcttggcttttagatttttttgaagttttttaatgaagtaattaacgcttaagtggagaatacgagaagaagcagcacaaaacttatttgttatttcataataaaaattcaaagatatttgcttaaaaaatagaaaaataaaattcgtaaataatataacaataaatgaatatatttattgaatgaaaaacaaatattttataaattcaaaccaaaaagaattttaaaaatgtatataaaaaatattttagcattataatttgttattctttatcaaataatttttattttattattaattattagggataaaatttaacaataataaatttattaataaaaaatttcttacggcttgaagaacgatgaagccaagtcggagtcgtaagtcgtatgcaatcagtcgaaaagtcaaagttgaaaaccgatgatttataaaagacaatccgaagaaaaatgaagaaagtttttatttattggagagaagacaaaaaaaccaaaaaaaaagcgagagagaagagagatgaaataaaaaaaaacaataaaacataatcaaatttgaacacaataattaaccgcgaaatgtaatcgttttaaaattagtcaaattaatgcaattcccagcacgttccacaactaatcaatcatctaataattgaatatattattaatgggtgcaccccaaaatctcgccgccgaaatctcgccgagacaaaatatcgccgccgaaatctcgccaccaaattttttttttaatttttttcaaatttcaaaaggcaaaaactccggcagaaattaaaactcgggaaaaataaccggattaaatgcttcaattttgtcatttggcgaggtgtctgtgaaaatctgatgatgcgaggccttcgaaaaaaattccaacagaacgagccgctcaaagaaatgcttataaaaaccggttcaaatgttttggttgagagctccccacacgatttgttttggggatgcggaaaggcaatggacgaccct

SEQ ID NO: 37219 - DNA, 780 bp, Heterodera glycines
catttcctaggttttcaaaaactttaaacctagttttttataaaagttttttgtgaatttttttgcggcgatggagtgcacactcctcttttcaatatatttctctttatgtgaaaaattaattaattgattgttagaaaattaatttttcatcatcaatcaaagaaaatgtcgtcatactcataaaaaagcaataaaattagtatatggtcaatgagcatacgtaccaactaaactaattaggcatcaattaccattgtcattaacacataaattattttaccccgctgttgctcattggttgctgctgttgcgtcgtgccctgttgaattggccaccgacaacgaactttgtgtgactttctgctgcagaaaaaaaagaacaaaatatatttgacagtcaatttttggttcgagaaaaattgatttggttttataggcaaaaaaaaatagtaaataaatttttaaaatttttaaatttaggtttttgaaaaaaacgaattgaatgttttgactaaaataaattaaagaaaatctttcaatttctgaaaattgattcatgtgtaaaaaacattttgaaaattttaaaaataaaatttttttcaaaaacaattaaattaccccattgtaaaattggaaaagaaaaaaaataagatttctttcctcaattaaaaaagcaattaaattcccaagaatcgattcctacaaaaaaatcattggtcctttcttcctcctttcaaattgcaaggccattatacaatagtatcatcatcatcatcat

SEQ ID NO: 37220 - DNA, 1230 bp, Heterodera glycines
  misc_feature (43)..(43): n is a, c, g, or t
ccaagaaaagacataagcagacaaactgtgaaattaaacattntcgaaaaactaaaatgttgaacaaaaccgttttctgattggtttctcgtcgcagcagaaaaaattccgaagttttataataaagcaagtgccagcgacagacaaaaagacgaggacgagcggtctcacgccgctcagtttatcatttattttcacaatatacggaaaatgaatagagggaaattgagcgttgcttatcatctaaagtttggcacttaaaaagagtataaaaagaaaagtaaggcaaaatgtaataaatttaactttttcattgatcgtaatgattgatttaccaaaacaatgatagcgaaatataatcagaagagtataatatagcgactgttaagtcatgctaactcgtacaaaagtaaattcattggccaacttggacactttttttattttcgagaattaaaacagtaagcattaattactgtacatttccattgactcggttgttacgcctcccaacccaaaagtttcctgacgacagggtcatccaaattacgcaacgtttctttaaaatcttccaattgtgggtcaggaatatatctaaacatgaaaattcaaaaaaataaaaataaattaaatgcctgcagcgttcgtcgcgcggggaatgtttcttcacaacaattttcatcccaacgggtgcgtgcgcttgcaaaagggcaatgaagagggggagttggatgccggggacgggtccaacccgcacaactctgctgtacgttttcaaaacagattgcgaaacgggaatggtcgagccagccttgtactccttgacaagctcagaagtgtgtgcaagagcataactaacacaaaatttgcaaaaagcacagcaaactcgggcacctttctacgatttgtatcccaaaatgtttggcggcccaatgtacgtacgcttgaaatttctcgacgggttgaaaatcatacgcctgtagcaacacattgagaaggggaacgtcaggatatttgcggtcactctcgaatctgcgtgaaaattgcagcaaattccacaccggacttggttagcacccacctcggttcatacaaatcatctggttttggcgcattagcagaggaacggagagttgggtagtgccgacaagacgggagattttcataaccgacaaagaaccgattgaataaatttttgcttagaattcgattcatactaaagaaataatg

SEQ ID NO: 37221 - DNA, 955 bp, Heterodera glycines
tcaaaatgtacgattttgcgcccggacaggcccgcgatgtatttccggccttcaccaactgatggtggtgcccaattagaggtaaacggcctaatatacgacaactcacatgtcgtgccgtataatccttatattctgctacgttaccgagtacaccataatgtactgtttgcatatggtaacaaagcaaatattaaatacgcactcaagtaccctttcaaagggccagggcattgttatgtcgagtgcaaacaagagtccggcaataaaatcggaattgatgagccggctcaatatgccaagatgaacttccgtggtgcaacggaagcatatgccattgtccattcactgccatttgccaaactttcacatcaggttgtcaaacttagcatccatatgcctaatcaacaaccgattgtgtacagggcttttcagctggtgagcaaagctcaacaaatccagcaaggcgaactgccagagacgcaatgttctgcctattggaaacaatggcaaaatgaatggaagcatgatccgaagctcaagggcatgctttttgaaaaagtccctgagcattttatatgggcaaaggacaaatggaacaaaaggaaatataacctaacaaagagaccaccaatcggtcgaattgttcctgtacccccatcggacccggaaaggttcgcgctctattcacttatgcgtcactttcctggagacccagaccatcttaagatggttaatgggttgctttgtacctcattcactgaggctgcaataatgcatggtcttcttgaagacgacaaaatttgggacaaaactctggcggaggcagctctgtcgcgctggccagatcagatgagatggctctttgtgagcatcctggtctatggccagccgagtaatgccatagaattgtggaacagtacaaagacaaaatgtactttcctcaaggcattac

SEQ ID NO: 37222 - DNA, 1100 bp, Heterodera glycines
  misc_feature (1040)..(1040): n is a, c, g, or t
accgaagatgaaaccttggctgagctacgtaaagcggttttacgacaaggataattgggttctctcttggaaaagccgacgtattctggacgaacttcatgacttgaagaacgaaggacgttggttcttataccacgcaacaaatggcgctcaactcactatctcaagaacgttcgatggaacacgaccatttgccgaatttcgatatgtggaagaaggacacctcgtggatctgactccaaaccaagtcatcttccgccaaacggttccagatgagcccgaagagagtccagtgagcaataataaaaagttggaagagaaggcagaaaaaccggcacgcaacgacaaacgaacaactctggccactcggaaggtggaggagtattgcacggcagagatgaagcagaacagctactgctatgacatatttaaaccgtgcgacgcaacgcacgaaacgtgtgccaagtcggcaacgtacagcgctcttgccgaaaacagacacaagctcgaagagttcaacaactgccatgccagctgcctctttgaggccctcatcttcagctggctgtcaaggaacacaaatctgcccggcaacgaagtatcaagaatgcatgaagaactgatcaagcccaccacggaattggaagaagtggctaaacttttccacgacgaacaaatcgtgaaaaacaaacgcggactcgggaaggatcaacaagtgatgaaagtcatcgaaatctggagaaattcatgcgatcgcttcggagagcttttcaccaagccagcgatgcagcagatcaaattccggccaatcctgattgaacacaatggccagtataaccaatggatcaaccgccaaaacacgcgaatggcggaattattttccaaaatgcgaacgaaggctcagcatccgacctacttgagctacaactgcacaacggtgatcgtcggcgataacgtagcggaactttttccaccccactatttgatgatgccaaatggttcacgcatttcccagcggacacatgccgattgatacctgnggccaacgtcaaacatatcatcatgggatatcaagccacggacgagaacatggcggggca

SEQ ID NO: 37223 - DNA, 1142 bp, Heterodera glycines
attttgcatttcattcatcattctgctccgccgtcagccagccggcaattcatcgctcatcattccctcacgaaattcattccccccccaaattttgatcatctcccttccacttatcatttctatcattgatcaaattgtccctcattttattttgatctgccccatcccctgggccaattcatccatcttttcacctcgaattgacctcatttatccccaatgtttcctttggggcaagtctcccccatgttattctggtctcttctatttctggtgaacattttccctcattttctggtttttttaattctggtcaacccctttcccattttatctggtcaaacatttccctttaattactggtcagtcccacttttcacttgatcaattgccgcatttttttctcctggtcaaaattgcgcacctttctaatcagtgccattccctcatttttgatcagccctattctttttgcttctcaagttgcgcgaatttcttctaatcagtcccatttttcctcatttgacaaaattgcgcaaatttttaatcagtgccacccctccccattttcattgacagtcacatttcgtctgatcaatgcttttcccccatcatttttctcaaattgcgcgcaattatgctgattagtcgcatcccttccccatttccgttgatcagttccattcccctcagtgccatccctccccaattttcttttgattaatgccacttattttgatcggttcccctcattttcattgatcaaatggtgcgcatttcggttgatcagtcccccaccccctccattttctttggtcatggcctcattcattttgatcaatcttctttactgccatttcttttgatcagtgacatccctcacccattttcactgatcaatttggccattttatctgatcagtcccatctttccccatttcctttgatcaaattggccaagtcttccccagttcgcctctgaacggctccattttccccaattttttccccttggccaattctccctcgtttcactttgacctcatctactctggtcaacacttttcttcactttctggtcaatttgccccctctttaattctggtcacttatctctcccaattctgatcaaacccctt

SEQ ID NO: 37224 - DNA, 567 bp, Heterodera glycines
aaacgcggtgggggtcggtttagtctggccggtttagtctggccgttttagtctggccgttttagtctggccggtttagtcagagggtcggtttagtctggcaagctgtttttgtccaaaatagattctactcagattttttttcgaaaaatgtttaaaattaacaccataacatatttatcagtgtgttttcaacgaaaaaataacaaaacattgaagaatgactacgggcgtattacataatttttgagaaattcaacgagaaaattgaagatattatcaggattaacattgtatggtaattttgatcattttggtaagcagggttgatgttgttgatggtattgtaaccctgtaagagtcgagaattctcgcatcgacggcacgatatttgcgcgtttttgaggagggacttcaccagcgacgcatcgtgcaatgtctgcatcaattgacttttctcatatcaaattgtgttgatgaagcggaagatagttggatatgaacaagcataagccggttgaagctttatatgggaaaaaaacgtgaaaaaataaggtttttactttg

SEQ ID NO: 37225 - DNA, 1503 bp, Heterodera glycines
  misc_feature (7)..(7): n is a, c, g, or t
agttttntggaggcacttttgacattgactgaaaattgtcccattcaaatggcctttgtgacgcgaaacggacgttcattggccgaaattttccgttacagcggtactcacaatggacaatacgtaaatcaaaccgggattttgactgacgcgggaatcaaggccgtccttatctggttgtataatgtggcaaatttcccgggagagcgagatatgggacgaaggcgttcagtgattgggaatgtgccttcggggtctcataaccgtctaggcgacggtagtgggcgagaaaatgccgaaaatgaggtgcctgggcgttctgagtcgcgccctgggagttcaaccggccgccgttctttcatggccaatcatcaccgccgtaatgatgctgggtgcaaccgccacgaccggattccgatccgcgatcgagtttcggcgtctaggcgacgcccggaattcggaaattcgcgttcgaatatcgccgttagcactcaccgccaccgatacctgacgggtcagccgaatcgcagctttatgtgacttttaagcgtcggggcgccgctttctttgaggggcgggatgtgataattaatgttttattattaaattttgacttgattctggcattctgtttatttttgtctttccccaaattttgtttcccatcttcaaaaattttatgaattttggaatctcgctcttctgataatttttaattgtaattgtgcttttatttaaattggtcgtctcataaattgttggatttgatcaaaagtgtgaattggacgtgtttcccaaatttgaagcggttttgaatccaagcaatttcccaaaattgcctttccctccaattacacaccgcaaatttattttgacatggcgctttctgaagctggtgagtgctagcggtttctttggttttacttcgggtaaaagcaagttttgcgtgcaattgggctgcttatatttgggtttggaaaaattttaaaacaggtacagttcaatatctaggcgatattgttctgatttggtggcaaataaatatctaggcgatattattttgcattttgaactcacctcgacgcacatgcaacaaaacctactgccacatcggaattatttgactcgtagaagagcacaaacactgagagacgagggaaacatgctgaatttgtcagagatgagaaatctgctcgagccaatgccgccaaacgaccaaatcggcattcaacaaaacgcagaaccggccgaaaattctcagtcgagacccccaaataccggggatagagctgcacgcggggaacaacaaaaccgtggaaggaaccgagaacagcccaattttacagaaagaatggagtacgacgaaagcattgtcgacgacggagcggtgtcactcgtcggtgaagctgacgaaaacgaatttgttgggcgtcagcgacgcacaccatgaagcagaatgagcgggatttgggaagtttttaccatttttccacggaacacaaa

SEQ ID NO: 37226 - DNA, 811 bp, Heterodera glycines
  misc_feature (796)..(796): n is a, c, g, or t
taaaaaatcgtcacactttttcatcaacaaaagttctcaagggatcatttgtactgctcgattagtcccacatcccctgttcctcgttcaaactgacaagaatgatctgatgccgtggcaccgaatccaactttcattggtagttccccgggagatctcctcgcattttgaccgttcgtcgatgaattgggcgctcggcgacagtcggatgatctgatggttctgtgggtccaacacgcgttctttttggcggcaattctaaagcaaatcgtaaagcatttggcaaatgttcgccggctcaacaagcgattcgttgccataaacagctttccattgggaattggcatcgtagtaaaggtaaagcgactgcaactcgaaactcttcaaggaaagggacacgcaattcacttcaacgggaaaaaaagtcgaaactgcctttggatattggacggtgtattgaagagtgccatcattggagacgaagcaaaatctgtccaaatagtgccaattcttagggacgggggagggaaaaagttggggattgggagagaaaatgattaatttctcactttcgaagtggaaagaatgccttgggatattttggcacaaatttcgaccaaaaagaaagcgcaaataaaaaaggaaacaaagaagagggagggggaagaagaagaaaaaggcatggctaacaaatggcaattcaatttgattattaattagtgcgattaaaagtgtatttaatttaatggaaatattttaatcaaaattatcagctaaaatttacctcataaattangctgaaaaaatgata

SEQ ID NO: 37227 - DNA, 919 bp, Heterodera glycines
aaatataaaatgtcctgaattattacgatttgtcctgaattggagaaaggcaatatgaaaaatataaaatgtcctgaattattacgatttgtcctgaattggagaaaggcaatatgaaaaatataaaatgtcctgaattattacgatttgtcctgaattagagaaaggcaatatgaaaaatataaaatgtcctgaattattacgatttgtcctgaattagagaaaggcaatatgaaaaatataaaatgtcctgaattattacgatttgtcctgaattggagaaaggcaatatgaaaaatataaaatgtcctgaattattacgatttgtcctgaattggagaaaggcaatatgaaaaatataaaatgtcctgaattattacgatttgtcctgaattggagaaaggcaatatgaaaaatataaaatgtcctgaattattacgatttgtcctgaattggagaaaggcaatatgaaaaatagaaaatgtcctgaattattacgatttgtcctgaattggagaaaggcaatatgaaaaatataaaatatcctgaattattacgatttgtcctgaattggagaaaggcaatatgaaaaatataaaatgtcctgaattattacgatttgtcctgaattggagaaaggcaatatgaaaaatataaaatgtcctgaattattacgatttgtcctgaattggagaaaggcaatatgaaaaatataaaatgtcctgaattattacgatttgtcctgaattggagaaaggcaatatgaaaaatataaaatgtcctgaattattacgatttgtcctgaattagagaaaggcaatatgaaaaatataaaatgtcctgaattattacgatttgtcctgaatggagaaaggcaatatgaaaaatataaaatgtcctgaattattacgaattgtcc

SEQ ID NO: 37228 - DNA, 1143 bp, Heterodera glycines
ttttgatgggaggaggtcggtgtaagcggctttttgtagagctcgacgagctctatccaaccatgttttcggatttcggaaattttcagaaattttcgagctaggccccctcgaaaattttccgttttttaattttattattttttgcagatttttccgggcaaaacgaagaccactttcaagcaaccgtttttcatgctctatcgattggtgtcattttcagaaaaatttttaaaaatttttttggaaatagaaaatttttggttagtaggcctcaatttcagttctggcgcaataacttgtcaggagttgattttatcaaaaaatcgtctaagagcttttttgtagagaattttaagcccaatctaatgtgctttgtctcatgtatttatcttgaatttaaaaaaagttatgaaattaaatttaattttgcaattcaaaaccataggggggaccccatggttttgcatttcatgaaaaatttttttgctcctaaattagccaaaatgcatttttatggcataatttgaggtgctgaatacgtatatacgctttattttgcgtttcagattttttggaaagtgttaaaattttttgaaaaatcgtcacaatttgggccccggaaaatccagtgaaatttcgaaaatttataaatctcttcgcttttggtcaaatttagtggaataaagtttgaaaaatagcaaaaaattaggagaattttatgggatttatttagaattcctatcttccaaaataaataagttattccagaatttctggaaaaattcgatttttcagaaaaaaattcctaactccattctgaaaaagtattttataaaaataatatactcaaaaaatccgcaattttttgctctattttataaattttatttggcatttttatcacttttttgaaaaaagttatagaaataaaagtcattttggaatttgtgaccacaggggggtgaccaggatttttgagtggaaaatttttttcaccaaaaatcttccaaaaatatgattttacgggttatttgggccgctgatcaagaatatgcaatcagattttacttcagacatcgttaagacctcagaatccctgtgtgattggggattctgaggggtgggagcgcccgttctgag

SEQ ID NO: 37229 - DNA, 754 bp, Heterodera glycines
ttacgaaggacatgggccgaccaacgtgaagagctgttgaagttaacaaacgtatgtgtttaaacatgacaacataaaaaagcgaccggatttctcaaactaaaatttttttttttgacctttagaaagtcatccaactgcaaaacattaatgacgagaataaaagttacattgaagcgttgagagagaacgatgaattaatgaagcaaacaatagaacaacagcaggaggaattgctgaagaacagacaggaaattgtttcgttgcgcttgcaaatctcccaaataacaaaggcagcgatggtaaaaagaagggttctagtcggttttacgcgtcccataacaaaaaataaaggggaaaaattgaaatagaaaacttaaaaaaacaagctagaatcttctttttataatttttcttaatgatgtcaacagaaagttacaatataaaaaaattttacaaaaaaagcctaagcctaggtttaaaccaaaagcttaggcctagtctaagccattgttcgagttgcctgtgtatgagttgttattatactttatgtttaacaacgaaattttagttaaaaaattactgaataccggacaaaaaaaaggtttcatcatagttattaggacggctaaaataccatagaccagggatagcacttaattccggtttccaaaaatttttgagcctcggaatgacatccctgccatggacacaaatgtcatgggacgcataaaatgccatgggacgcgtaaaa

SEQ ID NO: 37230 - DNA, 888 bp, Heterodera glycines
atttggctgctttaggcatttaaatatataaagaaattttctaagtgcttaagaaacgtaaagtagtcaatttttagggtgcattttcagatttttttgtatttttcttacgatttttctcaaaaatgccaaaatatgtgctaaaaaatccaaaatagcccaaatatgtgcgatatgtttttataagtcgctctaaatcaaaaattgttcggagaaaatgctatttttgggcttctctcgccataactaagccgcaaaaaaaaaaaatgttaaaacataaaaatcccagcccttgttatgatctgagaagctcaaaaaaccaatgtttttcaacattagtattttttttttggtttttcaattaagaaatgaatattatagtgcccaaacttcatgtccttccccatttatttagctttgccctgcactcatcttcatttttgcgcgaattttatcttttcaaacgttgaattcatttgtgtattcgttgccgatctcaagacaaattttggtggttggcatttcatattgtcaaagatacggtttgctgtgtatgcgtctacattttgtcgcggtggcagtcaacagagcacacgctgtgtgctttccgctaaactatgcacaagaaatgaataaaaagtatcttctcgatttcgaataaatttttgtagacactgactgtatgaatgaagctgactgtggcggtaaatggagaattgatgagactagagttgtacgggaccgggaattttcgggttgaaaaaccgggactttttggctgtgaaaaacgggaaaaaaccaggactagtcccggtcccggtcaaaactgggactgcgtactcaggtgtacgtttttttcagtaccagtcctggtcccgtgcaactcta

SEQ ID NO: 37231 - DNA, 879 bp, Heterodera glycines
ctttttctatcaataatgggaggtgaataaaattttaattgctttttaactttagggaaaaagtttaggcttaactttttagtgaaagtttgatcactcatatttttttagtctaatctactcaaaacggttcagaattcaataaaaataacattcacggtgcgaaaaatggggtttgacaagtttattggggaaaaaaagactttacaaaataatacccctgggagaagggagtgggaaacatgatttcaaaattttcaattttttctagtctaatctactcaaaccggttcagaattcaataaaaataacattcacggtgcgaaaaatggggtttgaaaagtttattttgaaaaaaagactttacaaaataatacccctgggagaagggagtgggaaacatgatttcaaaattttcaattttttctagtctaatctactcaaaacggttcagaattcaataaaaataacattcacggtgcgaaaaatggggtttgaaaagtttattggggaaaaaaagactttacaaaataatacccctgggagaagggagtgggaaacatgatttcaaaattttcaattttttctagtctaatctactcaaaacggttcagaattcaataaaaataacattcacggtgcgaaaaatggggtatgaaaagtttattggggaaaaaaagactttacaaaataatacccctgggagaagggagtgggaaacatgatttcaaaattttcaattttttctagtctaatctactcaaaacggctcagaattcaataaaaataacattcacggtgcgaaaaatggggtttgacaagtttattgtggaaaaaaaacttttacaaaaaatacccctgggggaaaggagtgggaaa

SEQ ID NO: 37232 - DNA, 1657 bp, Heterodera glycines
  misc_feature (814)..(814): n is a, c, g, or t
attgaatacttacataaaccatttaataggcaattatttaatggaagaaagttaaaaaaatttcaaaatcatttaattaatcataactaaatttttgttattaataattaaatggtactaccaaagaaagacacaaaaaatcaaataataaaattgtaaagttcaaaaattaattatatagacaaaatcaaaatgataattttcaattaacaacaaatttatataaccgctagcgttcaagctcagaggagagcatcgtctaggcatcgctagaattaataaaaatgaaataaaataaatattttttaaaattttgtaaaagattaaaaaataattattccttaacattataatttgacaactgatagtgcaaaactcactttatgaatatgaacaaatatgttacaaaatggaattcaaatatatttgctaaaaatcgaaagaaaaaaagttctaaattaatacaacaaatatatttgcaaaatgaaagcatcttttttaatttgattaattaacggcgttttttgttgatcaaatctgtagcaaaaagggccgatatatgaaaatggcaatttacatttatttaaatggcaatgaaacttaaattttagaattatattagagctgaaaatgaaaataattttcaattgaaaaaagcaataaaaagatactatttaatgttcaagttcaaaatgccgaagattgagaattttctcttgaaatttacaccgagtttgtgatcattccaatttatttgcaatttttttaccaagtttactgtatttgaaaagaatgtaaattttttatagagaanaaataagaaaaatacattgttataacttttgttttgatcaaaaagtcaattgcagctctgttatcagaccatttctccttcatggtgattgaaatcgatgaaatttttagaaaaaaatttctagggggtggaaaaaatttttcattgaagtcgaacatgacggaaagaaagtaaaaaatttgctacaaaatgttaaagatcacacttcgaacttaaggaattaaaaggcttccaatccgaaaaacgtgagaaaatgaaccgctgttgtctatagaacatattgcttagaaatgccgcttttatttttttattatatttataattttcattttcttatgctttattatgcttttgattagttaattttaaattttcacaaaaaatgttgcttctagtgaagaatattcgtaccgtggaatagttcacaccaattgccactaggatcaatgttctgatcaattacagaaattaaataaatgcaaaaaatatgaatttagtcaattatttggataattttgtattttcctcaacatattatatcatcaaatttctcattaatcaaattcatcaacacaaaatattatcactaattgaaaatataataataatttacccaaataccaaataaatttattttctcttttttgttaattgaaaaaaactcattacaaattcatcatttctggtcatcgctaatcacaaactgacaccgacaaaacattgatggtcttgtacatcaaaaaaattcattcaaggggtgttatcgctatcagcgatcagtttacccatccttggctaattgtatattagtattttttgctcggttttgtcgggggggggggg

SEQ ID NO: 37233 - DNA, 1275 bp, Heterodera glycines
ggttaattcaaatttgtcttcaatcaaaaatccaacacttgttctttgtcttatctttttttcccacctttgttcccatatccggttgtcgaattctttcactcctttccatcgtcttttggcactttcttcttgctgattgtgctggcggcacatttcggaaagatatcccccctttgatgatcggtctataacctatttctaagttagacaaattagaaattgtataaataggtctcgctacgttcgaatctcatttcttttccctatatcggcatcacattttataattagtctcttatgccatgaataagctcaataaccctagtttttgtagtcaactcgttttgactagatttctgttttcttaaccgtgacagaacacttttcttttgtgtcgtatataaaaagagagatatcgcgtggagagcatgatgagctagaactggaggagagagagaggagagacaacgcgaggagagagagaggagcgataacgggaggagagagagcgggcgatatagagagagaaagagacctgttgagagagagagagagagaaagagagagaaagggaggagagagagaggagagagaacgggaggagagagagatgagagagaacgggaggagagagagaggagagagaacgggaggagagagagggggcgataaagagagagaaagagaacggaggggagagagagagagagaaagagagagaaagggaggagagagagaggagagagaacgggaggagagagagaggagagagaacgggaggagagagagggggcgataaagagagagaaagcgagagagaatgggaggagagagaaaggagagagaatgggaggagagagagaggagagagaacgggaggagagagagggggcgataaagagagagaaagagaacggaggggagagagagagagagaaagagagagaaagggaggagagagagaggagagagaacgggaggagagagagaggagagagaacgggaggccccccccctttttttgtgctcgctgtcacagcgctgtcgttatcgacagattgtgcggtcaaaggagtggtagcgggggcgtttgttagacagctcgcagccatcgttatgatagataactggatgcgtgagagaggatagagaacgggaggagagagagaggagagagattcgggaggagtgagagggggcgatagagagagagaaagagagcggaggggagaaagggagagagaaagagagagaaagggaggagagagagag

SEQ ID NO: 37234 - DNA, 1368 bp, Heterodera glycines
gtgcgagcaattaagcacgcacatcgggccagatgctggggcatttgtgctgcaccgcaagcggcgcataagtagtgcctcccgacaccggggagcaagaatattgctatcttgcctaggcgggattctgacttagaggcgttcagtcataatccctcagatggtagcttcgcaccattggtctatcgaccaagcacatgaaccaaatgtctgaacctgcggttcctctcgtactaagcaggattactatcatagcaacaggtctttagtagggtaaaactaacctgtctcacgacggtctaaacccagctcacgttccctattggtgggtgaacaatccaacgcttggcgaattctgcttcgcaatgataggaagagccgacatcgaaggatcaaaaagcgacgtcgctatggacgcttggccgccacaagccagttatccctgtggtaacttttctgacacctcttgctggaaactttacacattcaaaaggatcgataagccacgctttcgcggtccgtattcgtactgaaaatcaggatcaagtaagcatttgcctttttgctctacgagaggtttccgtcctctctgagctcgccttaggacacctgcgttacgctttgacagatgtaccgccccagtcaaactccccgcctgacactgtcatcggccgcgggtcgccgggccaaccgggtggcccgacttaacaccaaaatggacaccctttcgggcgcactcccgttttaccgattaagtaaggaatcgatgaaagtagtggtatttcactggcgccttgcggctcccacttatgctacacctctcatgattcttcacaaagtcagactagagtcaagctcaacagggtcttctttccccgctaaatttgccaagcccgttcccttggctgtggtttcgctagatagtagatagggacagtgggaatctcgttgatccattcgtgcgcgtcggtagttagccgacgaggcatttggctaccttaagagagtcatagttactcccgccgtttacccgcgcttaatcaagtttccttggcttaacattcagagcactgggcagaaatcagacacggtcaacgtccacaaggaccatccgtctcctctgttttaattagacagtcggattccccgagttcgtgccagttctaaactggtcgttcagcgccaaccgaagtgcataccctgacgagcatacacgcagctgaagcgctccacaagcagctctcaccactagtccacgcaccatccccgaaagaacagcacgcagccacgggcaaaagccgcctgtttcacgcaacagcccggctgacccgacctttagagccaattcttttcccgaaagttacgaat

SEQ ID NO: 37235 - DNA, 886 bp, Heterodera glycines
ccattttgtctctacagttgttacaggggatagtcctataaggggacatgattattcagctccctggcgggcttcctttgccacattgcctggcagagattgtctgcattttatgaatgagatagccgcccattttgtctctacagttgttacaggggatagtccaataaggggacatgattattcagctccctgtcggccttcctttgccacattgcctggcagagattgtctgcactttatgaatgtgatagccaaccattttgtctctacagttgttacaggggatgatagtccaataaggggacatgattattcacctccctgtcgggcttcctttgccacattgcgtgacagagattgtctgcactttatgaatgagatagccgcccattttgtctctacagttgttacaggggatcatagtccaataaggggacatgattattcagctccctgtcgggcttcctttgccacattgcctggcagagattgtctgcactttatgaatgagatagccaaccattttgtctctacagttgttacaggggatagtccaataaggggacatgattattcagatccctgtcgggcttcctttgccacattgcgtgacagagattgtctgcactttatgaatgtgatagccaatcattttgtctctacagttgttacaggggatagtccaataagaggacatgattattcagctccctgtcgggcttcctttgccacattgcctggcagagtttgtctgcactttatgaatgagatagccaaccattttgtctctacagttgttataggggatagtccaataaggggaaatgattattcatctccctgtcgggcttcctttgccacattgcgtgacagagattgtctg

SEQ ID NO: 37236 - DNA, 651 bp, Heterodera glycines
ttttcgcgtggccattttcgcgtggccgttttcgcgtgagggccgttttcgcgtgagggccgttttcgcgtggccgttttcgcgtgagggccgttttcgcgtggtgacgttttcgcgtggttgcatataaaagagaattcataactcacattatattttaccaaaatttgtttcactcttttttctaacgagtttttattttattatataatatggaccagcagcaaaaaattaaaacaaaacgaaacaaagttaagttagaacatgacggcgcactctatacgacattaataacattcacctcccccaaaatgatcacaattatgccaatgccaatgtgaatcccgaaaacattatcaattttctcactggtgtttcccgaaactatgaaatgcgaccttagtttgttctgaaatttgttattttttgttatatttttataaaattttaattatttttttccgtttgacgcacatccgaccaaactgacaaattattgtagaagatatgagccgcaagcaaataaaaaaattaaactagtaagaaatttgtccatatgcggcgtcggattcgaaacatggatgatttgcacaaacccgaccaagttcattcctcaactgttactgactcgaaaacggcgccacgcgaaaa

SEQ ID NO: 37237 - DNA, 1284 bp, Heterodera glycines
  misc_feature (307)..(307): n is a, c, g, or t
  misc_feature (311)..(311): n is a, c, g, or t
ccacccactgaaattaccgctacttcgactaactaatattggattaccaccgtccttgacggagtgtatcttcggcatacgattcccaccgctggccatctaaacaacttttaaatgaaactttttaactaaataaaatattcttagctcatataataaatatcctttacacaaataacttttaataagtgatcacttattctcatggctttttcttttttctgactttccatttcactgatttttccacaagatccttctgatgcttttgaaacaaccagccacctttcagccgtcaggttctggngggntgggtaagttgtctttttcagaggttataaacacccccaggttttctaaggttttttattttttttatggccaaaggggccctgtgggaaaatttttttatgggtttttttaaacaaaaatatttttttttttttgcccccctctataaatattttttttgggggagaaaagaaaaaaccccccccaaaaaaataaaacacattttttttttcccccacaaaaaaaatttttttttgtgtttttttgaggggccgtcttttttttaaaaaaaaaaaacaaaataaaaaaacacccacccttttttttttgttgtgggggggtgtgtttgtggggccccgcaaaaaaaaaaaaaaaaaaatattccccccccccccccaaaatttttgggggggggggttttttttgtgttgtgtttttttttttcacaccccccaaatcttttttgtgggggggtttttttttttttttgggaaaaaaaaaaaaccccccccccaaaaaaaaaaaaaaaaaaaaaaaaaaaaaaaaaaaaaaaaaaaatgtgtggtggggggggggggggcgccccccccccccccccccccaacaaaaaaaaaaaaaagaacccccctctctccctcttctttttttttttttttttttttttataaaaaaaaaaaaaaaaaaaaaaaaaaaaaaaaaatttattttttattttttttttttttttttttttttttttttttttattttttttcaaagggaggggggagggggggggggggggggcccgggggccggcccccccccccccccccccccccccccccccccccccccccccccccccgcgggggcggggggggggggggtgggggagtgaaagagagaaataaaaaccccccccccccccccgcccgcgctctgtgttgttttgttttttttttttttttttttttccccccccccccccccccccccccccccccccccccc

SEQ ID NO: 37238 - DNA, 389 bp, Heterodera glycines
cccccccccccccgggtccaaaaatttttaaggaaaaataatattttggctgaaaattttaggttttccttgctgggctggtacccccaccccacagacctggcctcacccaaattttccaagaaatgtcgctaaatttttcaaaaaatccacaaatttttaatgaaaatctgctaaaaatggctcaaaatcacaaaatttggtcattttttggacaaaatctgttaacaaaccgcaaaaattttcccggcggcgcctatcggcaccgccggaccccctgtaccccaaaattttttttgcaaaaaccgcgccacataaaaaacgggtgtgaaaagcaaaaaaaaaaaaaaaaaaaggtcgtcgcccggggggaggtgtccccccccaag

SEQ ID NO: 37239 - DNA, 516 bp, Heterodera glycines
tttttttttttttttttttttgtgggtggggggggggggggtggaagaacccccccccccccccaacacaaacacacaaaaaaaaaagaaaaaaaaaaaagattttttttttttttttttttttttttttttttgtgggggggggggggggggggggggggggggggggggggtgggtaaaaaaaaaaaaaaaaaacaaataaaaaaaaaaaaaaaaaaaaaaacaaaaaaatctctcttttcttttttttttttttttttgtcttctccccttggcctgctgcaaagaaaaaaaaaaaacaaaaaaaaaaaaaaaaaagaaaaaggaggggggggggggggggagggtagagttggcacaaacacaaaaaaaaaaaaagaaaaaataaaaaataaaaaaaaaataaaaaaaaaaaaacaaaacaccccccccccccccccccccccccctttttctttttttgttttttgggtggctttcctccccccccccaaaaaaaaaaaaaaaaaaaaaaa

SEQ ID NO: 37240 - DNA, 999 bp, Heterodera glycines
tatagccctgggagctgtcttgatacctgtcctgagtgttttagcccaacatttattagaaaaaataacatcatgaaatttgcaaagaaaatgttaatgattcccgaggcggaatatttggctctacggagtgcgatgaatagtggtgattatctccaaaatgaaaaagcgagtttagacgcaaaaatttctcagaatttacaagaccccgacataagcgaggacctcaaggcgaagagacatgattggctctataaagaaaggcgtacggtaaaggggatacttgaaaatagaccacagaaggtagtgattgagaatcatgtaccaggtccaaatgttgcaccatatctgggcctcaataaccaatccaaaccacaggagaccgaagaaccacggaaaataattattcctaggaaaagacttaaagagcaaactcctgatcctgaatcagataatgatacacttgaggagttaagtccggaaccccaaacaacatccacactcaaaacacccgttccgatcaaaactattatacacccgacccttttaaacggtctttttaggtacgtgaaggaaaacaaagatttatttaaaattacggcggccggaaaggtacagtcgaacatgaatttgccgattgaaaacagtaattatagagatgttttgttgtatctcgcagggaagaaagatgaaacgccgcgcggtgcaaaatttctcaaagatcggttactgaaggatccaacagtaaaagacatggttgataaatcaaaggtcatgtggggacgtggaaggaaaaaggcaataaaatctataaaaacacccggcatagtgcgagtgaagaaacccttcaaaccactaatatgggcaagactgtagagaaaattttatcgaaaattattttaatttaaaatctccgggcagttttgctggaattcaaaaaatttttaaatgcggccaaaagatttgaccgaaatacgaccgatgacgttaataaattcc

SEQ ID NO: 37241 - DNA, 898 bp, Heterodera glycines
cgttccctataataatacgtcgccgtgttcagcattaatctgttgatggaattcttcttcattcggaatgtccatgtccatttttgaaaattttacacggttttgttccttttccgtctgtcgatgcgtttggtcttccgtcggcgtaagcaaaaatcgcattttctattaaattttatcaccgaattaatgaatgatgttcattaggactgctcgagtcggtctcgggccgataaaattccccatttatggccaagagtcacggaaaatttcagtttaaagcagtcctaaatttaatgtcccaaaagtgtgaaattcgcacctcgccaaaagttcgaccctttgcttttcccatttgccaaagtgcgaccaatggaatggccgaaactgacgaaagggcaaaaacaatgcccaaagaattggccaacggaggataaacgtagtcttggtactgaaggggctgcaggttgatgaaactgctcagaatcattgcctaattgggggggggggggtgggcaaatgggcaattaatgggagccattaaaatgcgttgaatcattgacgtactatcagaaagaaaggagcccccactgtccaacagattctaaagacaaaatgccaaagtgcgaagggaaagaaaaagcaaagccaaccgccaataaaagccgggctcaaagccgagcattgcgcgaatgtcagcacaaaagcgacgaatgcctcaaaaagtcattgagcaactaatgggatttaaaagcaaataccgtaacagaatgagatgaccatagtctaaatgaattatatagtatgtttaggataggagaataggaacatacatacggtaggaaaattggttaaatattgggttacggaaggagaatgggtaaatgcttaagtatac

SEQ ID NO: 37242 - DNA, 1030 bp, Heterodera glycines
  misc_feature (20)..(20): n is a, c, g, or t
taaaattaaatttccttatnttttccattgtttcagttggatttgcaacgacgtgtggatggacattcttccatcttttgaccgtccccaactcggcctaaaaatggcattgctttctgatcgtttcgatgtgctggtggacaaacattttgatggaaaaagcgaattgacaatttggaataccatttcaattgaaaccagaagcgaactgtctgtgctgagactgactgatttcaaatcaatgaatttttcgttgccggaccgtccgctgcccaacaaaattcgttttcgtttccttcggattgagtaattaaagcaaatcttatacagagaggccaactgatattaattaaaaaaatttcaaatatagtaattttttgtgtgtattatttttgtgccccccttttcaggtacattgatcattccgtcatcgaattgctccgctccaatcagcaaatcttcgacaaaggcacaaatttgtatttgaatttatgttcatccaaagccgaaagcaatgtccagccaatttgggatgtttttgtccatcaaatttggcccattcttacgacgacaaatgtccatcatttgggctttagcaatgctgatcatttgaacactttgcttcgtctcacatcgccgacaattctctccgatatgaacattaattcaatcgaatctggtcgtctgttccccgatgcaattggtgacgatgatgggccaaatgcaacttctgctggccaagttttgtcaaaatggttacacattccgagaacagatggtcaaccgaggaaattgcgctgcgcttcctctctgttaccgccaccaaacaccgagtggatcaacagtttcaaagaggtgtgaccaaactttcgttaaacgactgactaattgatttgcgtttcccattgtttagacatttctccgtgccaccgcttcagtcagttaccaagtgaatttcctattgagaagtccaacgcaaattgagccatttgaattggtgaatgaagggaccaaagaaaatttgttattg

SEQ ID NO: 37243 - DNA, 1069 bp, Heterodera glycines
taatttcaatgactaaattaacgactttaaattctaagaatttaatttttatttaaggagttgcgacctagatatatagaaagagatggagcatgtagtaaaatttctaaaccgcagaggatataatattcctagagttacatttcttttttttaatttgttaattggatttatttttttcatattttgatttttttaaatatttttattcctccgtttcccctttttccatcgctcttttcttctgtttgtctcattttttgtgtgcctcgccattcaaatttgtaattttccattttatttattttttatttttttgttttcccctctcacacgtattgaaattgttttctcctgtccttccgccatccgtccgtccgttcagctgactggcattttattgctgttcatcactctttgaaacgtaccgcttccggccacggcattggcgcatcgccaacgatggcacaaatcgcctccggcgagcggatagaagagggagaaaggggagaagaaaaagaggcattttatcagtttagtaaccgccgctgctccccgcgccgcctccgtaaaatggcaaaatggcaccattttacacaatcctatccccgagcgaaattcaaagcttccctttaattaagaaaaaaatatttaaaaattaagagattagctttaaaatttaaataaatttgctaaactcagtaaagcttttttaatttatttttttgttccttccattttatttgttctgttttgggttggtgggcttttcggcaactcaattcggaaaacatcataacatattccaatcaaatctcttcacctgtgccccaatttttcttttccgggaagtgtaaaaacgaaaattagtggcacattcagaaaagaatggcaaatgccaaaaacaataatcaaaagtaataagaaattaagcggcaggtgacaaaatttgcgtctgtgaccccccggggggacggaaagggaaatggccaatcatccgccgcttattccccggcccaattccccaaaaagctctcctctcttttcgctgtgccgtcgtttttttttg

SEQ ID NO: 37244 - DNA, 1513 bp, Heterodera glycines
  misc_feature (1444)..(1444): n is a, c, g, or t
  misc_feature (1453)..(1453): n is a, c, g, or t
  misc_feature (1485)..(1485): n is a, c, g, or t
  misc_feature (1505)..(1506): n is a, c, g, or t
aggatgggggcgagccaaggccaatttaaaaaccatagctcctccctcagttgacttcattttacaaatttgccattgtttcaatacttttatcaagctctatattagatcaaaaaagcacaattaaatatttgctaacatttaaaaaattttacttaataaatatcgcaaaaattctgagttttttaagcagttaggttgtaaaatacgtatagttttctaatttcaaacttataaaatagagccaagattgagaaaaaaaaaatatggcttcttaaaataaaattattttttgtataaaatcattgggacataaagaaatgtatggcatgaatatttgtttaaagtgcattaattgttcagtcagctgaagaaaaattggagaaaaataaagaagctgattgaaataataataataaaaagaaattcccattgattgtttgataaataactcattaaaaataagtcctaatttaacagaaataaattagctttacatttttcattgataaataactcattaaaaataagtcctaatttaacagaaataaattagctttacatttttcattgataaataactcattaaaaataagtcctaatttaacagaaataaattagctttacatttttcaaactccataaaggtgtacataaaaatttatgactgattttattaaataaaaaaagtaaattatgtatttttaaaacaaattattattttttctttgcgattattcacgaaaacaaaagcaatgcaaatacacaacaataattaaaagtgcattttgtgagcttttgagaaaataaaaagaaaacaaattagggcgttaatatatctcgattatggcaaatcttaaaataaaggattttatttatccgacctatacaaataagggcaaatggcagtccttatttaagaccatcagattattgcctttttacgccataattattacatttttgttggtaggggagaaggccgcaaaatttacgcaacaattcttttcatatccatttatttgaacagtggcaatcaatcctttcgcattataaaaatgaattaccacaaatttttcagtttcccaaaaatatttacggcaaaccgacaaaaatttagaaattaatacaaaaatagaccaaatattaatattttttttcataacaaaggattggaatcatgaaaatataatattaaaattagttaggtcaatgaaaaattatttatcgaaattaatgctataggttttatgtgaattacctttcaaagctttttatcaattaaccataattggtctccatagcacccaccatttgaactttggctcccagacgaaaaaatacaaaatttcattatatagacaaaatttataattgattttctaattccaaaaaaataaatgatcaagaccataatgacgaaattattatgcccaaaaattgngtgggaggnggaagggcggcggtgccgaaaaaggtgtcgancgaagagagaaaatgaactnntgaccta

SEQ ID NO: 37245 - DNA, 364 bp, Heterodera glycines
tcccagaaaaaaaaggtcgaaaaaaggaattccgagctttttttgttgtgcactcaggggttttcgcaggcgctgatcacgaatatgacatccatttcgacagaattcgagccccggacccgatttcgaacaaaaatcggaaattaatttttcaccaaaattcaccggtactagtggactttgtatccgcttttttttttttttcgcatttttcagttttttttacttttttattgtcacaattgctttaaataacaaataaaggagctttatgtgcttattggatacaattccgcgatttgggtccacaaattaaaaaaaatgtccggtcctccaaattgcctacgccacaaaaaatcggaaa

SEQ ID NO: 37246 - DNA, 1306 bp, Heterodera glycines
cttcagaatggcttctctctgccgcgtctcttctcccccccacccggaggtttctcgtgccttcgtcttccgcgtgatgtcctccactttcttcggcttttccctttgtttcgcttctttccttcggtttcgctgcgtttcgttcgctgttccgtcgtcctccgttcgctgctccattcgttcgtaacaactcttccgatattggcacttcagttttttgtgccgttcatccatgccgtgccatccttcgatggcttcttcttctttcacttcattttttattgccattgtcacccataaattgtgccattcctcccaaccgtgcccccgcttttcatcttcgtccccctcttcctgagtcgcccatcttcgaattggtggcttcgttcctgtcgcataacaactcttccgatatcggcattccaaccgttcttccttggacagtccttgccatttcctttcccaaattttcgtcttttcctctttcacttgcgctgcttcaactttgtacttcttctttttctttgaaattctttttggtttttcttcatcttcggtttgtttttcgtgccctttcctttcttccttttcctcctctctcttatttccttcttcttccctttcttccttttcctcctcttccgtttcttccttttcctcctcttccctttcttccttttcctcctctctcttcttttcctcctcttccatttcttccttttcctcctctctcttctttttttccccttccattttctcttttctttctttctttttcccattaacttccttttcctcttccttctcttcttctttgtccttctcctccccgtccatttcataaaaatgcttcttcaattgagcttccccattcctattccttttcctcctttttgatttcttcctcattttttccttttcctcttcttccgctttcttattcgtgtctttttctccctccttttcatcatcatcattttcgcgctttttctcgtcttccttaacggaagatgcttcttctccctcatcctttttttctctgcatccctccaacttttcttttttctctttcaccaatttttcgggtgaacaactctttttttgtttcttttgccttttcttcctctccatctttcccacttccgttttctcttccttatcctcttccccctcctccttctcttttccctctttgtcttcctctgtcccctcactttctacgtctagcttttcctcctttcttctatctttccctctgttcctctttctcctcctccttcgcttcctcttcttcctcatcattttc

SEQ ID NO: 37247 - DNA, 1165 bp, Heterodera glycines
ggccgagtaaagcaacgaattttctaaattttttaaaattttctccttttttaggtgccccacggatttaactctcggcaagacccaattagaatttaatcgagtttaattttcaatatttttttcattctctttacagtttccattcgattcgcagacccgcaagctccggcatcgaaagctcgtaaaattttttcgcctcgatttttttaatgggggtatacaattttacaaaattaattgttttaatgaaggcttttttcatcggtgttaggggttgctcaccgaaattttttaaatttctctaaccttctccgacaaattttttcacagaatttcctccccgatccacgacttttctctccccgaatgtcggggaaaaccctaattttgtcggaatctcgaaaactattttaaaaaattgcattattttgccagatgggtacacctcggaccaggtgtcctacggctggtccaagggccaacgcgaggcactgaaactgcacaaaattcggctgcccgacttccgaatcaaagaagcatttgtcacttcccagttggaatcatatgcgaccggtaaaaattgtttaaataatttttttaaattttttttacattaaaaaataatttaaattatttatttaagttttgatttatttgtctatggttcccatttaaaaacattcgagaatttcaaactcttggaataattccacaaattctaagtctcgtaaaatttcagaaatttttagaccttggaaagtctaaatttaatattttagaatttgttgtttcaaatggtcaatgtcttatttaatgagttaaaaataaattaatattattattttcaattagtttaatttttctctaagcaattaatcgatttaaaattttcgaaattttctgcattaggaaagtttttttttcgccccaggcaattacagccgtttgtacgtgtgctttgttttttcccgatcagccggcttctgttttctgcaattgatcattccgtcaaccgtaattaattaattatttttttttttaatttccgaaaatttaatatttttcaatttttttcttgcaaaaaaggccgttgtgatcacttcatgggtgtcactttgggtgggaaatgagacatcttttcagggtaaggaggaaatggaaa

SEQ ID NO: 37248 - DNA, 933 bp, Heterodera glycines
  misc_feature (792)..(792): n is a, c, g, or t
  misc_feature (822)..(822): n is a, c, g, or t
  misc_feature (828)..(828): n is a, c, g, or t
  misc_feature (857)..(857): n is a, c, g, or t
aatatttgccaattttcattgaaaatatgtttaaaactcccccccatttctatttttacccaaagcaccgttgagcccaacataaagtacttttttcgtttaaaaattggcccaaaatctcaaaaagttttttttgtgaagatttattaacaattttcaaaaaattttattgctaaaatattgattttgaaaaattccagttagcagcctctgggaaagcttaccatatcttctttccctaagctttatcctttttacaggcaataacaacgcctcctatcggtatgagtcttctacccccctgcgagcctcagcttcaactatcaccacctccttttcgattgccttacgcaccattgttgccggcttcacatccggcaacaatttcacaacctcccccaatcctttcgccccaaatatatgcgcctcgtcaaccgccacctcccgcacaatctcgttttgtacatattgcaccgcttgcaactgtaaatggtggtccggttgttcccactccattcccgcgggtgccaaccgcctcaattgttcgtccaatgccgacagctccggctaagccagcgaacagcagcaagtgcaacgaatgtggtcggcgatggcgcaaacaaatcatctgtaaacggacgcgtggctcttcatttggcccatctgctgcaccggtgaaggaggaacagatggaggaagaataatatttagtgctgatcagcaacgggtgatggttaagtcctggatttttaggacccaaaaagttgcaaatgatagggtttatgattctanaaaaaaagtaaaacagaaaaaatacagaanatttanatttttggagcatgaaaatgattgactanaaattatttttttcataaattttattgaaaattttttactttaattataaagtatcttaatataatgggagcaaaa

SEQ ID NO: 37249 - DNA, 154 bp, Heterodera glycines
gcttcgaagcgagaaattgcttaaggggaaggggtggcccacgcggaggaaagggactgagactcactcgtctgcgagaaatcagtcccgtaacgtttgcccaacgcaacgccaacgtcgccctgagtgaagccttaagggggggggggggggg

SEQ ID NO: 37250 - DNA, 825 bp, Heterodera glycines
tggtgaaattcagcagtttgcatcttttgcaatgttttcctctggtttgatgagcttcatggatgcttccgacctcttcactcttttaaccaattgagaattccttggctctccgcccatttggccactgtactttttttgtgttgttgtgtttcatttggatcgccccccccccatttagtcttctttgaatgccgtccatcttccgttgtctggtaaacagattttagatgtcggatgtggtgcaggcattttatcgacttctctttgtcgacgaggcgctttagtcactggcttagatgcggataaatctgtgctagaaattgctaatggttataaggaaacaatggcgccgagtcttcgcaaaaaaatagaatttattcctggcacgattgagagacttgcgcaagaaaaggatcgaatcggaagttgtcatccatttatgtccatcaattaatcagataagaattaagcattcgatgcggtcgtttcttcggaagtggttgagcacgtttccgacttgcccttgttcattcggagttgttgcaaattggctcgtccgaattctccaatttttttcacaacaatcaaccgtacaatttggagccaactcttggctaaaacaatagctgaggttttttccttcatcttctttttactgttcatgcttaggatttgctccggatactgcctcaagggttgcatcaattcgaacaatttgttgctccgcgcgacttgcgcaaattgctactggacgagcagtgcagcgttgggccggtgcttggaaatggcctacacccattttttaacatttggaattggact

SEQ ID NO: 37251 - DNA, 565 bp, Heterodera glycines
tttttgtattaattgccatgacaccgtgggaagggtgggggaggaaaggacaaatgtgctctttttctttcgtttgttttaattattcgttgtttttaacactcaaaatgagactaaacatatgcgtagatgacgaatgcgtttgaattgttttgtcctttcatcctccaatcgacctccccccctttttttattccgtcgcatttcccccccccccccctcccatcaaattcattcattcggtgcgacattcacccgagtgacacatcgattgacaaaaagtgagtcaccgttaatcaactttcccaccattcatcgtccattactctacgacggaaattaagcagcaaaaaaattgtgggaaggaaaagcgaatcgtaaattggcaattattagtaaaatgtgcggttaagtgaagcgtagtgctgcaggtgacagcgcaagtaaataacaataaaaaagacacttggcactttccaattttagattcgctatgcatttttaagcgcagctgaattgagagcgcaaagggaattattttattaaaggaacggagggggggggg

SEQ ID NO: 37252 - DNA, 1210 bp, Heterodera glycines
  misc_feature (1195)..(1195): n is a, c, g, or t
ttgaagctataatcaatcctcaagaaattaattaaaaattgagcaaattttcaaaaaattattgatcaaatgctttctctttaaattgttcgtttaatgggtttcgctgataaactgaacaaattttgcaaaatttgctgcagcaagattttttagggtttctttgataatgtgaattctttaaattgttcttaatgggttttggcgataaagtgatcaatttttctaattttgtgctttcatgtgattgtgcattggcttgacaattataaaagggttaatttttcttaaaaattatatttttataaaatggctaaattaaaaatatttttctttgcatttttgattttgtcacaaaatttgacaatttcaaaaccaattcgtcgcaaagaaagagaactggggactcttgcggctattgcaattatttcggcaattgttctaactccaataatacttggttcggttgcaaccggcattgtaattggttatactttaaaagatggaagtggtcgtgaatgtatgaatataaatttaaatttaaaaataataaataaaatgataattaaaatattaattaataatttaaaaaatcaaaaaatttgttcagataaggagtacctcaaactttttttccccatcaaattttcgtttggcgaccgcgaaatttcaattgatttggaaaactttaacaattaatttttgtttcgaaaaattggtgaaatgtggtccatgccaaatttggatgagatttgtttttttggtatgaaagaactgataaaaaaccacataaatcagccttcctttcagatttaaaaggaacaaaaagacgccacactcgatcgggacaaattgaaatatttttattttatctgtcaaaaatggaattgcctgtttcactgaattcttgttgattgctattttttctcgttagcccttgagaaaggcgaataaatttaaataaaaatttcattgaaaataggttaaataatatttgtatatgaaaattggttgaataaaatagaatttaataaattaaaaaaaataataattgttattgataataataaataatttataaaattgttagtgtgtatacagaaagtatttctatgtgtgaattttcaataaaaaggtttctttttaaaaaatgatttattattttatataggatgtattttattggcacgattgnttttttctaaattaa

SEQ ID NO: 37253 - DNA, 1312 bp, Heterodera glycines
ctatataatgggacatgataaacatagattcgtttatgccattaaaaaaactttatgcattttaaaaaatctgaaattttccgatttaaatttatttttttaattttcgaaaaacaataaattatttctacactcgacagtattatacaagcttgagtgtgaaaataattattaacaaatattttgattttcgaaagccgataagtaggtaatattgaaaaaatccattttttgttcataacttattaaatttaatgaaaaaatataataacatttaaaatgaacagacaacatagttaatattaaaatcgcattcttgttgatattaatccatatttaaatcatctttaaaaaagctgaacaaaatataatataaataaccaatagaagcgcattgtattatctaaaagcaaaaatgaaaaattttaaataaatttatgattaagacatcatataactggaggaaatgacaacattatagcgaattaatctattacagtatataaaataataatgaacattctgataaaaaaaacttatgttgaggttataaatggaaaatattcatctctactaatattttagatctctgcgaatatatcctccaccttttactattgaattaattaaataaaagaaatatcgtaaaaactaaacaaaaaaagctttccaatcattaacataaggcctaaaactaagttcgataaattgaccaaaacttattatatatgttaactaaaaataaaaaaattgcctgtatgcaaccacgaagattagcagcaatgcaagtggcatgatttcaaaaaagtcgaaaatttgttggagccatacaaaataaataaatcaaataattttaaataaaataaggtaaaatcgttaatttattaagcattagcaagtcttaataaaataataatatatatgtttcaaaatagcgaaaatgtaaaattatttgttttaatagataaaaacgaaatatacaccctaagaatcaacctaaaaattaaataagaattaaatacaaataataagaaaaaatttttatgtattgaaattataaaaagtcgatttaaataatatttaagaaaaatactaataaattcagcacatctgtcacccctggttatttgtcagcaaattttgctcaatatgtagtgacgaaaagtccaaaaaagtgttcctaagttgcagggttacgttatattgtaagtatgtgcaaaaactatagaaggaaatttaaattttaaaaataaatttccaacacattataccctttgatttatttaaaattgtgattaaatgataaataaat

SEQ ID NO: 37254 - DNA, 919 bp, Heterodera glycines
  misc_feature (848)..(848): n is a, c, g, or t
  misc_feature (864)..(864): n is a, c, g, or t
gttttgcctcggtttttcaaaatctgtcccacggtgattatccgaaatgcccaaccatcgaaactttattattttgttaatatccttttttcttttattatatttttcgttcttttggttgcccagttgagaatttgttttttacttttgtcctttttcattttgtgctatttctttttttcttaaatttgacttttcaatgaattaattacaatttgcgtcttccttttttccatttttatttttatttaattttttcttccatttaaaaatgcggatttttgtaaaaaaaaaagtcagaatgcatgtaattttgtagacgagtatccgtactgtaaggtatttgtgtgttaggaaatcagctttttcaaaacttcatgaagtcgtcgtcactaaagttaccagctctatttattaccatttcccaaaaaatagtatggcaaataatcataaaaaatcattcttttattccgtattattatattaatttgattttcccaatgaataatcaatcattcacaaaatatgaatggtcattcattttcatcacaattcacacataaaaaaggaattttttcattgtagcaaatctgtgcaaatcgatgatttatttttttattattatatccctaaaaatgactaaattagtgaaaattgtgcaatgattttttaaatttaaaatttaaaaattttaaattatattaagagagcaaaatgcatcttttctatgtgttaattgcttctgctctcttctatttgcacagcttcgcaaatggacaatcatcgcctgaaatgtaaaaataataatttaatttaatttaatttaaattattgttttaatttaattntttttttttgaggttncatttcgacgatggcagaagcggggaaaagccaatccaataccggacatctgctg

SEQ ID NO: 37255 - DNA, 714 bp, Heterodera glycines
  misc_feature (681)..(681): n is a, c, g, or t
taaaaaaattgtaattttgaaaaaagaaccaataaaataaacataagataaaaaaaagaataaattatattaaattttacttttaatttcgtgacaccatctctgacacatcttatttatttaaatataaatttagcataaaaaattattttgatttaaaaatcattaaatatatttttattcaaaaataattatttttagtagcccctgggaaatgcagcttctttaataaattgtatatttaaaccattgggggaatttagaattcaatgtgtaaatcaattttttaaattgcatttgattaaaatattaattgttgcagattatcactaaaacaaaaccatttttaaactttaaatacaattcttatattattgattattaaacaatttaaagtaaaaggtagttataatacaaccaaaataaaaatgaataaaattcaattacaaaagcagtaattttcaaaataaaaaaacaaacaaaatgataaataagggacaaaaatttggattcaaaaaatgtcaaaaaatagttttcccaagaaagggtatatccacttaagcttcagccaaaactgataaaaactataaaaaggaagtaatgtttaatcttacttaattttagaattaatttttttacaatttatattaatataagtaaattttggaaaatataatctangataatatcaggccctgaaaatttctttcaaaa

SEQ ID NO: 37256 - DNA, 970 bp, Heterodera glycines
ttctgtcctcttccatgttggggagtgataaaagatgaccaatcgaccgactcgggatcgaaaaacacatgtgtcattttttaaaatatacttttcttaaaatgtaatgtaagaatacaacttcccccagtgaaatttaacgaattcaccaaacggtgtgtgaatttcaattgtaatttctgaaattcgtttcgactgtagacgatgaaaatactcggtgctatatataacttcactaattgatcctgggtcatcgacgacgttaactattcttaagagtggggccatctggttgccgataattgtgttttcgattaaatttggtgcataaatgtatagctgccttacacctcccgtcaaatccggcatataagtcgcctcttccgcgtgaaatagccttgtattcttaaaccccagaacatatgcgaggtgttttgacaaatctatatgggtgacggcaaaggaaagatagacaataaatttttgatcaatactgtcgtagttaaattgaacatcctcattggctaatctctctcttttttgcggccctttttcagcttctgaaacttgtctattttcaatttccttacgtttaaaatgcccaccgagcgcctcgttaagcctaaccaccatcccgctaaaacccttttccgatttatcattatattcctcgagagttgatgtatatttggtctttgcctgtctggcgattccctttgcgacgtcggctgatttctttgcttctttcatgtcattcttttccacatgctccaatgttatgtttttggctttatctacttcttcttgaaaagatttaagttcatttcgggatgtttgaatttcggttcccatctcaaccattttgtcaaaccaaatttttatatcaggctcttctaaaatttgaggatttgtttctcgtagtgtgtttagttggggttggatggaattggatatattgttgatatgatta

SEQ ID NO: 37257 - DNA, 989 bp, Heterodera glycines
  misc_feature (36)..(36): n is a, c, g, or t
gttagggttaaatctttatttgactaaaaaaatcantcggaaaaattcaacggaaatatttattaatttttgcgaaaatttgtttaaaattgagttaagaaactaaaataatttccaggggggtccaaaaccggcctaatcgaaaatcagtacgcccgcttaacaatcaatctgatttaccttttaccactgtttgctttttctatttcactattttatagcccctaaaatccagcattcggtgaatcaaacctaaaatattaaattagcattctcgtgcagcaacttttcgggttctgtagtctaaacattcaaattcgtcattaagaagtccgttttattttaaacactttttgaaagacggcaatgattaaaattttaacttttttaatgcaaaaacaaaaaagacacccttaaaatcgacattaaaaattctaaaaaaaaactcctatgaaaaaacttgccctttttctgtatttttgttatattaaaattgttaataaaaaatgttttcccgtttttttttaaatttatttttttgtgtttctaatttaatgtttaaattaattttcttcccaatataattcctcttctcattatctcctctctctacttttctcttgtttcactttcctctctctgtctctcccacatcctttcggtgctgggacgttagtcaaaaccatcaaaatgggcgttaatcaaaaaaccatcaaatggaaatttgttgacagaaaattattcataatttcgcataaaatggatcaaattttataatcttgatatttttcgatagccctaagtgttttctactatcttgcaaaatttaagtttaaaaaaagttatgacctgagaagctcaaaaaattttcagtcataactttcttgatacttaacgaactttttgaaattttgtaggctaatagaaaacacttaggcctatctaatgatatcaagaattaaaaattgagttgcttttgagcaaagtta

SEQ ID NO: 37258 - DNA, 1358 bp, Heterodera glycines
  misc_feature (1300)..(1300): n is a, c, g, or t
  misc_feature (1310)..(1310): n is a, c, g, or t
cgatttgcccgctgaagaattgtgccaatgcgaaagcagtggaaacgcacaattttgagcggacaaattagagccaatgcgaacagaatatttggcgaattgatacattttgaggtgcaaatgccgatttaaaaaagaaagaaaagtaaaagcattcggcacaaaatgaaattaaaacattacaatttttaatatattccacttattaaattcaccaacaaaaataatgaaagaaacccattattaaactttaatgcatacttattgggtttgttcgaaacttagtctttcaggaaatttgtttcgattgaaatggccaatgccaaagtggtctcattcggctgtttaaattctgcttcgcgctgtccgcgcgtggcatccaattgacatatctacgtgcgaacactcgcggcaacggaagcccaatttatttggcatttattgttggcattgtgcaaacatttggccaaaacggcacaataaaggcaattttgaatgaattcggaatgtttttgacaattatttaggaaagaaattataaagtttagtaaattccattttgacaatttcagtccgccaaattattgcgaaatttatgaatttccgagaagtttattttattttgtctaaaatattttgaaatatataaattttaatgaaatcatacaaaaaaaaaacaatgaattctcaaataaaaatgaaaaaaaaaattaaaattacgtaaaatctttttgtatttattaaggttttcttcaaagtattaaattcaaatttcgaaaaaaatccaagtataggtatatcaaaaattcagatcaaacccattttttaaatatttcaaaaaatccaaggtatattacaaaatgaaaaaaaaattacacatttagtcttggctgatgtttttttttcctgaaattctttatcttttatgttcttcatttgatatatttttcgcctttttaaattgtaaacattgaaagattcgaatttttgttgaaattagcatatttttttcatttatctcattcaattatttatttttatttataaagtcatatttctgacacttaatttgactttactcattctatttgatatatttcccattctttcattggaattaagtacaaattttcttgaggcaaatgagaaaaattttcattttgagaaaaatggcgaggattagtgattgaggtgtaattctgaggaaaggagacgcgacattcccatgcatatttcaatgccgtgattgagatagcttttaaaaaaattttttggcgtcgcatttcgtaaactgtatccnaatgttgttngttttttattagaaaaactttaattacatctcatatttttccatgttt

SEQ ID NO: 37259 - DNA, 561 bp, Heterodera glycines
ctgaaagttttttcttctcagcggtctttcatgactgcgtaccagctcgtgcgcagttacgccgaagccaaatttgggccggcaggagcaaaattcatgcgaattcaccgctttcgcctctcgatgccacccatcgatgaaaaaatgggggaccagccttgcatctgccgcctacatcggcatggttgcgttgttgacaggccgagcagtgcgcgccgattggtgtgtcaccggcgcactggatttctccctctttttcggcattttttgttatcttctctttttggcacttttttccattccgcgcattcattcattttcacccacagaacccgcaaaatcggcaaattcagccgctgtgcgaaaacgtgtggtccaactgttgaagttcgacggcgccgccggcgagtcgaagcggcgacggcgcagcctcagcgacggcgcaaattcgacggcccaattgttgggctcgtacggcgtgctgctgggcgagatggtcgactgtgaaagcactgaatgtgccggatcgtgccattctgaaacgcactgcgatgaacatgg

SEQ ID NO: 37260 - DNA, 859 bp, Heterodera glycines
attgtcaattattatcacatcgaaattcacttctgctggagataagaaaggcccaaaatatcaatcaaatggcaaaaaagggcaccgccaccaaaggaaaagccaaaggaaaagccaaagcaaaataaaaaacaaatgccttttccgtcggccatttgcgaaggcaattcgctcttttggtccaaaagaaatgaatcggtcagcatttttccgcctccgtccgccgtcgaattttgggaggcgttgtgatcaccgccaaccgcggaagaatcggaagagttgggactgaacaacggaggttggccggacgaagacggtggtgaggcggcatcgaaagggagggggaggacggacacctgcgaaagtgcagaaaaagtgatgagtcattgggtggcgcaaatgcgaaaggacaaaatgatatcgggggaagaagagcatttttgaaacttccaaacagagagagagagacatacccatcaataaatttgaaattgcaaataattttatgatcggttaattaattaattaattaattgtccatttcccccgtccttcaccaccgaatggtccctttgctgatgatgattgttgtgcaaaagctgttgcatttgtgcggtggtcgtctgcatttcacaaattgggagacccaaaaagaaaagggaggggaggaaaagcgaagtgatcagcaacaggagagaatggagcaaaattaggacattggcaaatgactgaaagggacgaacgacggacactaattgttggacagaattgctgatcgatcagaaatatggacggaaatgccatccataaagggaggatgcggtaaaagcaaatcctttgaaggtgaagtgaaaaggaa

SEQ ID NO: 37261 - DNA, 1230 bp, Heterodera glycines
  misc_feature (162)..(162): n is a, c, g, or t
  misc_feature (169)..(169): n is a, c, g, or t
tgcttttctaggaatttataacgtcatcggtcgtaattttcgggtcaatctttttggcctcatttaaaattttttgaattccagcaaaacttgccggagattttaaattaaaataaattttcgataaaatttctctacagtcttgcccatattagtggttgnaagggtntcttctctcgcactatgccgggtgtttttatagattttattgcctttttccttccacgtccccacatgacctttgatttatcaaccatgtcttttactgttggatccttcagtaaccgatctttgagaaattttgcaccgcgcggcgtttcatctttcttccctgcgagatacaacaaaacatctctataattactgttttcaatcggcaaattcatgttcgactgtacctttccggccgccgtaattttaaataaatctttgttttccttcacgtacctaaaaagaccgtttaaaagggtcgggtgtataatagttttgatcggaatgggttttaatgtggatgttgtttggggctccggagttaactcatttattgtatcattatctgattcaggatcaggagtttgctcttcaagtcttttcctaggaataattattttccggtgttcatcggtctcctgtggtttggattgagtgttgaggcctagatatggtgcaacattcggaccgggtacatgattctcaatcactaccttctgtggtctattttcaagtatcccctttaccgtacgcctttctttatagagccaatcgtgtctcttcgccttgaggtcctcgcttatgccggggtcttgtaaattctgagaaatttttgcgtctaaactcgctttttcattttggagataatcaccactattcatcgcactccgtagagccaaatattccgcctcgggaatcattaacattttctttgcaaatttcatgatgttattttttctaataaatgttgggctaaaacactcaggacaggtatcaagacagctcctagggctataccactcccctgttgtatcctttttcttgccgttttctctgaacgagatttggcaatttctctataaaaatcggcgtattgtgccaaccttcttttttgtttgttcgttagtttaaaactaaaactcaatatatttgcacaaatttcaacgattgccaaaatttggtcagctgtagcgttttcaattaattcgttcttcttttgttctgatctggtggaggcaa

SEQ ID NO: 37262 - DNA, 889 bp, Heterodera glycines
aaaaatgaaaaagaattgggatttgttggcactttttattgaacatttttatttttctactaaaacatggacaaagatcccattaatgttatgtttacattttccgttagggttaatttctttttcattgtgtcattggtaaatttttcgatttgactaaaaaaaatctccaaaaaatcgcagttttaacaaattaaataattaattctggccatccaacaggttcataggaagcttcgtttctcgtcagcaaatccccaatcactgttgtttttctatcatttgtgcacatttcgtcttcaatcactcggaaagcgtcggaaataatatttggaatatttttttggtgtaatgctgcgcttattgtcgtcaatttgtccatttcgattttattctcagagacattactaaataaataaataatgattggtttattttaaattattttattaatgctattttctttttattcggaccaaaatttacgcgcaccataaattttttttattagcattgtcagttagtggtgctttttaaactgcctctagcggtccaggctcataattttttaaactttctaatttttttaaattttataaccaggataactcttatacatttaattaaaaatatgtaccctatttaaaaataattttgtctcacctctcattaagtttcagtgcgatggcaagtgctaaagtaagctgttgctgtaccgtgcccttgtaatgtagacggtcaacaaccaggccgatctgctgacgtgccagtgattcggcgttgtaaaattgatcaccaaagaatggcacacaaatcatcggcacgccattgtaaatgccctccaacacactgttcatcccacaatgggacacaaaagccaccgtttttg

SEQ ID NO: 37263 - DNA, 580 bp, Heterodera glycines
ccctccctcccccccccctcaccctcatctctttttcttattctctctccttttcccctttctctttttttcgtttctctctctttctctcattccctctttcttactcacttctttttcggcctttcccgctgaattcgatttgtcgcccctttcctaatagcatcatttggatcagcgcaccatcttggacttttgtcgccacttgcatttgactctatggcagggtcaactacggcttcctgtggaaaaattaaattgataaagacaactctttgattttttaatttcccactgtcactacccttcccttttaattttaatttccccatattctcccccccccctccctcttaccctaattccaaacctttttaaccccactggcttccctttctccctcattttccccttcctcccctctcaattccccccatttccttctcaatttccttccctcattttcatcctcccttaaatgacctttgcccagatgcgaaatgtgaaattcacttcgtccactttcgatcggtctattggagaaatattttctgaagaccttctcacctgatgggaattt

SEQ ID NO: 37264 - DNA, 1050 bp, Heterodera glycines
  misc_feature (982)..(982): n is a, c, g, or t
atagaatttctaaaaattcaacaaaaggactaactattatttcttcccgtgtatccaacaagagaacttagaatgtcatttacggttactgatttactcattaaaattccaaaagccgatttgacggatagaatttctaaaaattcaacaaaaggactaactattatttcttcccgtgtatccaacaagagaagcatagaatgtcatttacggttactgatttactcattaaaattccaaaagccgatatgacggatagaatttctaaaaattcaacaaaaggactaacaattatttcttcccgtgtatccaacaagagaagcagagaatgtcatttacggttcctgatttactcattaaaattccaaaagccgattggacggatagaatttctaaaaattcaacaaaaggactaactattatttcttcccgtgtatccaacaagagaagcatagaatgtcatttacggttactgatttactcattaaaattccaaaagccgatttgacggatagaatttctaaaaattcaacaaaaggactaactattatttcttcccgtgtatccaacaaaagaagcatagaatgtcatttacggttactgatttactcattaaaattccaaaagccgatatgacggatagaatttctaaaaattcaacaaaaggactaacaattatttcttcccgtgtatccaacaagagaagcatagaatgtcatttacggttcctgatttactcattaaaattccaaaagccgattggacggatagaatttctaaaaattcaacaaaaggactaactattatttctttccgtgtatccaacaagagaagcagagaatttcatttacggttactgatttactcattaaaattccaaaagccgatttgacggataaaatttctaaaaattcaacaaaaggactaactattatttcttcccgtgtatccaacaagagaagcagagaatgtcatttacggntactgatttactcattaaaattccaaaagccgatatgacgggatagaaatttctaaaaaattcacaaa

SEQ ID NO: 37265 - DNA, 1023 bp, Heterodera glycines
cgagactcaagaaactgagactgagaattggtcccagaaccaatcttttttttttgttggagacggatagccaaacataaatcaaattctttacaaatgataattagggaaggttagtgcctgaataaatttatgcaatatattctttcttttaaagtcaaaaatgaacaataaatggcaaataaatcatttgctcatcaacggtttcatttcgcactgatcgacggacaaaaatcactcaaaaagtgatcaattgtcagacggcggtcggttggcggggcggttaaatggcaatggcattcgtccaaaaaagggcaaaaaggcaaaggacggcggcggcggtgccgaaccattggacgaagaggggccaaaaggcactttaaatggcggcattcgtccaaaaggaggcctaaagccgaagggcggcggtgccgaactgttggacgacgagggaccaaaaaagccgtggccaaaaaatggccgaaatttgaatgggttgaactgctgctcctcactgcccgactcttccgaattgctctcctccgatgccatttccgacgaattgttcggcgcctcactttgtccattgacaaaaatggcaattgtcaaaataaaagcagcaattaaaaatttgttggccatttttgcgataaattaattaatgattttgacaattcggaagcacagtcaaattaaagttgaataatttcactgattcattcgctccttttatgtgctttcatttcccattcaaatcacagaatcacagctaagcaaattaaattttcattttttttcgttaatccctcaatttgttcagtttgacaaatgcgtcattttgtgaaattttgaaacggaaatatgttttagcttatatctgtccttgaaaaggggaataaaatactaaggctgcacgcaattacggattacggaaattacggcgttttggacgaagtaattacggatttggtaaagtgaagaatatgcatcttattgtatagaaattttataccattcggctcc

SEQ ID NO: 37266 - DNA, 1367 bp, Heterodera glycines
ttgtttcacaagtgatttgatggtaatttagggttctctctaagatttaattatttaaattggaaatgtccgcactgcttgggttgtttagcaactgttaataattcgggttaaacttgtccccatcggatatcgtgaatacaccaaatttggcgatttcgccgtgctttccttcccaactcacccaatctgtccaaataatcgtaagccatccgataaatttcactgcgagtgatcagtgcccaaagtgtgtcgaatttcgcccgtctctgctcattcatcggcgcttctccctgacaaacgggcgggtggaacaattgctcgttgtaaatgtcgacgagggcggcgaaaatgggccgttggaggaaagactcatcagagacggcgagaaaactgagaaagggacgatggccaagtgaaacaatccgaaatgattgggaaaagagaaacaaaacgaacaaaaggaaacggaccaaaaaaggagagaaatgggagagaatgccaaacgaatgccaaaacgactcacggactatcggacacgtcgatgacccttctgctggggatgtgctgctgccagtcgactctcaccatcgactcgttcactcgttctgtgtccttctcccacattttgtccaccaactgctgaatgttcgtcggccctctcagcgacggcattgactttgaccgtcccatggttttgttggtgcccatcgattgccaccgcttcgccgcgactgtgccgattcttccgcttcttctaccgccgtctcttttttcggaaacagcggaagaaaagtcatcgacggaagtgggagcggaggaggtgccatcccttttcagagggacgaaagcgaacgcgcgaaaaatgtgccgctgaagggaagggacggcacagtcactcagcaacaggggagagcaatcagcacattttgggattattttaaattcaaatttaaatttaaatgctctaaataatatacgtctaaccttgttacctaaataatattttataaaaatgaattaaatttgggattaaaccacgacggagtgaacaaacgacggttaattcatttttgttgagacttgaataggtaaagtgaaagataagaagtttcaaatattcggcggatggggagggggtatttgaaactttcaaaatttcgctttttgagtcgtgcggtagcgaacgccatgtttttaccatatgcctactgtacacttaccgtatgttcgtcccctgtctctcgcgatgtttgcacttcgatgctcagctccgtttggtcattctcttcatccgttttaaatgaacatcgcttctgtaagcatttcgattttggcactttcctcttggtccatttggacctgca

SEQ ID NO: 37267 - DNA, 999 bp, Heterodera glycines
attatatatcagggaccccattctttcttggaattttccagtacgggttgttccgtgaaaatttgaaaatatttccaaaaatcccattttcttttttctatccttgtggactgagtcggcccttgaaattatatagcagtgaacccaatacttccttggaatttccagaacgggtttgtccgggaaaatttgaacaatatttccaaaaatccctatttcttttttctatccttgtggactgagtcggcccttgaaattatatagcagtgaacccaatacttccttggagttttccagaacgggtttgtccgggaaaatttgaacaatatttccaaaaatcccaatcatttttttcgatccttgtggactgagtcggcccttgaaattatatatcaggaaacccaatacttccttggaatttttcagaccgggtttgtccgggaaaatttgaacaatatttccaaaaatcccaatcattttttttgatccttgtggacgaatcggcccttgaaattatatatcagtgaacccaatacttccttggaattttcccgtacgggtttgtccgtgaaaatttgaacaatatttccaaaaatcccaatcatttttttcgatccttgtggattgagtcggcccttgaaattatatagcagtgaacccaatacttccttggagttttccagaacgggtttgtccgggaaaatttgaacaatatttccaaaaatcccaatcatttttttcgatccttgtggactgagtcggcccttgaaattatatatcagtgaacccaatacttccttggaattttccagtacgggtttgtccataaaaatttgaaaaatatttccaaaaatccctatttcttttttctatccttgtggactgagtcggccattgaaattatatatcaggaaacccaatactttcttggaattttccagtacgggtttgtccgtgaaaagttgaaaaatatttccaaaaatccaaatctcttttttc

SEQ ID NO: 37268 - DNA, 1343 bp, Heterodera glycines
  misc_feature (956)..(956): n is a, c, g, or t
gaattacctccaccaatggaagatctttaaatgcgacatgaaacacttcgtgcagtcgataatcattgcgttttcggtccttctcgaaatcggtataattaacttttcgcaccaatttacgctcattagcatgattatattcaaacattttgaagggatgcaaaagtcgtagctcattgttttgaccgccgtacacataaacagccactttgactgtatttgagtcctgcaactcctgattgacgaatgggtttttgaacactcgatcgtcaaatgaaaatttgatctctccttgagcatttgtttgaaactcggctttgaagtcggaaatgaaaaaccatttgaaattgtttatttttattttttacttaccaggagcatagaaaacgactataattttgtatttctcaggaggatgaatttggtattggttgccgatggaacctattttgggaccaacaacaaatattggcattattatggccaataaaaaagccataattaatgtacgaggaggcgaagaaatgaattggccgagcatttttattattaaaatgctaaaaaaagatttttaccgattagaggtaataggagaataatttgaacatgttttgggcggtttttttttatcagcccacctctaaaataaatccaaattttgtatcattcctcaatttgtaaaaaatatgaattgaaggcttcacattactaaaataaaaatttcagaagccattgaataaatattaataatatttgtcaaatatttttaattgacttcccatgatgataatgatgatgatgaagattaagatgcctagttactatattatgccaattcatatgctattctgcgaaaatttctgcaataatccatcgttataatttggattgaattgattatggatatgtttaacgatgaaaaaaattatagaataaacatttttatattgaaatcncaggttagtaacaatggttcgaatatgattaaaaacggaagtatttcaaaaatccctcaaaatcaatttgtccttgttctgaaaacccatttttaaaaactcaaaaaactcatttttttagtgggtgagaaaatgttttttatatttttaaagattttatacttacttcatttaagaaaaaaaattttattttattttaaaatgagaatatcaaaattgccaaaattaatatggcaatttggatgaagtaaaaaatatttttagcttcaaactaaggttaaaccagggctcccaactctgctgatttatcagaattttgctgatttcagggggtcaaagctgatttttttgtcgagaatgatgattttttgacaattttctgttgga

SEQ ID NO: 37269 - DNA, 1145 bp, Heterodera glycines
tataaaaaatccccaaatatgaactaaaatatgtaaataaaaattttttagatggtcattttttggaaaaaaaattcctcgtaaagggtgaaataggcaaaaattaacataaaaatgatctaaataagcttagaatcacattatagcatttcaagaattaatttttgatattcattttttgagagaaaaatttcgatttttagggatacattgtaaaaatttttttaaatttttcacaaaaaatttctataaattctcaaaaatcctcaaaatatggaaaaaaaatgacaatatataggagaaattgcgaaatatgtactaagaagtctcaaatatgtacatatgtaatatgtagaaaaatcccaaaatatgtaaataaaaatcccaacatttgttcatgtttttcctactaattaggctatggagaatccaggaaaaaaatatgtatttacataaaaaaactatccctaatgatcaaacaattaaggaaaaactttttaaaaagcctgtactattttgtcgtttctctttttctttgttatttctctcactctggaatactatctcttcatttttttaatagaaaaaacaacatttacttcgctctatagaccttttttttcgccttacagattatcttcaaattttccaaagcaatagagaaaaaaatcctacataacgtaatacagccattttatgttttatatattattccatgagtttaaacctaaaaaggtatttctttttctctcatttttacgtactatttaaatctctaacattgaaattgcaaacaaatgctaacaattttgatttttcttttcaaaagctttttttaaatacaaatttgttctgtttaattgggaatgaagcgagttcatacactttttaaaaaaaattcattttttatttaaattttcctcaatttctgtttaatgacttttatttgtctcgttcgaatgcatcatttcatttgccacttaatttgctaaaaatcattaattcttcactctttttttcaaataaatatttttccgactttctatgaaaatatgtgcctcggcatttatgaaatttttaaaacccgcaaatttgattgggaattttttgccacgatacgaaaatttattttcttccctaaatgg

SEQ ID NO: 37270 - DNA, 737 bp, Heterodera glycines
aaacaaaattaatgagtacatttaagagcttacttttttccaagtgcgaaattgaaaagtcttataattgaggcgcgcaccccattagagacgacatcgatttgttctcctcgataaaggtacctttaacaaaaacattattttccactgttttgcttttgctgcttaccgaattttttcatcgaccgggcactgctccacgagaatgttcccggcgtgcagatcccggtgctcgaattcgagaacgtcttctgcgatcgctagggacaaggcgacttgatggaaaatggagtaacattcgcggccattttttatctatgaaaaaacttcattttagtttttttcttttcttttcttgaaacctaaccgtatacttctccagatcttttcccccataggaaaggccgatgattgcgaaatggagatcttcatgggcgtaaatgtctggccggtcgttctccaccaattcaggctttgccttcttaaagtcatcccatgctttcagcaatttggacggaagacatccttaacggaaaaatgagcttagcacggtttgacaaactttcttttaaaaacatttgcttttagatgtatctccattaagaaaataaaacacccataagcccaaattagttgttaactgcactccattaaacatacctttgacgaccttgctcatgcgcaattgggtgaaagatggcgtgacaaagtcattgccggcctcggataactttgaa

SEQ ID NO: 37271 - DNA, 1308 bp, Heterodera glycines
accttaaaatttcgaattttggtacatttttgttcagcttgttattgttgagcgaattaaatttttaattggttctccttatggtaatttggcgaattaccaatcattttgttcttgcaaatttgtaaaacaaaattgtatatattaaaggacaaaacaaatccgtgttttgataatgagtatcagaagcgattcagttgaattaacattaaattatagtaaagatgcaaaaaatgaatttaattgtctatttaaaatttttaatttttctgaattaaattattaccatttttgtccaacaagtgttcaattaaagtgcagaattctttcttgaacacgcggcgatattcagtgcttaaataaagccactttccatgaaatggcgacctttgaatgtgatgaataacagttatatttaaacctcattaacaaaaaaaaaccgaatttttaattgctaaaaatcctaaaaataattgccataaaatgacattagtgaattgatttttaccgattaaattcttgaaactgatacaattatgaaattctaaaataataatttttagcaacaaaagttataaagattattaaaatggaaaatcagcgaaaaacaattaccccaaacgggagctaaagcatatacagcaattgatacatggccaaattgatcaaatagctagctgtcagtgctaattggtaaaataatgataattgaccgtaaccggcgtgtgttcgtctgttgggtactgtaattaaatgtttgaaatccaaattatatggtaaaatgccaaaattaccgtaatttttgcatcggatgagcataaaaatttcatataacagcaagtgctgatttaaaaatgcgattttgaaataatttttgggcgtttctgacaaccaaatttgttaccattcaaaaagcttctggagtttctaacttattaattatttaattttagaaatatattagaaaagaaaaaaattaactgaaaagatcgcttaaaattaatggttcatgccggtctcgatttatttatttttattaaataatcattctgttcatcattattgtcttgtctgatatgatgagttcttgcaatattgttcttcttcaaatccatcagttccaattttaaataatttttcgtcaataaaattttcttaatttgaaattttaattgtttccagtttttttagaaattttttttgtcctcaatactttttattttcttttaattttggcttaatttcgtataaatttattttcttcactctgtccatttgcaattttaaataaatgtccgattgggttaa

SEQ ID NO: 37272 - DNA, 926 bp, Heterodera glycines
tgacccctcatcctaatccttatcgccttctcttcctctattgttcaccatataatccatcaacatctcgcatataatcatcaaccaattttttgaacatttttatcatcatcatcaccaataaacattttgtcggaaaagtgttgaaagggtcagagggcaaaaaaaaaagggggggggggaaattcgctcgggaacgaagtgaccaaaggggagccaaagccccgagaatcgaagcgggggacaagcccccgcagagcagcacacggacccaacggcagccgcagcagtttcagaaattgagtgaattgggcccgagggacgggagagaaactcctgtgcacagaccccactagccgtcagcgctggccaagtttctttgccacaaagataataattccaaacatctatcattaaattatataaaatatagaataattgaattggaaggaatccataagagtatgagagtgaaaaatcaaataattaaaatttaatctcttgccattcttattagaaaaattatgacaaataaaaatttttttttttatctcaatatctcattgcttcatttttatattagttaaaagatcaggaaaggtcattaatctgtcgctaaataaaaaaggtcaaaagaaacaaaaaattaaactttaaaaaagtattgtatttaaatgtgtcaaagttgtggaatcattattctgtattttgattttttacaattgttctttattattttacttaattgatactttaaattcactttttaatttttccaagcaaattgtaatggagaacgaaatgatttataaacataaaactctattatttagaacttattgtataatttaaagaatctcggtatttttaaattaaaaaatatactttaattatatgaaaaaatttcattttcattcgcatgaaaa

SEQ ID NO: 37273 - DNA, 651 bp, Heterodera glycines
  misc_feature (644)..(644): n is a, c, g, or t
agctattcccgaagggattcggtctccccataaatctcgggcgcatcggttcagggggactgccccgaaaacccaaaaaaaaattttttggataaaaattatttaaatgaactgactagataatatttaaaataggttatttctcttcctttcagtatccctgcaaagtttggtgcgcttctgatcagtttctgaaaaaaaagttaagcctaaactttttggcctgtttaaaaaggaattaaaaatttttaaaaattttattcatctccctttttgatagaaaaagcatcagagtgcctaaactaacatgtaaataaaatttggtgcgtttcagaaccctttctgaaaaaatatttaagaattaattttgcaaaaaataaataaaaacgaaagactcagattttcgaaaatttttttgagccagctagctcggcgctcatttcagtgtaagttagtcctttaccggggagtatccctgcaaagtttgttacgcttctgctcaattagcaaaaaatatgagtgatcgaattttcactaaaaaagttaagcctacattttttggcatatttaaaaagcaattaaaaaatttttaaaatttaataattttcctgcaccgaaggtactcactcggcctcttcgcggcnctcgtgg

SEQ ID NO: 37274 - DNA, 1475 bp, Heterodera glycines
aaataataaaatatgtaagaatttgctatttgacatttgatttggttatgttttttgtcaaattgcaacgagtgggaattgaataatctaaatcctttatctatttattattttatagcttggatttcgaaattctcatatttaataaggtaaatattatacatttctatttatttctccaaaaaaaaaattgcattgctttcgaattttattatttttagaattatatctttagggattaactggctttttcaagaatttttgaataactatacaatcgataaacagtcattatagttatatgttctaattgcaatattttctatacactgacggaataaaattcacaatttaattttcaattaacttttatattgaataacaaatattcagaaaatgagacaaaaaataaaattataaaaaattaattaaaaataatttaatattttacatacttttttcgtcaaaatattaaaatatggtaatataagataattatcattgaaaatatatccacgaaaataaatcctgttcaataataaataaaaaatgtaattaaaaagacctaataaaaaataatattctaattttttcaatcaattataccaaataaaactatttacaaaattaattagttcaaaagaaactcattatttaataaatttattttttttataacttatattcacaaataattttttgtttttcaaaagctattttagaatgaataataatagacaatttaaataaaatttaaagatgaattaataatgaaaatacgcactgtcataataaattatttgtttaatttattttctagaaaggtcattttttctctattcatagccattttcgatgatctaattaaccgacgattttatcattcgaatcaaattaaattgcttctgagatgataaggattatcatataatttcagtttatgaataaaccctcaattattggtatgaacgatactttcctaacatgcacgcgttttgcgctcgagctattcatcatcgggcttgtcaatctaaagcgaaacaacaaagatggtgttttgaacgaataaagggcataggttattttgaagaagtgtcaaagaacatgcagcaataagcctgcaaaatctaataagtggaaaatacctgagtatagaatttattttcagaaagtgtcaacagacttttggaaaaatatatttgcaatttatcaacaattttgagaagtgagttagaaatgataaacttcacgattcaaaccagttttcggtgctctaattaaccgcgataaaaacatccgaatcaattaaatagcttctgagataataaggtttatcataaaatttcatttaaaaataaaccctcaattattggtatgaacgatactttccaaacatgcacgcgttttgcgctcgagctatttatcatcgggcttgtcaatccaaagcgaaacaacaaagatgctgttttgaacga

SEQ ID NO: 37275 - DNA, 985 bp, Heterodera glycines
tcacttcccctcaccaccgaatagcatcaatcagcagcacacgcccccccccccccccatcccattcttccgtgtgtgtgtggtgttccgtatgcttaatcggatcataaacggcttttcaccgccgcttttacttttccttcccggttgccttcaaaaaattactctgatcacttcttattcggtgaattatctactcgtattcgtgcagagttatacaaaagaccaatcagcagtaattttttactctctattcataaagaccggaataggaccagcgggagattcagtcaggattttcctgtcttctggtcctgtgatccgtgtatttgtttttaaatccatccggatttttggaggagtccggaaactagaaggattttactccctcctcctttattgctataaaaaactgaaacaccaattaatggtccttttgccaatcaattagcatttaaacttttccttggccacacttttcttaattggtccagtcttcattttgagtaactttttttaacacatatatccgggagttattgctttaattttgtcgcaggacctttagcttattataatttatgagcatttaagaaaaaatccatggtccactaactcatggatggttttagttttatataaagtgctgaagaatcccacaaatttcagtggaactgatcaaaatgccatttgattaggcattatgccaatcagtcgaactaatttcactcactaaaaagaaattgaatgttgatcagttggtctgctgatcatctgctgatcagttcctgggtgtgtgttctttcttcactggaccgatagaatccggagcccacccctcactctccccccccccccttttttgggccgaggcgtgccatatgcttaaaaacaaaaacaaacaataacaacaataaattgcttgttgtttttatgcttttccttacactgttttttacgattttgtcaccccttccccctctct

SEQ ID NO: 37276 - DNA, 692 bp, Heterodera glycines
ataaaaatgcatattaataaaattggcacttttgatgtctttgcacaccgaaaaattccaatatggccttcccttttgttatgaattttttttttttgcacgtcgtgaaatcttgctcagtttcgaggtcgctaatatacgaatctcacatccatttcactaatccaaatcccaacaaaagggtccctccttggatttttcggggtgcctaaagaacaaaattgcccaaaactttatcatgccacaatcacaatttatttcaaatttggacaagtacgttagtttccattaggcgttagcgtaaaataaagattaggtttgtgttcagtgacgaaaattaaaaatataaagaacataaaagttgacaagaagggtgggtgagaggcgaggacgtacctcgcagacacacacttctggttgggttccccgcccatcacaggcaagcaatcaattgttagtcgatgattattgtactacataactcaggggtcatccacgggtcaacactgcccaacaaatgtcatcactttttgttaatgtttgtacatttactaatgtttcagaatactaattatgaaaattaaaattgcactgcccccagaaaatcttttagaagtggtaaattcacttcactttgacatttgttggaccaaaattcgggtttcctttgcctttgattattttgtattgga

SEQ ID NO: 37277 - DNA, 746 bp, Heterodera glycines
agtgttccatgcgcattggaaatggatctcgggaatttggcgtcgaatattgaagacttcaaagcggtgattttcaataatttatttggctttttacattcttttgggtttcgtttaaaaattttatgcccaaattggtccatctcaaccgtaaaagttctctcatctttttgttttttttgtcctcctcacaactgtaaaattgtcattcatttcgtttttttcccacattttaggcttttgccaatgcttcttcctccgtcaatttcattgtcatcattcggtttattccttcatccgttgctttcttcgttcttgtgccttttgatctgaccaacgaattgactcgggagcaattgacactgaaaagaattgacaatagcgacgacgactgtctgctgctgttggtccgttgtccaattgcgcgagatgaaagcaaatgggcaaaatgggaagaagaagcgattggatgggaaattcatgatcagtggaacagaattgacattcacattttttatgaggaacaaatcggtgacgggtcagtgaatgcttaagcaaacagttaaaagtcattgcgtttgtgtttttaggcttctcggcgtaaatcccggcccaagtgatcagcagaagaagtgaatgaatcaattgctgagaagtgatcgaccaatttgaattatggaattattgacgtgctcatagaaattgttattttttagcatggaattgatcaatgatcatcgtatatt

SEQ ID NO: 37278 - DNA, 768 bp, Heterodera glycines
taattgccgaaaaaattcgagaccaatttccgaatgttgaccgactaattgcaaaacgaaagccgtctttgtcaaagcgccttaccgagtcaaaaaatttggaaatgtatctcatatgcaatttcaaccaataaatttgaagaaattttgcactcaattttgaaaaatttatgtccatattttgacatttttgccatttatgtccatatttcgcgatttttgccattttatgtccatattttgcgatttttggtccatattttatggccatatttcgcgattttatatccatatttttggactccctactaattatatttgaggcatggccaaatctcactaccgtatttgctctaattatccccaaatctccattaatcccccaatatccaattatcccccagtctaggaggggtttgaaaaataatcccaattggaaatgaacttatcgcaccaattgaaaatggatttgatgctctcttttttctaagaaatgctttttgttgattcttacatttatttaattttcttttttgtgagagttttttggtgccaatgtcaatccgcaaaacattctcagttttcccgaatattaattaatttttttgcaatggaattaactctggctaaagcagacgtaattttgtctaattttgtggcttaaaattaaattttttaatttttttttgttttattgaaatccccaaatgtcggggttgcaaaatgtccgtgggttttcttaagtgtcttttgctcaaatgtcgttcg

SEQ ID NO: 37279 - DNA, 176 bp, Heterodera glycines
ccagtggaaggtctgcagcggtgtcggccccggcacgaagacgctgacctgcagggcctgctgattgccggtgggcagggccagcggatcgctcagccgttcctggcccgggccgatcagcacggcgggctggccgtcgaagtggagcggctgtggtgtcgcgcccggtcgtgcgg

SEQ ID NO: 37280 - DNA, 1014 bp, Heterodera glycines
ctatagtctgtactttaattctgcgttggatttttgctcctcataattgtttgagtaccccaaacggacacttgaataaatcgatttttttatttcataaatattttttcagaaagtgctctaaagcgcaccaaattttatttacaagtcaattttagcactctgatgctttagtatcaaaaaggaagatggagaaaaaattttttaaaaatttttccttatattttggttatatcgttttgcttttggtggggtgcttggaacagtggaatcatgcgcacccgtccgatctggcaagttaagcaacgattgctgactagccaaaaggttcggtgccgtgatgaaacgaaccagcactgcttaccccgcggcacccggcacggtcccccgaaggaatggatttaattaaattctctccttcggggatttttttccattaggtcgtctgttagcgtttgattgttctagtcaatttttcgtgaaatatttgtcgtgctctgaagggcgggagggcggggccgaagggcctcgcggggggggccgaaggttgaatgagagagttgagtgaaatagaacatggaaaagaatggaagatattctttcttactattaatgtatgcatagattaatatgaccatgaataatgggactaataagggtatgggtatactttctttgaatatatcaaaataatgtattaccttataaataatagagagaaaaatatagaaaatatgaaagttataggtaccgaaatgtaatataatttgacaagtagaatgtattagaaaatatatagcaattgaaaagactattaaaagagagaaagaaataaaatgtcaaatataaggcaggaaaataaaatgtatatgaaaggattttttgtgtatgcaatgcataattttttgtcagtatagagtaaataaatatgcaatttgcatattttttgcaggcctgtttatgaatttttaacaaaaaaaaaatataataaaaaaattttgtggggtcagggtc

SEQ ID NO: 37281 - DNA, 1247 bp, Heterodera glycines
  misc_feature (1203)..(1203): n is a, c, g, or t
attgtgaccaagcatatctttcctcgtatttctgggatttttttcagaatgtggtcatagaataggtgggttgaattatttgtattttttatgagtattatgtaaggatattttcgactaaacataaccaattccgagtttcatgaggcatcaacttcattcttttcttgtcctgcccaattgtctcaaatgtatacctaaaaatgcgctaaaaatgatcaaacccgtttttagccgaatatcctgtcaatatttccctattagaaacgatactgtgaattctttcgcctctttaattcattcgtgctttgcttcggattagtctaaaaatttctggacgccaattttacatattagccattttttattttatttgtgaccgcaaatttttacatactagccattttttattttattgtgaccaagcatatctttcctcgtatttctgggatttttttcagaatgtggtcatagaataggtgggttgaattatttgtattttttatgagtattatgtaaggatattttcgactaaacataaccaattccgagtttcatgaggcatcaacttcattcttttcttgtcctgcccaattgtctcaaatgtatacctaaaaatgcgctaaaaatgatcaaacccgtttttagtcgtatatcctgtcaatatttccctattagaaacgatactgtgaattctttcgcctctttaattcattcgtgctttgcttcggattagtctaaaaatttcaagacgccaattttacatattagccatttttttttatttatgaccgcaaatttttacatactagccattttttattttattgtgaccaagcatatctttcctcgtatttgtcgcgaccacgcgaaatagaaaattttatttaaaaaataaaatcattaaaaacaaaaaacatttaaattaattttaaattaaacagataaaaattaattaattaaatgtgaatggaatgaaggaataaatgaaggaaaattattagtcatttttagtcacaatttttccattagaaaaattgtcaaatgttaaactttaattatgaataattggaacgttaaaagaaataacagattttaaacaaatgttaaaatgggacaaattgtgaatgatattaaagaaattgtaaaatgttagaaaattggtaaagggctaagtggcacaaactggaaaatgagaaaggntagaaaaattggcaatggtagggacagaaatttggacatgccaa

SEQ ID NO: 37282 - DNA, 1144 bp, Heterodera glycines
  misc_feature (1111)..(1111): n is a, c, g, or t
tttatttaaacttaattttagcactctgatgctttccccactaggaggaagatggagaaaaaattttttaaaaaatttttctttatattttggttatatcgttttgcttttggtggggtgcttggaacagtggaatcatgcgcacccgtccgatctggcaagttaagcaacgattgctgactagccaaaaggttcggtgccgtgatgaaacgaaccagcactgcttaccccgcggcacccggcacggtcccccgaaggaatggatttaattaaattctctccttcggggatttttttccattaggtcgtccgttagcgttcgattgctctagtcaatttttaaaaatttttgttgaaatatttgtcgtgctctgaagggcggggggggccgcctactcaaaccgcaacttttgcctgttgttcttcaacgtcttacgtttccgctgtccaaatggtaccaattcgcgtttcgtttagcgcttcgactcaaaaaaccgcacaaattgaggacagcactcaaataagaactgtagatcgctctcaggtcataaacccaatcaccacatctaatttggacattctgaagtacgtttgtttttcgttgtttcagttaagctttggcagtcgttccgctccacgacacttcgaccttcaatcattggtttttctccgacgcaaaatttgtctcagtgcggatgccgaacttggcaaactttttcgagagcattatttgatcggtttttacgatgtccatcacgcgctcgtccagtcagggtccaatgtgtttctgatacgtactgagccaattctccacgaattcttttatcaagtaaaaaataatctctatcgaattataattcggtgttcttcttcacagttggtcatcttttccttcggtaacatcggttcctacgcgttaaaattaagttcgtctgactgttgcgacgacactgctgggggttcccttcccatccgcgaactgctcgccctttacttgaccgagcagcgcgacgaaaccagtgaaattgacgaaaccgaagagcaaataaaggcgtcgtcaaaagtactgatcgagcacaaggatttgctgtgggacttcttagggagtcanaattgttgcatatccttcagaagaagacaaagg

SEQ ID NO: 37283 - DNA, 122 bp, Heterodera glycines
tgctgcgattgttgctggtgctgcgactgcggcgacttgtcgcgcagcgactgtcgcgcgagtggcgaagtgccgtgccgctgcgatgacgatgcgttgttgttcactgacaacaatcgccg

SEQ ID NO: 37284 - DNA, 736 bp, Heterodera glycines
atttggcggcggatgggcaaattgcggtacggcgtattcacgttgaatttgtcgaagatgaattccctgaagaaacacccagaaactgagaaaaagcaaccacaatttgatccaaattgatgtcacatttcgcggtggatggtgaatttgcggcatgtctctcagcggcaacggttgaggcatcggttggacacgaattacctgaaaaaatacattcggaatcttgaaaaaaaagtaacaaaagcgagccaaaattaccggcacatttggtggtgggttgacaaatagcggcacgtctctcagtggtatcggttgttgaactggttggacacgaacggcctgaaaaaaggactcgggaaattgagaaaaaacaaccaaaagcgagcccaaattaccggaaaatttagtggccgatgtacaatttgcggcaaaactctcagcggcattggttgttgcccatcatgaattggtcccacacgaatttcctaaaaaatacactcgggattttgaaaaaaactgacaaaaagcaagaccaaaattaccagcacatttggtggagggtggtcaatttgcggcgggatcggcggaggcggcaagtgaatttcgtcatcttccgattcgtacccatcgtcgccggggaacatctgccgccctaaaatggaaaaaatcagacaagatatttgtggaaaaccaaaaaattttcatcctgtggacgatttcctgcaaacaaaatatt

SEQ ID NO: 37285 - DNA, 1073 bp, Heterodera glycines
cacgaggccgcgaagaggccgagtgagtaccttcggtgcaggaaaattattaaattttaaaaattttttaattgctttttaaatatgccaaaaaatgtaggcttaacttttttagtgaaaattcgatcactcatattttttgctaattgagcagaagcgtaccaaactttgcagggatactccccggtaaaggactaacttacactgaaatgagcgccgagctagctggctcaaaaaaattttcgaaaatctgagtctttcgtttttatttattttttgcaaaattaattcttaaatattttttcagaaagggttctgaaacgcaccaaattttatttacatgttagtttaggcactctgatgctttttctatcaaaaagggagatgaataaaatttttaaaaatttttaattcctttttaaacaggccaaaaagtttaggcttaactttttagtgaaaattcgatcactcatattttttgctaattgagcagaagcgtaccaaactttgcagggatactccccggtaaaggactaacttacactgaaatgagcgccgagctagctggctcaaaaaaattttcgaaaatctgagtctttcgtttttatttattttttgcaaaattaattcttaaatattttttcagaaagggttctgaaacgcaccaaattttatttacatgttagtttaggcactctgatgctttttctatcaaaaagggagatgaataaaatttttaaaaatttttaattcctttttaaacaggccaaaaagtttaggcttaacttttttttcagaaactgatcagaagcgcaccaaactttgcagggatactgaaaggaagagaaataacctattttaaatattatctagtcagttcatttaaataatttttatccaaaaaatttttttttgggttttcggggcagtccccctgaaccgatgcgcccagatttatggggagaccgaatccttcgggaatagcttccctatagtctgtactttaattctgcgttggatttttgctccccataattgtttgagtaccccaaacggacacttgaaaaaatcga

SEQ ID NO: 37286 - DNA, 1098 bp, Heterodera glycines
tttttttcagaaacttatcagaagcgccccaaactttgcagggatactgaaaggaacagaattaacctgttttatcacattagcttgtcatcagtttttataaaaaattttcaaaattctgagtctcctattattttatttttttttcaaaattttgaaggggcggagggggggcggaaacctcccccccaggcccgcgaagcggccgagtgagtacctcggtgcatgaaaattattaaggaagagagttcattatttgtttattttttgcataattaattcataaatattttttccagaaaatgctctgaaacgcaccaaattttatttacatgttagtttaggcactctgatgctttttctatcaaaaagggagatgaataaaatttttaaaaatttttaattcctttttaaacaggccaaaaagtttaggcttaacttttttttcagaaactgatcagaagcgcaccaaactttgcagggatactgaaaggaagagaaataacctattttaaatattatctagtcagttcatttaaataatttttatccaaaaaatttttttttgggttttcggggcagtccccctgaaccgatgcgcccagatttatggggagaccgaatccttcgggaatagcttccctatagtctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgatatgggggcagtccccccgaaccgatgcgcccaga

SEQ ID NO: 37287 - DNA, 1025 bp, Heterodera glycines
  misc_feature (94)..(96): n is a, c, g, or t
  misc_feature (168)..(168): n is a, c, g, or t
cagtttttcggtcgtttttcgataaaagaacagaaaagtcggaaatgaaaaaagaccaataaattttcatgggattttatttatgtatgtatannntaagttaataagaaaggaccgggagcacagcaatcctcaccaatgactgagaatttttaataaaaaaatganttaataatattttttcaaatgaaaatgcgcggctggtaatttcgacactgagtattttcggcacagataaattttcgacactgaactatttcgaaaattttcattgtgcctggcaaattgatgccgacggcacccgctacaaaatgggccgagtgacagcgccccacaatcacccatctattctttgccaatacgatggaattgaatgttaatttgcatcgaaatttatcttatgattagtcgggatgggatttctagggctaaatccacgaaatggatgtttaaaggcgaaactagataagatcattgcaaaatcatgttaactgtacattaaagacacagaaaacgcaaaattaattttttttttttttggcattttagagtttggatatttttggttctttttcaaatggtttttttaaataattttttcggtacaaaagcgaaaaaagatcgattgtgccgatctctaatttggtgactcgtttagcatttttcgtgtccttgtcctgataatttgcaattctttcttgtctaaatattctttccacttcaataagggtggtaataatagtacggttgtgccatcatcagcttcactttcgccttccgattgaagtcgcacagattgcatgttttgcggcacatttcgaaggcgtacgtctcgcggtaataacggcacacataaaggaactcatcgcacttccagaattccaaccggtcaatgcacgtgtcgtcgtcgttggaaatcgctgcgggggacgaaggggcggagaaagtgaaatgcgggaaaaccccagcggaaagggcactgctttctttaagcagttaaatgagtaatttgagctaattgttgc

SEQ ID NO: 37288 - DNA, 1365 bp, Heterodera glycines
tcccatcacattttacgcgacccatcacattttacgcgtcccatcacattttacgcgtcccatcacattttacgcgtcccatcacattttacgcgccacatcagattttacgcgtcccatcacattttacgcgtcccatcacattttacgcgtcccatcacattttacgcgtcccatcacattttacgcgtcccatcacattttacgcgccacatcagattttacgcgtcccatcacattttacgcgtcccatcacattttacgcgccacatcagattttacgcgtcccatcacattttacgcgtcccatcacattttacgcgtcccatcacattttacgcgccacatcagattttacgcgtcccatcacattttacgcgtcccataacattttacgcgtcccatcacattttacgcgtcccatcacattttacgcgtcccatcacattttacgcgtcccatcacattttacgcgtcccatcacattttacgtatcccaataacagtttacgcgttccatgacgttttatgtgaaccctttgaagaaattttgcttcagattttcctgttgaaatcaactactgtcgaaaccaatcaaaaaaaaatggttgaacttgatgagattgattttaatgtttctttggcatttgaagagaggaacagagaaagtgaagagtttgcggagcaaatgcaaagtaatatttttaaaaataatatttattcgatcacaatctttataaatttaggcggaagcgacggtattgccgagggggatgtgcgcgttgtcagcgatgacactgtaagtcacctgaaatattaggggggggggggggggggggggtatatttagaggataaggagttgaaatggtggaattccaaaaaggtgaccaagaaaattgtaatcgaagattattggcgattatcagctcggtcattccgcaaacactgattcagtttatatttcgcgaagaatgagctgtaattttgcgaattagacaaaaatgatcataaagtaacaaatgagagaatttcacattctgctaattaggctttaaatataaactgtttaagtgttgcagacggatcaggttgataagcgccaataacctcagatttactattttcgcgaccccactttttgaattctgacattttcagctcattacgctctaaatataaacagcatcagtgttccggaaggatcgatttgaaatcgccaataacccccaaattacaatttcctactgtaaacttatacagattacatttggatataagaaaatcagctcggtcattccgcaaacactgattcagcttatatttcgcgaagagtgagctgtaattttgcgaattagacaaaaat

SEQ ID NO: 37289 - DNA, 734 bp, Heterodera glycines
tttcgctgatcaaataactcttcaatggcatttccctctgatcagacctccccgaagagattccctctgatcagatcactttccactaacattcccccctgatcaggtctcttaagattgtcgcaaaaaatgatagaaattcccaaaaagtgcataaaaaggtagcacggacctccccaaatatggcgaattttccttgtaaaatgggaacgctgaccgaaaaactttaacggcactttcctccgccccccccttggaattttttcgttggcccaaaacagtaaaagtgccagaaattctccagcgaaatgatcattctgataccgggcaaatttaggagactattacttttgtaaattgaccaaatcccagtaaattgtatacatttctatacaacactgacagcaaaatacaacaacaaataggtacaaatatttgtacatatgtacagtatatacaatggaataccgaaatgtgcatacgatcaaatattaaagcccatcggcacatttacaatgaatatttatttcatccacaatattttcatcttccgcttggattgcgcacacttccttctcatccctcctcattcgttggccatcagttcggcgagcagtgcgggcctaaaaattgttgaaaattaaaatttcaataaaaaaattcctcaaaaactctacccaatgtcactgtccttgatggtgaagcacagcaaattgtccaacatttggtttgcc

SEQ ID NO: 37290 - DNA, 470 bp, Heterodera glycines
  misc_feature (34)..(34): n is a, c, g, or t
gacgcataaaagtcgattgggacgcataaaaatnttgattcggacgcataaaagtcgattggacgcataaaagtcgattggacgcataaaaatttgattggacgcataaaagtcgattggacgcataaaagtcgattggacgcataaaagtcgattggacgcataaaaatttgattggacgcataaaagtcgattggacgcataaaagtcgattggacgcataaaagtcgattggacgcataaaagtcgattggacgcataaaagtcgattggacgcataaaaatttgattggacgcataaaagtcgattggacgcataaaagtcgattggacgcataaaagtcgattggacgcataaaagtcgattggacgcataaaaatttgattggacgcataaaaatttgattggacgcataaaagtcgattggacgcataaaaatttgattggacgcataaaagtcgattggacg

SEQ ID NO: 37291 - DNA, 1403 bp, Heterodera glycines
  misc_feature (1319)..(1319): n is a, c, g, or t
  misc_feature (1351)..(1351): n is a, c, g, or t
tttttgtcttctttttaggcatttttccatcgcttcttcgcctgttgctttcatcatttgcgttgtatttccgccgtcctctccgtttcctgtcgttgtgccatttgaactgaccaacgaattgactggggagcaattgacattggcataaaaagactggacatgtttttaagcttatccgttgtccaattgcaccagcaggcgatgaggaaaaatggaaaaaggagatgaaggaatttattgacaaaagaacatcaaatttaacatctccatcggagacaacggagtcgacgatgggtgaacaaatttaaaaattttaatattaattttttttctttgtttttgaagtctcctggatgctgcttccgccaatccgagtggtgatcactgatcagaaacagtaaaaaacgaattgattgattgtcagatacgattatgagaccgaaattgttggactttgtcatttaaatatagttgtacaatatttgctttttttgcacatgaatttataaaacgatataggattcggctaaactttgtatagtcaacccccagaaaaaatcgattagcacttgcaaatttaatgtttttcattttgttgcgaagtgaataggttttttaaatcattaaaatgaagagatagtacgtcaaactgagagaaataacagaaaaaaggaatcgacgagataatagtactaggcttttttctgcccagtgggtggacccatatttattgttcttgcttagaccttgtttgtttgtacatttgtagctttgcttttaattgactacaataaaaatgtgtgttgccatggcttattaatatggaacggatttttaaggggcgaaaaattccaaaataagggcgaaaaaatcgcaaagtaagggcgaaaataaggtcgaaacgccaaaataagggcaaaaacttattttaagggcgaacatctaaaataaggatttctaaggtcgaataagggcgttaaaccgcaaaattttcgaacaaaaaatatgtttttcgtgcttttctcgtcgagttaaagccgcagaaaaaataaggaaaaacttaaaaatccgttccccacttattaattgattaaaattttgtttttcattcaatagtttttccatttttatccacttaaaatatttatttgtaattaaaattggtttaagccattttcacccaaaatatggcttctcaaccgccaaatttggttgaagagacagaaaaacccattattgatgtaaccaaggcaaaggaatggaggagtgctgaagacggtgttgaaacagggcgaagacccgaaaattcatccggncaagggcgattgttgctacgtccattacgtgngcaccatcaaagaaagcgaaaaagtcagtgggcggcacaaagaggagcaatc

SEQ ID NO: 37292 - DNA, 1320 bp, Heterodera glycines
  misc_feature (56)..(57): n is a, c, g, or t
  misc_feature (133)..(133): n is a, c, g, or t
  misc_feature (170)..(170): n is a, c, g, or t
  misc_feature (180)..(180): n is a, c, g, or t
  misc_feature (202)..(204): n is a, c, g, or t
  misc_feature (240)..(240): n is a, c, g, or t
  misc_feature (294)..(294): n is a, c, g, or t
gggggactccccgaaacaaaaaatcgattttcaagtgtcgtttgggtactcaacanntatgggagcaaaatccaaagcagattaaagtacaggctatagggaagctattccgaaaggattcggcctccccatnaatctgggcgcatcggttcggggggactgcccgaaanccaaaaaaantcgattttttcaagtgtcgttnnngggtactcaaacaattatggggagcaaaaatccacngcagaattaaagtacaggctatagggaagctattccgaaaggattcggtctccncataatctggggcgcatcggttcggggggactgccccgaaaacaaaaaaatcgatttttcaagtgtcggttggggtactcaaacaattattaaaaatttttagatttttattcatctccctttttgatagtgaaagcatctgagtgcctaaaataacttgtaaataaaatttggtgcgtttcagagcagtttgtgaaaaaatatttatgaattaattttgctaaaaaaataaaatagtgaagctttaaaaattaataaaaaattttaaattcagaattactggagttagcatcatagcagtgcttttccttgtctttttgatgccctcgcaaaatctggttcgcttctgatcagtttataaaaaaaaagttaagcctaaaatttttcgcaaatttaaaaagcaattaaaaatttttagattttttattcatctccctttttgatagtgaaagcatcagagagccttatttaacttttaattaacatttggtgcgtttcagagcacgttctaaaaaatatttatgaattaattttgcaaaataataaataattaatgaaaaagtcagaatttcgaaaaattttaaaaacaacaagcgttggcattttttcaggttaagttagtcctttacaatggagaaggcctgcaaaatttggagagattatatcgattttagtgcgctaggttcgatgaaactttttaaaatataagcctaaaatctttcgcaaatttaaaaagcaattaaaaatttttagattttttattcatctccctttttgatagtgaaagcatcagagagccttatttaacttttaattaacatttggtgcgtttcagagcacgttctaaaaaatatttatgaattaattttgcaaaataataaataattaatgaaaaagtcagaatttcgaaaaattttaaaaacaacaagcgttggcattttttcaggttaagttagtcctttacaatggagaaggcctgcaaaatttggagagattatatcgattttagtgcgctaggttcgatga

SEQ ID NO: 37293 - DNA, 966 bp, Heterodera glycines
tcttcttttcactgttgtgcctcttctaatcactgtgcacctcttctaatcactgttgcacctcttctaatcactgttgcacctcttctaatcactcttgtacctcttctaatcactgttgtacctcttctaatcactgttgtatctcttctaatcactgttttacctttcttaatctctgttgtacctcttttaatcactgttgcacctcttctaatcactgttgcacctcttctaatcactgttgtacctcttctaattaccgttgtacctcttttagtcactgttgtacctcttctaatcttgaactcacgaccaacttctgcacaacgttatttaaatccgtgtgcaaacgtcctgaattttaaaagattttcaaaattcaaaataatatattaacatacccttgcacttgtctgacgggccatgaaactcacatcgccaaaatttcttaagtcaatctgcgctcaattggtcgaaaacatagagtgcgccgtcatgttctaacttaactttgtttctttttgttttaattttttgctgctggtccatattatataattgaaagaaccttaatttagtttataaactcacttaattataaaataaatattcgttagaaaaaagagtgaaacaaattttcgttaaataaatgtgagttatgaattctcttttatatgcaaccacgcgaaaacggccacgcgaaaactcccacgcgaaaacggccacgcgaaaacgtaccccacgcgaaaacggccacgcgaaaacggccacgcgaaaatggccacgcgaaaacggccacgcgaaaacgtaccccacgcgaaaacggccacgcgaaaacggccacgcgaaaatggccacgcgaaaatggccacgagaaaacggccacgcgaaaacggccacgcgaaaatctgcacggaaaatggccacgcgaaaatggccacgcgaaaacggcacgcgaaaatg

SEQ ID NO: 37294 - DNA, 1081 bp, Heterodera glycines
  misc_feature (10)..(11): n is a, c, g, or t
  misc_feature (20)..(21): n is a, c, g, or t
  misc_feature (34)..(34): n is a, c, g, or t
  misc_feature (1053)..(1053): n is a, c, g, or t
ctctagagtnncacgatttnnttttttgaaacanttcgctgggttcaaacgatttttcctgtatttcttctaaaattttgaaacatttttctgaaatttaaaaatattttgcaaggctaatccggcttaataattctattttagttttttattgcttttttctgtttaggaatgtgctcatgtgggtggtgtcggccgaggaggagttcagtccgctgaagaacccggactcggccgggcgcgactgtctgtccacctgcctggacagttttcgtggccctcatgcccagtggattcgccaggcgtgcactgacgcgcgtagtgccaaaaagaattgactgacgcctccgacaaaaattgcaaaaagaatttttattttcaaccattccaactgcttaattaattaattcccatttttgcactttctcaacattccaattgcctttttatagatttaattaaagatgttctataaatgcgttgtgcttacacagatgaaatcacacttccagggtttctgatcatgtcgctgacccacgaaatgtccaagtctcgaatttgagttttttattattcagatgggcctaaggttaggcaaggggtaatataaatggtatattcgtattcagcgaccccgaaaaccctaaaaatcctaaattagactcattttgtttttataaattttgaaaaattttggattaaatttaaaaaaattcttgtgctttttattgcataatttgacgaaaatttgatttctgattcgaacccggtcaggggtccgaaacagctcgaaacgcttctaagaatagctttattaggatctgaaaacacggttcctatttggcagtttcttaaacagtcttagccaattacagtcagaaaatcactaaatttatcctaaatgcatacacaaataaaagttgataccgcagcaaaaagaacaatattatatataattcaaatgggctcaaattcattctcaactccgcaattcaaattgatcggttcggtcacttctcagcaatcattcattcacttctcctgatcacttgngcccatcattgcgtgaaacgtctaaaaa

SEQ ID NO: 37295 - DNA, 936 bp, Heterodera glycines
  misc_feature (766)..(766): n is a, c, g, or t
  misc_feature (860)..(861): n is a, c, g, or t
  misc_feature (920)..(920): n is a, c, g, or t
ctaatattttaaaaattatttctcagtgacgaaacgatcgtgccaccaaataagcatggcattcattaaataggtacaaaaacactcgaacattttatgacattactgtagaaataaataaacagtcaaaaaatgttcatcagcagcggccgcatcggactttgtgaagccattcatccttcgtaccattgaaatttttacgacgatcgaatcgaaaaaatccgctgactcccgccgattgcaacggtcggttggcactgcgcggatgtgccgggctcagctggcccacaaatgatgggtctggtttttttgaaaaataatggcataaaaattaattaatttgttttgatcgagtttaaaaaccactccaccctcaatttgttgtcgatattccatgttgtatcgcacagttcccagcacactcatgtcctgcagatggcacgtcacgtttggcccagtgggcttgtaaacgcaaaaaatggtagacccaattggcacaatacagtcgggctcggcggcacaaagcaaagccatgcaaaaattattgttgtttatcaatcaacagattaatgcattttcacaatttaattggtaggggaagaatattaaaaattccgcggtttcccaccccataggaattttttttttggcaattttgtccaaaataattaattaatttaataaattgtatcaaagttttccaacggcaacatttatgtcgtatttcctataatagagcccccgggtgctctatttttcaatcccngctcaaaggaggggggctttattacagggggtctatattataagaatacggtatgtataattcgggattcgaaaaacgaaatatacacccctannaaatcggggtttttgtcagcccccccccccgaaagccaagggtctggctacgccattgngtataccgtatccatt

SEQ ID NO: 37296 - DNA, 821 bp, Heterodera glycines
  misc_feature (722)..(722): n is a, c, g, or t
tccaacacttcaagaggaaaatagcacttatgaccgttattctgatacgtagttatacatgggagttgagggaattgtagcttgatccggtgtcgtgagtagaggtgttgttctacagtaaccccgaggaaacctcggtaggcaaatagcctatttgaaccattaaatgcgatgtcatccggtgagataaactgattgtgcctaaggtgtctagttattagaacgtgtcttctcaaaaatttcaaattctttttcttccgctgtcgtagaatttcagatagctcgtgaggttcgcattcgttaaaattgcatagaatttcaacgagagaattcatttttgagcaccgataggcattttcatattcgttgcaattccttatataccattacctcaccactgtaggatgagtttttgccttttctctttaatttaaaaattctgagaactgaaatgcacatgatgaccactaccaaatctaaaattgacaaaaaatacacccaaggatttgaacttgaaactttaattttctcaaattctttgaacactactataaaaaattcactatccgtgtctgacacatatttgggaagtatttcgtttgagtcaaatcgatctttgtatattttcttctccttaatcagataaatttttccctcaattattaagaaatcggtgtatgatgatggcattgatccaatttctgtagtcataaattcagttncatttgtgtttgtccataaattctcgattgatctaatgtcaatctcgtctattcgatcgtctctgattacaaaagtcgacccatcatatgatcaaatct

SEQ ID NO: 37297 - DNA, 798 bp, Heterodera glycines
ttttgtgatccgtgaccaaaggggggtgacaggatttttgagtgaaaaaattttttcaccaaaaatctttcaaaaacatgtcattagggctattttatgacgctgatcacgaatacgtgatcagattttacttttaacatcgataagacctcagaatccctgtgtgattggggattctgaggcatcattttgaggggggagggggcaggttcggatccggacggtgtaacattatttttctgtacatttttacgttattttcaatgattttaattaatttaaaatattttgttgagttaataaataaaaaattatatttaatttttttttgataaataaattttataagtttaaattaattatttttttcctaaaaaacgggcgcgaagcgcccgtctggcccaaacaaatttaaaaaacgatcaaacgggcgcgaagcgcccgtctggccccaactaaatttgaaaaacgggcgtgaagcgcccgtctggccccaactaaatttaaaaaacggtcgcgaagcgcccgcccaagcccaacaaaatttgaaaaacggacctcttctgatcactgttgtacctcttctatttcctgttgtacctcttctaatcacagttgtacctcttctaatcaccgttgtacctcttgtaatcactgttgtacctcttttaataactgttgtacctcttttaatcactgttgtacctcttctatcatcggagcgccctttgaggccgcgaagcgatcgaattaaaccttagaatacaaaagggcgcggagcaccctttgaggccgcga

SEQ ID NO: 37298 - DNA, 191 bp, Heterodera glycines
ttagcatagacagaatttggatggggtggcaccaggccagtatccagaaacaatttcggggagggcatcccgaagagcttttttttttgctcttcaacccaaaaaatttttttttactagtgctattttcaaaatcttcagcgcggaagccaaaaaagacgcattattagcggatttgcgccgaaaaatca

SEQ ID NO: 37299 - DNA, 792 bp, Heterodera glycines
aatcactggggactcaacccaacagcatttcaatcacttgaactcaacccacagcattccaatcactggcactcaattctcctgcatttcaatcactgggactcaacccaacaaaattcaatcactgggactcaacccaccaacatttcaatcactgggactcaacccaacagcatttcaatcactgggactcaacccaccagcatttcaatcactgggactcaacccaacaacatttcaatcactgggactcaacccaccagcattccaatcactgggactcaacccaacagcattccaatcactgggactcaacccaacagcatttcaatcactggaactcaacccacagcattccaatcactggcactcaactctcctgcatttcaatcactgggactcaacccaccaaaattcaatcactgggactcaacccaccaacatttcaatcactgggactcaacccaacagcatttcaatcactgggactcaacccaccagcatttcaatcactgggactcaacccaccaacatttcaatcactgggactcaacccaacagcatttcaatcactggtactcagcccaccagcatttcaatcactgggactcaacccaacagcatttcaatcactgggactcaacccacagcattccaatcactggcactcaattctcctgcatttcaatcactgggactcaacccaccaacatttcaatcactgggactcaacccaacagcatttcaatcactgggactcaacccaccagcattccaatcactgggactcaa

SEQ ID NO: 37300 - DNA, 882 bp, Heterodera glycines
  misc_feature (22)..(22): n is a, c, g, or t
  misc_feature (34)..(34): n is a, c, g, or t
taattgcagtagcactacacanttgggatttcantttttgctcaaaagtaactaaattttcattttttcatataatgttgttccaaaaaattatgaccagatggatttgtgtgtaaaatgtttagtttggtggtgttttttgtgtaacgtcatacataacatcaatgagtttgccatttgaatttgctattggaattggaacagtattttcagtgcaaagtgtccaccctgcggcccatcagtgccggctccattctgatcattgttgcgggaagtgcactacttgaaaacagtgatgaccaacaagaacaaccgcaaaagtgccaggttgcgcagggcgccgtgctgttcgtgccgaaggattttggcgctttgctgtgtgacgcgagcgcggactttttggcgtttcgatcattcactccctctcccccgcattctcccaaataacctgtttttattattattgcaagtgtttcgcaacatttccattggtttttacccaattttgcacactttaatttattacattgaacacgtggtggcgccaaaacaattttttcgttgtaattttcgccgtataaattatgtaaaattattggagtaaaaaactattcttagtagtcctttgaattatgtatacacattgaaatattggggttcccctacgggttttttttgacacaaacgaaaacatatttgattatttcctagtcctcagttctgttttgtttgttgccttttaatctttgttgagtgtgtttcgattttgccccccccccccccaacgggtgaaagggcatttcatttctctgtgcgtgtgtgattagtgagttaacaaaaaaaaatatttttgttatcgttcgggtcttgatgcatatgcca

SEQ ID NO: 37301 - DNA, 1420 bp, Heterodera glycines
aatttatttttttatttggtctttctttttgtctgagtgtcgttagagaaattaaaaaaatttcaaattttatcattttaaattaatttttaatattttttacttcatttcttgcattaattttacgtcaaagtctccagcgattcacgtcaaaaagctgctcattcgacggccaacaacaatttggtcagaatttataaaatattcaattagcgtatccaaaattttcgtctatgtaaaaaaacaggtataaaattagttttttataatcctagaggtcataatcagcattaaatagtgattgtaattcataatttgaattttttttttaatgattaattattagagcccggaattttgaaagtaccgggacttttcgcaccataaaataattttttgaaaatttgaattttcgaatttttgttagaatacggatccggggttcgaatttagtcgaaatggatgtcagattcgtgatcagcgaccccgaaaacccccttgaaatttttttataagatttataaatattttattttttatggtctgtaaaatgcgtaagtgccgcgatttgttaacagatttatcaaaaaattaccaaattttgccagaaataacttttttctttaccaataaaatccaacatagttggtatcattcgaaagcttaaagtgtttagaagcttttcctaagctattgcttcgcgattagacaattactaaaaaaactaaacattaaaattgcaaaaagtcgaaatttttaagttttttcataactacagttcctctggttcccaaacccattatcacttgatggggcacttggcttgatgccgtcaacttttactctcacaatttcgaagccattaaagaagtgaatgaattgatttaagtaattaattttaaaaattcgcaggtcgtcgattcatttgaccctgaggaggcccagtgtattgccaaatctcagaaatgcttttcgatggcaacagtgctccttgacattgcctacattgaagcaaattttggatgtctccccggggcaatcactcgtttggagaagaaagggtttacaatacacgaatctgccaacaatctgtgtgaagtccgtgaagatgtcttttcgtttacgggagaaattggagcgaaaatccgtcggaaattcgatagcgttatcgcaaaaaacccgggatttgatacaatttgtgatatttgaaaaattctttctggtcaaaaaatcaatttcaatatgcctcccaatctgatttcactttacaaatacgcccccttgacttcatgtgatgttgaacgatcaaatttacaaatctattttgactgacaatcgttcatgtctatctcccgaacatcttgaaatgctacttatttgcaatgtgaatctcaataacgatttggattaatatttgttg

SEQ ID NO: 37302 - DNA, 1435 bp, Heterodera glycines
  misc_feature (36)..(36): n is a, c, g, or t
tagtaaaaaatattaatatattaaatatagagtatnaactagaaatggccgaagaaataattagctcgaatatttccaaaaaatgagtcaagagactgaaaatggaaacctccgcctaaaaaacgaaattttcaatctaaatatattcttaggtgggtcttttcttaatttattgtaatcacttaaaataattaatttttaaatttccatagagcattaattcattgttcgagagtctaagttgtcgggaatcgaggcaagattgaagtgtctcttttttatttttatgagttttattttcaatttttaaattttcctttcggtttcgtcaccatcgaaatttggttgaaatactgaaaaatttacaccgctaaaagcgatccattttagtataaaaattatttgataccaaaaatgatttgtagtttgagaccgaaactctcgagcagccctaatattaaaagcgactggacatttggaccaatggacatctggacggtggccattactatagtataatgaaatcatttagttggaaccagacgaattggacggtacgaccgtggaagactttttttcttttatcctttctctctatattccttatccttttctctttctcatccatctctctccgctctccatatcactttgttctttctctctctctatctatctcttctctctatccctctttcgctttctctatctatcattttgtctttttctctctattcctctctttcttccctcatttttgtttttttctttccttttttctcttcaacgctcttcctttctctctcgctctctctcgccttctctctccctctctctattttcttttttcctttttctctctccctccttctctttatttctcttttaggaaggaatcaacttataaaaacttgatctgaatttttttttcattgttaaaaacatttttaaaaataaaatttggcattcactgtcgtaatattgataattttttatatcatattttatggatcattttcagatgtttttcctcatccgtgcaacgaaattttcaattcaacaccgaaatttggtcctccttttcatgacaacaatggctcaacagcagaaagcgcatttcacgacttttatggaaagcgtagttttgggaataatatgtgcaaatgacagtgtcaaaacggcggagacacagagatgaaatatttttgtgtttaatttttttttctattttttttgacctaaatttatatatcgtggaatttgccataaatttcactaattttttttttgtgacacaatatgtttaaaaggaagaatacggagtttctgatagttggatttaaaaaacggcattttggacacccgaaggaaaactggacaccatattcctaaaataagccaggaattagggttgaaaaaataaatttgtgtaggg

SEQ ID NO: 37303 - DNA, 785 bp, Heterodera glycines
tagggctgtcaaaaatatggatataaaatcgcgaaatatggacataaaattacaaaaacatggacataaatttttctaaattgaggtgtaaattttcaaaatttcttcaaattaattaaattctggtaaaatacctttaaaatggctaaatatagtattaaaaatcattttagaaaaaaaaaaacatgaaagctaaaatttactaatttttaatgaaattcaatccgaaatgcgaaattttagcttttttgtttatttttgacataaatttatcaatttaaaaaatccaaatttatttatattttcgagaaaattttacgaaaaactttttttcggaaaattttccggttttttggtcaaaaaggcaaatttatctgttggggaccattctaatagttttttttttagaaaaattccaaaatatggacaaatatggaaatatggacataaatcgcgaaatatggtaaaatatggatatccatataaatgacagccctagtaattttaatgagaactgctgaaaaaagattaaaaaatgaaatattagccatagaataaatatatatatttttgatgcaaaatcttatttgaccaaggatgttcttatttttaaaaattctaacccaaccctgatttatgtcctataatagaaaattatctaaaataatattttaaggaaattttctcttgaaaatcataaaataatcgaaattctcaaaataataaaataaaaattttgttagcataatttctgatcacaaaaacaaatgatttccttcggtgca

SEQ ID NO: 37304 - DNA, 917 bp, Heterodera glycines
  misc_feature (867)..(867): n is a, c, g, or t
ggtcttatcttctctttctccgtctttatcttctgtcttctctctctctctccccttcctctcttctccgattccccaacattaattaagcttccgcttttcgacaccgtctcaaacggcaccgcactttcgtccgcacgggatttcgtgaccgatttaacttcagcgaaagcatccattaccacgagaattacctctccgtgctttacctgtccatcaaaatgctcttcctttccattgttttccttcagtcatgtttgatgaatcgctttctccaaacggatgattacggtagctgagcaatttgcggccatttaatgctaattacaataattaccgtcttccatttgtccttttggatttctatggttggggcgtcttcatggacttaatcggagggaagggtaaagccgcggagagaagcgcacacaaaagaaacgctgtttgttttcatttagcgtggagtgactcgggcaatttcccccgggtgactttttgtgacatcgacgtacgaattttgggcgcaatgcaacggcacactgtccagtgcattttggtgatcaacattttcacggaaaaggtctctcactgatcgtacggttggacaagggatggaagtgatcagcgaaggctgggccacggacagagtccgatcagtcgatcactgccactgatctgtcagtgaatgatccgatcagtcctttgaggtgtttctgctgttgtggctttggtactccctccttctgctgatcaccgttttcaatttgttcggttggctcttcgctttgctccctttttcggcccgcagagatttcattttgcgccatctccgaatggccaacgtaaaatttgaaaaggaagaggaanatgtggacgaagtaaagggacggaaagagtgaaaagaacgcaatttaaaa

SEQ ID NO: 37305 - DNA, 965 bp, Heterodera glycines
ctctgtccagtaaatgcctttttccccatttccaaggcttgtcacgcgtgtgcaggagcgcgagcgtgaaatccaactcggacttcccgccgggtcgctgcagaatttgccgcgtaatttaccaccaatttagttttaagcgtttccctttttgcagtttcaagctccgctttggcaaattcgggcctcggcggcactgaccaccagcagcaacagcagagttcagcttcgtcggcgttggtcagcgaattgctgggccaaaatttgatcggaaatcagcaaattgatggtggagctataaaaacaaaaccaaacaacggacgattataaatttggaagggctttttgttgtgtccccgggtttaagtgacgggtttggtcgggagaaatagggcaatgtacattatgcacaaaatatgaacatttgaatgctgcggatacaacacttttcccgtttcgaatttgtgggacaaaatgccaatatttcctttgtaatttttttttgttggcatttcagtgaatgcgcttttggcggcggccgctgccgaaaacccgcaacagatcgacctgaacgacgcggcggtgctcaatttgctcggcatggccaccagtgggtcggatttgttcagcaacggcggcggcacgggcaatgcattgggcggcggacaccacgagcagtcgcagcagcaacaacacgcgggcggactcgctcagcagacggcgggcggtggtcagtcgtcgtccgccgcagcggccgcggcggcgcttcagcaacagtacaaccaacgggtgggtgtactgtactcgtcgtaccgtaatggaaggaagcaaaaaaagaaatgaacagacgacacacattactctcgaaattaaaaataaaagacagttttttttgtaattttattcattgtttttaccaatgcttccacagtttaagtccagaaaattgtgagtggggggcaatt

SEQ ID NO: 37306 - DNA, 663 bp, Heterodera glycines
cacacttcataagaacgaccaacttatgaccgagcactttcactcggacgattggcggcgaaagggtcgaaaagaaaggcaaaagaacgaacgaatgaatgggcgaaacggcgccgaaattgggttaaaattgttaaaattgggctgctgtaattgccggggccgtcgtcattcatccggcggcgtaaggtgcgaaaaagcgaaagagcaacattcagcagaagcagcacagaagcagttgaaatgcgcaattcgttcatcgcgtcgttcgcgtcctcgcctcgggcggcgtttgtccccccccccgggtgcttgcattttgtcctttctttcggtttcttttgctcttttgccaccgcctttccctgcggcaccgccaaacccattaaagtcgcagtcaaccgaaacacaaaaacaaacattgccaaaccattttttccctttttttaaagctcagacaaatcaaaaaaggatcagagaatgaataaataaatggtccgtccgcaactgatcactctccgccaatcgttgatgttcattttctggccaattttgacattacaaaaagcgcaatcgatgcataaacgacggagacgagcaaaggatgggcacgcaaattgggggaaagcccggcggagttttcgtcgaaaacttttgagtgat

SEQ ID NO: 37307 - DNA, 984 bp, Heterodera glycines
  misc_feature (11)..(11): n is a, c, g, or t
tctattaattntctgcataaaaatcttttaaatgtgtgttttcgcgcttttttcgcaacaaatatagcatgaatttgcattttttacctccttttttgttgattcgttcttttgctttgttgtcgtcctttttctcttccgttgattttttttcaacttttttgccaattttttcattcgtttttcttttaactttttttgtaattttatcgggaaatattttggcactttgttctttgcttctctcctccgggtttttggcattttttcctttcaatctctcctctggttttttggcactttgttctttcattttttccttcgattctttggcactttgtcccttcattctctgctcctggtttttggcacttttttctttgattctctggtccaattctatggcactttgtcctttaattcgttcctccggttttttggcactttttgcttccattttttccttcgattctttcacctcctcctcctcctctttctcctcctcatttattttatagttcaattcctcctcatttagcagctccggtccatttgaatttttgaataaatttttcaatttatatttattttcttcactgaattttgaatcaaaaaagaaaatggatattttgttcagctcataagcggcatcgatcaaagacaaaagttgtttacgaatctgaaatttcggctttctcgtggaaaagggattttgcatccacggagggaagaaaacttaaaagaaaaattattaaaactaaaaaaaaatatgaaaattttatttttattttaattataaaccttcagcgtacaatctgaacgaatattcatacagaatatgtgcatattttcggtatttttggcattctttccgtccgttttcttcattaatttccttcacaattttggcacatttccaattctttctcattaaatgcaaaatgccaaggtacgtttcgtaaaagtaagagcaaaaactaaaat

SEQ ID NO: 37308 - DNA, 775 bp, Heterodera glycines
agagaaaaacggcgaggaaattaaatgacggcattatccccccaaggaatattatcagtagggattattgtgaattgaaacgacagacgaagagacggttagcagatggcatacattttttacagattggttaaaaaatatgtgaaagagaagagaagagaaagggatggaaggggagagagaaggaggggaagtgattcagacggagtgattgaggtgattgagcggagggggcaactgattgatggcgagagaaataaaggcattggatgaagaaaagacgaatacgaaaataaggggagactttgcataagtgccattttgagtgttcgcattggcaatgccttctttgccccccccccctcaatcccacgtcggattaatgttcttttttctcttaaacttttcccttccatcccttcaaatgccgctttttccctctcttttcaatacaattttctcgcctgtttatgtcgtgaggatgaacaatgaaaatgaaaatgatgaatgaatggcgcaattcaattaatccctttccctttcattttgtcttccatcgttggatttcccggccaattttcccgtcttttggttcctacctcgcccaatccaaaaactctttttttccttgtcccccccccacccctcttttccaggaaggggatttagggaattgtccttcacctattttcgtattaaagtaaataacgtaaaaacaaaaaccaatatcctgcagaataatatggaccgaaaaatttacccatttctaaagggg

SEQ ID NO: 37309 - DNA, 585 bp, Heterodera glycines
aagtacacattaagataaagaaaatcccattgtattgatgaacagaaagcgcccggggggtcaaagacagccaaaatcaattaccaaattagtgataaaactgtcagaatatgtgcagaagagcaacagtgataagaagaaaaagaaggagaagaagtacataatataaaacagtaaaaataaagacgaagaaaatttgggggaaagaaatgataaaatgataaaattgagcaatgaacagacagacgcacctaaaacagtgagaaggcattgggcatttgggctgtgcgagagtctcgactatcgacttgggaaatttcacaatgtttaagattcggtaaactttctccatttttaagactctcgaattgggaaactttctcgctttttaagactctcgaactgagaaactttcggtacttgtgggttatctgtgtacagattttcaaaaaaaaattttttgaaaataaacttgttttaggggttttcagggtcgggaaacccgattctgaaatccattttggccaattccgaaccccaaacccggataagaacaaaaaagtcaaaattcatttttcaaaaaat

SEQ ID NO: 37310 - DNA, 1001 bp, Heterodera glycines
cataatttgtgcttttgccgcattttatgccaaattcttcctaggatttttggaatgtttcttggttaacccaaactctttcataaatttttttttccatttttgtacattttaaactcattaacccgttcaacaaattcctacttcttctttttgtaatagtttttataatttcttttagttttcggcttaatccgaattctttttccatttatttttctcatttttaattaactttttctcataatttcaccttatcttcagcctttcttattgcgtgttttcgcttctctgaattaattattagtgtgttttttttgtattatttcgtggtttaattttatttcagcgatttcatttatcctttttaaaatttaattctttgccttatttgatttttgatcaattttctcttttttatttcatttaaattcaatactcagcccgcttcaccgaacattcaaattgttgaggaacagcagcgttcagtggccgaaattctttcaaaattccagcaacgtgattttgtgcatcccaatggcacggaaagaaaggacaaaaaggaggtacggttttctagggggttagatttcctgaaggtttaaaattttaaaaattttctaaggccccaccagtgctgcgcccgaccaatttaaaccgtggctgctccggtgcatccatttgggcaacttcaagtgtgcgaagtgagtttgtgatgcgttttaaaatttacagaattggcataagatcgaaaaaatttcttaaaaatttttactgattgattagagccctcgcagggtttttgcgggaatccttgtcctcatgttcctgcatttttaggtgaaaattgcatttgaattgcaggaggagtccaggctaaaacagtacaggattttcggtctttttctgtccagacccattttcaatctgttcattttccggcatttttttaaaattcagataaattattgtgttaaattggtgaactttccctacgtctg

SEQ ID NO: 37311 - DNA, 1398 bp, Heterodera glycines
cttcttctacttcttctttttctcgtgcttccagttgatccacctgccaacaactgtgacgtaggcagcagaaatggttagaagaaatgtgtgaattattttaatttatgggtctgtaggggcgggaaggtcaaagggaagcgccgccgggcacaccccgggcaatttgcacttttgacactctctccaattgccaatgcttcaattggcactctgccaacacatttcaatgccctactggtacacataggtataataaatggaataccttgcactattacattccattcattaattaataagctttgttcggacggagttgccctccccccctctgcctgccccaatttagcattttgcgtttgccatttcgtttattgccaattttaattggcaacaacactcgcacagagcacatccacacttgtgcatttgcactctctttgctgtgctgctgcgcttttcagttcagctttttttttctggcactttttttgctgcctttgccgatccttccgagaaaaacgaaacggaggaaatggcagcagcaaataatttgaatttgaattgataattaattaattaattggttggttgtcgacgagacaaacggaagggggaaaccaacgagaacgaattgctctctgcttttttggacaaaatgcgacagtgcaaacagaaagttgacgcggagtttgatggaacagccgggaaatgctaaagatggctgctatttcaatgctattcaaaaaaaaactttgaatttgatttgaagagaaaagtgcatgctaattaaaataaaatttaatattttaattatttaaatcttaaaatattgtttgaaaaaaggttttttagcaatttacaaaattttagaaaaagtaattttaaaagtcgtgatcacggttctgacattcgttttgataggctctattgcattttcggcgtccaatcagtagagaccggaaatttcaaatttgcggatcctgctgcgggactggaactcaaaattttttgcgggacgggatcccgcggtattaatcccgcaaatcccgcatttaaaatttgcgggatcccgtgcgggattgcgtgattttgaaaaatcgaaaaaatttcaattaaattcaaagaatttccaaaaatcaaaaaatgctgaaaaataaatttttaggggctggcgggatgcattaaaaggggctgatgggtcgactaagatttttcgattggatccgacggtaaaaagttgatcggaaatcaaattattaacggttcataaatttgactaaattttcggaagtgtcggaaatcggatttccggcgggggaaaacgtcggaaatcagaaaatttcaaggggggccggggagaataaaaaaatttctaaatatataataggctaa

SEQ ID NO: 37312 - DNA, 958 bp, Heterodera glycines
  misc_feature (32)..(32): n is a, c, g, or t
aaaacaaatataaatataaaaacattaatttntggtgaattattattagttttatttataatgctattatttattatttttgaattatatttaaaatttgcttcaaatcattctcctgtccatttgttaaattattatttatcttctgtctttcttgcattaatagttttaagtacaaattttagttttttaatcatgtcaagttctgttgatatcgagattattcgccctagcgatgagctgtaaattgttggtttgattgtcgctcaaattaatgttaatgtttcatactttttattttgaatcgcctctctccgcccgctacctcatcaaaaaagaatataaatttaattaaccagaaaaaaagaaatttcaaaattatttttttaaatcatttgataagaaataaaaacatttaaataaaattcaataattttattacatataaaatgattattttttatgtaaaaaacaatgcaaaatgattgaaaaataattagaaaatagtaaaaaaaagattaaattctatcaaaaattgcaaataattgagaatataaattaaataaaaaaataaaagtaaatttagtagctttttacaaaaattgataaattattaattattttctgtcttggaaaatacctaaatgaaaagaagcaattaaaaagagtgacaatataaaaaaaaagaaaaaataacatttctaccaaaaaattgcaaaatacttacaaaaatagctataaaattcataaatatgtaagaactgtggtgttcattagaatatttgaaaacaataatattatttaaaaaattagcattaatttgttaacataaattgctcgactaaaaatattatggcattaattaaacagaaatataattacaaataaattaattaatacaagaatcggcgctaaatatgaaatttaaaaatattttaatatcttttttaatcactca

SEQ ID NO: 37313 - DNA, 892 bp, Heterodera glycines
cgaaaggtttacaatgaattccttatcgttgccggccgacatccggtgcgaagctggtcccgcactttgccaagaccagtggactggtgagaggtaacgtaggatatcggagtcaaccaaaatgtggaccagtcctttgtggactttggtccgattacctgcccctccgggggattgtggttctcaataagctgattgaattcggcaatcaatgcttaatctctatctgcattcttaacgggatgtgtgagcggtcaatttctgcactcaatgtcctttatgcgaaattagacatgtgagcctggcttattgattcgcagaggaatcatgcactgattgattcgcaacggcatcactgtggcaaccaaggaagatacacactattattcacattttcaaatttttgataaatatttgatttaatgtggtttaatggttgtttttcctaaatattttgccacatgtacacatcattgcttcatcgttgttttcagatgccttcaaaacaagaagttaaaagaaagaaggaacaagagcggtactaacggcagatggagaaatctgtcagccgtggtcgctcacccgtcccagacggaagtgcagatgagaatggggtggcatcacacccgggcaccacaacgcctaatattagtgctttacaattaagcaccccggcttcttccattggaagtaaaagaaggggcagacccccaaaagccggagcggagccaattatgacttcgcaacacagtgtgtcatctgttgacacacaaataacattggccacccaaaatactgaaacgtcgccgtgcagcaaaaaagggaaagtcgccgaagctgaccgacccatgtttgctaatgaagcaattgcttctacgcctatttcgacgca

SEQ ID NO: 37314 - DNA, 964 bp, Heterodera glycines
tggctagttctacttagtgacatttaccttaataattatctattgaacctgagaaagaaggaacataatccacgagattaaccactaagccgcagggagcaattatggactcatttttaaaataaatcttattaattaaaaaaaatttccttaatcggggtccttctctgctcttttgccgaattccaaaacggggcgaaggagaagaatcagaaagaagacttttaaaatcacttaaagccacagcaatccaaatcaattaaatttaaacaacacaacaattaaaagcaccattaaaattaccacacaccatccgcatcaccaattttttaagtccgggcgaagagtgaaaaacataaaaatgaaaatcaaagacacaaaaaaaaaataaacaaaatgccaaattaattaaaacttttaaaagtcgaatgaggtcattatttaattatcacatcctcggcctgcaacgagcgatgtcctcagcgatcaaagtgacggcgattggaattcggcaaattcggcgtgcgaaaggggcggaaagggtggcgatcaacggcggtgcgcgagtacgggtgctgaacgaacggtcggctgttcgagcggcgaaagacgggcccgtcgcgtcggaatggaggcggttcggtgcggccgtgttgtcgatctgctgccgtccccgctccttcttttcccttctctccactctccggcttcttcttcgcaattcccaactcttggtcacccgggaattctttgacttgggttagaagccatgccttcaacatgttcagtcccttctctttcatcactccctctggcgagacatggtccgtgttgtaaccattgccgtagcgccaaatctcaagaagcgaacggccattcgtcgttgttgccacgaattggatgttcttcgtcttttggccaaaaaagtcgcgcaattttccgatcagtgtttcgtttcgaattg

SEQ ID NO: 37315 - DNA, 1423 bp, Heterodera glycines
  misc_feature (57)..(57): n is a, c, g, or t
  misc_feature (1415)..(1416): n is a, c, g, or t
ttaaaaaattttttaattgctttttaaatatgccaaaaaatgtaggcttaacttttntagtgaaaattcgatcactcatattttttgctaattgagcagaagcgtaccaaactttgcagggatactccccggtaaaggactaacttacactgaaatgagcgccgagctagctggctcaaaaaaattttcgaaaatctgagtctttcattatttatttatttttttacaaaattaattcataagtatttttacagaaactgctctgaaacgcaccaaattttatttacatgctagtttaggcactctgatgctttttctatcaaaaagggagatgaataaaatttttaaaaatttttaattcctttttaaacaggccaaaaagtttaggcttaacttttttttcagaaacttatcagaagcgcaccaaactttgcagggatactgaaaggaagagaaataacctattttaaatattatctagtcagttcatttaaataatttattcaataaaaaatttttttttgggttttcggggcagtccccctgaaccgatgttaggcttaactttttttcagaaactgatcagaagcgcagcaaactttgcagggatactgaaagaaagtgaaataacctattttaaatattatctagtcagttcatttaaataatttttattcaaaaaaatttttttttgggttttcggggcagtccccccgaaccgatgcgcccagatttatggggagaccgaatccttcgggaatagcttccctatagtctgtactttaattctgcgttggatttttgctccccataaatgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtctccccgaaccgatgcgcccagatttatggggagaccgaatccttccggaatagcttccctatagcctgtactttaattctgcgttggatttttgctccccataattgtttgagtaccccaaacggacactcacttgaaaaaatcgatttttttgttttcggggcagtccccccgaaccgatgcgcccagatttatggggagaccgaatccttcgggaatagcttccctatagtctgtactttaattctgcgttggatttttgctccccataaatgtttgagtaccccaaacggacacttgaaaaaatcgatttttttgttttcggggcagtccccccgaaccgatgcgcccagatttatggggagaccgaatccgannctctaga

SEQ ID NO: 37316 - DNA, 951 bp, Heterodera glycines
gcaatacgtagaacgggagtacaatcgcaattggagggaattcggtctgcaattgcgcatcttcaaattgtgggggaagaggtcaaacagatagacaaaaggcaaaaaaatgtaaaaaatcagtcgaaattaaactttacatttttagtatgcatgaaatcttcgcccgtcttcagtccattccatcggcgagaattaaactaaaggaactgagcaaagcgaacagtcagcacagccaatacgcaatagcaatggacaatatcaaacacatttgcaatttggctgacactatcgaaaaaacgcacgagtcggtcatttgttactaaatgaaacaaggatttaaaagtgattttcagctttatactcgacgggaaacttttacttgctcataaaaatgtgatggagttggagaatgccagggatgacttaatgtttgaagtgcacaaattgaactctgaacgcagagaatacgacaaaaatgcactgttttttcatctttttcataacaataactcgttttttatgtttagttgctcaaaacctatttttccgatgtggacaaacttatcgaagacttgggcaaacagatttggtacatttgttctcgagctttggaagcagttcagggcaatgacagcgctctgcaacagttggtctccgcgttgcgaataattgagcgtgaagaacggtagtttaagttagagacttattaaataccaatttttagcattgatgtttattatttggatcaaaagccgatgtccaacaatttcatgccaccaggacgaccaagaaaatggcgtcagcgtttattccaactgctgctgaagaatgtgcacgatcggatggaagggaaccaattgaaggacaaagcaatcaatcgccaatgattggcgaggtaaaacaatgaaaaatgagtcgaaaggcttaaattattgtaccattcctacc

SEQ ID NO: 37317 - DNA, 816 bp, Heterodera glycines
cattccaatcactgggcactcaacccaccaacatccctataaagtggcactcaacccaccaacatttcaatcactggggactcaacccaccaacatttcaatcactggcactcaacccaccaacatttcaatcactggcactcaacccaccaacatttcaatcactgggactcaacccaccaacatttcaatcactggcactcaacccaccaacatttcaatcactggcactcaacccaccaacatttcaatcactggcactcaacccaccaacatttcaatcactggcactcaacccaccaacatttcaatcactggcactcaacccaccaacatttcaatcactggcactcaacccaccaacatttcaatcactgggactcaacccaccaacatttcaatcactggcactcaacccaccaacatttcaatcactgggactcaacccaccaacatttcaatcactggcactcaacccaccaacatttcaatcactggcactcaacccaccaacatttcaatcactgggactcaacccaccaacatttcaatcactggcactcaactctcctgcatttcaatcactgggactcaacccaccaacatttcaatcactgggactcaacccaagagtattccaatcactggactcaacccaccaacatttcaatcactggcactcaacccaccaacatttcaatcactggcactcaacccaccaacatttcaatcactgggactcaacccaccaacatttcaatcactggcactcaacccaccaatatttcaatcactggactcaacccaccaacattt

SEQ ID NO: 37318 - DNA, 1120 bp, Heterodera glycines
  misc_feature (804)..(806): n is a, c, g, or t
  misc_feature (810)..(810): n is a, c, g, or t
  misc_feature (838)..(838): n is a, c, g, or t
  misc_feature (855)..(855): n is a, c, g, or t
  misc_feature (864)..(864): n is a, c, g, or t
  misc_feature (872)..(872): n is a, c, g, or t
  misc_feature (888)..(889): n is a, c, g, or t
  misc_feature (892)..(892): n is a, c, g, or t
  misc_feature (896)..(896): n is a, c, g, or t
  misc_feature (898)..(898): n is a, c, g, or t
  misc_feature (901)..(901): n is a, c, g, or t
  misc_feature (903)..(903): n is a, c, g, or t
  misc_feature (905)..(905): n is a, c, g, or t
  misc_feature (910)..(910): n is a, c, g, or t
  misc_feature (924)..(925): n is a, c, g, or t
  misc_feature (930)..(931): n is a, c, g, or t
  misc_feature (941)..(943): n is a, c, g, or t
  misc_feature (946)..(946): n is a, c, g, or t
  misc_feature (958)..(958): n is a, c, g, or t
  misc_feature (960)..(960): n is a, c, g, or t
  misc_feature (963)..(963): n is a, c, g, or t
  misc_feature (968)..(968): n is a, c, g, or t
  misc_feature (975)..(975): n is a, c, g, or t
  misc_feature (992)..(992): n is a, c, g, or t
  misc_feature (1000)..(1000): n is a, c, g, or t
  misc_feature (1002)..(1002): n is a, c, g, or t
  misc_feature (1016)..(1017): n is a, c, g, or t
  misc_feature (1030)..(1030): n is a, c, g, or t
  misc_feature (1043)..(1043): n is a, c, g, or t
  misc_feature (1075)..(1076): n is a, c, g, or t
  misc_feature (1081)..(1082): n is a, c, g, or t
  misc_feature (1090)..(1090): n is a, c, g, or t
  misc_feature (1092)..(1092): n is a, c, g, or t
  misc_feature (1094)..(1094): n is a, c, g, or t
  misc_feature (1099)..(1099): n is a, c, g, or t
  misc_feature (1107)..(1107): n is a, c, g, or t
  misc_feature (1110)..(1110): n is a, c, g, or t
ccccataaatctgggcgcatcgtttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaataaatcgattttttcaagtgtccgtttggggtactcaaacaattatggggagcaaaaatccaacgcagaattaaagtacaggctatagtgaagctattccggaaggattcggtctccccataaatctgggcgcatcggttcagggggactgccccgaaaacccaaaaaaaaattttttggataaaaattatttaaatgaactgactagataatatttaaaataggttatttctcttcctttcagtatccctgcaaagtttggtgcgcttctgatcagtttctgaaaaaaagttaagcctaaactttttggcctgtttaaaaaggaattaaaaatttttaaaaattttattcatctccctttttgatagaaaaagcatcagagtgccgaaactaacatgtaaataaaatttggtgcgtttcagaannntttntgaaaaaatatttaagaattaattttgnaaaaaataaataaaaangaaagaatnagattttngaaaatttttttgagnnagntagntnggngntnatttnagtgtaagttagtnntttannggggagtatnnntgnaaagtttgttangnttntggtnaattagnaaaaaatatgagtgatngaattttnantaaaaaagttaagnntaaattttttggnatatttaaaaagnaattaaaaaatttttaaaatttaataattttnntgganngaaggtantnantcggnctcttcgnggnctcgtggtgg

SEQ ID NO: 37319 - DNA, 1192 bp, Heterodera glycines
cgccaataaattttaaaggcgaattgcacaactttccaattgtaagcaaccaaatccggcaccgagaaatttatgaggattttggcccctaccgggagcacgaaaattttcgctccagccaaattcaaattcgccaacaacctgcgttagcgtggcaacaacaaaatgcaaacttcggctttttgccatgcgaacggcaacacaacgaattcgtcggacgacatctttttgaggatggacgtcaaatgatgcacccaacggagattccgaggcaaatgcatcaacagccaccaagagaagagcgtggatggcagcaacaaaacagtgttttgtaccgtccagtggcgcgacagcagcaaaattttccggtttacgaaaaccaaatgctgccaccccaaagccaaaatttagcggttttaagtagtctggagtacaatatggtccttgaaaggatcccagacctcaacggaaaggaagggacggacgaagttaagcgttttttcaaaaaattcgacgcttacaccgacagttggccggatgaaaaaagaattaagggaatagaaagcaaagtgtatggccgagctgaaagagcttttgaagcggcgaaagcagtcattccaataaggtatgaactgcttcggggtgaaatgatgcgacagttggaggaaacggactcaaaaaacttgaatgcttttgatgagctgatgttaggagtccgacgaaaacccaacgaatcgattgatgatttggcaggtcgaatttcggggttggtgaagagagcctaccctggtctttctttccaattgtcagacgaattctccatcaaatatttgatccgatcaattggtgacccaactttgtcacttaatttggaactcattcgaattatcaacaattttgagaagtgagttagaaatgataaacttcacgattcaaaccagttttcggtgctctatttaaccgcgataaaaacatccgaatcaattaaatagcttctgagataataaggtttatcataaaatttcatttaaaaataaaccctcaattattggtatgaacgatactttccaaacatgcacgcgttttgcgctcgagctatttatcatcgggcttgtcaatccaaagcgaaacaacaaagatgctgttttaaacgaataaagggcataggttatttgaagaagttcaaagaaca

SEQ ID NO: 37320 - DNA, 381 bp, Heterodera glycines
attctccctatattttccggtcattttgttgatgcaaatgtcttcaggaattctgtacgtttattatattccttttttctgacatttcgcacttttttttttgtttttttgctcaaattttggcggaattctgagattagaatttcaaaattaattttgaaagattagctttcggtaatactgtaatttatttaccccccccttttttgaaaaaaaaattttcaaaaattttaatgtcataaaaacaagtttcctgggcttttcgaggtcgctgatcacgaatccggcatccatttcggccacttaaatcccggacccgaattcgaacaaaaagtcaaaaatccaaattttcgaattttgcatatttcgtctacaaatggt

SEQ ID NO: 37321 - DNA, 1523 bp, Heterodera glycines
caaaattaagtctttttttgactcagatgcttgcaattagcaataaatagtattcccgttactatcattcgtcacatttgaggctgtcgtcccgcaacgtttgtttggttggcgtgtttgctttgtgtagccgagagatatttaccgccttcgtctgcagtgaagctgattcgcgacgcacgagcaatccgcaaactccaaatagaccaccaaattgtaaaataatttttaatcatttgcaacattttcctaatcccaacaacaagtttgatgattttgatttagctctttggcttttcaacattccgtgaaaaagaccaatgcgtcgtttatctgaggaaattcattgaagcgccaaatgccaagtccattgtcgaagtgcactcttttggcactttgttatcccttgatatcaccgaaatatgtaaagcaattatcggcgtgcacatcaagaatgcactccccgaggcagcactaagcgtgctcaagtacgacaaatccctttttatgacttttcacggccgatttttttaggtattttacttcggcagtccattcgccggcaaaggcacatttggtcattgcgttgcacacatgcacttttgtgtgttggaaactcgccgagtcggtcagagaggagcccgcaaatgctgacattatcgtgttgtctggaagcattgttgcagccttacaatcagttctcacaaaattgatagattggtcggtcggtattggcgagcctcgatacttatgagtcttattcaagaggtattgtaaggagttcattttgtcttgttccatataatagcgataaatcgtgcagatctttatagactttgttgtaatcattatggaatacagtcgatgattttcgattgatttctaaatgaggaattcgggactcgcaaatgtcgggaaataacacttaagaaatggaccgcaaatgtcggggccgcaaatgtcgggccgcaaaaatcgggccgcaaaagtctggaccgcaaatgtcggggccgcaaatgtcgggccgcaaaagtcgggccgcaaaagtctggaccgcaaatgtctggaccgcaaatgtcggggccgcaaatgtcggggccgcaaatgtcgggccgcaaaagtcgggccgcaaaagtctggaccgcaaatgtcggggccgcaaatgtcgggccgcaaaagtcgggccgcaaaagtctggaccgcaaatgtctggaccgcaaatgtcggggccgcaaaagtctggaccgcaaatgtctggaccgcaaatgtcgggccgcaaaagtctggaccgcaaatgtctggaccgcaaatgtcggggccgcaaatgtcgggccgcaaaagtcgggccgcaaaagtctggaccgcaaatgtcggggccgcaaatgtcggggccgcaaatgtcgggccgcaaaagtcgggccgcaaaagtctggaccgcaaatgtcggggccgcaaatgtcgggccgcaaaagtcgggccgcaaatgtctggaccgcaaatgtcggggccgcaaatgtcggggc

SEQ ID NO: 37322 - DNA, 723 bp, Heterodera glycines
acttacaaagggaggtggccaagtgtccgtgggatttccaaatgaaacttggttggatggatagagcacccatgggttcttaagaaaaatggttttattttctgccaaatgagcacgagtgccgagttatgacgtgccaaagtttttagttttttataattaaagaaaataattaattatttacatgtcttcgatgtgttgtttggtgtagaggtaatgtgttagtcaaaatttttttgggtcacaagttcgaatcccctatgtgtaaatccattttgtaatttttatttttcctttttatgagcacttcaattagcaaattttatttctttatcaaaatctttattttaattttatcccattaaaaattgcattaaacataaagatgtaataaaaaacctgtcgaattaaaaaaatatatttttgtctaatatttttattgagtattttatgcactaaataatttcaaaaaaataaaagtaaagtttttttaaataaaaaatattttgataattgacttggcataatagacaaaaattaaaaaaattaatttacatgtaggggatccgaaccctgggttaaatgatgctgactagtgcactaccgctacaccactggacactgtgccgagacacaaataagtatttcttttatttcatcattaaaaagtttggcattttttatctcggcacaggggtccatttggcagaaattgaaggtact

SEQ ID NO: 37323 - DNA, 1442 bp, Heterodera glycines
ccgagaaaaaattccagaacaattagtatcggcgtaattattctgagaatgcggttggaattcctattaccgttgagcagaaaaagagatagccaattttccaaatttttccaaaacaaacgcgccgagaaacaaattccagaacaattagtatcggcgtaattattctgagaatgcggttggaattcctattactgttgagcagaaaaagagatagccaattttccaaatttttccaaaacaaacgcgccgagaaacaaattccagaacaattagtatcggcgtaattattctgagaatgcggttggaattcctattgtcgttctgatgacggcaaaaaagtttgaatgggctgggcggacgtattcagagcgagttgacaaaaattaaagaccaaaggcgccaaaaattcactttattttgtaccctcaaacttgggtaattaaaccataattaattaatgaacaaatataatccgacatgataaaatgggcacaaaggggaatggtaaggggaaggcgcagggcacggcacagggaaggcgcagagcacggcacggggaaggaatggaaacttcggagggaaccaatgagcgatctgaaatcactgaaaacccagccccttttatacggcttttttgaaaccatagtacgctccaatttataatttttaattaaaatctgtttttgttatatccgtttgggttttgccattttcccattaattgtttgttttccactttttcctttacaattccaattcctttaatatattcaattaattttaataatttgtttacgaacgcaatccttaacagaattcgccatttaatattaattaattttcgttcctttcattcctgaggaaatgcacttttcattttcaaacaattttccgttattcatttcaaaaggttttcccattttttataattatatttttgatagttttttctaatatgtttttccaaattaaatgaaaaattatttttgtttatgtaggttttgtttttccccattttgttttctagtgttttttattttttcctttctttattttgggatttcgcgctgtcgcgacaataagtggttgtaaacaacttttgggtatggaattattttttgaagtgagtcaaacaccgtattagtgctttgctgtgccgagaaccggcaggcaatggatagctttaaatctgcaagaaattagattggcaataagtggttgtaaacaacttttgggtaatgaattattttttgaagtgtgtcaaacaccgtattagtgctttgctgtgccgagaaccggcaggcaatggatggctttaaatctgcaagaaattagattggcaataagtggttgtaaaaaaattgtgtaaggaattattttttgaagtgagtcaaacaccaaagaagtgctttgctgtgccgagaaccggcaggcaatgg

SEQ ID NO: 37324 - DNA, 992 bp, Heterodera glycines
tgagtcccagtgattggaatgctggtgggatgagtcccagtgattgaaatgttggtggattgagtcccattgattggaatgttggtggattgagtcccagtgattgaaatgttggtggattgagtcccagtgattgaaatgctgatggattgagtcccagtgattgaatgctggtggattgagttcccatgattgaaatggtggtgggatgagttccagtgattggaatgttggtgggttgagtcccagtgattgaaatgttggtggattgagtcccagtgattgaaatgctggtggattgagtcccgttgattggaatgttggtgggttgagtcccagtgattgaaatgttggtgggttgagtcccagtgattgaaatgttggtgggttgagtcccagtgattgaaatgttggtggattgagtcccagtgattgaaatgctggtggattgagtcccgttgattggaatgttggtgggttgagtcccagtaattgaaatgcagaagaattgagtcccagtgattgaatgctggtggattgagtcccgttgattgaaatgctggtgggttgagtcccagtgattgaaatgttggtgggttgagtcccagtgattgaaatgttggtggattgagtcccagtgattgaaatgctggtggattgagtcccgttgattggaatgtcggagaattgagtcccagtaattgaaatgcagaagaattgagtcccagtgattgaatgctggtggattgagtcccgttgattgaaatgctggtgggttgagtcccagtgattggaatgttggtgggttgagtcccagtgattgaaatgttggagaattgagtcccagtgattgaaatgcggatgaactgagtcccagtgattgaatgctggaggattgagacccgctgattgatatgctggaggattgagacccactgattgaaatgctggtgggttgagttccagtgattgaaatgttggtggattgagtc

SEQ ID NO: 37325 - DNA, 1040 bp, Heterodera glycines
catcagcaacagcagcagaatggcacgtcccggacctcctttgattggtaagagatacggatggcgcgcggcatgacactctctctgatcagatggacggactgcgctgcgatcacttttttttgccggggagggagaccaattgcttgctgatcagtcgtcgtcattcattaaccaatcaatcaatgaacggatcaatcaatcaaccagtcagtcaacaaacaacaacaacaaatcgatttgaaatacgaatgatccatttacaacagtttacgggcccttttcacgcatttctctcatcatcatcattgtcataaattgtcattttatcgttaattattatcatccatcagccagttgacctctgatccctcctcctcccgtccgtgttgtttcaaaacgtttttttatttaacagatgcgagattatttatgtgttctattattttgttttaatttttttgtgtgtttccccactttttcacgtcgctttctctctcttaattttctggaaattttcaattgtttccttttttttttaattgtgtctctcttgtttattttggcgcgggtaatctccatcatcattatcaccatattagcggcacgatgccgacaaagcagggactaaatttttgatttttgaatttaaaaatttgtatcattccctaattcgggtgtattttttcgagaaaacaaaaaccgcggatcggagagtcttggaaaacccctcagggtccggtttctcttaattattgttaagccgtccgtcttttcccctataattttctgctctgtcggtttcatcgtgtcggaaaattgcttctggattttattttaaaaaatgtgttatttttgtgttcattttctcctcttgtgctccttctgttttgctgattgatcaatcagtaatcgacaccaaatcacaacatccccccacaaaatgtaattcttttttctttcatcgtccccatccattttcacacaaaaataataattatttttgttttgtcacccatttatttcatcacgactctaga

SEQ ID NO: 37326 - DNA, 829 bp, Heterodera glycines
aaatagaatggtgattgtgagagccctccgtctcatacacaagcgcttttctggaggtataaaatttatcaaaaaaagagatagccatttttctgggatagagtataaatttaaaaattccctcaaaaataaaaggtctattgcgcaccgccctccctatcatgctcgagagcatttgtatgtgtataaaatttatcaaaaaaagagatagccatttttctgggataacctctaaatataaaaatcctctgtgaaataaaatggcgattgtgcacagccctccgtctcatacgcaagcgcttttgtgaggtataaaatttctcaaaaaaaagagatagacatttttctgggatagagtataaatttaaaaattccctcaaaaataaaaggtatattgcgcaccgccctccctatcatgctcgagagcatttgtatgtgtataaaatttatcaaaaaaagagatagccatttttctgggataacctctaaatataaaaatcctctgtgaaataaaatggcgattgtgcacagccctccgtctcatacgcaagcgcttttgtgaggtataaaatttctcaaaaaaaagagatagacatttttctgggatagagtataaatttaaaaattccctcaaaaataaaaggtctattgcgcaccgccctccctatcatgctcgagagcatttgtatgtgtataaaatttatcaaaaaaagagatagccatttttctgggataacctctaaatataaaaatcctctgtgaaataaaatggcgattgcgcaccgccctccctatcatggtcgagagcatttgtatgtgaataaaattt

SEQ ID NO: 37327 - DNA, 906 bp, Heterodera glycines
tttgatcaggggatggcatgaaaccgcagggtgatctgtttcctttcacaggatacattcgcatggcacgcaatcgcaacaacaattgcggcatcgcttcccacgcctctttcccattggtctgatcggagtgaatttgttgcccttgcgctgattcagagacatttcatttgattaatcgtgcaaaatgataagataattgataatccatcagtcaatcggtcgatttccattttttatgttcgcaattttattcacatataaataaattacttattttatttacactcaattttctgttttttttctgttaaagtcaaagtcatttgccaattgtacgactattaaatttaatgtctatcattttggctcaccttttgtttttgcgagggattggtcgaaggaatttggcgttaattaccccaaatattttcgatgaatttgtgcaattaatcaatcatctgacaatgagagaatgaatattcgatgagtttaaagatgaaaaacaaatcttgcgcatttatttcccaaccaaaaaaaaaagttttttacgagaaatggccgtacaaaaagacgcggcaattaaagggaacccattttaatatttattagcaaatatttaaaataatttaatatatatttttttaaaagatggaaaagtcagtgatttcattgtgttttttggttgggttggcatttcttttgccgtccgaagcagcattcagcaggtggcagaataatgaagcaaaaacaattaaaattcacaatttttgttagcatgcgaacgaagcgaggcggcggaatgggcggagggatgggcagcggaatgggaatgagtggcatgccaggcggtggcatgggaggaatgagtggtggcagtacggaagcagtgggtacggtggaaac

SEQ ID NO: 37328 - DNA, 488 bp, Heterodera glycines
ggcgaacggcgtggggagggtcgacgcaccagcagcaataaataggtaaggaaggaggcacacaccgtaacggtgcgtacagaagaaccggtggatacagtagccgaatgagcagtttgaattataaaagactaatccatgctcggtaattcttgactacgattctatcaacaacttgtttcatgtttgatctattccagtcatttcaatatcaaacgaaaacgcacagtatgaataatgtaataattcgagaaaacaaaagaattttaacatttcaagaaagttacaaaccaaaataatcagtaattacttaattaatcttatcttttttggtaattgcctaaacgttgagattttatatattttagcttcgttagattttgtgctttcgaatgataccaaaaagatagtttgttctaacatgaacaaagttattgtataaaaacccgggattgtcaattgattggactcataaagtgcattagagc

SEQ ID NO: 37329 - DNA, 1271 bp, Heterodera glycines
  misc_feature (30)..(30): n is a, c, g, or t
  misc_feature (73)..(73): n is a, c, g, or t
  misc_feature (93)..(93): n is a, c, g, or t
  misc_feature (100)..(100): n is a, c, g, or t
  misc_feature (147)..(147): n is a, c, g, or t
attgggacttcggatacactaaaggatgcnttcataaggtttttatcgttggggtacgaatgaaaatatcaanaatttagcttgactgctgtnggtgtangctcaaaatttcgcgcaaaaaatttactctagctatcaaaaaattcnatggggcccacacttcggaacgcatctctgaaatcctaaaagctcttctcgaaagttggaatgtaaaagaatgccattgtttgtgaccgatttcggcagcaaatttagttaaggttagtttattgaacattttatttcaaatacattttttggaggcattggatttaatgcacattgaaagaatcagctgtgccgctcatgacctcaatttatgtgtaaaggattgcttttcaaaagaaaaagacgaaatggctcaaattttcgaaaaatgtcgaaaaattgttggaactttaaaacattcggcaaaattgatggatgatttaaaagatgttcaaggcgaacttggtctaccgaaagctaaattgcttcaagttgctaattatcaaatactcatttaattttcatttcaaaggacgtaagcacgaggtggaattcgacattacgtatgatcgaacgtatgctggaacaatcggctgctattgatgaatttttggttagaaacaggaaattcgatctgcttctaagtcaagaagaatggtccattctcaagctaattaaggcaatttagtgttcaatattttcttatgttttaaaattttaaggaacttctaaagcccaccgaagaagtctctttacattattgtaaagaaatcctctccgcccgaattccgctcgctcgaactttggtctccactttggaacgagttgatctttcagtgacaattgatggcgaaatcaaaataattaacgaagttgagcaaatgcgtacaaggctgattgaggcggttaaaaagcgttttttacaaaaagaaaataggtatatacttaaaatactattatattataaattgtatgttgagtacttttctcgaccctcgcttcaaggatcgtttttccgacgaaagtgacatattttttgcgcgcgttgcacgttttttgaaggacgaaggaacagaagaaaatgacattttggaaaatttggaggatgaagtgaattcgactcgcattttgccaccagccaagcgcgcttgttccattgtggagataatgcagaacatagccagttgtaccaaaaaaggtggtaccaaaattgcaattttgatttaaaaaaattttagctacat

SEQ ID NO: 37330 - DNA, 622 bp, Heterodera glycines
taaataattccgacgcataaattttcgggcgggcgatgcctttagaaatttcctcacccctcctgccatcttaataattgaaatttcaatctctttttttgtattaattaaattcccccccccccccccattttcccccaaattttgtccaaattatttttccctgccgcccactcttttgatcgttgggttcatcttcaataatcattaatataataattattgttgttgctttttgaacagcgctcaagtgatcgtgcgtgaatgggcttgagagattcttatattttcccataatttcctttcttctttttcctcctcctcttccttttttcccttccattttcctcttttctctccctcccctttttctttttcctcctcctcctcctcctcttccttttttcccttccattttccttttttctcgccctcccttttttctttttcctcgtcctgctcctcctcttccgtttttgccttcgattttcgtctggtctctcgctccccgttttctttttgctcctcctcctcttgcttttttcccttccgttgtccgcttgtctgtgcctcccctttttctttttcggcgtcttcctgttttcccttccattttgggctt

SEQ ID NO: 37331 - DNA, 1154 bp, Heterodera glycines
ttggtggctttgtcaactccaatatacactaatagaggactttggagctatagatttataccaattttttaatttgaagcttctataaaagttatgatgcattaaatttagcgacgcgtgaagcttctcactccgccattgcgcgagcgagcggtgcctatgttccgccatatctgagaatgaacggtgattgcaccggagcggtaagtttgtctccttttaatcactaatcattgacactacctcaggcgtggcgaagaccaatccctcgctgtaaaactgttaaagagttgaatatggacgtggtcattgagtacagtgggcgagccgctgaattgaagcttattggagaagcaacaagtggatcgggcaaggacataacgaaagcaacggatgtaaaaaaaaataaaaaattgtttttatttatatttttttatagataattatgagcataacaagaagtcttgccatggctggtggacctgaacggccttggttgaactatgaagtctgtttcactttatttttagacttttttcatttttaagattgctaccccgtctgcttctgacttggaatggttcagagctaaagaacgcgaaattcgaatgaatgccgaacgaaggcagagaagcaagtgaccaaacactgggtttgaattttgtttggtatcagtgaatagaaatggaattttcaggaatgcatttgtgctttggcaacagcgttggatgagagcccaatgtgggaaatgaacgaagacgagttgaaaaagtttttcgacgattgggacgcaaaaagcgcacttcttctaccagcagccctcccgggacagaactgacgcctgggacatcgaacgcgccgccaattgttgaacaggaaacgccgattggacaaaacgagccccctccaaagaaggccaagaatgatgatacgggagttgatgaagatggggagaaacactgttaagagtgtatgcaattctttttaattgcattttgttgacaaatttttactgcttaaaaacatcaatttacaagcctttttgataaatggtcaaaacttgttaaacgttcatttcattatgtaaatacaatacaaacaaaagcgtagtaaaattgacgaaatgtttttagcaaaaaattttttttctcatt

SEQ ID NO: 37332 - DNA, 1502 bp, Heterodera glycines
cggggggactgccccgaaaacaaaaaaatcgattttttcaagtgtccgtttggggtactcaaacatttatggggagcaaaaatccaacgcagaattaaagtacagactatagggaagctattcccgaaggattcggtctccccataaatctgggcgcatcggttcggggggactgccccgaaaacaaaaaaatcgattttttcaagtgtccgtttggggtactcaaacatttatggggagcaaaaatccaacgcagaattaaagtacagactatagggaagctattcccgaaggattcggtctccccataaatctgggcgcatcggttcagggggactgccccgaaaacccaaaaaaaaattttttggataaaaattatttaaatgaactgactagataatatttaaaataggttatttctcttcctttcagtatccctgcaaagtttggtgcgcttctgatcagtttctgaaaaaaaagttaagcctaaactttttggcctgtttaaaaaggaattaaaaatttttaaaaattttattcatctccctttttgatagaaaaagcatcagagtgcctaaactaacatgtaaataaaatttggtgcgttcagaaccctttctgaaaaatatttaagaattaattttgcaaaaaataaataaaaacgaaagactcagattttcgaaaatttttttgagccagctagctcggcgctcatttcagtgtaagttagtcctttaccggggagtatccctgcaaagtttggtacgcttctgctcaattagcaaaaaatatgagtgatcgaattttcactaaaaaagttaagcctacattttttggcatatttaaaaagcaattaaaaaatttttaaaatgagaattcatgcgagattttctggaaataagcttaatagggcctagttaagctgtaaaaaaaatttggggcgatttgaatgagaatagaaatagccaggttcgatgaagttttggtaagccaaaaaaaaatccaaacatttaaaaatctataaaaaatttaaaaattagaattcatgcgagattttttggaaataagcttaatagggcctagttaagctgtaaaaaaaatttggggcgatttaaaagagaatagaaagaaccaggttcgatgaagttttggtaagccaaaaaaaatccaaacatttaaaaatctataaaaaatttaaaaatgagaattcatgcgagattttctggaaataagcttaatatcgcctagttaagctgtaaaaaaaatttggggcgatttgaaagagaatagaaagaaccaggttcgatgaagttttggtaagccaaaaaaaatccaaacatttaaaaatctataaaaaatttaaaaatgagaattcatgcgagattttctggaaataagcttaatagggcctagttaagctgtaaaaaaaatttggggcgatttgaaagagaatagaaagaaccaggttcgatgaagttttggtaagcctaaaaaaatccaaa

SEQ ID NO: 37333 - DNA, 1167 bp, Heterodera glycines
  misc_feature (1138)..(1138): n is a, c, g, or t
tgcttgggacccgatcccgcaaattgctgacatttgcacgcgccataagctttggctgcatgttgacgtattattaataaatagcaaataatttttaattaattttctacaattttttcccatttatttgtcattttattctcttctgtttatcattttgtaattaccgtattggtggaaatactttgttaccgtatcctttgatttaaaatgcataattttaaggccgcttggggaggtggactgctgttgagccctgaacatcgtcataaattggctggaattgagaaggctgattcagtagaagaaaagaaaaattatttttatactttaataattttttattaattttaattaaaaataaaataaattatgaatttattttcataaaatataatttcaatttccaggtcacatggaatccacacaaactgatgggtgcgccgttgcagtgcagtgcctgttttgtccgaagagaagtcaaaatacggaaaaaatattattttttctttaattaaattatttttttttcatttaaaataaaaaatagaatacgaagtttaactctttctacaggggcttctcttccaaaccaatcaaatgtcagctgattatctgttccaacaggacaaaccatatgatgtcagctacgataccggggacaaggcgatgcaatgtggtacggtacttgatactgtaatataaattatttacctactgaaaacaagcaaatttattaagtcgaaaaattgaaaaattaaaattattaaattaattagttttcaataactttatatttagggcgacacaacgacattttcaaggtggattagcgctaaatttcaactaatttcactaatattatttaaataatatttcagttgtggcttatgtggcgttccaaagtctcttttttgatttccttatctttaaaaacaaaaaataacatttattaaggggatggaaggttatcgacgtcaaattaaccaacttatggtaacaacaaattaaaaattaaattagttttaattattacaatttttaggaccttgccaaatattttactgataaaatcaaacgcactgaaggctttgaaatggtgctggacgaagtgattatccacaggcgggagaaaaantggcgctactgtaaaaaagttgttggttt

SEQ ID NO: 37334 - DNA, 1009 bp, Heterodera glycines
  misc_feature (26)..(26): n is a, c, g, or t
  misc_feature (33)..(33): n is a, c, g, or t
tgtagcaatgatgcacgtgtcctggnaattctncaggaattatccctgatttcttctatttcttatcactcacaaatcactgggggaaaattaagatgatactgatgattagcgttcttgttcgattttggcgctagtgcgatatttattctcatggttcttggaaagtactcaggaagtatttcgatttttgtaaataccatcagctgatataaagaaaagcattgttgtctgtccttttccaattatattgccatttcggcatcggtctaacaaagctgcgcatggctttgggaaattcctcaagaattaattttcgttgtctaaagaaatgcgctagtgtcgggcattttgacattaaaaagccattaaggcaccgttgtagcaatgatgcacgtggtccttggaaattcctcaggaattaatccctgaatttcttctattttcttatcactcacaaatcactgtgggaaaattaagatgattctgatgattagcgttcttgttcgattttggcgctagtgcgatatttattctcatggttcttggaaagtactcaggaagtatttcgatttttgtaaataaaccatcagctgatataaagaaaagcattgttgtctgtccttttccaattatattgccatttcggcatcggtctaacaaagctgcgcatggctttgggaaattcctcaggaattaattttcgttgtctaaagaaatgcgctagtgtcgggcattttgacattaaaaagccattaaggcaccgttgtagcaatgatgcacgtggtccttggaaattcctcaggaattaatccctgaatttcttctattttcttatcactcacaaatcactggggaaaattaagatgattctgatgattagcgttcttgttcgattttggcgctagtgcgatatttattctcatggttcttggaaagtactcaggaagtatttcgatttttgtaaataaaccatcagctgatataaagaaaagcattcttgtctgtc

SEQ ID NO: 37335 - DNA, 1442 bp, Heterodera glycines
tttttattaatttttaaaacttcactattttatttttttaatagatttttaaatgtttggatttttttttggcttaccaaaacttcatcgaacctggttctttctattctctttcaaatcgccccaaattttttttacagcttaactaggccctattaagcttatttccagaaaatctcgcatgaattctcatttttaaattttttatagatttttaaatgtttgcattttttttggcttaccaaaacttcatcgaacctggttctttctattctctttcaaatcgccccaaattttttttacagcttaactaggccctattaagcttatttccagaaaatctcgcatgaattctcatttttaaattttttatagatttttaaatgtttggattttttttggcttaccaaaacttcatcgaacctggttctttctattctctttcaaatcgccccaaattttttttacagcttaactaggccctattaagcttcagaaaatctcgcatgaattctcatttttaaattttttatagatttttaaatgtttggattttttttggcttaccaaaacttcatcgaacctggttctttctattctctttcaaatcgccccaaattttttttacagcttaacaagccctattaagcttatttccagaaaatctcgcatgaattctcatttttaaattttttatagatttttaaatgtttggattttttttggcttaccaaaacttcatcgaacctggttctttctattctctttcaaatcgccccaaatttttttttacagcttaactaggccctattaagcttatttccagaaaatctcgcatgaattctcatttaaaaaattttttaattgctttttaaatatgccaaaaaatgtaggcttaacttttttagtgaaaattcgatcactcatattttttgctaattgagcagaagcgtaccaaactttgcagggatactccccggtaaaggactaacttacactgaaatgagcgccgagctagctggctcaaaaaaattttcgaaaatctgagtctttcgtttttatttattttttgcaaaattaattcttaaatattttttcagaaagggttctgaaacgcaccaaattttatttacatgttagtttaggcactctgatgctttttctatcaaaaagggagatgaataaaatttttaaaaatttttaattcctttttaaacaggccaaaaagtttaggcttaacttttttttcagaaactgatcagaagcgcaccaaactttgcagggatactgaaaggaagagaaataacctattttaaatattatctagtcagttcatttaaataatttttatccaaaaaatttttttttgggttttcggggcagtccccctgaaccgatgcgcccagatttatggggagaccgaatccttcgggaatagcttc

SEQ ID NO: 37336 - DNA, 976 bp, Heterodera glycines
  misc_feature (17)..(17): n is a, c, g, or t
  misc_feature (942)..(942): n is a, c, g, or t
ctttaatttttatattntggttattatatagataatcgtatccaaaagtgagcttgatttctctttccatcttggaagacaagaaaggcattcaccgatcggaacctttcttcggtttcgaagttcattgtatttaccatttaattcacaattacttatgataataaaaacaaattatgttttaaaataaattttatatgattgtaaatggcttggtattttaagattttgggaaataatagaaggtcaattaattaataaaagtttgcctttttctggtattttatatgaattaaaaaaatttgcgattcgggtactacaaattttgtgttgtgtaaacattaaatgtgattttaaaatttaaattgtctttatgcatcatgagatagatagtaatttccatgtgtgtgcagcaattttgtttcgataatattagatttcttagatctccggtgctggcaaagctttactcttgaacggtagattgaataaaaagctccagtctttcgacaagtttatataaattgaatttttattgttttcgtattaattgtagttctgcatttgcaaataggttaaaactaacattttatgtatgtaattttgatgattttaatttttagaataaatatattttattttctcagcaggtataataattgagacttttagcaaaaaattacggttgaagaacttctgtattcatgccatagaatttattatgtataaactaaaccacgtaaaatagaaagtttaattagtactaataaaagatgggaatatgctctcggggtctgtgggattcaataattatggaaaggggaattggggatgggccaaaggtgttttgtccaaatattgtccaaagttgggacaatatttatatgaagtaaattgagccgcgaaaatacataaataaaaatggagagatgatattaattnagagagctgcagcagaagataaaatataaaactg

SEQ ID NO: 37337 - DNA, 834 bp, Heterodera glycines
cttatccatgccatctatcatctatgattctttcatgcatgcattattcatgcaaacattcattcatgctagccttattcaatcattctttcattcattcatgccatgtgctttcatagaatcatgcgtttataaattttcatgcattacttataaatgtaataaatattataaatggtgcggaattagcttatcacattcagatgagaaccaaaaatctgccttctaagctttccaattccgaagttttaacaagtgatgctagttcatcgagtgttgagagccctgcggggaccatttatgaatcattcgatgcgttgagcattgatagctcaaaagcagctgcaagccctgaggggtccgctaatgttggggctgaaattgttattgaagggactgaatccaatgaaaaccctgcggggtccgggtatgatgaagtgagaaacgagggtagtaacgtcacatttaaagcgatggaagtggcgcttgaccaagtcgatgcagagggttttgcgaataatggctttgatgatgaggagcctgaagcatgtcctccggctaaagatgtgagcaaatcatcgcttctttatttggtttcgcaagccggagatggctacgtaattgcttgcaagaagtcgcctaagtcgaagccaaattggccattcttcatgaacatcgaagacaagctgattgagtcggccccaggctttcagcgtaaacttgaagttggtgactttgtggcggtttcatcatttgagtggaaccagaagctgcgatatttggctgaacatcgccaagatgccacacagtcctgcaaattttggttcaacgaaa

SEQ ID NO: 37338 - DNA, 567 bp, Heterodera glycines
ttatcctatatattaaagttgagtgtttgtatgtatgtgtccgtggtttgaattggtgtggcgttttgtttgaattttgcgttaaaaatgaatttgaaaaaagtagagtgagggaaaggtgggaaaatagtgcactgtctgattgtctgtctatgcgggcagcggcgggtgagaggggcatacagagaacagacgcgtgctgctgtgcagcagcagtctgttggacgcgtgcgtgtgtgtgggagagggaggtagtgggaaaaaaagagagtaaattgcaatggaaaagaaaagagagtaaaaagtcggtcactcattggcgccgttttgccgagaaaatttcgcttttatatttttcaatttcatgttgtggttatcgaacgcatgagaaatgcattgacaaagtgcggcgcgtttgtccgagtttggccctggcgagaacggaattctctctccaattcgatttgtgccccgagaaatcgctgcttgaacaaaattatcagtgcgccgaatgtttttcgcccattgtattcgctaataattattttttggcaggtcccttgagat

SEQ ID NO: 37339 - DNA, 643 bp, Heterodera glycines
ttcattttcaagcgcacagtgtttattatcaaaatatattaataaatatatgaaaaaattaaaataaattataaataaaaataaatttcttttatttcaaaatatttgttacaaatatttaaaagaaatacaaattaccatttataatagcaaccaaagccttgttgcttgaattaaagaattttaaaacaaaaattacttaaaaatttacatactaatctttttgctttttaaaaattctttaaaaaatagatgcttcaaatgatgctatttgccatgggaagtgaaaaaataattttattaataaagagctatgctgatatttatttacgcaaataaaataataataataataagtttaaatgaataacagcaaatgaaacacgcttcaaagcattcttatccaaataaatccaaataaatattaataaaaattctattcattaagaaaagggattaaaaacaaatgccagttcataaacccaaagatttttgtaatgtaaattatttaaaatttattttagcggctatttatacaagtagtatcaggccacttaatccgccccaaatcccccgcccccttccattacccaaatccctggcgcttagcgaccgattggtaattttttgggggtcattcggc

SEQ ID NO: 37340 - DNA, 1015 bp, Heterodera glycines
gcagatgaaagccatccattgcctgccggttctcggcacatcaaagcactaatagggtgtttgactcacttcaaaaaataattcattacccaaaagttttttacaaccacttattgccaatataatttctttcagatttaaagctatccattgcctgccgttctcggcatagcaaagcactaatagggtgtttgactcacttcaaaaaataattcattacccaaaagttttttacaaccacatattgccaatctaatttcttgcagattgaaagccatccattgcctgccggttctcgcacagcaaagcactaatagggtgtttgactcacttcaaaaaataattcattacccaaaagttttttacaaccacttattgccaatataatttctttcagatttaaagctatccattgcctgccggtctcggcacagcaaagcactaatagggtgtttgactcacttcaaaaaataattccatacccaaaagttttttacaaccacatattgccaatctaatttcttgcagattgaaagccatccattgcctgccggttctcggcacatcaaagcactaatagggtgtttgactcacttcaaaaaataattcattacccaaaagttttttacaaccacttattgccaatctaatttcttgcagatttaaagctatccattgcctgccggttctcggcacagcaaagcactaatacggtgtttgactcacttcaaaaaataattccatacccaaaagttttttacaaccacatattgccaatctaatttcttgcagatttaaagccatccattgccgcacagcaaagcactaatagggtgtttgacttacttcaaaaaataattcattacccaaaagttttttacaaccacttattgccaatctaatttcttgcagatttaaagccatccattgcctgccggttctcggcacagcaaagcactaatagaggtgtttgactcacttcaaaaaataattccttaccccaaaagttttttac

SEQ ID NO: 37341 - DNA, 1013 bp, Heterodera glycines
atgtgaatacgggtagcatcggattctccggttctccttcaatcgcttcaattgttgttgctcttttgcttctgtcgctgttgtcggaccattttgtgctgtttacggtgcagcgggtacggtggaggcgacggaaacggtgccagcggtgggcccgcggcggcgaccatggcgccaggcggtggcaccacctcgacgcagaagggcggcaagcagggagacggcgggggcggaagcggaggcgaagcggcgaacggcggcggtggcattgccatcaccaccggagaaggcggcggaagcggaggagaagcggcgaacggtggcggtggcattgccattacaacggtaggaggcggaggcggcggaagcggtggcggtagcgggggagcacagtaagcgggtgcgatacagaacaccttcggcggaaggggtcgtattaagggttagcaacccaaaagccgacattcccgagccaataattaagtccccagaaggactaagtaggagataatctcgagattaagccggatatgtttttcgagaatatattggaggcgaacgatcactcaattgaaccatggatttgggaaaaatgaataatcccatgggttttgaagacttaagtcgagagttcagcagttgtgagattagggaagatacacaagaaaattttggcaagagtctccaaatgactctcgagatttgtgtgtttgggaaagattaagctctcggttgatcgggccattttttgaaatcagtgaaagtcaaatactccttaaaattgttggcaaacctgcggcggagacagaggctggaacatgatcggaggcggcggaggtggcgcagggacgggcaccggaggcggaagagggggcggactgaacagaagcggcccagcggaaagaataggtgtgaccaaactgtgggacagcagcggaagggttaaaagcggaaaagcgggggggggggggttaaacgcgagtgcctcaccggacagtcaatggggggaaatt

SEQ ID NO: 37342 - DNA, 665 bp, Heterodera glycines
ttctaaattggacgtttttaccctttttccggacagaatcggttaaaatcgttttaacgattttgaggacccataacttttgtcagttgttttttaatcaacaaattccttcggattcatgcttaacaaaccgaaagcaatcgattgatatctatttggtcgcaattccatgtgtttgtctcgtaattgggaaatatgcccccaaatttaactcaaactttggacggcaaaatcacgagaatttattgtcactgagcaaaaaaaaacacaaggaatgaaaaagcgatcaccaaacagcatcattccaacgaacggggcgggggatattaatattacacactaagtgatcattgaaagccggggagggcgtgcgaaaatccggccaagctgatggctggcgattgtggcaatagaacaatactaggaaattgtgaaatgttcggttgggaatgggaggggggaatcatgggataagtttcgcaaattgcgacactccgtgcggcggaggacttcgggggagaatcgaatctgatcgaatttaatggcactggatttccttcgatttgtcttgcgattttctttcatccggttcgctgggtgctcatcggaaagtgttacaattggccatgcgatccgactctggcacgagagatgacgcgaggacg

SEQ ID NO: 37343 - DNA, 973 bp, Heterodera glycines
  misc_feature (355)..(355): n is a, c, g, or t
ggggacatttaaaacaaccgtttccatttaaaattaattgattgattatttttggcaaaaagcaaataatcaaaatcgtttactttttcaaccaattaataatttaaaaaaaccgtaatctattcgaaaattgtacggtaaagggtaggagttacgggctgcgaagaatggagtacggacttataggcttataatccgaagtccgtaaacccattcggtcgaaaaaatatggattacgggctatgggtccgtaaaaacccgttccaggaagtgggaacgggattcccataaaatcccattcccgtaaaaaaaaatcatactgggatagaaagtactagattgggaccgggactcncaaaaaaatcccccgggagtcacgagtagggatgatatttttaggtttttcactatttttttcctgagctccccgtagcctgaaatgcacgaaaaacatgtttttttttggctgttgttaagctacttttcgagttattagcacctattttctaggtttttattagcacttaaaaaacctaaaaaaattttaaaactattttcacctattttggcgttttgcccaaaatttgttaacaaaaatgcaataaaatagaaaaataaacccgtaagaatcggtgacccacgcgtttcggcgctcccgtttcggcgctcccgtttcggcgctcgtgtttcggcgctcccgtttcggcgccagctcgtttttccacttaagcttttttctttggcatccaaatccaacaatcttggtatcattcgaaagctcttaacatgctctattagccttatcaaaaacgaaaagtttttcaagcctgtaaaaattttattaagaaaaaacttcaaaaatttcgacttttcgcaattttcatgcataactgttttgataattgtctaatcgcaaagcaatagcttagaaaaatcttctaaatagattaagctttcgaacgacaccaacaat

SEQ ID NO: 37344 - DNA, 750 bp, Heterodera glycines
acgtggacagcactcgtgtgaagaaagtgggaaagatggtgcgtgcaatttgcattcataatcatccgattccgaacaccaacgatgcgccgagctgtcagattattattcctcaaaaacaagtcggccgcagttttggtgagtcctaaaaacaccgttgcttctttcgaaacatttcccttcttattgttagacatttacgtgtcttgcgtttccaattccaaccaagtgactccaaagccgtggttcatcgccactgtttcgaccactgttgaaacggagaaccccgaggctgagatacaaccggcacttcaattgcttggacccatttttgaaaagttgtatcaagaagagttaaaaatgagaaggttttttaggtttgtgacaatatcggatttatacgagccggtggacatgggctatgagtctcaaatcttcatttcgcgttctttcgacgcgaccactcactttgagaccacttgcttggatgtgctggacattttcaagaggggcactacggaggaattcgacttctccaagatcacccatctcagtttggaggacaacgaatgatcagaggggcgctgtttggaaggggtggggtcgtggcccagaaaagtgagcatttcgagaaaatcagatgatttaatcatcccttgcaaatattttcgttaaatgactcacttttctgtgttcattgcatggttttaatacacagatatttgtagaattcatttcctagtgaccaaa

SEQ ID NO: 37345 - DNA, 753 bp, Heterodera glycines
tgtgcggcggcgatgccaatgccaaaaatgccgtgccgtcgtctgccgcccattccgatccttttgacccgtgccaatacgccttcctgtgcccgcaaagtgcagctgatacttcctccccgttagcatccgttagctcattgcaaaacaacacaaaaatttcctcagctgtcgccgcaaatattgcgacgagttacgcaagtgagtagcgatggtgctgctggtgttcctgctactctttgagcttggcccattcatttctttttcaacattactattggcactttttctttgcccatccattgcttttggcacgtttgcctttgtcaggtcataccggcatcaatcagctgggcggcgtcttcgtcaatggccgtcccctgcccaattacgtgcgcaatcaaatcgtcgagatgaacagccgtggcgtccgtccctgtgacatttcgcgacagttacgcgtctcacacggctgcgtgtccaaaattctcggacgcttctaccagacggggtctgtgaaaccgggagtgatcggcgggtcgaagccgaaggtggcgaccagggaagtgaccgaagcgatcgcccgctacaaagcagtgaacccgacaatgttcgcttgggaaattcgggtaggaattttgggactggcgaagagaagagaaattgagacggacagacgaagccaatgcccgcgggcaattaattttttgcttttaattggcaggacaaattggtggaggagggcatttgcga

SEQ ID NO: 37346 - DNA, 1620 bp, Heterodera glycines
  misc_feature (30)..(30): n is a, c, g, or t
  misc_feature (173)..(173): n is a, c, g, or t
tttcatattaatttaaatattcaatttatngtacatttcaaaatttctctttttaattaataaaagggaataattaatttattttttaaaatttataataaattgcattcaatttttgtacctcttctaatcaatctcagttgtacctcttctaatcacttttgtacctcttntaatcactattgtacctcttttaatcacttttgtacctcttctcatcactgttgtgcctcttctaatcaaacacagttgtacctcttctaatcacagttgtacctcttctaatcactgttcttcctcttttaatcactattgtacctcttttaatcacttttgtacctcttctcatcactgttgtgcctcttctaatcaaacacagttgtacctcttctaatcactgttcttcctcttttaatcactattgtacctcttctaatcactgttgtacctcttctaatcacagttgtacctcttctaatcaatcactgttgtgcctcttctaatcaaacacagttgtacctcttctaatcacagttgtacctcttctaatcacttttgtacttcttctcatcactgttgtgccttttctcatcattttttgtacctcttctaatcactgttcttcctcttttaatcactattgtacctcttctaatcactgttgtacctcttccatttacttttgtacctcttttaatcaccgttttacctcttctaatcaccgttgtacctcttctgaccaatgttgtacctcttaaaatcacttttgtatctgttctaaaatttaaaaaacggccgcgaagcggccgaaaagaacaacaaaaattagaaacgggcgtgaagcgcccgtcttgagccttgatgtggactaaaaacccataataattttttaaaaattcaaaaaaaaatctccaaccaattcgatcaatttgaatcgcttcacagcctaggtagcgaagctcaagaagcgcgaagcgctttttcccagctaaatagccgacggttcacgcacccgctagttactatatatgttatattgacaaggagtttcgtttcaaaaaacaaaatctcccggccgaaggccgggagcgccctgaaagtggtggaagggtcttacaactttttgaggagaattcgggaaaactataggttttttgatccgagcgccaactgagtaccggggactgatttgtcacttttgtttgcatttgaaggcccctaactttttttgtaaaactcgaatcaaaaagtgcccgctgaaagggcactccgcctaagggtcctctacaaggtggtattttttaaaattttttttgagcaaacccctggcctgcaaaaaatggcaactgaagcgtgctcaaaaagtacacttcagtaccaggtgaataccgcgccagggtttgatctgagcggggggtggtcagcgaacttattgtagagctttcaaagctcgattttttgaaattttaaaatttcgaaaattttcaaaatttttcgagttaggcctaaaaaacggttttcggatttttgaattttaggattttttaacgatttttcccagagaaacggagaccacttccaaaacatagtttttcgagctctatcgactggtattttttt

SEQ ID NO: 37347 - DNA, 1250 bp, Heterodera glycines
tcgtaattgataccaacgtcgggagactgaaacaggaagacccctttatcttcgatctcttgacttgtatttcgacgaataaaactgcgacctttccgattcctgtttcccatccaacagagaattaatgtagctccaaaactgttgttgctgaacattgggcgcacaatggaaaatccatgggaaaacgaaaacgccttcatcatacagtttgcacagtttcatgtaggaagaaagtcgaacgaggaaaatctggagaacagggtaaatagaaagtaaataaaagcaataagatatacaacaccttgacgtcggtaattgcgacattctcaggggaacaacaaaggaagacattttcacgagttgaacacttggacaagcccatcaaaagaggatcaagcacaagatgatctggaaaaattaaagaattagtaattaatggtaaagttagagttacagtttagattagaagaataagcgagaataaaggccaatcgtctaagaaagtgaatgtttcgtcgaagaggccaagcattggccagcaaaaggggaaggacatcgaaacgcaattccgaaagagcaattgggtcggtagtatcaatttgaagaaaagaagtgaccgatgtgccaaattgggcacagtctttagaaggcacagatgaagaataacagcggaggaaggagaggagctaaagaacggaaagaaactgaaaattaactggcaacaatattcttatgagtcaatggcaattagtaccaaaactagttcgtacaataataaattcgtataaattttttaaatttaattaaaaccagtattatgtttggagaatggcattgcaaatgtttgtgaaattgacgattattatacaataaagaaaacaacaccaacgaccatgttcctgtcgcattcgtgcatttccgcctccaactgagagtccgcgtgcaaattcgttctgagcagtgtcgtcaactcagcggcacagagtgaaaggagcgcgctatccgctccatcacttcctttgaccgatttatggcatgcccatttcaatgccaaaccgtagcaaaacattgccatcgcaagcagtcggaattcgttgaaggattgctaaatataaaataaggacagaaaaataaaagtgtgctacttggtaaatggaagaacagagtaagaaatcagcgaaacgacaatagaaagagcacttgaccagacaacggagcaacgaaatgttcgcatttttggccaaaag

SEQ ID NO: 37348 - DNA, 1681 bp, Heterodera glycines
  misc_feature (80)..(80): n is a, c, g, or t
tttttttttaatttatttcgggaaacttttttttttgggattttttttaatttgggcttcggctccccgtttccattttnactttcgggttcaataaagttcttcatgagtgtcgtctcgagtctgtcacattttactagggtatgaaggctcattccccggcttgcagagatttctcgaatcccctggctcaattataagctcccgagtctgatcagttctacatctcgatttccggtcaaagggcttagccagcagggagggaccccgaaatccgaaaagttggaaatttttgaaaaagtataccattttccttagaaattatacgcccttgtccggggtcaaattctcggtctcgaatctctggcaccgattcttggctcagctggtcaattaacgcttccgagtctcgattaattaattctccgtctcctcttcctgatcccgaaaaacttcgattctcgagtatctcaattttactaatttgtaaaaaaatgtttagctatgccgatttcggctttgccgtcaaccaatcggatggcgcaattcgaatgcgcaagggcacttacgcatactcaaacagtggcgctttttgcattaacaatgtgttgaaactcagttatgcaaaatatgcatacggtgctggtgatacggtgggatgtggcgtcgatttggccagccgacgcatttttctcacaaaaaatggcacatttttgggttcgtaaaatattcgtgagacgtattttgaaacatttagggccagccagaatttggtaattgcacgcctcgaccgggttttagagtttaaaaccctgccctttttggaccctgtctggttgagattagagatcggaattttacgattgtacggatcatggatggaattccgaggccccaaaaattttcagaaatcggaattccgagtgctcaaaaaatttatcggaattaattaggttttatatcggtcaagagtcgagaatttctctgcctttttagaaggggtcttgaaatttcggagcgccgtttctcagtgataaatttttggtatttttttggcccgagaattgcttcgggtttttcgtgcactgaataaagctcgatttataaaagtaatttatgatttttttaaagaatccttcgatttggttcttccttctaatgatcttccgctgatcccattcgtcactttgtggagctatgatgacaaaattgaggccaattttggaccgaaatttgaattcaatttggccactctctgacgcacatttttttgttctttgtttttttatgtatttttgatttttgactttttcattgatttaaaatgtcgttaaaatgttctcagttttgttttttattttgggaccggacattttttgcttgtaaaatttgttcaaataggcacgaaaaagctgaaaaaaggcataaaaaattggaaaggcagaaaaaatgaaacacttttattcgtgattaagcatgtcttgaaaaaattaaaatattttctctacatcttatatttagaagagatgttgatgaggccaaatcttccatagaaaattttacatgaaatatttttatttattttttcccgaactaataaagcatgtgaagagctttcgaatgataccaagattattggatttggttgacaaaggaaaaaaagttatagtccaaaaacatg

SEQ ID NO: 37349 - DNA, 952 bp, Heterodera glycines
aaaatttgggactcaattaaatttttattttaccatacaaaaataagtaatttaaaaatttcatttcaatatgaggcgacactttaaatctaaaatttcggagcttttttcaattgattatattaaattttaatgatgaaaataagtgattagattgcaaataacaaattatgaaaattctacaattccggcactaacaaaatttggaaaattattctcgtaatgtatgttgcttataattcacatacattacaaacataggcttttatcattagcttgtttgatgtgatgtgctgaatttggctccccgacctttggggatttgcaacttgggtacctgtcatttttggacccgacattaggggatcccgacatttgggcaccgagccgaaggccccccacgaggccgcgaagcggccgagtgagtaccttgggcgcagaaaaattattaaggaggagggttcattatttatttatttttttacaaaattaattcataagtatttttacagaaactgctctgaaacgcaccaaaatttatttacaagttgaataaggcactctgactcttatattatcaaaaagggagatgaataaatattttaaaaatttttaattcctttttaaacatgccaaaaagtttaggcttaactttttttcagaaagagtgctgaaacgcaccatattttatatacatgctaaagagggcgacttaagattatattagcaatagcgcagacgaacaaggaaaaagccaagttgaagcagcatgagacgcgactgttgcaggcaaaggtggaaagccgtcctctttcggtgctcctcgcgcaacgtacgcaacaaaacgcgaacactgcgaaaataacacagaatagtacgacgacaagcgaatcgtaccctttcggttcaaaaatggacagacagagttgggactcgcgaatttggaccgact

SEQ ID NO: 37350 - DNA, 792 bp, Heterodera glycines
cgaaaacaaatttcgttgcatttttccatggacactcgggcaattaattaaaaaatacatttttttaattagttgcccaatattattatattactatataaaaacaaaaaactccggtaatgaaattacaattataaaaataatttacgccatagcaaccttagattataataaaataattatattaaaatgaatttttaaagttattttttgtggcttttgaaacttttacatattttttaaattattgatggattaattaaatggttatgagtaatttgaatatgaaaaaataataataatttataattttatttaaataaaaattctaaataaactaattttacaattaattaaataaaagaaaaaataaataaataaatgattattcaattaaatacaaaagaaaacaaagccgttagggctcctgggactataaaaaagttttctatttatttcacgccatttattatgtaattctctaaaaattatgtttcggctcttatctaaaagaaaattataaaaagataggaaaataaaataatttatatatttacgaaaattgttaatttaacaatataatatataaatatagatatgaaaatttaaaagaaaatgattaaaacaattttaaaatggcggctacgcgaatccaagcggcttcgcaccatcatcccgatcggatcactttgatttagcaagttttttaagagataaatatagataaaactgtaattaaaaaactataaaaaagtaattttaaataataaaaccaaacactatataaaaaaa

SEQ ID NO: 37351 - DNA, 1100 bp, Heterodera glycines
tggtccttggtggtcgtttatattttttgcttttcactctacttttatgcggagcgttcaaaaaaaattcagcaaatttttcaaaaaaaggaaaaggggggaggtagcaaatgaaaatttacacacctccacattgtcgtagatgcacagcggtgccagcattgtcgtggacgatttgccgtcggcggttgcgccgcgtgtggcacggaaaaagtcgagcaaaatgcgaactttgacggggcgtttggtcgccacactttttgccgcgaccgccaaccgatggaccaatcgctgctccaacgcgtcggtgcccaaatagagggcggacagcacaacgcgacgctttgcggactcaacgcgttgctgaaaaagcgggggaaaatgggggagggattggcatttttaaaagcaaatagaaaaatcatgggccaaatctccgaattatggctggttcggcattaaaaccaataaaaaatgaccagaaaaattttcttagatatatgaattaatgtttttttagtgtttctttttaggtttttagtggtagacagaaaatttctttaaaaaaccgggaaatagtggagctacaccccccccccccccccacattcttcgaaaaaattttttcttttgtttcaagtgtcatagaaatgtttccaaagctttaacggggtcgctgattaacatcccgacatccatttgatcaattctgaatccaggacccgaattcgaataaaaagtcgagaattaaaatctttcgagattcacatggggggggggaagaaaacgaaatgagaaaatcacgaaattggatttgatgaaaccaaaattaaaaaacatttgcaaatacatcggaaaaacggaccagtaatgtgttgtaaaaatggtcgggcgaacgcaaaaaatggacggacgacgaatggacggggaaacaaaggttggaatcatcacaattgaacaatgaagaaaacaatggagaggaggaggaggaagacattttgaacttctactgatgggacactacccggcaaaggtgtagaattgacagaaaataaacttaaaaattttatttttgtttttcctgggatggaaaaatgtgc

SEQ ID NO: 37352 - DNA, 1302 bp, Heterodera glycines
ggtgtgatgtgctgcgagtgtgagtgttgcagcagcagcagctcgtttcccctctccccattctctgccagtttcccaccgtatcgatcccctcgaaagattcaaagaaaatttctaacagaaaattttcaagaaaaaatcagaaaaatttttcattgtttttttgtaaaaaacacgattcccttaaattttagatggataaaacgaaatcttaccattttactgttgctaaacaaatggaagcggtgttcaattttgaacaaatggtggtctccgttcaacaggtgtcgtcgatgataaaattgcaattcattcactcattcattttaattttcagatggtccaagtggatgccaaattggacaaaaatgagcgcacattccttgcacgggcttacaaaaaattgatcgatgttcgtcgggaaacctggcgttttttctgtaacatggacgagaatccgcaggatgccgacacggaggagcaaaagcaggtggaaggcgtgatgtcagcggacaatactttttaatgttttttccccttttacaggccaggaccgatctccgtttgaaaacgcatgagggattgctgcaactttaccgcgaatttttggttagttttggatttttgttggtttctatcactttgtttcatttacaatttgaggatgtcattaatgaaaagctcctgccaaacgccaacgacgaagaggcgagtgtgttctaccacaacatgaagggcgatttctaccgagaccaggtcgatttgttggaggaggatgaacgtgccggtaagggtttttgtttcgtttgtttcccgcaaaaattttcattcactttcagaaagtttgatcatttcggaaaagtcctacgaagaaggctttaccattgccaccacaaagttgaaacggtccaatccggttcgcctgggcttggcgctcaagtacgctgtgttccaatttgaagtgttaaagttggaggaggaggcgcgtcagctgatgcagaaagtcaactttttgttttccttttttttgttggaattaatttgtaaattattgtaaatttaggctcttgaggatgccaatgatgaactttgcgaaaaagaagcggcaggggacacggaagctgctcttctgctgatccagaagcaattgaccgcgtggaagccgaagaatttcgctgaagatgccgctcaatgaaaaacggatgatattttgttgctgtattgtcatcgatcattaattaaatgtagaaatgggagtttaaaattgatgttaacttgttgaataaatgaacaatcaccatt

SEQ ID NO: 37353 - DNA, 822 bp, Heterodera glycines
atgaactaaagaatttcattatctatatgatttattgaaactgagtgaattttagaaaaaacaaaattaattgaatgaaattaaatgaaagaaagtttaaaaattttgcgctcaagattttctatggcaaaatcattggcaataaaatttttgctaatcgcttgtaactggcccagcaatggagctttacttttaattaaatgacaataattaatttattttacgtttccatgactatattaataggatgtctcagtttaaggcacaaaatggacaaataggcagcactcaaaaatcccaattaaattaaatattttaaatgaaaatttatatattttttaaaattataatgatttttgactaacataataacactattgtacacgttttctaggaaaattttagctcatttctcagtgcttagcaaaatagtaggcgttttggcgccgacgtttttgcgccaacccaagtttttgggctctaacttgttttttgttgttaaccaaatccgacaaacttgatatcatacgaaagcttaacttgtttagaagctatttctaagctattgcttagcgaatagacaattatcaaaaaagttataacatgaaattgctaaaagtcggtttttgaagttttttcttaatacattttttaccggctaccggctataaagtcttttcgctttttgtaagactaatagagcatgtgaaggtctttcgaatgataccatgatcaattgatttggtcgacaaagaaaaaagagttataatcaaaaaactgaggatgacgccaaaacgtcggcatccaggtcaaaggggaggg

SEQ ID NO: 37354 - DNA, 785 bp, Heterodera glycines
atatatatatatatatatatatatatatatatatatatatatatatatatatatatatatatatatatatatatatatatatatatatatatattcaatttttggattttaacttttagtttgataatattctatcggtttttttcttattgaaaaattttcactttattttaaaagaaatttttctacataatactgaattgcgccccggacattgcgccccagacatttgtgcctatgtccaaaatcgggctcaaacttacattttttcaacttagaagtcttaaacagcattaaagttaagaaaacaaagtcttttggtttattaagaaaaaataataatgttgctagagaaatttattattttttcaaaaatttgttgtcgttaaattatcgcgcatacaatcattttcaatcgcttatttaaagcagtttagtcatctgggattgaaaaaatgtaaatttgaacccgattttggacatatgcgcaaatgcccgaggcgcaaatgtggggtaaccgtctgtcaccaacggggtgggtttagaatggtttgtaccagggatgggccaaattgaaaaataaaaagcgaaaagcgaaatttgcgaaactgaaaaatgcgaaatgaaaaaaaagcgaaatgcgaaaagctaaaatatgcgaaaatgcgaaaggcgaatgcgaaagcaaaattttttctacaactttttaatagttaaaatcataaagcaaaaatcataaaaatcaataaaacgcttttttgaggcgcgctttttccaaaaatttt

SEQ ID NO: 37355 - DNA, 998 bp, Heterodera glycines
cagttgctaaatcttaaaatttaataaatatgctatgtatatggaataaaaactcgttaaatttaattggttgcgaaaaaagatggcaattttttcggaacgaatcagacactgaacgccaaaaaacggtaaaaaaaattttttaggggtaccgtaaaacggaaaaacatcatttatggcaatgatcaacaccagaagaagtgatcagcagcagcactttatcctttcaatgtcggaccctttcaaaaaacaacggcgaccgaaaaaatccgaatccaaaaattgttgccaattttcgctgttttttggggttggcgaatggcggcggagtgccattctttacgtgtccacgctgttgttgtgcctgctgtgcataagccaaaattgtgttgcacaaattatttacgacagtccgcccgttggcgtttcggtgcgtgccaattttgaaaaattcgggttcggacaccgcagggcttttcaccctgtggtttttcgaccgactcaggctaaaacgggactgaaaaatgccgttacatggtcaaacagttcctcctgtatcaatttctcatggattattcacctccccctctccagaatttttttttaaatttaaaacagaatttttcaaaaaatcggaaaattcttccgcgattttttggaataattttaaaaaactttgaaattcatcctaaattttgcagaaataattttataaaattttcttatatacaaattttataagattttttgaaaaatttctaaatttgaaatttttctaaatctttcgggacggggagggacaagctgtttgttctccatttaactgctggccaattttttttttggcattttttggcaaatttttgtgggatgcaaccatccacctaaaactcagttgacacgacctgttctgccgtggcttgcacgttactttgtcggtgccggtgaccgtgagctgcactttttggacgagcctcaacgcggactgaatcggccgc

SEQ ID NO: 37356 - DNA, 1564 bp, Heterodera glycines
cagcagtttccctgcaaaatttggtgagcttctgatcagtctagaacgttgggtgataaaatgaaaaaaataatttaaaaaaaataatgctggtgtggtaagtgtgaagaactgtgttcctccaggcaaaaaattctaagaaaatttataagcatttgtagggttctcagcagtttccctgcaaaatttggtgagcttctgatcagtctagaacgttgggtgataaaatgaaaaaaataattaaaaaaaaataatgctggtgtggtaagtgtgaagaactgtgttcctccaggcaaaaaattctaagaaaatttataagcatttgaagggttctcagcagtttccctgcaaaatttggtgagcttctgatcagtctagaacgttgggtgataaaatgaaaaaaataattaaaaaaaaataatgctggtgtggtaagtgtgaagaactgtgttcctccaggcaaaaaattctaagaaaatttataagcatttgtagggttctcagcagtttccctgcaaaatttggtgagcttctgatcagtctagaacgttgggtgataaatgaaaaaaataattaaaaaaaaataatacttgtgtggtattaattcataaatattttttttcagaaaatgctctgaaacgcaccaaattttatttacatgttagtttaggcactctgatgctttttctatcaaaaagggagatgaataaattttaaaaaatttttaattcctttttaaacaggccaaaaagtttaggcttaacttttttttcagaaactgatcagaagcgcaccaaacttagcagggatactgaaaggaagagaaataacctattttaaatattatctagtcagttcatttaaataatttttatccaaaaaaattttttttttggatttcggggcagtaccctgaaccgatgcgcccagatttatggggagaccgaatccttcgggaatagcttccctatagcctgtactttaattctgcgttggatttttgctccccataattgtttgagtaccccaaacggacacttgaaaaaatcgatttatttttgttttcggggcagtccccccgaaccgatgcgcccagatttatggggagaccgaatccttcgggaatagcttccctatagcctgtactttaattctgcgttggatttttgctgcccataattgtttgagtaccccaaacggacacttgaaaaaatcgatttttttgttttcggggcagtccccccgaaccgatgcgcccagatttatggggagaccgaatccttcgggaatagcttccctatagtctgtactttaattctgcgttggatttttgctccccataattgtttgagtaccccaaacggacacttgaaaaaatcgatttttttatttcataaatattttttcagaaaatgctctgaaacgcaccaaattttatttacatgttagtttaggcactctgatgctttttctatcgaatagggagatgaataaaatttttacaaattttttattcctttttaacaggccaaaagtttaggcttaactttttttcagaaactga

SEQ ID NO: 37357 - DNA, 970 bp, Heterodera glycines
  misc_feature (30)..(30): n is a, c, g, or t
  misc_feature (884)..(884): n is a, c, g, or t
tctattttgtaaaagcgaatcaaattcctnttggattccaaagtggaattacagaattgcgacggcaaatcctaaatagacaacgacgctttcatcataaagctttaagggagacaaagtaatacgaatatttcaatttcttacttatccgaatagacaaagataggttacacacgaacatttttatagaaattctggctgaaactaaaatccctcttttggtcttaacctatgatttttggcccattatggatgaattaagtatagaaggcgtcgcagaaatacattcatattttctaaattcgggtttcagaaaattaagatttaaaagaggctaaattacagatgcttttcaaattttgggtgtatccgaatagaaagaagttggaaatcagtacttttcacgcctataaaattcgggccgaaaaatattggtgtttgtgactagaaaaatagcagatgcatatcaaatgactacagaaaattacagcctccaagaaaataattgctttgcacaagcaatattttgtagagcccatcaaacacattgtgcttataggaaaggcagaattaaacaataagggcctttttattatgattacaacaaatcagcatggcgtctcgctgatatggtatgtttcagttaaggtttagccgatctacaaatttcggcactgtctattttgtaaaagcgaatcaaattcctttggattccaaagtggaattacagaattgcgacggcaaatcctaaatagacaacgacgctttcatcataaagctttaagggagacaaagtaatacgaatatttcaatttcttacttatccgaatagacaaagataggttacacacgaacatttttatagaaattccggctgaaactanaatccctcttttggtcttacctatgatttttggcccattatggatgaataaagtatagaaggcgtcgcagaatacatttcatattt

SEQ ID NO: 37358 - DNA, 1173 bp, Heterodera glycines
attctgctgatgaaggattttaagtgatcggagagaatgatcagtgaatgatggggagagaatggcaaatgatcggagtgccgaaggaagaggaggaggaagaggggaattgactgaatgaggggacgggggcatcaattacccattcaaatggaaatgagacaaaaatgtacagggaagtgccttcttgactaatgtcctcataatgagcagggcaaattcagtggcattggcacttaaaagagttggcaaaaacgacgcgtgggatcaaagaacagtgccgagggggcaaattagggaaattagcaaaacgaaaagaaagattgatgcgcgaccaatgaatcatttagtaaataaaaggaaatccatgtaaaagaagcacatcgaaacagattggcccatgtgtccaaatggccaattttggcacttttgttacgatttatagggggaatttattccaattttagcaacacgaaaaggaagaggagaagcactttcacgaggagcacagtccctaattgacaattttctgaatccctttagagaattattaataatcaaatttggcacatcggaaaaaagcgccgaaaatggagaaaatttgtgggattttattgtgaattaccaatgtgtatattaaaataaagcatagaaaccagggctgggcgtaatgacggattacggaaattatgggggtttttggacccctgtcattacggattacggaataccgtaactgagaaaatcgctgtaattacggattacgaatttcgtaattgaagatccagttacgcccagccctgatagaaacccaacacatattaagctagaattgtgcacaatttccctgctgaatgatttgttgccaaatctaagggattttcttaagtgcctatttgtgccttttttttgcgtgccaaattaaagaaaagtcggcaattggttcaatgtctccaccaaatgacattggctgtttttctgtgttgtttgccacttatttattaattcatttttcgtcccccaaggcgacaaattaattttgccaatgattttgtgggaatttctacttttcctttgcattcacttttacattttttctcatcaaatttgcataaaaaagaggtacattaattgtgttaataaagtaaagaaaattggctaatttttgggggg

SEQ ID NO: 37359 - DNA, 350 bp, Heterodera glycines
tttagtttcgactttatcaacgtgttgtgtttaagttcactggcggtggtacatttggctgtggtgcgacttgattttgattaacatttcgtcggaacaccttttgaaactccgtttggaatgcctgtcgatactccgtacttaaatttattaaaaatataatatattttaaaatttaaaaacacctcgtaaagtacaaaatgggcccatttgatgccgcaccaatgagcaaaggaattccagtgatcgcttgtccgaaccaagcagtgatcggagaagagattgagagcctgatcaacatggcataaagtgccgaaataaaatatccaccaatgttaacgatgataatg

SEQ ID NO: 37360 - DNA, 945 bp, Heterodera glycines
ctcagaaaaatggctatctctttttaggacaatattctatctcgtaaccccgatgctaatccgttccggagagcctcttcaaaattttttccattaccgcaagagctgcggaaattgtgaattaattctcagaaaaatggctatctctttttaggacaattttctatctcgtaaccccgatgctaatccgttccggagagcctcttcaaaattttttccattaccgtaagagctgcggaaattgtgaattaattctcagaaaaatggctatctctttttaggacaattttctatctcgtaaccccgatgctaatccgttccggagagcctcttcaaaattttttccattaccgtaagagctgcggaaattgtgaattaattctcagaaaaatggctatctctttttaggacaattttctatctcgtaaccccgatgctaatccgttccggagagcctcttcaaaattttttccattaccctaagagctgcggaaattgtgaattaattctcagaaaaatggctatctctttttaggacaattttctatctcgtaaccccgatgctaatccgttccggagagcctcttcaaaattttttccattaccctaagagctgcggaaattgtgaattaattctcagaaaaatggctatctctttttaggacaattttctatctcgtaaccccgatgctaatccgttccggagagcctcttcaaaattttttccattaccgtaagagctgcggaaattgtgaattaattctcagaaaaatggctatctcttttaggacattttctatctcgtaaccccgatgctaatccgtccggagagctcttcaaatttttttccatacccgtagagctgcggaaattgtgaataattctcagaaaatggctatctctttttaggacattttctatctcgtacccccgatgctaatccgt

SEQ ID NO: 37361 - DNA, 1035 bp, Heterodera glycines
aaatcaacgagtcatcaaaatatgagacaccgagaatatgtggacatgttccggcaatgtcaaagtgccgaaaggcatttgctaaaagattagtcaaaataattcaagagttgtgccacatagttggttttgattggcaaaaaattgggcaatgttttggccaaagaatgggacaaaatcgtcgaattgatggactcggtggacaaattgggctcggcggaagagctgtgggcagcagtgaagcagaagacgccgatgctggccgatctgctggagaacgatttgtggaagggaagcaaagagcgatggacaaagttcgagggcaatttgggcgacgaggcgaagcagtacaaggaaaatgtgagagagagaatgggagacgataaagcaatgagagagataaggaagagagagtagataaagagacagaaaaaagacgtagagaagagaaatttgagaggtagagaagtgaagagaacctgagagagacaagagacgatgtgagagagagagagagagagaggagagagagaagagataggtagagaagagcaaagagagatatcgggtgagggagaagagagagaagggcaacaaatggggagtggaatgccagaattcatcaattaaatctggcgagatataactccaaagaatcaggcccggggtataattaggcaccaattgggacatgattttgggtactcaatcggttggctaactctcaactcgttcgcaaaaagtatttaatctcgcactttttcgatttttagctactagaccaattgtttccttgggtgtactatagtcaaacccccggaaaaatggcacaattatataccaatcgattcgtcttgacgagctatgaacgaaaaaataggtctccagttgcggaaatgccaaaaaaccgtgttttgaaccggtttaaaactcgaaaaattgagtgaaaagggggcccctttttggtactgaagtgtccattttcactggaactcagttttcccagtgcctagatggcatcggttcgaatttata

SEQ ID NO: 37362 - DNA, 1255 bp, Heterodera glycines
  misc_feature (9)..(9): n is a, c, g, or t
atttataancgttggcaaacaactgacataaacattttttaataaataaatatatttgttttgcagtttttaagaaacgcccatagtggcagtttttaagaaacgcccacttggcagtttttaagaaacgcccacttggcagtttttaagaaacgcccacttggcagtttttaagaaacgcccacttggcagtttttaagaaacgcccatagtggcagtttttaagaaacgcccacttggcagtttttaagaaacgcccacttggcagtttttaagaaacgcccatagtggcagtttttaagaaacgacctagcaccacaaatagcattataaagaggggggggggggggcagaataaaccgatacaatttagaaatcggcaaaattaagcctatttggaaaattatccgggtttaaaatctgaataatgacatcaattaatttattaaaatgggagaattggcagtgctaatgaagaaaatgctaattagcgaagcacaaaataagaaaaccgtagaaaatttttgttagaaatgacaaattcttcattctatttttattttttaaagtgaattgtgagagagacttaataatttgccaaaatgttctgttgtatttctcggtggtgcggaagtgtaaaagatcaacccacggtgggactcgaacccacgacacctcccataacgcgggatgctctaaccactgtcttttttttcgtggataccttaagttttgcaaatgcattggtcagtcgaagctttatcatctctctgtcattggcccgaacattaattaaccaaagaaatgggacgatcggtggattgatcactctattaattgttagggttctgtcggtcttcgctctttctctcttcacgtgatgtttgcttcttttctgagtttcgccgctctctcttctgccaaagatctctcgccgttgtccgtctccatggccccgggtcttattcgggagtgtatgaaatgtctgtcgtccttttgtccggtctttggactgtgcgtgtttttcgtcgtcgtcgtctctgctggagctgatcttgttgctcatgtggtgttaatcaaatcgccgttttgttcttctttgtttgttgtaaagaaaatgccaccatcccaagttgttcagttgtgccgtttttggtgccgttctcttcgctttccctcccatttcccctccggcaccgctcagtagcccggcggcgtgcgcggctgcgggcagtggtcgcaagagccgggctcg

SEQ ID NO: 37363 - DNA, 974 bp, Heterodera glycines
ttaattcgtcattggatttcgaagttctctgctggaactttcaatttatagaaatgatttatcaaaaaaagacaattttaccccaaacacttcgaaatgtatttgatttgcgttgtatgggctaaaaatgataaagaatgagatttttgggaatttttatgcaaaaacacacttattttttcaatttttaacacatattttagcacatattttggcatttttgggggtttttagcacatatttcagcattttttagcacatattttattacatatttcaggatttttagcacataaaaatccgggccctatacattacagaggggttcgagattttcgaattcttgcttaagagcctgcagatttgaattttggcactcaaacccggcattagttaacagattttcccacacgattcgaggatattatctaagaaattagttgtatttttgactacattccagcaggagatatttgtatagaaaaagtgaaagcgataaatttttggcaaaaaaatcatacaagtcttatttttattagttacttcaattataaattttgtatatgcaaattgtatattcatataaattcatgtgtacaataaatcatgtagaaaattaattaaaaagtactgtcgaaaccaatcattgtcgaaaacacctggtacggaaaataggccctaataactcaaaaagtagcttaacaaccataaaaaaggagctcaggaaaaaaataaataaaaaccataagccctaacatcaaatacttgattattagggctaggatttttatgtttttacatattttttttgcggcttagttatggcgagagaagcccaaaaatagcattttctccgaacaatttttgatttagagcgacttataaaaacataaaaacacatattttggcgttttgtcacataaaatatgttagcacatatatggggtttggcacatattttgcacatattttgg

SEQ ID NO: 37364 - DNA, 719 bp, Heterodera glycines
  misc_feature (9)..(9): n is a, c, g, or t
agaatttanttgccttataaataagaccaaagttgaaatcatttttaaaaattaaaaaaaacaacaaatgattacgattgcaactacagtatggcgcaaaatatttgatcataattttaaatacatttgtccgtttttgcttttgtaacggtaaaatcaatggctaacgtcactttgtcttcttttttgttgtataagcctttggccgggtccatcaattccttaatttgcaacaatttattaactaattaggtgggaaagtttattgttcagttataccacacccactcaattcctgtatttcctaaaaaagagcctccgggggctttcttttcaccccccccccccctcaaaagggggctttattcaggggagagggtgggttctaatttagggggggctgtattttgagaaatacggaagtcacaattttctaaggtgctgaaatgtaagtttgaaaaaattaactttatttaaatttcaaccaaaatttatgaaaaattttcataacgaaaatcgcgtttgacgcctactaggaaaaaaagaagatcaagcataactcaccgaaaaagcaataaaattaggaaatccggagttggttgaaaaattgttaaagacagtgtctcgagcaaattctcttcggaagtcccaaccggcgccaaattgggagacaattcgaagagttgccgaacatttgcagctccaattttctgctcaat

SEQ ID NO: 37365 - DNA, 875 bp, Heterodera glycines
attttagcttttatgttttttttcttttaaaatgattgtacgtacctaattgccgaaaaaattcaagaccaatttccgaatgttgaccgactaattgcaaaacgaaatccgtctttgtcaaagcgccttaccgagtcaaaaaatttggaaatgtatctcatatgcaatttcaaccaataaatttgatgaaattttgcactcaatttttaaaaagttatgtccatattttgacatttttgccttttatttccatattttgagatttttgccatttatgtccatatttcgcgatttttggtccatatttttggcatccctacttataacttggtgaatactagagcaaataaaaccattttatgctcattttgaagggaaaattctggagaatattgtaagttttatttggtttggccttaaatccacacggcgattcaattttgggctccaatgagacgggggtctgggcttcgagtctgcttggctacgttttattttttatgacacttgatgaaaatcatagacaaaatgaaggttcatgcataatcagagcttagattcgtgatcagagtattttttaaccccaaattcatgcttaactttaaaaaaaataattttaaaaatcgaaaaaaatcaagtagttgacaaaaaatcttagataaaatcaatgattttcaaaatctgagtcagattcgtgatcagcgcattttttaagctcgaacaccggtttcgccacaaattcgtccatcggtctgaagctaaaaatatttataaaaagaaggaaaacaaatgtgagagtgggcttcgtcagtacgagatctctcacttctagaaaaaaaagttctgtttcagccctgactcgtatacagaacaaa

SEQ ID NO: 37366 - DNA, 695 bp, Heterodera glycines
ttgttttataccaaaatgggtcgaaattttttggcactttttgctggaatatttaaatagcactataatttggtgcttttcgtaaaaatgtatctcctggcccccaaaaaagtgccggaatgtaaaatcctggcccccaaaaaagtgccggaatgtaaaatcctgacgctagaaaaagatttccgtacgaatggaaacctgatcgggcccgcaaaaaaatgccggaatctgaaatcctggcccccaaaaaagtgccggaatgtaaaatcctggacccaaaaattgtcgaaatgagacctcctggcgccagcaaaaagatttccgtaagaatggaaaacccgataggatctgcaaaaaaaatgccggaatgtgaaatgctgtccaaaaaaattgccgggcccgtatccagaaaaaaattgcgagcgaggagggcacccgaagagctttttttttttgctcttcgggccaaaacattttttgcaccagtgttattttcaaaatctgtagcgccggagccaaaaaacaggaaatagtagcggttttgcgccgaaaaaccacaaattatgtctttttgggctcaagctttaaaaaaataatggtccagttggggcccggcggtgccgacgacagaaaaatttttggaaaatgtgcaaaattttcagaaaatttgcccatttctgccttgaaaatttttt

SEQ ID NO: 37367 - DNA, 1053 bp, Heterodera glycines
  misc_feature (989)..(989): n is a, c, g, or t
taataataaaaaattttttttaattttttttgaaccccaattaaaaaagggaaaaaaaattccagtcaaaaaatttaattggaatttctccaattttgtttcccataatttcagagggtgggtgggtatcataatgccaaaacaaaaagaaatcgttttaaaatattcctttctggacttgacttggtttcttgatatcgaagctgttttctacgctatttctaaaacggttataccaaaccccagatttttgaatccggttttcagaaaaaatgccttgtggtgaaaacaatatttcacatttcactccataactttgtgagttcggcacggatcgagaccgggataagaccattggaaagagcagctcgagctctacaagaaggtatggaaagaaaaaatagttatttctgggactttttcagaaatcagaattaattctccaatgtggcccaaattttaggcccccagccacagccctttgcttctcccagttttaagtcttggatttgtcaaataaattcaagacttcaaattaataatcaaaaattctcttaaaatttttttgaacccaattcaaaaaaggaaaaaaaattgcagtcaaaaaattattcgaatttctccaattttgtttccataatttccgaaagttattcggtatcataatgccaaaacaaaacgaaatcgttttaaaatattcctttctggacttgacttggtttcttgatatcgaagctgttttctacgctatttctaaaacggttataccaaaccccagatttttgaatccggttttcagaaaaaatgccttgtggtgaaaacaatatttcacatttcactccataactttgtgagttcggcacggatcgagaccgggataagaccattggaaagagcagctcgagctctacaagaaggtatggaaagaaaaaatagttatttctgggactttttcagaaatcagaattaattctcccatgtgggccaanattttaggcccccagccacaggccctttgcttctcccagttttaagtcttggatttgtcaaata

SEQ ID NO: 37368 - DNA, 1038 bp, Heterodera glycines
cagcaatattgacttcaaacatattttaaaactgataaatcacacgtatcagtgcgctgtatttttaagattgtcaaaagtactaattgcgtttctcttattgctttcgtgtgagatttttcttgatgaaattagggaatagaatggtcagcaatcaatttcagacgctttttgcaggtttaacgtataaataatgcttttccagcgattgaatataatcacaagcaatttcaattattgccaatgaagctttgcaagaaaaatgatgttgacttctatgcgagggtttattaaccatgaatattgaaatttttattgttggcgttcatgaaccagtttttcaaaacagcaaccgggccaatttagaactcgcactacccagcaatattgacttcaaacatattttaaaactgataaatcacacgtatcagtgcgctgtatttttaagattgtcaaaagtactaattgcgtttctcttattgctttcgtgtgagatttttcttgatgaaattagggaatagaatggtcagcaatcaatttcagacgctttttgcaggtttaacgtataaataatgcttttccagcgattgaatataatcacaagcaatttcaattattgccaatgaagctttgcaagaaaaatgatgttgacttctatgcgagggtttattaaccatgaatattgaaatttttattgttggcgttcatgaaccagtttttcaaaacagcaaccgggccaatttagaactcgcactacccagcaatattgacttcaaacatattttaaaactgataaatcgcacgtatcagtgcgctgtatttttaagattgtcaaaagtactaattgcatttctcttattgctttcgtgtgagatttttcttgatgaaattagggaatagaatggtcagcaatcaatttcagacgctttttgcaggtttaacgtataaataatgcttttccagcgattgaatataatcacaagcaatttcaattattgcctatgaagctttgcaagaaaaatgatgttgacttctatg

SEQ ID NO: 37369 - DNA, 687 bp, Heterodera glycines
  misc_feature (679)..(679): n is a, c, g, or t
ctcattaaaattccaaaagccgatatgacggatagaatttctaaaaattcaacaaaaggactaacaattatttcttcccgtgtatccaacaagagaagcagagaatttcatttacggttcctgatttactcattaaaattccaaaagccgattggacggatagaatttctaaaaattcaacaaaaggactaactattatttcttcccgtgtatccaacaagagaagcagagaatttcatttacggttactgatttactcattaaaattccaaaagccgatatgacggatagaatttctaaaaattcaacaaaaggactaacaattatttcttcccgtgtatccaacaagagaagcagagaatttcatttacggttactgatttactcattaaaattccaaaagacgatatgacggatagaatttctaaaaattcaacaaaaggactaactattatttcttcccgtgtatccaacaagagaagcagagaatttcatttacggttcctgatttactcattaaaattccaaaagacgatttgacggatagaatttctaaaaattcaacaaaaggactaactattatttcttcccgtgtatccaacaagagaagcagagaatttcatttacggttactgatttactcattaaaattccaaaagccgatttgacggataaaatnttctaaaa

SEQ ID NO: 37370 - DNA, 768 bp, Heterodera glycines
tcagcctcggcaggtacaaatgtatgacccaaatgtgagcaatgattacggcggatggttaactaatgcttaacccccccccccccccccgacccttttccgagtccccgacttattcattttttccccgtccctttcccccgaaaaagggcactccggtgtataaccgagtatgatcattaagaagataagacttcgggaattctatgatcaaattccatttaaactgactcgggctccatttttgtaaatttccccgcccccattctttcaactaacctaatcccaggccaattagctaattgttattcttaatgtgcctgtctattgttagatgaatttccttttcaaagcttttccttcgctgatttttgccccattttccaacaaaaatcacacatattttttgtgcctttgtccgtgataacgtcttttttttgtttgtttttgttttttgaattttgtgcccaaatcgcacttccatttccattgcgcgttcagtgtctaacgcacttctggcaaaccattcgactttgctgatcaaccaattgcaaggtacggtagcgagcccatcagccgctgctagccaaaaggtactgtaatgtactgtcattaagtgcaaattgtcttttgcacacaccaagattggcaatccgaggtcccaaaaaatttcggaaaaccaatttccgacctcaaaaatgtcggagatcggaatttccctgccatccctaggcacatcctcctcataaatatggcattttaatgacg

SEQ ID NO: 37371 - DNA, 790 bp, Heterodera glycines
  misc_feature (776)..(776): n is a, c, g, or t
ggtaccggtaccgctcaaccctacttttttcaaataattaaatttaatatatttataaattatgtacaaaaagacacttaaggcgtcgaaatgcacccgagcagcagttcatcgccaaaaataacatcaattggacagcaaggtaatgtggaaatgaatccagtttaaaaattggccttaaaaatttaaattgttgatattccctacagaaagaaatgtctgacaaatcaatgaaaattgctaattgttgctttaccactaaagcttttgaaaattgccgagtttttagcaaaactgccaactttataacaaaaagaaatcgtagcttttcataaaattaaccaaattaattattcattagcattcgatatgtagcttaaggttccaccaattgttcagatttaagtgaattttgagttaaattctgaatttaaggaaaacaaaagttaggaattctccaattatttattagtattattaaaaaaattttgagagccaaaaacaccaaaacatgaggctaaaaatgcagcgacaactgtcgacggttgtgacggaggaacgacggcgacaacgccgaagagtacggcgaattcgcaacagcaacaatctgcagaaaaagagaacaatcggagcagtagcaggacgagaagcagcagagagaggaagaagcagaatagcagtggagaggaagagggcgacagagaagacgagaaagggaaagacagggagaaaaacggtaggaaaagaggcgagaagagggcgagagagtggatggngtacacagtgaggg

SEQ ID NO: 37372 - DNA, 1120 bp, Heterodera glycines
aaaaaatatttacgatttgggaaaatggctgacccaagtacgaaattgagatggcatcagcaaattcgctgacctgctccatcgtgatgcccaacccgtacaggttgatcgcccgctgatgcttctcctgcatctccacgctgagcattcgtttgatcattggcgaaacggacataagccaatgggcagaaatggccaactgacgatcgccgatgtgcacagtcaaatcgtcgtccggcgaacaaattggcgggcatggactgagtaaatggaggggggcggggatgtacgaaaaaggatcagtaccatagccagataatttcggagtaggggcggaaggctaactaccattcccctcaaagcgagttgcgttttttacgagtaaaattttgccgcttttaaatttttgataagatgacctaaccaaacggtatcttttgccaaactctttcttttttcccattatttttgttggagtttcccattccaccaccggcatgagcctgaggccaaacaaatacggcaatttggtttacatttaataattaactgtattacttttcgatcacttcacgttttttgagaaatctgatcacaagagaaattggcaaatttgtttcaccttcagcaccaattgttcctcttttcttcaggataaaggtctaaaattggtgcctaatttagaaaagaaattagcaacaaataaatcaattactactttttggatggtctgtgttccctgagaccatttccacaaaataatttgcgccaacaattcggaaccgttctgcagtgaaccattgctaatatcggtgattgtcaaaaattctggcccataattattataattatttttgtaatgccgatttttcgtgaattcactaaatttagtaaaagtcttattttaaaatatgaaagctttttacattgcagaaaattgggatttgactttgagaattgaagctttattactacagcaattcgtggtaaaattgaccattttttcgtcaacaataagataattattgtaaatgtccatccatctaagccagttttatttctaaagaaaaaaattattgaaaaatttcctaataaaaatttaaatataacataaaaatgt

SEQ ID NO: 37373 - DNA, 1013 bp, Heterodera glycines
aaatatgccaaaaaatgtagcctttacttttttagtgaaaattcgatcactcatattttttgctaattgagcagaagcgtaccaaactttgcagggatactccccggtaaaggactaacttacactgaaatgagcgccgagctagctggctcaaaaaaattttcgaaaatctgagtctttcgtttttatttattttttgcaaaattaattcttaaatattttttcagaaagggttctgaaacgcaccaaattttatttacatgttagtttaggcactctgatgctttttctatcaaaaagggagatgaataaaatttttaaaaatttttaattcctttttaaacaggccaaaaagtttaggcttaacttttttttcagaaactgatcagaagcgcaccaaactttgcagggatactgaaaggaagagaaataacctattttaaatattatctagtcagttcatttaaataatttttatccaaaaaatttttttttgggttttcggggcagtccccctgaaccgatgcgcccagatttatggggagaccgaatccttccggaatagcttcactatagcctgtactttaattctgcgttggatttttgctccccataattgtttgagtaccccaaacggacacttgaaaaaatcgatttatttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagatcgaatccttccggaatagcttccctatagcctgtactttaattctgcgttggatttttactccccataattgtttgagtaccccaaacggaacacttgaaaaaatcgattttttttgtttccgggggcagtccccc

SEQ ID NO: 37374 - DNA, 761 bp, Heterodera glycines
ctcaacactcacatgaattccaaccacattttcggaatagtagcgacgaccctaatttttctggattttctttctgggcgagtttggctctgaaaattttgaaaaaacgtctatctctttttctgctcaacactcaaatgaactccaaccacattttcggaatagtagcgacgaccctaatttttctggattttctttctgggcgagtttggctctgaaaattttgaaaaaacgtctatctctttttctgctcaacactcacatgaattccaaccacattttcggaatagtagcgacgaccctaatttttctggattttctttctgggcgagtttggctctgaaaattttgaaaaaacgtctatctctttttctgctcaacactcacatgaattccaaccacattttcggaatagtagcgacgaccctgatttttctggattttctttctgggcgagtttggctctgaaaattttgaaaaaacgtctatctctttttctgctcaacactcacatgaattccaaccacattttcggaatagtagcgacgaccctaatttttctggattttctttctgggcgagtttggctctgaaaattttgaaaaaacgtctatctctttttctgctcaacactcacatgaattccaaccacattttcggaatagtagcgacgaccctgattttttctggattttctttctgggcgagtttggctctgaaaatttgaaaaaacgtctatctctttttctgctcacactcaa

SEQ ID NO: 37375 - DNA, 1014 bp, Heterodera glycines
cgcagagcaatgcacattctattctacagggattttgtaccatacaaatgttcccagcatgggcagagattctcggagagcaatcagaaaaatggttatctcttttttgcgagaaattttgtaccatacaaatgttcccagcatgggcagaggggcgcggagagcaatggccattctattctacagggaatttttaaatttattctctatgccagaaaaatggctatctcttttttgcgagaaattttgtaccatacaaatgttcccagcatgggcagaggggcgcagagcaatggccattctattctacagggaatttttaaatttattctctatgccagaaaaatggctatctcttttttgcgagaaattttgtaccatacaaatgttcccagcatgggcagaggggcgcagagcaatggccattctattctacagggaatttttaaatttattctctatgccagaaaaatggctatctcttttttgcgagaaattttgtaccatacaaatgttcccagcatgggcagaggggcgcagagcaatggccattctattctacagagaatttttaaatttattctctatgccagaaaaatggttatctcttttttgcgagaaattttgtaccatacaaatgttcccagcatgggcagaggggcgcggagagcaatggccattctattctacagggaatttttaaatttattctctatgccagaaaaatggttatctcttttttgcgagaaattttgtaccatacaaatgttcccagcatgggcagaggggcgcagagcaatggccattctattctacagggaatttttaaatttattctctatgccagaaaaatggctatctcttttttgtgagaaattttgtaccatacaaatgttcccagcatggcagaggggcgcagagcaatgtccattctattctacagtgaattttttaattattctctatgccagaaaatgggtatctcttttttgcgagaaatttgtaccatacaaa

SEQ ID NO: 37376 - DNA, 1343 bp, Heterodera glycines
  misc_feature (55)..(56): n is a, c, g, or t
  misc_feature (872)..(872): n is a, c, g, or t
  misc_feature (879)..(879): n is a, c, g, or t
atttggtcaatgtaatccaagcaatgacgagagaattccttaaaacaaaaatttnngttttaattaggggttgctctggagtcaaattgaaaaaaaagtcgggaaaggatggaaaaaatctttatattttgacaaatgaaaattttctctatcagaatggccccatttgataaatgggtccccgtgaataacaaaaagtcagaaataaatttaatttcccatattaatggtaattagggtaattaggtccctctaattattaggataggccgggtccgggtattttggcaaataccgagtccgggtattgcagggttcagaaaagtcgggtccgggtacaagtatttcaaccgggtcggggtccaaccgggtcttgaaaaaattcaaaaaaaaaaaaatttttttttaattaagtttaaataataagaatttattttttgtgtaaatgttttaaaacccaaattttacattttcgttgagaagaagagcctggaaataggcaaagaacacatttggcaattcattaattgggaattccaaacaagctttgaccagcgaagagacattgtatttatttgctaaaatattttaaaattaaaaataattattattcaaaatgtatttatttgctaaaatattttaaaattaaaaatttcaaaaatatttttacccgcgtaaagcactgccatggcattttctccgttcaatccactcaaatcttcagcataaatgaaactgagcatcactttgaaagcattcgcactaatgtcaggaatttctaccgaactatccgttttagcggaaggagctaaaaattaatttaaaatatttgaaaaacatttaaacttttctaaatttttactttcagtctntggtttnttgtcatcaaaacggaacatcgattcgaacacattcgaagcagtcatcataatgcatttgtgcgcttttaaaagctaagaaaatgcaaaataaaattggggaataaatgaaaattccttaacaaaaaatacaataaaaaaaaaatctaaaatttcaaaataaatttttcaaaaattcgtcacctaaaatttgtttgtttttctcgaaaaagtttggtttttaaaatttagctcattttcggtttcttttttttttgttttgattttttgtcttcaattgaaatttgctacttaaaaatcataataaaattttttttatatacctctattttgctgttttttgtgctattttacattatatctattttgaaattttctgtgcctaaaatcattttcctaataattattaattattttattttggagtttataaaaattcttttgtgggccaactcgcctcctttt

SEQ ID NO: 37377 - DNA, 906 bp, Heterodera glycines
aacaaacgctttaaacattcttgattttttgggttttacatatttcgatttgattaaaacggcaatgaggtcacctgaatccgcaaattttgggccagaattacccactgttcccccccccccccaatattttttaaggattccctttgctatccctcccccattttgtcagatgatgttgatccgtctgtacgagtacatgttgaccagcagtcagtgccctcaaagtctgctcgtccacaagcccattctgatgcctttgctgcaattgcttgagtggtgccgtcgctcttcgctggacgaacagcgaatgacaataaatgcgacgaaggagcagcaacaacagcagcagcggaggagaccgatgacgaacggagttgatcgatgctttgttcgactgatcaaccaggtcaagcagcaccaggcaaaatacatggacaaggggcggggtcagaaagttactctaacgaaatgccccctcagaatcagaagccaaaaaatttaacgaaattgaatagaaacgctcaaattttttatgataacttttttcaaaactatttttgcggagctttttttaaaattgggaacaggggcaaactcccagaaaagctttgacatattttgttcaaaaatgagcacattgacggactttggcaagaaaaaatgtcaaattgtctctcatctcaattttcaaaaatggcagttttataaaaaattgtttgaattcagatttgtcgcaaaatcgcggcggacgacacgctgttgcactttttcttccattcgtcggtggagacgccgtgtgattctgaggaggcacagaacggagcattcggcaacagaaacggaagcattggccaccattatgagcaatttgttgagggaggacagggaccagcgacgacgcca

SEQ ID NO: 37378 - DNA, 807 bp, Heterodera glycines
tttgatcaccttctgctccaacaatcggtccagttcttcctctacaaccaaacgtgtgttgtaaggcactggccggggacgacaatagacgggcacagcctcaggcctcaattccaaatgagcctttgctttcgtgcagtgtccaagtccctccacaaaaacaagcggaaattttgtttgaagcgcagccaaagtggtctcctgttgaagaatcggcgactttttcgcttccttcttcaccaaattgacattcatggccttttcaacttcccttctgaaagcgtccaataggccaaaggcatccaacatatcaattcccaaaagattgagtgatcctttcttcgtcacataatattgcccattaattgtttttcctccaaatgaaaaacgtgctgtgccttttcccaaaagcttacagcttgtaccgtcatggtacacggcttgctcattgcagtgggtcagccgaggctttccaatagccatatgtgcgacttcgtccagcacagtcaaatcggcacccgagtcaagcacaaatttgatcggattgtcattcacccagatcgtgacttccatcagtcgtgttgatccatttaggatgttcaccatgaggccaccaattcgcagggcattcatcttcttgcctagctttggtcccttttgctttgtcagccattcatggtgcgcggcgcacatactctgcacatgcccaactttcgagcattttcgacatattgtcttcaatgcggacagtgcaatggggtgtgctctctgccacaacgccaacatgattgctgcttatagcccttt

SEQ ID NO: 37379 - DNA, 733 bp, Heterodera glycines
atcaatttgaaatgaaaaaggtcgccaatgcgaaccctaattggaacaaaaagttaatcggcatttgctaattgtaaatttaaacgaatttctttgaattaactgtgaattttaaaacattttgatttctcattcgaattcggcattcgagttggtctaatgaatgtcaaatttcgtgaccaacgacctcgaaaagccccacaaaattttgcaagttgaaaactccaacaatcgtccaaaaaacaaaaagaaaaccttcaaatcgatgtccattttcccctcttcgtctgtcccagcggccacccgttgcatctgatcaaattgctgatcagtgagccgtgtcggcttctcccctttgccatcgtccgacggaggcacagtcgtagtcgttgttgcatcttcttggcacttttcacattccgtgccggcggcaccgttttgggccgctggcgccgccgcactgttcggcctcaacacgtggccatcggacggaatttcgatgacaatgaaatcgctgtacaaccgcttcagcacacaacgaatttcgccgccgtcaaacgcggacgaattggacgcaaattcagtgaggccaaacattttgaaactccgaatttaatgatggcgctaaaattgaataaaattcttcatgagttttatgaaaaaatgtaagggaaatagaaattgtagtgtttatgccaggagtgtcattcgtccttggatgccaaggacgtcc

SEQ ID NO: 37380 - DNA, 1321 bp, Heterodera glycines
  misc_feature (27)..(27): n is a, c, g, or t
cattatctaaataaacttttaataatnttttttaatcgcatatttaaattaatgaaataattttcaaaattcagagaataatggataatattttttaatgataataagtttatttttaaaaattaaaagtaagcatttgcttttacgtataaaaatttttcttgattataacagaaaacgaattaccatttaaaattaaaaaacctcattttattcaatttctaaatttttattttaaattataattttttttttaaattggcaaatattaattcattcatttgcattagaattattaaatatttaaccaaattgattttaaataaaatctattatgtatataaattagagaccggacaagagggtcggtcgaacggtttcggttaaaaccgaaaaaaaccgaaatcgaaaaaaccgaagaaaatttttcggtttttttttgaatttttttatcttttcccaaaaaaacaataaaccatttttatcaatagaaaaagcgaaagatcacctctgagtaaaattgtagagctattgaaactctattgaatggtgtactaaaggtttggaaaatgatagaaaaggcagccaaaaaacatgtgtttactccttgattataaaaaccgcaaagattagttatagcgatttggtgcttttttggcgttttttcccgaaaaattccattaaaaattcaaaaaaatcggaaaaatacacccctaagaaatgatctaaaaaattcatagaatatacctttatgaattgaacgccaaaattcatttttttcttgataaaaaattttaggtttaaaaatttccttattgaaaaacattataaaattgaattatcaataaatcagcaaaatttagttttttggttagtttttacgtgttttgctccctaaaaatcattaataaaaaaatttaaatgccttttttcatgcctttttcgggatttttgtgccttttttcagtgccattttgcgctttttggtgccttaattgtgagctctagccataactttagggccggcggtgttgataagagccgccgggaaacttttttgtaattttaatgctatttgttagcagattttgtctaaaaataccaaaatttgagattttggctaattttttaagaaaagatagctttttggggggtcggcggtgccgataggcgccgccggaggaaaattttaagaatttttaatgaattttgttaaaaaaatggccaactgatttgtcaaaaaagtcgatcgattgtttcggttttttaattatttcggtcgaacggtttcggttaaccgaaaaaaaacgaaaccgaaaaa

SEQ ID NO: 37381 - DNA, 1430 bp, Heterodera glycines
  misc_feature (14)..(14): n is a, c, g, or t
  misc_feature (54)..(55): n is a, c, g, or t
  misc_feature (62)..(62): n is a, c, g, or t
  misc_feature (147)..(147): n is a, c, g, or t
  misc_feature (163)..(163): n is a, c, g, or t
tttcccattttgtncctctggccgtcaatcatcctaaccaattccatccccttnncatggcntattttgtatttccttcgcattgccattcaaccctttcctatgtaatgtccttctgctcttttcttctcaatttgtggcactatntaagaactcttcccantctcaaaaggcaggtcattctacccataattttccaatctcaggttccctgcctgaagcgatcaaactcactaaaaccttttaactttgctttgcttatttaattttgaaccttcacatttcttttaaacctttttgacttttaataaatttccaaaaaaccagtctttgcctaagaggtgaccgggttgaattaatttgggtaaggacacaacaattttggtgccacgacccgggacgccccttaaacggaagtaaggggaagaaaaggctgaaagccagagaagtgcgggactaaatccgcataacgtgtttggaatttgagctggtctagctgtgtgcttccaaccggctgtgtgccataaccaaaagtgaaaaaggagaagattaaacataaaaaagtttgttcgtgtgctgtgtgctaaaaaaacgagagagaaaagaaagacacgggaaaaaaatggagaatttgcctcagggaaatatccagcgaagtggatcagattttgactcaatttatttttcgcctgaggagaatcggaaatgggccccattactcaaccgaatgcggtcatttgagcaggctgtttgccgtcaatttcggcaaattgacacccaatttgtacagtttttgagccaaattcatatccaaaacatgtctgagcgggtccgagaattggaaagttccattaaagaactcgagaacaccaccgaattagacactttccaggcaaaggagcaaatgattgaggctgagcaagaaattggaagggccaatttgagaatggaatattatgaaaagctgacaaaagtgcgatttggaaaaagtgattgagaaaatgaaagaggaagtgaaaaagatcaccgaaaatttggacactctgcaaagccgtgtacaaattttggagtttgaaatggacggtgaaatacagaggaccgagtggatagatgatggtcattcggtggaacatgaccaattaccacttcacagtgcaaatggaaaggaaccgaatggcggtgaaggacagaatgaaatgcacgtggacgattgtgaaataatgataatggatccgtttttgggtggaatcactcctttggaagggtacgacggaaacccgggaatttcattttcccgttgggtcgcccgatttgaggacatgttggcattatcccaatatacggagacccaaaaattaagcagactccgaattttgttaaaggggcaagcaaggttagagtttgaagccatggagcccccagccgacact

SEQ ID NO: 37382 - DNA, 1116 bp, Heterodera glycines
ttaattttctgctggttgcagggagtaggtggtggctgcctttggagcctctccctggctatgcccttgatcagttttggcaacccatttttgccagttgggggactcctaattcatcgtgcctactttttttatgcctttcatttaaaagtgccggtttttttgccgcttcacggtgttttccatgtgctcagaatgggtgccactctgttcgtgcagccgttggacctggtcaagaatcggatgcaactgtcgggaatgcagggcacccgcgagttttcctcctccttccacgccctgcgcacaatcgtcgcccgcgagggaccgctggcgctttacaacggtctgccaaaaaaaaaaaaaaatttggcattttgtacaatgtcatcgttccctcatccccccttcccaaaaaaagttttttttaattttgtctaaatttgaaagtctgccaccaaattgaatggtcttcattgagtgccagggtcaatttgatggggaccggtaaattggacaccggaaaattggacactgtcggaattttggacaccaaaggaaaattggacactgtcggaattttggacaccaaaggaaaattggacactgtcggaattttggacaccaaaggaaaattggacactgtcggaattttggacaccaaaggaaaattggacactgtcggaattttggacactggaaaactggacactaaattcctcttttaaaatataaacccaggaatttaaatactcaatatgcacaatgattgatcaaatgtggcaaaaaagtgtacaaaattagacgatgattgatcaagatgccaaaaaatatacaaaattgcgtgatgattgttcaatgtaccaaaaaatgcgcaaaaatgggaactccataaaaataaaaacttttttcgttatgaatgtatggtgagttctgcagctgatgctacaaataataataacattatttatttcaattaaaatttttgtttttattctaacttatttattttttatccaatactgtccaattttccggtgtctaatttgccattggtgtccagtattctagtgtccaattttcggtgtccaattttctggtgtccagtttaccgggagc

SEQ ID NO: 37383 - DNA, 930 bp, Heterodera glycines
ttaggaaactacccatatttttttcatcagcattaaaacattccaaaaaaaaatcaggtaagaataactttgaagtgcccatacctcaaaaggtagcaacaccaagttgatcagatgcggttttttgaatattgtagcaaattttgtgctctataaaatgggcctactcaaaatttccagaaaaagttttgcacggaacgaaaacgaaactgaaaactttttgctagccgattctggtacatttttgttgaatgaaaatggacccccgcaacggtaggcaatgcgttttgttcgattcactattactttttttcttaggattttgattttcgggcgcatgtctcataatagctgggccaatcaaatgacagaatgttacgctgacggaagattttcattaagcccaccactatttagaattttaattttaatgcctcttcgaagatttttgtgtatttaaaacctattttgcgattttttgtgcctaagaaagggaatttggaagtgggtcttggcgcccagttggcggcgcccagttgagctggcgcccagttggcatcgcccagtcggcggcgcccagttggcgtcgcccagtcggcggcgcccagtcgacccccaccggttccgcatatattctcccgcaacataaccacctgaagctgtgaagcggtctgtgccgagacgccggttggcgcaagcccactgagcaactgattgattgcggccatttgctgggcaactgctgttgatgaagagccgccgcctccgtggaaatcggtgccggcgccgccgcctcccaagccgaacaacgatgatgtcgagaaggatgatcctgatcctaaccaaatttgaacataaaataatataccccagatccggttttactcatttgaacgcccctcccccctcttcacagggttgtcattttgc

SEQ ID NO: 37384 - DNA, 611 bp, Heterodera glycines
tttgtacggaggaaacccaaaacactggccgaaaaaggatcactaaacaaaaacgagttaatattttattgattaatttaatttttttttaaattcaaaattaattattggcttttgtatttatgaaagccctctctctaaccatttcgtctcttttggaactgataaaatcacaattgaccgggaacggttgaagatccccacttcattttccattctccatagtctaaattattttctttttaattattatttcattctcgcggataagttgcaaaagcgaaatgaaattaagggccatttcggtaaggatacggaggtgaaatggtttggctagaaatgagggcggccatagcgcgctaattaagcgttcatcgactgagagagggcgggattgtttaaatgcttaatctgtgccaaacaataaaaagtaatatttcagtggaaacaattctgtataaaactactgtagatttaatgccaacaattttaaggacaaatgcttgtgtctttttggtgagaaggacattgacttctctaacgaaaatctcacaattgaaatccccactgtaatgaccactccgaccctgacaactctgaccacgaaggaa

SEQ ID NO: 37385 - DNA, 124 bp, Heterodera glycines
atggtatttccatgcattggaatagttgccggaaggatttcaagtagttttaaaatttaaaaaagttttctgaaaaaaattggttaagaaagttaataaataattagtaaaaatataaacaaaa

SEQ ID NO: 37386 - DNA, 854 bp, Heterodera glycines
aacaaaccaacaaagtggctgagagtcggtgctttgccttctcctttgtcattagtcgttaattacccaatcaaccaccgtcggagagtacggtaaatgtccctcatcactcactaattcacccgcccctccgcccccaccccaaccacctcctttttggtgggctgcgagtgggcgtattccgtgcgaatttgtgcctcctcccttctgccgatgcgctgactctccgccgcattgccccgttcttcggcgaccaccaaacgctgcagagaatggctgtactctgaaccggagagaaagagacgacgagttaatgacacacacaaaccgtagtaattaatgactgattgtataaacggaaaaagacggaacgagtcgtttttggatgcaattcattcccctcgcccaaatttttttaaacttttcaaataaaaattttttcttcgtataaaagtttcaaggaaacttttcagcgattcaaaaaaaatcggggggaaacgacctctcaggtcattttcactcttggagattcaaaatttgattcaaaagaaaaacggtattgagtctgtagcaaatagggtgccagttagctatgtactttaaccaaatcattggtactcgaataaaagtataaaatttcattgatttccaattaaaaactccccgccccttttgttacgttttattgcgtttgggtccctctgctgctgctgttgtcctccttttccgtgccattgtcgtgtctccaaatgagccaatttggcctcgtaaatgcgtcggttgcccgcattcattggccccgcaatgcaattgcgccggcgcaaccgctcgcgcagttcgtccagccgaagcat

SEQ ID NO: 37387 - DNA, 1065 bp, Heterodera glycines
aagagagaaattgccgccacctatcagaaaaaatgaccatttgaattgatttgtgagaaacgacacctggaggcccatacatgagcacgcccttcggtggatgaatgccaatctttatgaacagctcctttttggtcattggaagcacctgaaaatgagaaaatgggaagttttgatccaaaattgttttttgacacgtacaatggcctcttgcaactctttgatttgcgtctcgcatccgccaatttcgctgtacgtctccgtcggtctttccaccacttccatggccttgacgcgtcggtcaaaatggggcggcaattttgcgatgatgtgataagtgtcgttgtcgatgccgaccaggtcccccggcttcagctcgtctgggccgacgagaccaatgcgaggcaaaaacatgacgagtcccttcgatattttgatgactgcgcctttcttctgacgcgcgtccaagtcgctgctcgagccttcttctccttccgcttggtcatccgcgaggtccagaatttccacgacattggccaccagccacggcattttcatgtactgaaaatgcttttcgtcataaatttgtcgttcctccttttgtttgtttgctcactttctgcatctgtttgttgttctccttcgtcttcgttcccattgttttgatgttgtacgcaattttgcgcatttcgtccctcatgacgcgaatttcttcgtcgagctgtcgtacgcgttcgtcaatttggtcggaagacatctccagcacttgggcgtcggtctgaaaaattgaaaaaatgaaatgacatagaaaaagaaaatgaaaagcaccaatcgctcaccacatctccggcagggtgcgccatcttctcgttgtgttacgccccgttagtaaaatatgagaaaaatgcatcacaacagcgacttttatacacaattttggacgttttttttttgcattgtgtgcagttgcagtgcgccaaaatgtgcgagtttcctattttgaatatttttcaaattaaatcttaattcagcacgatgatacacaaaatatgagtacggctacca

SEQ ID NO: 37388 - DNA, 1089 bp, Heterodera glycines
tgaggattgagttatttattgattatttttaggggaaaccttttgtggaaaataataattattaaatttaattttaaaatggtttaaccgatgactcctgtggtctagttgtttttctttagagcgttgaaaaatttttaagtgccaattgccgccaccggactccaaaaatctttttttaattacacaaaagccacaaaatttatcaaactttttttgaaaaaaattataaacatattcattattgcattgtttagaatttcttttattacttttaagttttgaaaaattaaaaggaacaccgaaaacttttattttgtttctgatttttttttcaaaaaattcttatttaatttttattgtaaattactaagcctttttgtgaaaaatattttttttttgaaatatatacgcggtaattactctttgttatcgcttaccgtgccgacactaatttacagtatggtgcatatgtttataatcaaagtattttttgtcgtaacttttcaaatgactttcccaatcttaatgattttggtatcaaaaatagcttcatcaaaatctcagttgacttgtttctgcatttttttgaaaaattgagctaaaccggtttaaaaaacatgccatttttcaagtcaaaggagaaaataatatgggaaaatataattctctacaagatgtactatccaccatactgtaactccattcgcattcagcttatttccattctgctgcttaatggtcagcttttcctgcccgtcttctgctgatgcgcatgagacgccccccgaccaaaagcgccgtctgccgcccctttcgcttttccgttgctctcttttggtcacttttggcgtcccattccattacgggtttcagctgacattaatcagccccgtacagcgcgtaatggtgcagtttatcaacgagtccgtccacagtcattacagtgtccggttggaccgttacgatgccgaggtacagtatacggagggggagaggggaatcacacactcttggggtcctctaactgtctgtcctcttctttggtacactctctcccctctccccccccctaataccaaaatggca

SEQ ID NO: 37389 - DNA, 1878 bp, Heterodera glycines
  misc_feature (134)..(135): n is a, c, g, or t
  misc_feature (159)..(159): n is a, c, g, or t
  misc_feature (347)..(347): n is a, c, g, or t
ttttttaagttttttccatttaacgaaattaggaccataagcatgtattaagcaagtaattaatttttttaataaaaaagtattttttttaaaaatggaaaactttcttttttataaaagaaaaacaaatttanntaaaaatttatttatatacgcaanaataaatggctattaattattattataaaaatgaaattataaaactaataaataaattaattagatatacatatttcaatcacagaaatattaatactaggggcaaatcaaataataatttcttaaatgttttttttatattaatattcttacggtttattatttttcagttaaagagtatgaataanctgatgattcataaggttgagtgacctttttaaatgcatcgacgttacgtcgcttagtacaaaaggtgctatgtcgttatataaaaaccatcaaatgaaaatttccaacctaaaactgtccataacttttgttaatgtcagccaaattaaacattcttggtatcatccgataatgaacaaaaaaaagaatgaattttagttttaataaacctatattaaattttttgtttatttaataataagcctgtatataaaacataattgcatttatttaaattttgggttaattttttttaataaaattgtttaaaatcataataattgcatccggtgttagtcaaataactgaaaaatactttttttttaaatttttacaaaaaaactaagaatgaattgaatgaagtaattaatttcttacttggattaaaaagatttaaataaaaatttaaaaaaaaaatcccaaaatatctttctaaatgcataaattatcgagcaaaacaaaaataacttaactaaattgactaataaaaattaactcattttcacaaatgactaaattaattattaacacaaaataaagtaattgttttttaaacctttaattcactaaagaacttattaaaaaatgaatacaaaaatagtattttaaataacgactccgccccgtttagtggtatgagattttttttcaaaaaaattttatatgttttttaataaataaatatttcatttttgaattttactttacactacttaaagattatttttatttttatgcacctgaatgatgagctttactactattttcagttttatttgttttataaataattttttctaacaactaaaaatgccacttcataacaaatattgattttttaaataatatttgctaataaattattctcggcatttgactgtccagtgatatgctgatttaaggcgtaccttttttagggatttttgaattatatatataataataggtaaaattattaaataaaatttttatgttcattttttatatcaaatgcgtatccctgtaatgattacagtcgaatttgggagtttgacttttacttttgagtattcatgtccgtgaatggaagtgttgtcgagtgcttgagcgtttaaattaaaaatgcatttttattgataagttgaattaatttattgttttatgaaattaaactttttataatttttaaaattgtatttcattaattattttcaaaatcatttttatttattttttcttagtgattaaatttagttcttagcgaaagtaaataaaattaatcttatttgttattataataaagatttacaacttcataagaaataatatttaattatttattactaattataccattacgtagaaatatggtgatttaattttacagaaggaaacaaaataaaaattgataaataaataaaactaaaagatcgctgagcatggctgtgctaaatcgaaaattttccatgaaaaagagaatttaaaaaattatataatattatttttaagtag

SEQ ID NO: 37390 - DNA, 930 bp, Heterodera glycines
tcgcccggggtgctgtcggcgtgcctcaagcagctgcggctccacactggtgaacgcggcattggagcgcgtgtccttgtacagctcatccaacaccttttcaatcagcagctcacgtttttgggcctgcacttctgcattcttgttgttgctgttgttgttgtctttgtttggatttttcacgcttagttttctcattgttcgagtgagtgttgtgtgtcaccaaagttggggcttgaacaaaagagcactaccgatccgcttctttccaagcgccgcctttttaaatgtgtgcagcagcagcgcggaagaagcgccgcttccgcgaattttcttccctcttgctttccttgtagcggtaatagcaacagcagcggcattactgcttttgcgtttggtcaatatgcccccacgtccaccaccaccaccaccaccaccaccaccaccaccaccatgtccttcaccgctgatgctgctagtgctggaggtggggaatagcaggtgtgacagctgtggatgctgtttagcgttagcgatgaacgtttggtagccgggcgggggcttgagccgatggtgttgttgtggttgttgggcagatgtaaaatgataggcgagtacggcttgcaaactgctgtttttgatcgggcggtatgcacctttcatgaacttgtacacctgctgaccatcaccgatgcccagcgtgcccgcgtgaagtgacgtgtagtcaagggcctgctgttttcgtcgctgctccgcctcacccaggcgctgagctccggcaacaacgacggcgcctgttgatgatgatgtagatgcaacttgcggctgatgttgttgttgttgctcttcttctgctccagaagctgctgacgtatacgatgaggcagtggtggcggtggtggttcgtttccttttccctttttgtgcagt

SEQ ID NO: 37391 - DNA, 672 bp, Heterodera glycines
tgtttattaattgatagcatgttatgcccctccccattaattggctaattaggataaacgattgccatttgctcaatgggaattatttggcagacacttaaagccatttcaattaacattaattaataatcaactaatttattaatattggctcagttaatttgtaccaattaattaattatacctaattaatgatgttgtgattgcattgacactgcttcgaccaagtgttcaacgactggatagcctggttcaaaagctccgaaccccccatagccttaggctgatcgctgcgacgcgattgagattgggactgatgcgccgagtgggatacttggtgtttgactagtctgtgataaaagagaaagcaatgaaagtaagatgggtcatttgtcgaagcgcccgagtttttccaatgcttggaactgtcggaataatccacgcatttataaacaatcactttgggcgaacatacagagctcagtactgtgaacagtagattacttgtacgctcatattgtacgtgagaatgcgagagataccgacattttgtctgagacaatattagagcgctgtaagtttagcaaaatggcaatgatgcggccattagtcgttcgactctgacgtactgttagcttattgttggccatcacacaagctgatcgattgatg

SEQ ID NO: 37392 - DNA, 1070 bp, Heterodera glycines
ttttaagatttccggttccgttcttttagcccagcgcaatcttcaccagaacggaatttttaagattccggtcccgtactttgccccagcgcaatctttactggcgcgggatttataagatttccggtcccgtacttttggcccagcgcaattctttactgtcgcggaatttataagatttccggtcccgtacttttggcccagcgcaattctttaccggagcgggatttttaagatttccggtcccgtacttttggcccagcgcaattcttcaccagaacagaatttttaagatttccggtcccgtacttttggcccagcgcaattcttcaccggagcggaaatattaattttccggtcccgtacttttggcccagcgcaattctttaccggagcggaaatattaattttccggtcccgtacttttggcccagcgcaattctttaccggagcgggatttttaagatttccggtcccgtacttttggcccagcgcaattctttaccggagcgggatttttaagatttccggtcccgtacttttggcccagcgcaattctttaccagaacagaatttttaagatttccggtcccgtacttttggcccagcgcaattcttcaccggagcggaaatattaattttccggtcccgtacttttggcccagcgcaattcttcaccggagcgggatttttaagatttccggtcccgtacttttatcccagcgcaattcttcaccagaacggaatttttaagatttccggtcccgtacttttggcccagcgcaattctttactggcgcgggatttttaagatttccggtcccgtaccttagacccagcgcaattctttaccggagcgggatttccggtcccgctcgcgctcccggaaacttttggcccagcgcaattcttcaccggagcggaaatattaattttccggtcccgtacttttgggccagcgcaattctttactggcgcgggatttttaagatttccggtcccgtacttttggcccagcgcaattcttcaccggagcaggatttttaagatttccggtcccgtacttttgg

SEQ ID NO: 37393 - DNA, 934 bp, Heterodera glycines
  misc_feature (782)..(782): n is a, c, g, or t
  misc_feature (861)..(861): n is a, c, g, or t
  misc_feature (877)..(877): n is a, c, g, or t
  misc_feature (886)..(886): n is a, c, g, or t
tttataatttaaattaaaatgatataatcattcaaggattttcatctaaactttggtcaacacgaggaacaccagcagcccgtgctcggatcaaatttaacacaaaggaagcccaatccggttaagagtgaaatttaaaggaaaataaattttaatttagccaaaaaaccgatggagcgtaaacagtgatttcttcctaataaaacccaatcatttgaaagctgtgtatcgcgcaagaaagaatggtagcaacaataaagattaaaattaacttttttaaataaatttaaattcagccaatcaaaatttgtatgccaaattcgtgctcttcccgcatttggccattgtctattatgaaaccaaaatcataaagaataacagaaacatcaggtaagtattgatgttcgatttttaaagatatgcaaaggctggttgaggttgaccacatcctatggattggggcttttcagtgtttgctttgttccagaggaaatgaaaattttattaaaattccgaggaaaattgaattttttataaatttactttcattctaaaaaattcctttctaatatgtagagaggagagtaggaatctaagaaattgtggacaaatttaaaaagctgaaagtcggcctttggtattggaagccgatgctgatttgaatttgatatcattaggcatttacagtaccatttcgattggaatttggacaaaatccgacgacaccttttacaaatattcaaacaatggcttcattttcggacacagtgccactggcttgngcggatatccatcttttgcagagggcgacacaatcggatgcggcgccaatttaacatcgatggaaatcatttacaccanaaatggacaaaaattngagtgaganatattaatttatcatgaaattaagcagatgaagactatttttagacac

SEQ ID NO: 37394 - DNA, 861 bp, Heterodera glycines
gttaaatgacccgggtcaataagaagatagttcgtggtagtttgacggaggttggtagtcaaaacggtacttcgtagtcattttcttattgacccggtttaccaccaacttcgtggtcatttgaccacgtcatttaaccaccttcttattgaccgggccctaatcacttatcatattagcgcaccctaattgatcataaaaattaaatattaagagtaatggtgtgaagaattcaaaaaacaaagttttttatttgaatatttgttggtcatatcttttttaaaacataatgaataatttcctatgattttaaaacctatctaatttctctctttagcttttaaaattttataaccaaaaatattggttttttcttttaacttttcagtaacttaacgaaattttttttaatttcttgactaacagagcttcaaataatcccaaattttaaattcgctaattagtttgcttataaaaaagtgtcgcttcgctttaaggtgaccgcgttgaagtcgcgttgcgaaacgcatctgatcaattgcgtggaaattccactgatcgaccgtttccttctgattgatcgctacggacttgaccattttaaagtgattactaatcaaatatttattttttaaaataatttttaatgattcaattatagaattcttttttccatttggatgtcaacaaattgcgtgcctttttcgctgcgaaccatgaactatttttgcctattatcagcaaagaattttttgtacgctttgtctgtccgagcattggccgggctttgatcaatttgattttggcatttcataaatgttttttttgtacgaaatcttcattttcaatgggagaattgtt

SEQ ID NO: 37395 - DNA, 839 bp, Heterodera glycines
tcaattagattccactggtcaaagaaagcagtcgccggaatgcccctaaaatttaagttttttattttggtctcaaaatcattttccatgggttttcgggggttgctttatcacgaaactaactcggacttgctcgattacgaagtcctaattcatgaccatcgccctcgaaaatccccggaacctgattttgagagcaaattaaaacatttttaaatagaaaccccaattcttcaggattgccaacaattctttaccgtttcccgatcgcttccgtctcccattttgtccatttgctttcgtctcgcgcaattggacaacgcactaacaaaaaacgatagcaattgtcaattcttttcaacgcaaattgttcccgagtcaattcgttggtcagcacaaatggcacaacagagtgttgagcagacaaatgaaaaaacgaaatgacagcgatgaaattggcagcagatgaagccgaggcaaaagcctgaaatgtgcgaaatttgtaaaacaattaaatgaattaatttggttattaccgctttcaatgctgcaattttcggcgcccaattccatgttctgtcaagagaacaattgaacacctttggcacattgtcaggtcggggagtgaacagccatttggccaaagcttgcccatccgatgccgcggcattgtcatcggccggaaattcggcgaagatatccacaaaatgggaaaagacaaagcgaagagatgggcaatcgctgagaaatgaggggaccaatttgcgcaaacggcggaaattttcgtcggacaatcttatgctttgaatgtttttttcgagcagtggccaaatgttgtg

SEQ ID NO: 37396 - DNA, 1209 bp, Heterodera glycines
atgagatagtttttaatgtctaaatgtttgctgctgaaaaactatagttaaaattttatttttagggttttgtatagagtagagcaggaccgggacctggtactgaaaaaacgtacaaatgagtaccgaggtcccggttttggccgggaccggcaaaagtcccggttttttcccggttttgcccaaaaatttcccggtcccgctctactctagttttatttaaaagaagttaaattttattttaaaaaattgttttcaatttattttattataattttaaatttttttggttttcggtgaaacgccgagcagagaatgaaagagacaggaaagggaaaaatgtatccataaaaaatttctattaaattaacaatgagagagagagagagagagagaaaaggagagaaaatagtacattaaatgttaaggaagagaaatggcagacaactgagagagaagcatttgtttgtgcgctttctcttccccttttacaccccatcatcaaaataaagtaaaaacatttgagttatacaaaaggcacagaatttgggcaggaagtgcgatttgctcgttgacgccgtttcccgctttggtcacttgtattatgtactgtattggaatgtatttaatacgcatgtgtactgtattatgtttattgtttcgcctggaaatggcttctgatcaccgtctcgtcagaagacggagcggttgcattcggttggagtcgacttgagcaaatcggtcttttttgcccttatcacacaccatttttaaatttaaaaaaaaactatttaaaattgaaatttttatactttcatttattaaaaaatcttttactaattatttattttttgaatttttaaatttttcagaaaaatttattttgagtgatatttgaacaagtggcattttgaatatgtatggtgaaaattattgaaaaagatgtaaatttaaaaatatatatttaaattaattaattcccagctaggaaaataattcttgaaaatatttaaatagaaattgtaaaaaaaaagattttagtgaaaatttaaaaaatcaattttaatgaaaaattaaaaatcccccattaaatttccatttaaagtcatttaaatgaaactttcatgccacagaaattccaaatctatctccaatttactgaattttctatgagaaattaaaaaaatttttttaaataaatatgtaatg

SEQ ID NO: 37397 - DNA, 748 bp, Heterodera glycines
ccgcgggggatttgaaaaaaacacaagaggttaaaaaaacttttaagggtcactttcaacttttagtcgagcgcactcaaactttttgttagtttttcttcggcattctcggatttctttttgcgtaatttttgtttgcagaaaatggatgacggatgcccggaggggcggggggcgaggcggggcttaaaagaaaaagctggcctagtgaaaagggcaaattcgcgaacattatctcctgctgaagcctaagcagagggcatttgttaagctatacgattataaaaatttgctaaattctagccaatccgtgtacattaaattcggaatttctacccaaccgtaagttacttaaatcgtatttcactacccaccctaagtccttaatcttaatttttacccaaagtctttaaattatttttttaatccggtcttcctaataataatgaaaatttgcaacgacaaaaaatattcaaaacattaatttgcatcattttttgcctttcctctcctcctctgctgttgttgcatttgaatttaaatccttccgccggtggcactgcgcactttggcattttaatgctcaccagtgccgacagcaaacactaaaatgcttattagtctagggtcacataagccttattcccctgtgggtggcatcattttgtcatcagaaatttagtgagaatatgattcacttttcgttgtttaagtgctgccttggattgaataatttcccaccatttaa

SEQ ID NO: 37398 - DNA, 889 bp, Heterodera glycines
gcgcaattgcgaatagatttattgatttgccatgttatttaagtgattttacaaatattacagaatgcgcattgaaaatattcattccattacattcggccatttttaaatattatattactttttaatttttaatttaccttaacattttaaagggcaaaggcaattaaatttcaaaatgaaaattaaacaaaaaagagagaaattattgttttgcaatttatgttttttcatttttattattgccataaacaattcaaattttgtgtccggaggcaaaaaccaaaggataaaacaaaaaagcaaaataacggaacaaaaacaaattgtgcagcagcaaaagcaaattgagacgaatgagcaaattgaaaatgaagcacaaaaaacggtggaaaaaacgcaccaatgccccgaaaagcgaacaaaaggcaaaaatgggaggacggcgaaacaatcggcagaaaaaatgggtcagaaaaagggcgctcccggacaatccgacagtgagaacaatccgacaaaagagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggagtagctttcctatagcctgtactttaattctgcgttggatttttgctccccataattgtttgagtaccccaaacggacacttgaaaaaatcgatttttttgtttcataaatatttttttcagaaagtgctctaaagcgcaccaaattttatttacaacctcaattttagcactctgatgctttagtatcaaaaaggaagatgg

SEQ ID NO: 37399 - DNA, 931 bp, Heterodera glycines
  misc_feature (825)..(825): n is a, c, g, or t
aaattaacaaattatgatttttaaaattttctcaaaaaggatttttgctcttttcaaggtccgtcaacaagatgatcaggaagcgggcgctgcaggacgtgttgcggtgatgaaggagccgcgttcacgtgccgacacgctgccaccccagcatccaatttgcacactgtcactcacgctgcctgactacattggaccgttgccttgcatcagtgcgcaggctgacatgcaacgtggtgacaaacagcagccaccggacggcggtgcaccacgcgtgccgtcagtgagcgaacgttacgcagaggcgctgcatgcaaacctggccgaggcatacccaaacgtgccgcttgaactggtggctaaacgaatcggcggagactggtaaatcctgaaattttttgccactattttggcattttttggtcactttctgccgttctctttaattttatcgtctctccattttatttcttccaccgcttcccattttacttctaaatattgataaatatttatcccaacttttgacaacaacatctgctggacaacaacacatcattggcacatcctcaatcccccacaatattccacatatttcgtattcccatagagcccaaaaccacccctatttattagtactataataccacgaaaatccgaggggtttttttcttttcttgagtcgagactcttgaaaattgtttccccaatttttgttttcttcaaaattctgatattttataaaagtaaataatattatttttactgttgcttgagaattaagatttccgagactcggcaatgatactacaaacatccaatggnggttttttgagtcgagactcttgaaaaatcactgtttttttttaccggtttcccttatttttttttcagggctcgtctcgcccgtgtgctcggccttcacccccga

SEQ ID NO: 37400 - DNA, 1015 bp, Heterodera glycines
taaaaattaactttttgtgcaaatttcgtcaacaagtcttagaaaattataaaaaaattttaaatgccccatttttggcttaaatcagacaacaaacaagcaaataaattgctaaaaatggcaaagcattaaaacaattggagaatttaattttgttggttaaaatgaaattttagaattattttaattgcattttaaaaacttcttcatttttcccctaaatatgttttgttgattaatttgaaacattcatcactttttcttatttatgcaatttttaaaaaatttttaagggccatgacgacgcattttcagtgatcacattggacagagttgttgaacagttcttccgctggcgcttaatgcttccacgcgttaaggtaaagaaaaatgaatggatttgatttgatttgattattaattttcactaaataaaataaattattttatttataataaacaacatttattttttttttacattaagcctttctacgccgtcaaatgcaacaatgatccaattttattacaacttttggctaatttgggatgcggtagaaattaaatttgcactcaatttaaaaaaaacaatacattttttgacaggttttgactgtgcaagtcgtggtgaaattgaatcggtaatcaaaaaaatctatatatttttttaaattatttttgtttataataataataataatttgagattgtcaaaaatggtttgtgctccggggacaacattgtgtacgcaaatccgtgcaagacacggtcatacattcgtcacgctgaacaaatgggtgaataaaatttaaaaaatatatttttaaattcataaaattaaaaaatgggggagagatgagtcagcggccaatttgagaagtgatcccagccaagtaaattgaccacttttttttttgctttcgaaaaatttaaaatttaattatgctgatttgttaacaggtttagtctaaaaaatgaccaacgccgatgggaaatatttttgggattctttgaa

SEQ ID NO: 37401 - DNA, 935 bp, Heterodera glycines
  misc_feature (841)..(841): n is a, c, g, or t
  misc_feature (897)..(897): n is a, c, g, or t
aaagcctttggcatcgattatagacaaaatcatcggtttttaattttaaatgccattttaatttcaagatattcaaaaataggaatgattgaaagcgaaaaatgttattaattaaaaaactaattacggcctaatgttgttgctttaacgtttgttttcgtttttctgttcgagtgcgttatttttatttcggtttcaaaaaaattaatttagctaatgttcctcgggttcattttgatgaaaagctttcaaaagaattaaaaaataaatttaacaaaattattcatttaaaaatttatttatttaagtgaaaccaattttataatgtaatattgatgccgacggcacattttatgcgctatgtgctgataacaggtaggatttaaaaattaaatataatttttaaataatttataggaatttattgaagaatataaaaaaaaatttttttttaaaaaaataattaattttaggcgcaacagatggaatcggaaagcaggcaagcaaatgataaaattaaaaaaaatatattttaaattgaattttaataattttctaatattttttactttgaaaaaattgaaaaaaaaattcagttagcttatgagcttgcatcaaacgtagaagaaaattttgtgattgtgcacgggcgttcccggcaaaagtgtgaggaaacaattggttggctgctcagcgggcaacaccgaattggacacaattcactgccagcagcagctggcaatagccattcaaatgtggactttgtgacagccgatttctcaaaattggctgaggtaatcccaaacaaattttaaaaatggacaaaaattaaaaaaattanatatattatgccagtggaaaaaaacaaatggaaaacgagcattttaaggcaattanataagcgatttctcaaaattggctgagctaatcccaac

SEQ ID NO: 37402 - DNA, 1562 bp, Heterodera glycines
  misc_feature (1493)..(1493): n is a, c, g, or t
  misc_feature (1497)..(1497): n is a, c, g, or t
  misc_feature (1554)..(1554): n is a, c, g, or t
gttgaaaatctggtttttttgagttcttcttgccataacttttttgaagcttaatgaaatttttctaagttttgtagactaatagaggacatttagggctttctaatgttaccaacaatgtttgatttggttgacaaagaaaaaagtttataaccaaaaacgtgctggcgcgcaactgaggggttccgacaattagagctaaaatttcttaaaatggatctgcgccactttttttggcatttttgcgccaaaggaactggcacaaataggaggcgcgttatttttgttgttttttttaattcaaatctaggcgccccaaaaccgaaaagtatcccaaaaattacattatgttgcaaagattttgccgaaattttaatttccatctgcttcttccattggttcgatccgtatttaaatgatgccatttgatgtgatggaatgccgcggcattcattgtcagccgaaagggatttgtcaatttggaaataacaaataaacaaaatcagaaataaattggcgagctccattttatcgctacaataaatggaggtaatattacttatcactagggcatagaaaaatatgtatataaaatcgcaaaatatggccatgaaatatggaccaaaaatcgcgaaatatggacataaaatggcaaaaatatggacataaaatggcaaaaatatggacataaaatggcaaaaatatggacataaaatggcaaaaatatggacataaaatggcaaaaatatggacataaaattttcaaattgagggtgtaatttctcaaaatttcttcaaattcgctaaatgtaaggtaaaaatttcaaaaatggccaaatatggtattaaaaatcatttagatgaaaaaaacaatgatagagctaaaatttactcatatttagacgaaaaatcaacccaaaagccaaattttcgcttttttgcttatttttgacataaattaaccatttttaagaaaatttaaatttattcaatattttcaagaaaattttgctaaaaaatgattttttgggaatttttccaatctttaggggtcaaaaaggtcaatttaactgatggggcggttctaatagaggttttctggaaaaatgccaaaatatggacataaaatatggataagaatgccaaaacatggacataaatcgcgaaatatggaaaaatatggaaaatatggatatagaaatccatcctagaagcttcaaaccaaactaaaacatgtttttcatgcgtttcaggccccccacagtccaggaaaaaaatatggatttccatataattggaagccctaattatcacatcttttttgaaatttattttttatttttgaaaaaattcataaagacgtgcatctagggggttttcggagtcgttgatcacgaatttgaccctcatttcgtgcaattccgaatcccggacccaaaatcgaacaaaaactcgaacgttgaaattttcgaatttttcttttttcgtctaanatgngaattttcggaaaaattcttaacaaaaaatgaacttacacccctaagaatcgacccngaaaattt

SEQ ID NO: 37403 - DNA, 1330 bp, Heterodera glycines
  misc_feature (23)..(23): n is a, c, g, or t
  misc_feature (82)..(82): n is a, c, g, or t
tccaaaaaaataaataacgaatntaggactaataaaaaaaaatcgtaggcgtaaaaaaactctatttgttttttatcgtatntaataaataatttactttattgttaacttaggaaatatggtaaatattttaacagtgatttatttttattactagaaaagtaaaaacacagaatttatcaatgattttttctttcctttaattaattcgaataattattttagtttatatttttgattaatttttatataaattatttgttaattttccttctcaatcctaatttaaatgatttataaacagggatcattttttatgtaaatacatatttttttgctgtattctacgtagtctaaatagtaggaaaaatactttcttttttgtgtttgcgaacaaaagttgggacttttatttacatattttcggatttttctacatattacatatatacatatttttattgatattttggactttttcgtatatatttcgcttcgcaatttttcgtacatattttcattttttttacatttttgaggatttttgagaatttctagaaattttttgtgaaaaattaaaaaaaaatttttttgaaaatgtatccctaaaaaatcgatttttatttaatgagatattaaaaattaatttaaaatataaaaagtgattctaagcctagctttgtggcatttgtgcctattgtccgttatttcaccatttaaaggaattgtttccaaaaaataacaattaaaaaattttgatttacatattttagtacatattctgggtttttttacatattttaacatttttttatacatattttatttacacatttcacgatttttcttacgtaaaaaatgatccctgtttataacattagaagaaattattaattgagcagtatttgacagaaaaaaaccaaaaagttttttttattcccgaagaaaataataatttttattatagaattcatctcacatttaattttgggttttagaatataaataacgaaattaatttaagtcaatattaaattattttcaatatatttagtcaaatgattttgaattgtttaatttcggcattattaaataataattgtatttgttatttttctattctcattaaagtgatacttttttattaaataaaatttttacgacatattaatgatcatttttttgggtaaattttatatgaaagtacagaatgttataacttaaatgattttttcctttataatgaatatttataattttaaaaatttagggtgctcattttgcagcatttaatgctgatttggtttttctggattttcatttgtatact

SEQ ID NO: 37404 - DNA, 1439 bp, Heterodera glycines
taataaatgggaaaattaaaatttaaaagggggggggggggtaattaaaattcgggtaattaaatgattacaaattcttacgcccgaatgcttttccctctgtttcagaggcattcacatcaccatggatcagccccaattcgctgcttcgttttccccttattacggatgggacactcacaccgtaaagggatgcgacagaaggggacaacagaatgagacaaacaatcgtaattaagcattgttaattggttgatgattaattggtaattgcattcacagctaatcaattgcccataacggaactgccgccgacatacgcacaagtgatcggacaaaacgcagaacagcagcaaaggaatgagcagaggacaaatggacaagaacaaaggagcacaatcgaacaacaaagtgatcagcagcagggacagtgatcaaatggaagaaaagggaaagtgatcaaatggaagaaaagggacagtgatcaaatggaagaaaagggaaagtgatcaaatggaagaaaagggaaagtgatcaaatggaagaaaagggaaagggatcaaatggaagaaaagggaaagtgatcaaatggaagaaaaagacgagaaaaggaaagtgatcaaatgaaaaagaaaaagacgagaaaaggaaagtgatcaaatgaaaaagaaaaagttgtcaaatggaagaaaaagatgagaaaaggaaaagtgatcaaatgggagaaaaagagacactgatcaaatggaacaaagatagagaaagagagtaggaagagaagttgcagggacacatccctttcacctttctctttacttcatattcaaattgtaaattatttaatgattctgtgacaagactctgaaacatttttgctatttagggcataatgatcaattaattgttaattgagcacagttgaatggttcctccttctctgatcagtgagtggtcgcgcacctttagcttacgccagggctatcatagcataaataatgaaagataaacaaacaaaacggaatggagaaaaggggataattgtggtggtgattaattatacgacttttcctaattagaatcgttaattgtcagaaatggaaagcgaatttagcaaaatgaaattcaattttcccacacagaaatatttagctcgactctttcgactgttatttaacttaattactttaacccatttttctgaaaatgatttccgatttgtcccctaattcaaaagtagcaaatatatataacaaattcattaattactaatgttaaatgaatatttcaatttaaattgtattgataatttatgccctcggaaaaaataaataaaaatttatacattttcttcaagaaaatatttaaattcaatcagtttaacaccaatggatttgtttctccccccccccctcttaaatcggatattgcaatttgctcat

SEQ ID NO: 37405 - DNA, 1067 bp, Heterodera glycines
caccatcatcgcccataaatactgctctcttccctccttcctcgcttcgggcttcattcattctcatttatcatttgcatttcaccccacacacacactttttctctctcttcacctctgagtttatttatttgtttattgattatatttgttgttgttgataaacgacacaacaattcttcaaaaattgccgaaatgagggaacatactttgctggacctcttaggtcaatagcctttttaacccgtacagaagcagcttgatagttggccgcgctctcttcaatcggtgcgttgcctaacgcgtcctctgcgcaatcctgcataattttaggccacgcacttttctgcataaataagttttatattaaagtatttagttgtgaattggtatagcgcccattttaggtggtctatggaaaatttgtttattttacttcaactcaatatttttgggccaataaatctgaaaaaattcttcataactaacttttgatacagtactttttgcacatacaaaatttgaaatgcccataccttcgggtattagtcgtagggacttgcggtcttttgggtattgtagcaattttgtactctttccaatgggcttactaaaattgcgcaaaaattttttaacgcctaggattttttcctaaattctcccatataactgatcaacatgaaggagtgatctgagaagaagcattaaaaggcatcctgttagagtcgaatacaatctagaacccgaaccacgtgctcaccctcgaaaatccgagccggaagagtcgagattctccctctccatattagataaccttggcaaaaccttaagactgatttagaaggttggacaacaaaaaagggcccaaaatctcagcttcgttgctaactaattagttcattgtttaatcttatattctggtttatcaataaattgatcagttttttgttcacctgacagcacccggtttgtgccatcagtgtcgtcatgtctccgactgtcttctcctctcggtgattccattttggccatacgaaagtcggctgcctaccgatggcatttcaatt

SEQ ID NO: 37406 - DNA, 697 bp, Heterodera glycines
ttttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgattttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggagtagcttccctatagcctgtactttaattctgcgttggatttttgctccccataattgtttgagtaccccaaacggacacttgaaaaaaatcgatttttttgttttcggggcagttcccccgaaacgatgcg

SEQ ID NO: 37407 - DNA, 1185 bp, Heterodera glycines
ttatgccattcaaacggcccaatgttttttattgtgatatttcttcacatgtcctaaacatttctatatttgtcctttgtcagcagataatcattaataatacctaacattctcatgttgcaaatttatgtatcgtaaatttctcgggcctccagaaagacaatcctcttggccagaatcgtcttgttttattccaaagcaatcctaatacgtcgatttttcaaatatcttcattggtggttcattcattttagtctcccccccccctcccctaaattagagcccccctccctaaaataaagcccccctcccttgaagagggttgagaaatatagccccccccccttaaattagcccccccccccttgaagagggttgagaaataaagcccccccccttttgaggggggttgagaattgagaaataaagcccccgcccccttaattagagcctccccctaaaataaagcctcccttttgatggggttgagaaagaaagccccccttttgagtggggtcgagaaataaccccccccccccccgccccctaaattagagttccccttttgaggggggttgaaaaatagagcccccgggggctcttttttaggaaatcggtattagttttttgttaactcctttccatggatttgtgtaaattttatgctgaattcaaaaagtaaataaataatttagccctaatttttatgttttattttagggaaattttgatgctcaatttgggtgtccatttttcttccaaaaaaaacctttaaccaatatttctggtcctaaatctcttctgttttcctcccaatgaatgaatgacctgttcgagctcgtcctttgccacattgttctttgccattttgcgtgccgtttttccatgctttgttccaatggcaaaagcaacacagaccagtaaagcaagcaaaaattttggggcaaacatttttgggaggtattttggaaagcaaaaatttcaagtttttcgagtccgaatgagagtgattggcttcgctgtctccaaccggcgtatttatatgcaaccgattgcgggtgccatgtgaaaagcagcattccaagaatttgacatttcattatcgccatggcattttctagaaaaacagaacaaataatagcataaggctgatattttgggccaaatgggcaaaaacacagcaat

SEQ ID NO: 37408 - DNA, 1420 bp, Heterodera glycines
  misc_feature (1387)..(1387): n is a, c, g, or t
  misc_feature (1397)..(1397): n is a, c, g, or t
  misc_feature (1405)..(1405): n is a, c, g, or t
aatgatggcattaaaaatttgacaaaaacttttctctacattaaaagcattgtaaattcgccaaagagtaaaagtgctaaaaatagattgacagaagaaaatggcggcgcaatagaaatgattgaatttgatgatgatttaaaaaatatgggaaaccaaagaggatgacatcactctcaaacggacactgacgatttcatgggcaattgggtgtggattgactgatgagtagggcacagatttgtatggatttccatatttttttgcacacttatttcggcctaaaaacacgtaaatagtatttttagcttggtttgatgcttctaggatgcctttttatttccatatttcaggtttttgtccatatttccctattttcatacatattttagcattttcattaaaaaagtcgaaaaaataaacccctaaaggtggaaaatttttaaaatacgccaataaatggaaaattttgaaaaaaataccaaaaattgtgcaaaaaaattcattagcaactcgcttaaaaatgattttttttttacagaaaattactaatctttgcaatttttttctaaaactttattcttataacaattaattcattaaatttcaaatctttatacgaatgtatctcgtttttcaagaaattctgattcactaacgcttttccactgacgcattttaagaggtgaactaattttggccggttcatcgacctaaaaaaatttatgtaagcgacggctgcatattttatttatttatttattcaaaaataaaaataaccaaaagaagggcattgctgccgcttacacttgaggtggaaatacgagaggtcaaatgggtagaagtgaaagaagacaatttacatttggtaatgaaatgaggtcaatgggtagttgtgacattattgttgaaattttaagcaaagggaaattggtttttataggaaattgagaaaaaatttttgggtaaatttttaggaaattgtgtagagatattttttttttcgatttgttggaggtctgcagaactatttatcgaagcactgggggaattgttttcgaaatgattccagttggaggagaaatttgtcaatatttgagagtggatttggattttcgttttctgtgattgttttgtcaacctgcgatgattttgaagtgtcttcactggcctccttcggttctggtccattttctttggcaagagtcggaacatttgtctgtggggtttgtattgctggtgccaccggagctttctgtggcttagttatggcgagagaagcccaaaaaagcattttctcctaacaattttcgatttatcgatttagagcgacttataaaaacaaaaaaaaaaaaaatatattttggcgttttggcaaaagaaaaantatcgcacantatttcangggtttaacacgtat

SEQ ID NO: 37409 - DNA, 884 bp, Heterodera glycines
atcaatttatatattcagtattcttctttttttcaagccaaagtcgccatgcggcattgtcaggtcgtctttcgcgtgctccagctctttctgcgcgttcccttccaaaatagaccaaaaaggtgtagagcatgccgaccatcgaaaagaagctaaaaactcctatttagaataaattgttttctgatctgttctaacgagatcgagcctcttccccgcgcaccgcgtcggtggtggagacccccgtaccccgagacccaaaaaacccgagactcgagacttttttcaaaaaattttcctattcgcttaaaaatcgttaaaaacattttttgactctattcttaactaatttttgtttttttttttaattttgattcaatttggcacaatatttatcatttcaaaaacgcacaaaacaaaaattcattaaaatttaagtgcaatttgttaactgatttagtccaaaaaattaaaatattttacgaatttaattgttaaaattatgattgaattcccactgaaaaatgaataattttgaaaaattagaagaaaaacaactacttggaggggaattacttttttgaatgatcggccgaaagacttgttctttttgcactatatatttgtgaaagttgactgaaggtcctctctgatttcatcaataaacacttcatcgctttgctcattttcagccggaaaattatcagaaatttccggatccattactctaaaaaagttcaaaattaaggactacaactaaaatatgtgtgtgaaacgaataaaatatttcatctttatttattggcataatgtcaatatttttccataaaaaattctcattcataagctcattttcttattatgaaaagcctaatcattagggg

SEQ ID NO: 37410 - DNA, 983 bp, Heterodera glycines
tgatttttataaaattagacgtaaattggatttgtaatgaaaatgataaaaatatgaattaaaatgaataggtgaaaaatcaaaagaattttgaaatttttgtgcttaatacgaataaattaaatttcaaattaaaaattatttctatcttttgcaaaagtttaactaaaaagcttcgaagaaatgttttgtaaaaaggaaatggagtaaaataaatttaataaatttaaatttaaaaaaaagaaaattgaaatataaataatattactgtctttggaatgttttctcttttttttgcagcattttcttaaaaaaaaatctgaaaatgccaaaaattaataaaagcttaatagtcttaaccaattattccaattccaatgaataaacttttcctgccatttcaggcatgtttagcgaatttgaggtcaattatttgcgcaatttggccaatcaaattgcccaaaacgcatatgtggcaaagccgctgacagtgcaaacaaacattcataatctgacaataacattggcaatttttcgaaaaatcattgccgagcttgaaactaatcccaatgtgttcatattagacagcctgaaaagtgacaaagaaattgcaacaaattttttgcatctttgcgtttcgctgttggacgccaaatttgaacactttcagaaccaagtgttggcacgtttaaacgaatttgaccggatccgaaagggcattttggacggctaagggcaaagctcaaaatccaaataaacaaatttggttgggaaatttgacaaaatccgacaaactagttgatgaataaaaagttgttgattatttttattatttgaacgtttaaaaatgtttatttcatatgtgattgtgttgtgtctctatcattttactacaaatttacgataaagacaatttgtgaataccgtgaaaatatggtccattttgaagtaatcctttaatgtttgacaaaactttacttatg

SEQ ID NO: 37411 - DNA, 987 bp, Heterodera glycines
aaaatgaggataaatcctgagatctggcaaccctgattattatcctattttattctattattgttaattatttttgttatatttattttcattttaaatattataaaaattgacttttcattttaaatagcaataacaaatgcataccaattttgtatttcatttctccatcatagacgttcgggcaaaatttttatgtgcatattataaaatatttcttttcttttttaacttgtgccgcccaacaactagttttcaattgcatagttaatgatgctcgcccaaacttgatgaggattattcctttaatttctgatatatatatatatatatattgcattttttttgaggtttaattaattttttgaatgtatttctctggcttagttgttgaatttttccgattgggattattaacttttttttttgcaatgtttttttttttaattttatttataaatttttgattcgcggtagatgatattcaatatttaaaatcatattagtttttaggttcattgtcacttttttttataatatataccaaaattcgcctcaaatatttttgagaccttcatttatttattaaagtgcacgtatcacgaccatcgtgaataaatttttaataaatctgaccattatttttgtaattttgaggttatggatttatttagaattatttataaaatatctcgcctgtctcaagtcgaccgtggtttttgttgaccaaaaacataaacaaaaattttggatcggtttaacagaaaactcattttagagatatcggattaatccagcgtttctattgaaaatttttcaaaatcataacatcaggcttcaaaaatcagattttgggatcaaaaaatcagattttttacaattttttttgcggcgtatttttccaaaatctttgtaaaaaatacatccctaatgatttgcttatggtaaactttaatttaaatatcattattaactttttgtttttga

SEQ ID NO: 37412 - DNA, 935 bp, Heterodera glycines
aaaaaacaaaaattatgcgccaacctcataaaaaaaatttgcgatagttttaaaaaaaaatgtttttatcaaatttattagctttttattcgtctgtattcccatttttacgaatgttttacatgttcaatattttgccagatgatttttggcgagacgcccttctatgccgagagtttggtggacacgtacggcaaaatcatgaaccacgaggagatgttcgagttcccggaggacatcgacatcagcgacgaggcaaaggacctgatctcgcggctgatttgtgcccgcgagacacggctcggcaaaaatgggctggccgacttccgggaccatccgttcttcgccgacatcgactgggagaacatccgaagcggtcggtaaaaacacagagaaaccaaaaaaaaaaaagcgtaattttctcgaacatataccggaccaataataactggaaaaaattgtaggggaaatttcaagtttttttttctggcgcttgcccccccccccaaagtttttaatattttaaaaaattgtgttcaaccggcgcaggtcgtccccccccccccctcccgccatttcgcttgtgaaatattgcaaattaagaatatttgcaaaaaaaaaattgttaggaatatttttccgtaagaaaatttcaagaaaaaaaatttgaaaaatttttcagcgattagtggaggcgcctttgcttttcctcaccccttaaattggcgtaaatttttaggcccaaaaagagtaatttttgaatacctatttttggaccaaagcaatttttttttaaaataattttaagaatctacaggaaatataattgtaatttttaaatttctcaagaaaaagggtatattttataacaaatcgttttttattctttttaaagagcaccttttctatttttttctaaaaattaaaaatttatt

SEQ ID NO: 37413 - DNA, 1497 bp, Heterodera glycines
  misc_feature (34)..(34): n is a, c, g, or t
acgggggaggtgaagaagtaatagcattggacancacggcgagaagagacaaaagtattggaaggactcagaaaagaaagacgaagaaggaccatttgaatgtcaaaatataatctgaaaaaaagtgagagaggaaaggcaattgaaactccaaacgagcatggcattaattggcttttaaatcatcattgaaaaataaattaattttgagttattttttaaacaaagtgccaaataaattcaatttttcacgcattttgttttgcttctacaagtacaaaaatatgcttgaacttgttgaacatctctttaccttttattattccatttaatccactggcactttgctgatttctctcccgttccttcaaaaaacaaagggccgggggggggcttttttcgttatcagcaactccaaaaaccctgtgaagatttattatgacaaagaaaactttgcaaccataaggggtcccattttgtttaataaattcaaacatttttcgggggagtccatttgcaaaaccattacatttttccgtttacagcactaaacacatggtagtgacctcagcattggatgatctgcagaggaaagcgcgtcttttggaaaatgaaatcgatgctcaacttatttctctgaacaagttcaatccttcagacggtggactcattatatatatttttaatttaatttcaattttataaactggaccgatttcatttaaaatttgtccttttgtttttgttgaattaaatgttttccttttcagctctttcgtcttactcttacaactcaaatcagacaaagggtcaaggcaaacgggcggtgttcgattcgttaacaactgacattgaaaataaactctcaaaattgagcgaaataaacgatgcggttcgttttgcagaaattatggtgaattttagactttcatttgcacttccctcttcagatgcgcgattgctttgagaatgatatggccgagttcagcaaaacttccgtccaacacattgtgcgacgacaccgcgacattctcagggattacagcacggaattcactcggacaacttcgaacatcggaaaccaactgcacaggttaaaatgcgattattcacttttttggattataaaattcagagaagaattaatggccatcgaatcggagtcatcggtgaataatcggtgcaaaccgacggactatttactaaaggaacacgaaagcataagcaggcattaattaacacattttgtattaacggatcaataaaatctcatcaaaaagttaataaatttagctgtgatcggcttttgaatgaacaaataaggtataattatttttgcttaatttcctggcttttcttagcaaggtttttgccgaatcgttcattttcttccatatttagcattgcaatgtctgtcaaagagaatctgtacacccaaagcaccgggttgggttcgattggcaagcgtttgaatcagttgacaagtgagcaattggt

SEQ ID NO: 37414 - DNA, 730 bp, Heterodera glycines
tggaaataagcttaatagggcctagttaagctgtaaaaaaatttgggggcgatttgaatgagaatagaaagagccaggttcgatgaagttttggtaagccaaaaaaaaatccaaacatttaaaaatctataaaaaatttaaaaatgagaattcatgcgagattttctggaaataagcttaatatggcctagttaagctgtaaaaaaaaatttggggcgatttgaatgagaatagaaagagccaggttcgatgaagttttggtaagccaaaaaaaaatccaaacatttaaaaatctataaaaaatttaaaaatgagaattcatgcgagattttctggaaataagcttaatagggcctagttaagctgtaaaaaaaatttggggcgatttgaatgagaatagaaagagccaggttcgatgaaattttggtaagccaaaaaaatatccaaacatttaaaaatctataaaaaatttaaaaatgagaattcatgcgagattttctggaaataagcttaatagggcctagttaagctgtaaaaaaatttggggcgatttgaatgagaatagaaagagccaggttcgatgaagttttggtaagccaaaaaaaaatcaaacatttaaaaatctataaaaaatttaaaaatgagaattcatgcgagattttctggaaataagctttaatagggcctagttaagctgtaaaaaaaatttggggcgatttgaatgagaata

SEQ ID NO: 37415 - DNA, 680 bp, Heterodera glycines
attatatgcctaccttaaatagtttttatagcaataaaacttttaattttaaagaacttaagtttgtaacttttattacatgtattttaaatattcactaactcaaacaatcaaaaaatattttttaaatttaaagttggtgtcgtgtcgggttttccagtgtcgaatttaccgctagtgtcggattttccaccggtgtcggattttcttgcttgtgtcggattttccggctcccatccaagaattgtgcaatttttatgatttctaatttacgacaattttagaaaggttatggggtaatcaaatttggtaaaaggggaaaaaacaaaaaaaaaacaaaaattcataaataaataaaaattttgaaaatcaaaaaatccttaaatcattgtttctgcatccaatttgttcgcttgtttttgtctgcctattaacgctctcaaatttggtgtagtttcaatcaattttaaaagctatgggtaatcaaatccaaaaaatttgttaagaatgctgcgccgcttattgctgcgtaattgtcatcaggccgtggaagtgggtggcggttgagttcgagtgcgttgtttaaaccggttgagaaatcaatgcaaactctgattttgtcatttttctttttatggccaaaatgggtgctgccctgtggctaaattctatcggattaa

SEQ ID NO: 37416 - DNA, 1035 bp, Heterodera glycines
  misc_feature (696)..(696): n is a, c, g, or t
  misc_feature (698)..(698): n is a, c, g, or t
  misc_feature (702)..(702): n is a, c, g, or t
  misc_feature (709)..(709): n is a, c, g, or t
  misc_feature (719)..(719): n is a, c, g, or t
  misc_feature (737)..(737): n is a, c, g, or t
  misc_feature (743)..(743): n is a, c, g, or t
  misc_feature (745)..(746): n is a, c, g, or t
  misc_feature (750)..(750): n is a, c, g, or t
  misc_feature (758)..(761): n is a, c, g, or t
  misc_feature (770)..(770): n is a, c, g, or t
  misc_feature (803)..(803): n is a, c, g, or t
  misc_feature (825)..(825): n is a, c, g, or t
  misc_feature (827)..(827): n is a, c, g, or t
  misc_feature (833)..(834): n is a, c, g, or t
  misc_feature (862)..(862): n is a, c, g, or t
  misc_feature (867)..(867): n is a, c, g, or t
  misc_feature (869)..(869): n is a, c, g, or t
  misc_feature (871)..(871): n is a, c, g, or t
  misc_feature (883)..(883): n is a, c, g, or t
  misc_feature (916)..(916): n is a, c, g, or t
  misc_feature (918)..(918): n is a, c, g, or t
  misc_feature (929)..(931): n is a, c, g, or t
  misc_feature (960)..(960): n is a, c, g, or t
  misc_feature (975)..(976): n is a, c, g, or t
  misc_feature (985)..(985): n is a, c, g, or t
  misc_feature (1000)..(1000): n is a, c, g, or t
tttacaaaaggttgaaatacggctcctaaaaatgcatgagggagaagaatgaacacacttttccgatttcaatttcacttttaacttttgttgtcaaatgtcaccaattaattttaattaaaattatttggtggtattaatctataattggcactttcatcgtcgtgtgagcattaacagatataatttcttattttttgccggttttctgtttttgtacgcggtgtttctttttttctgaataaaatggtaattattaattaaacatagtctaaacctggaatttttacaagatttaaaaaaaatatttttaaatgcaaaaattaatataaaatcgtttgcctttgatttaaaattctcttgggattataaaaaaaataatttttaattttttaataaatcccccctgaaatattttttaaataattatttttctaggataatttttagcgtgatcacgaatatgacgtttatttttagccataacgtgttttacgtgacattttacgcgaaaaagtgagaaattaaaaaatttaaaaaaataattaggtgccataaaggcaaaaaatttcgtaaaatctcataaaaaaacatcatttatggttttttagttgtttccttacatttaagccgattttgaaccaaaaaaacgaaactagaaaaaaaatttgaagtttcgactttttgttcgaattngngttnaaggttntaattgggtngaaatggatgtaagaatnggattntnngagngtgaaaannnntaaaatgantttaatttaagaaaaaaaatttgaaattttttngaaaggggggtggagtaataanantgttanntttttaaatttttgatgttatattttanttaantnantggaaaaaagtnatggttaaaataaaagttatatttgtgattagngnttaaaattatnnnagaaaaaaaatttttttttttaatatttnaggggggtggaaaanntataagtantaaaagttttatttnagtaagtgattagaaagttgggaggggtttatttt

SEQ ID NO: 37417 - DNA, 1104 bp, Heterodera glycines
gagaagttggagcgggaaaaagcagtgatggaaaaattggccaaagaagcggagaacagagtggaagagggaaaggtgggacaatggggaaaagagagagcaagggagagaacgagcagagcagagggataaagataaagaagagggagaaatagaaagggagagatggttgataagggtgggaaaaagaaaggaagagggaagggtgggacaataggaagagaggatgcggaagagggagagcagtggagagaaagagaagagcagagatttggatcatgcggtagagaaagaccgagagagcgaaagagagactgattgagagagaaacgagagaaaaagccaaagagagagatagagacgggggggggggataaattgataatgaaaaggccgcccacttttacgtaaaagttcagaatcacccactaacaaaaaagtcactgagtgaattgaaccgacaagtgaaagcagcaattgaagcggccggaaaaacgaagttggggataaacagaataaaaaaagataaattcagaaatgaatggtaatttaagagagttggagcaattactgaaacaattggccataaaattgcaaaagaatatttgcgaaggaatcgcagcaacggaaaagaaatgtgaacaattaaaagagcaaattaagcaatggaatgaaatggaagaagtaaaagagaaaaagtgacaaaaaaggaaaaatttaaatttaggaaagaccggcggaaaatgacttaaaagaaatgggagagatgggacggacactcggagaaagcatcggaagagcggaggcaatggcggaagagggagcagtgttggaagcgtaattaattaattaattaattaggggaattaataagcgagaaaggaatcagccattttagacaaatgaacgaaattcgacaattgaagaagtgctatgagaagaaagccatggaaatgatgggaagcagcgaaagtcataaaaagtttttcgcagcggaaatggaagaattggaattccgatggcaaagactgtgtacgaaaagcaaatggataaagaaaggtggagaagagacgacggaaaaacactgggaaatgggaggagaag

SEQ ID NO: 37418 - DNA, 1318 bp, Heterodera glycines
tctgattttgttgcatttcaatttcttcctccaaatgtgagctttgtctgtccgttctcttcttttgctgtgctcttccgtcccctcattttctttccctttctccaatttttctgcttttaaatgttcgaagattccgtcgatttgcaatcccttaaggttttttaagccgtgataaacggcatttgaaataaaaatttgtttaaggatccctcggggattttcgatctgattgaggtggtcggcaacggcacttatgggcaagtttataaggcaaggaaaagggggaaaagcgaagaaaaaaggcacaaaattattaagggaaggcatttgaaaacgcaggcattagcagcaataaaaataatgaacataaacgaagacgaggaggaggagatcaaagcggaaataaacatgctcaaaaaggttgggagggaatcaaaaagaagggcccaaaaaagaggggaaatggctaaaaaaggaggaaaataaccaaaaaagaaaggaaaaatggcaaaaaaaagaggaaataaatggccaaataaagggggattaaatggcagagaaaagggggccaataattggcacattaagtgggctaatgggacggatgaacgtgcaactttttagtattcacatcacccaaacatcgccacttactacggcgccttcatcaagaagttgccctcctcaactggcaaacatgaccaactttggctcggttttctcgccccctccggcatttcagtctttccgttaagtgatggaattttgcggcagcggatcggtgaccgatctgatcaaatcgttcaaaggcggttatttgaaggaggaatggatcgcttacatttgcaaggaaatcctttcggtaggcccaattcttctctgaaggacatttccccctttaggggctaagccatctccacaaaaacaatgtgaggggggggggaagagagaaggggacgaggcgggagagatcggacaatgccattgcaggtgatccatcgggacataaaaggacagaacgttttgctgacggacactgccgaggtgaaattggtcgactttggagtcagcgcacagcttgacaggacagtgggcaaacggaacactttcatcggcacgccttattggatggtggggagggaggggaaagggatcgcatttctgggaaggatggcatgggatttggaggatggccactcgcaatgggttttaggcccccgaagtgatcgcttgtgacgagaatcccgagtccacctacgactcgcgcagtgacttaagggttgagacttcccatttgcaattggcaatctttcat

SEQ ID NO: 37419 - DNA, 996 bp, Heterodera glycines
tgaaaaatttctgctcaaggatatgcaaccattctgcagctcaacttgcaaaatggcaagtgaacaactctgaattgttaagagaagcagaacgccaaaagaaaaaagatttgaattaaaaaattgtatttaaatatttgataaaaattatttgtcaaaaaaaaataaattttttgaatatttcatatttatattttaagaattaaattttcttatgtgtttttgtttttagcatatgaatattttttattttttcctgccctaaaatggatccgagatcgagatcccgaccaaatctagattaaaatcccgttataaaaagtgccttttaaaaaagttcaatgcatatgattaatatttttatcttttcttttttcgaattaaactacatccctcctccaattgtaaattctctttatttattcaatgtttataataaatatattgtggcaaaatcaaaaatcatggggaaaagaattgaattaaaaataaattacaaagtttttggcctaaagcctaaaattgtaatgtttgaaaattattgggcaaaatagttatttactttatgattttttatatttattaagattccgtttggtcatttatcattcgaattgtaattaattatgtagatttattgattaattaatgaatgcaaattacatcatcaaatatagtcccgatatatatgaataaaataatattttggaaacactttttcattttaatctcttcttttcaccgttctcatcatatttcataaagaattgaattgttgggtggcaacaattagcgcgtggacggcacaaagaatggctaatatgcaaaaaaaaaatatatttttatcaataaaaaattattaattcaccaatgattttcaaatagcaatacacagcactgctgacgcgaacaccatttcctgtaatttacaaattctattaaacaagtaattaataaattcattcaacaccctcattaatggtttattgagccaat

SEQ ID NO: 37420 - DNA, 990 bp, Heterodera glycines
tcagtacattttcatgacaacatatgtcctcttgtttcgtccattttcggacggaatatgcgtcgcgatgaacgcctttctccttcagccctttcttcgtgcgaaagtattaaaaagttacgcgaagcaatcaccgaaatggccacactttgcgcaaaagaaccaaattggttggatgagactcaccagtgccgacgcagactctctattctcgttagtgacggagaaatgaaagcaagtgaaatgacggaatgtcgagccaagaaagccgggagcacaaatgcggaggacttggcggataatgaagaaaaaccaacacatacggagctgatacctctttatagttctgaacaacagaataacagcggaaaaatggacagcggtgggaatgtatttttttgaaaaaaggaccatccgtgttcaggtatttttgaatggaccgggagcgatggagaaaacggcggggcaacaactgcggatcgggaagaaaacaacgaaaaagaggacaccgacagtaactgtgagaaccatgccgacgacagtacgacgcgtagtcgcaaaaggtgtgagttctattacttacttattaactcgtttgaccttgtcatttaagtgcaattgaaaataagttgccgaactgcacagagaaagaagggagcacttttatacccaaaattgtcacgaacgatgaaatggattcaggcctagtagcagatatgtccccagctgcagaaaaacaccaacattttcagttgccgccatcacctgatcattaattattatacttggcccaaaattctcacaatcattagattctgtttattccaaaaaagatctttttcaaagtattcacagcggaacattcccatgggtatcaaaactagaccggacaactggtgtcggagggatcccgactgaatcccgatcaatcccgaacattttggaaaaacgatcgggacggatcccgaccgatcccgaagattttttttc

SEQ ID NO: 37421 - DNA, 892 bp, Heterodera glycines
ttttctgaaaaatgtaaataatttgatcgatgtttaatgttccgtttgttacgagttttgtcccaacgcattttcccgcatgatatccgttgcgatgtgcacaggcaacaccaaatgggcactgtcactgacgaacagtcggtctgccgaatcctcaattttgttgctctccaattcctcgaaaagggcgtccaaattgacgacgactccgttcccgacaatgttcaacacctgcaacagcaacattagtttttgttttgttttttgggtcaccttttctgaggccaatccggaaggcaaaaggtggaaatgatactcgcggccatttgccagaacggtatggcccgcattgttaccgccttggcatcgcgcgacaatgtcaatctgagaaagtgagagggtttaacaaacaaaacaacaaaagatatgcagaaagcccttcggaacatcaataacgaaggatttccagaagcccaccgtaaccgaccttgtgatgtccgatgagaaaatccaacactttgcctttgccttcgtcgccccactgggcccccaaaagaatagaaatggacgaaggcgacatcggattttattcggatcttaaaatgagaattaggaaattgaaccatcagcagaatgcattaaaattatgaaaaatgattgcattgtaacttttcttttccttttatgtgtttttcacaaaaaacatgctcttatttttcatctcttttaaccataaaatgcgaatgttttaaagggaaagaaaaatttaaattttgtttggcaattaattaattgttctaaagtcgcagcttttacccgtcaaatgcacggggaaagagaagtggcggaagggtcgctttttggcgtactatttctttatctctgttaatag

SEQ ID NO: 37422 - DNA, 994 bp, Heterodera glycines
  misc_feature (33)..(33): n is a, c, g, or t
cagaaggcgccggctatcattttcatgacgaanttggattcgattggtgcgcgcatttttgaatttgctttactgacattgtgtttattccttctgcaacgcaggcacgaaacgattcgacgcctctgacacgggggaccgagacattcagcggacgatgttggagttgctgaaccaactcgacggattccaacccaacgacgacatcaaagtggagtggtggagcaagccaatcaattcacattcattttgttttcatttaacgcaggtcattgctgcgacaaatcgtgttgatgtgctcgacccggcccttcttcgctccggacgttttgaccgcaaaatcgaattcccagcaccaaatgagaagggcagggaacaaattcttcgcattcattcgcgccggatgaacgtcgagtcggtgacagaattttaggaaaacaaattattcctcgttttcagcaaaaatgtcaactttgttgagctgtcgcgctgcattgaggacttcaatggagcacaatgtcgagcagtttgtgtggaagcggtgagcggataaacattttttgaggatatgcgtcagcttatctcatttttacagggaatggttgcacttcgtcgtgactccactaaaattctgcatgaggatttcatggacggaattttggaggtaattaataacaatttgagaaattttggaggaataagccaaaattttcaggtgcaaggcttgaagaagaataatctggtgtattatggctgatgggcgtcttctccggcggaatttaactgatgtgccacggctgaacactgcccagcaatttgtattgacattgacccatttccatgtgatgccttatgccttgtagcctgtattgtaatacatttcgtatatgtgtttttgccactgtatttcatgtacaaatgttctcgtttagtgaaattgttgtttgtgtgtgtttgtttatattatgtacataaattattcgcgcgtatagag

SEQ ID NO: 37423 - DNA, 993 bp, Heterodera glycines
aaagaggaatttttagaaaagagcgcaccgcatcggggcttaaaagcattgtacagcgtaattaaaagctgatataattttcgtatatttttcacaatttatttcaaaaagccaaaaagtccggaaccaattttaaaaactaaaatagtgcacaaaaggggagccgccgcacggcggggcttaaaagcattgtacagcataattaaaaccgaaaataattttcgtatatttttcacaatttatttcaaaagacaaaaaaaaatgattcaattttgaaacgaaatagtgcacaaaagggagggatggttagacgaaaagaggaatttttagaaaagagcgcaccccatctgatattcccatttttccgttccacaactggccaaaggcgactgtgctcattgacacgtagttgtccaataaggtacttggactttccacagtaaaatgtggtacaaaattttggaactgtcccgcctcacggcggggcttaaaagcattgtacagaataattaaaagctaaaataattttcgtatatttttcacaatttatttcaaaaagccaaaaagtccggaaccaattttaaaaactaaaatagtgcacaaaaggggagccgccgcaggcggggcttaaaagcattgtacagcataattaaaaccgaaaataattttcgtatatttttcacaatttatttcaaaagacaaaaaaaaatgattcaattttgaaacgaaatagtgcacaaaagggagggatggttagacgaaaagaggaatttttagaaaagagcgcaccccatctgatattcccatttttccgttccacaactggccaaaggcgactgtgctcattgacacgtagttgtccaataaggtacttggactttccacagtaaaatgtggtacaaaattttggaactggcccgcctcacgacggggcttaaaagcattgtactgcataattaaaagctaaaatattttcgtatatttttcacaatt

SEQ ID NO: 37424 - DNA, 1298 bp, Heterodera glycines
  misc_feature (1183)..(1183): n is a, c, g, or t
ttttttcatcggattcattcagtggtgaatactgtatgacacatatacagtgatgtgtacagtaagaaacgaatttacataggttctgtgggaaggttctcatttctatctgttagcgcttttctttggcactttgtccactgaattggacggggttcgcttctgcttccacttggacttggtttacgaaggcacggctgacaatttgttgttagaagggaccgacgtttatttgttcattaattagttaattgccttttgttttgctagttaatcaccttcccgtttttactaattaattaattgccttctctttttcttaattaattaccttccatttttgttcacttttgacttttgctggtgaatgtcttctgacaacggcaattggaccgaactcacctcaaaatatgccaaaaaaagtttaggtgtttggcattttcaagggtttcacccctttcagcacgcgaccctgcgaatccaccaaattcgtttggagaatcgtattcactccgaagtcctttccgattggtggcggaatcttttaatggtaaattagcttagcggcgatcagatggcgggggggggggagggttttggccaatgctaccgtaatcctagcttttgccggcaaagtttctgtctcattaatcgcctaaattaaaatgtataaaatgccttttccttcgcttcgttttacaaatgccactcccaatggaccgccattctttcttccgttcctcaaattcttatggaaaatgagcggctttgaaccgttctgaaatttcattatttacaatatttcgccattatttatccgaagaattacaggggaaattgatgggataatgggctcggttgggtgctgctaaagaaagacaagcggacaaagtaccgaaaagcattttttggaaatttctccgtttttctgaatttcgttcggtccacaaaagtcggaattcgaaattgcttcccatctcccacttccctccccgttggactgactcttccgctctctctccgtccctccgtttgttcctcccttttttcgtgctgctgcggctcattcactgctttggccggtcgaagtccgaccggcactttgtcgtttttgagtgccgaacaaagaaaagagacgaaaagaataagcaaaggggaaaaacagcaaaacatagcgaaaggngggggggaagccaaagaaacgaatggaagggaaaggaaaagcatccgcagaaagaaagtcggcgtcttcgatcatccgtcacttaagggagtcatttttctgactgcgcttcccc

SEQ ID NO: 37425 - DNA, 1181 bp, Heterodera glycines
gcacaattaattaattttttattgtatcaattctcttgttcagtcctgaaaaactgttgcagtatgggtccattgtcagcacgcttggtgtccgatacatggtgcaaattacttacaccgattgcgaattatttaccgattcaaccttttttccaattttttttccagtcgtactgttccaatgtcgcgcgcactatgatggtgatgcccaccccgttgatggaggagctgtacgagttgctgttgaccacagagacgacagtgatcgaagcgttgaagcccggcacttcaatgtccgcagcttacgaagcaggcattcggcattttcgcagcaaaaagcccgactttctgcaataccttgtcaaaaatttcgggtaactatttttgttgacaaatattatattttcacttgaattgaaattttgtttattttcagttttgtcactggcattgagtttcgtgagtcccaatttttgatcaacgaccgttgcgcgcacaaagtgcatccgaacatggcatttgtggtggcggtgggccttcaaaattttcccaaccaatcgacggaaaacggaaagaaaatgatgtccattttcctcagcgacaccattctgatctgcgaagtttgtcttttcctatgacccaacattttatatgaattttaaccgtgataagcccagagaagcattccaattaaagcacataaaaatggggaaaaactttttggtcgaccctttttaaaatttgcctgtcctatttataggaaagagaatttgcacaccgacatttcaggacggacccaacgatgtgctgacaatggtggccaagagccgactgcgctccaacgccattcgctttcgggaggacgagcagcagcagcaacaccaccagcagcagcagaaggcgaacagagacactcaagaaatggccaacggcgggcgcaacaaacggtcggtggtgttgcaggaacaaacgcgggtaaaatatgcaaaacaaggcataattatgattggtaatttgcataaattaaagcacaaacaaacaaatgaagagaagcggaaagagcgccagagggaattggccgagcaactgaacagagaagcgcgggagcgtctctcaatcaaatcgggcggagtggaggcacaaaagtgggcatttttttaatatgggtggatggttttgat

SEQ ID NO: 37426 - DNA, 890 bp, Heterodera glycines
gacaactggtttccaaagaagttcaacggaaaaacaggaagccttccaagcactgaagcagcgattcaagaattttgtttcgccatatttatttaagcgaagtgtttgaaagatttataaataataaattaaaagacccaaataaacatttaatgaataaaatatctaaatttagaaaaaatatataataaaaaaggaaatttcatttaaagagaaccaaaatgagaatcgtaaagaaatttttcattttcagatcacaagccgtaataaatgaacaatttctaaatattatgaatttttaaattttaaaaatatttatttaatatcaaattaaaacagaagtgaataaatgacatctgggcacgtagaataagagagtggtagtggttaaatgatcatgaccttgtggtaaaaactgctagaataagagctcgtggtttgcaaccatgacctcatggttatttaaccatgaacttcggggttatttaaccatcaactttaacctgtagaataagagagacgaccatggttatttaaccctatgaccatggttgaaaaagctaccgcgcgagagggcatggttgcagaagtaaccaccagatttagccgcttataaaaattaatccaataattttaaaataaccaaaatgatatttttagataaagcaagcttttctctttctgtatatactaatttcaataaaaaaataattgagatttaattaagatttatttattctaaaaaagatattgaaaagtcataaaaaataaatttttatgatctctaaataaaaaaattatatatcaaactttttttttactatgatttacatgtattagccttataaattatttcatgaaaagggaaacgcgtattttgttgaagctta

SEQ ID NO: 37427 - DNA, 1538 bp, Heterodera glycines
ccaatttgaggacgagttgaaaactgtaaatatggaaaggctggtgaatataataattttataaaatagtccgaaaaagattcggacttattttaaaaataaatttgtaacatttttaaatttaaaaaaaatttactgcattccacattgaaatttcttcacggatttgcaatcgtcgcgttccaaaatttcgcacaacattttttggtcaatttgcaaaaatccctccgattcgatcaaagtgtcggcattttcgtaaatgtaaaataaacaatggtaggcaaaattctaaatttgaaaggaaataaagtattaaaaaaattggctcgattgagaataaaaataagtgaaaaaaggaacattatggaaaaaaatcgatgcgataatttccgcttttaaacacaatttggaaatatcaagttaaattgagagaagtttttctctcaaatttccttactattttttcttctctgcccgccgctaaaaatggtagcagcgacaagtcagagaagagaaaatagtaaggaaattaaagagaaaattttatttttttttattcaaaacaatttagtgattaaaaaaagattcagacttattttaaaaataaatttgtaacatttttaaatttaaaaaaatttactgcattccacattgaaatttcttcacgaatttgcaattcgtcgcgttccaaaatttcgcacaaaatttgattagaagaggtgcaacagtgattaaaagaggtacaaattgttagaagaggtacaaaagggattagaagaggtacaatggtgattagaagaggtacaaaagtgatagaagaggttaacagtgattagaagggtacaatcagggtttaaaatgaaataaataagaataaattaaaacatttgttcaccaaaataatttaatttaaattaaaaatttttatttattattaataatacaaaacaaattaattaaaaaatgtaaaagtaagcaaaaaatgcatagtaaattaatgtacaccgcccggatccgaactccctcccccctcaaaatgatgtctcagaatccccaatcacacagggattctgaggtcttaacgatgtcaaaagtaaaatttgattacgtattcgtgatcagcggcccaaataacgcctaaagacatgtttttggaagatttttggtgaaaaatttttttcactcaaaaaccatgtgcacccccctttggtcccgaatcccaaaatcacttttatgtttgtatcttttttttaaaatgtgataaaaaggtcaaataaaatttatattatagagcaaaaaattgcggatttttgtagtattttacttttacagtatgacttttcagaaccgagttctgaatttttttctgaaaaatcgaaaatttccagaatttctggaataactttttttatttttgtggtataaatttcaaataaatctcataaaattcttccgattttttgctatttttaaaactttaattcacttaaattgagaaagcctccattgagttatgaattttcaaattttaacccaaa

SEQ ID NO: 37428 - DNA, 1312 bp, Heterodera glycines
  misc_feature (1232)..(1232): n is a, c, g, or t
cccatctccccatctattccttcctcataaaattgttctatttactcgacgatggcaaataaaaaatgcacaaatctaagaagcactttgacctttttttgaccttcttattcgaattcacgagttccatgagcaaaataatatttgcattagacacaggcttggggttagttgcggcatgataacagagatagcggatcaacagttcaggcactgcgttcctatattggtcgcctttgagatttgagaagattttggtgattgttgcaaatatggaaggtttaggtcttagcgggcggaacgaacggcgagaataattcttgactagagcaatagctatggtcgctcattcagtggccttttaatatgtttaaattgtcattttatatctgcttattttatattttaaaaaataattaattaagaatccattaatcaactgatcaaaatgtcctcccgcgcttcggacgccatccaggagttacgaagaatggtcagtgatcagaaccgcatcatcttcaacttgcggtcgcagttgatagatcaaagggcggtagttttacaaaatcttgcgcgcatcgaacaattggaatgcttcacatcgaatgtaatttttattttaaaccccggggcagtttaaattttaaaaggtgagatgttgtaatgcacattttcgcaaatgctaatttttttaaatataaaaaataattattttgttaaggaccgtgctgggcgcggaaatttccgcctccgctacagtccaatggcagctgttgagctcactctactcgggcaacgtctcgaggatagagctcgtcgccatcgaatggcgataggcgcaatagcatcaacttccacttcgaatggagccaatggggccgggggctcggctgagggagacgcagcaaacaatgagaacggttggttaaaaaaataagttaatcaaagaaataaattaaaaaaattaaaaattattttaaaaaataaggttaaccaaaataaataaacaaagcaattcagacttttcaactccacgtacttcacgtgtaccgttgtccgccataagtataacatcaataatctcatatatttgtatctaatgacaaaaactttttagataatgtgccagctgatcaaaatgcgcatggaggaaatgcttcgggtgatggaaatggtaaataattttaaaataactcaatttcagtctgaaaatttcagtcccctcgtttggngcaacgattgaacgcacatggagagatctcgtcgacgttgctgcatgatgagatgggtcagcgcagtgtcagcagcattt

SEQ ID NO: 37429 - DNA, 977 bp, Heterodera glycines
  misc_feature (6)..(6): n is a, c, g, or t
tttttntgtttaaactcaaaacatttatgtaggtatgttaaattaaagaaaatttatttgtgttttgtaattatattttaattgggcaattaccgccaattttgattttgtatacaagcaaaattttgtcgttttttaatatggataataaccatggccaaaaaaagctcagccaaagatcaacaacaacccttacagtcatcgccaagtctccgttatttgcgtcggcaattatttcttcgctgccatttgaagttgccaaagtcaccgctgcgaacagcagacacatcgccagaatacttgccattttcaatttgtttttccaatttggcctcagtttccgacactttctcggccaatgcattttgattctcgcgcattcccaaaataaaaatattaaattaaaataaatattattttgcaccattttccaatttgttggacaacaaattttggctgtcgcgcattcctaaagcgcatttcaagaaaataaataatattttctaccgttttctattttggtggtcagcccctggtgattgttgcgcagttcagtaaatactaaacaaaatttttaaattattttatttaattaaataaattaatttatgttttaaataaaaatacttgccattttcaatttggttttccaatttggtggacaacaaagtttgggtttcgcgcattcctaaaataaaatataaaaattcaattaaatgaatttttaccgttttaaatttgtttttccaatttggcctcaattcccgacattttctcggccatcgcatttcgattctcgcgcattcctacagattagaaaagagcagaaaataattaataaaaaagtgcatattaatgcattttttaccatcttcgatttctttttccatctgtttgatgtcaacattgtcattaatgccaaattgccaccacctgtgacaaaaaatggcattaattattgcttttcatatatattt

SEQ ID NO: 37430 - DNA, 1384 bp, Heterodera glycines
aagagagttcattatttatttgtttttgcataattaattcataaatattttttcagaaactgctctgaaacgcaccaaacttttatttgcaagttattttaggcactcagatgctttcactatcaaaaagggagatgaataaaaaatctaaaaatttttaattgctttttaaatatgcgaaaaattttaggcttaactttttttttataaactggtcagaagcgaaccagattttgcgagagcatcaaaaagacaaggaaaagcactgctatgatgctaactccagtaattctgaatttaaaattttttattaatttttaaagcttcactattttatttttttagcaaaatcaattcataaatattttttcagaaactgctctgaaacgcaccaaatgttaattaaaagttaaataaggctctctgatgctttttctatcaaaagggagatgaataaaatttttaaaaatttttaattcctttttaaacaggccaaaaagtttaggcttatattttaaaaagtttcatcgaacctagcgcactaaaatcgatataatctctccaaattttgcaggccttctccattgtaaaggactaacttaacctgaaaaaatgccaacgcttgttgtttttaaaatttttcaaaattctgactttttcattacttatttattttttgcaaaattaattcataagtattttttcagaaagtgctctgaaacacacaaaatgttatttacaagttaaataaggctctctgatgctttttctatcaaaagggagatgaataaaaattttaaaaatttttaattcctttttaaacaggccaaaaagtttaggcttaacttttttttcagaaactagaaatcagaagcgcaccaaactttgcagggatactgaaaggaagagaaataacctattttaaatattatctagtcagttcatttaaataatttttatccaaaaaatttttttttgggttttcggggcagtccccctgaaccgatgcgcccagatttatggggagaccgaatccttcgggaatagcttccctatagcctgtactttaattctgcgttggatttatgctcctgataattgtttgagtaccccaaacggacacttgaaaaaatcgatttttttgttttcggggtagtccccctgaaccgatgcgcccatatttatggagagaccgaatccttcgggaatagcttccctatagcctgtactttaattctgcgttggatttttgctcgccataattgtttgagtaccctatacggacacttgaaaaaatcgatttttttgtctcataaatattctgttcagatagagctctatagcgcaccaaattttattagcaacttaatgttagcactctgat

SEQ ID NO: 37431 - DNA, 791 bp, Heterodera glycines
ttgttatggtcattaatcttcggcagcttttgtattctctgatcactggtcaatattacccaatgcttcggaattttttttcaaaactcatttttttgcgtcgaggagagcgggggggggaatcaattaaattcataattcacatattttaaagtttgcggcattttttgtttctaattttatcatttcccatttttttctcgttgttttatgcctacattcaaatttgtattctcaatgttgtttattcttcaccagaaacgcctcttttttactacaattattttatcggtgcatttaaacaaaataaaattggcacttttattacggtcattgatcacactgatcactgattagacggggggggggggaagttatcggagagtgttaggtatgttgactgactaatgatcaatttctactcttctccgcgcactctccgcgtcccattcgtccgcgttcagttccggcgccgccagcactgctgcggctcgtccatcatttccgagaaggactcgccctgggcgctgctgactttgaccgagcgttgtccgcgccgcagttggcgcatcagacggcgcgcctccgactccgcgcggtccatgcacacaaagtggacacgcttcggcttttccccgctaagctgctgatcggcttcttcgccgccgttcgttgtggtgccgcgcgggcattgcttgaccggctcggtggagaagcacagcgcgtggttctgctcgtacaccttggtgttcattgtcggcataaccgctgaatggggagggggggggggg

SEQ ID NO: 37432 - DNA, 1342 bp, Heterodera glycines
acgtcattacattttgttgggcgagctaaaaccccggacgagaatggatgaatttggtgagtgacaaagtccatttaattctctgaatatcttatgccttaattgatttatattttctgtttattgaatgtcgcagaaaaacatgtgatgcaccaagatgattatgggacagtaattgcaaaacttcgccgtcagatataccaattgcctaatagtcgctcagttttcgctaaaaaaacagaggcccaatggtctgattttatataggtagttgaatattttaaaaaaatcattaacattttaaggtttaccgagctggcagaaacatggaagcgaatccgagaggaattgccgacaatgacagaggatggatgcacatttaagcgacagcgtggcattggtgcccattcacatttgtttggaattttaaatcctcgatactcatccttcagtgactccattttcacgcaatgcatccaacgatgtgtttatgttgaagcaacgaacggcgccgcagggaagtgaaattgggcgcgggagacaaaggcgaaggagccgtaagggaggcaccaattgggaggacaacaccggaagcatcctccggagagaagcagtgaattttaccgaaacagctacggatgaaaccgaggaagtggagtcgaaggccaacgaacatcgaaagacgacagcgacagccgagacagagggacaacagcaccaaaaacggagagtgtggcgaacgcgaaatcgaacagcacttgactgtaagaatatgacaaggaagcaatggaacatcgagcagaagacgaaggaagggtcatcattaaagcacaaatctgttgtagaatgggtggacagagagcagcagttagacgaaagtggaaggtcgggcacaccagacatggagacaatgaagaacttgaccaacgggaatgaagtttctatatttgaacaacgataaaatcaaatgcttacgattataaatagtgtttatttccttaatttgaaacagaatatacaatctgatcaaaagcgaatgtgtgtcaaagtcattttgccgatttgagtccaaaaaaacttataagccgtatcaagaaatgactaggcaggtcccttgtagaattggttttaatgccgtagatttttttatgcggcttggcgctattatcaaaatttgttaaactctaaataaccagaaaaaattgcaaattgaacttttcgcggttgtgtctatgttacaatccagatacgactaaatcatcgtggttaggtcagtggtgaatggtaagagcatttctgatcagagtgaaaatatgactctcctcacgcatttgcccacgct

SEQ ID NO: 37433 - DNA, 927 bp, Heterodera glycines
aaaatggaaatcccattgggactgactttgccggtttcgacagtgccaatggggtgacgcgtttggtcgcccgtttgttgttgtcccccgagaggggctactgattctttgccgttgttttctgctgctgccgggggcccacaaatcctcccaaacaaccaacaaatcttccgcggatgatggatgggccacaatcggccaaaagatgaccccagcggcgccctcggggaatgggaggaaaggggagaggaaactttggcaaaagtgccaggcaaaagaaatattggagcgataatcgtctacccgaaatttatggtgtaaaataaatgtggggggggggaatgaaattaataactaatatttaatgataatgacgcgatgagggattatttatggtcgtaaaatgtgaaaataataaaaaaatttagaaaatttgtatataaattaaaaaccgataagaaaattaaaaatgtttcggataaatttaatattttttttaataaaacggtgttcattaaattccgattttacaaaggcaatttgaaatattcttaaatgtagaaacaaaattttaaaaaattaataaatttaaaagaatttgaaatgggatttaattagttcaattttttttgccatagaatttttgtagaataattaattaatgtgtttatttaatgacaatttgggcgttgaatttattggaaaatgcatcaaataatagaaaatataaaattgtgagtgattcttctcatttgttgtaaaaattcaacaacaacaaaaaaaacacctaatattagataaattagtgataacgaagacaaaaaaaaatttatgacaattgattaaagaaagaaagagacaactaattatgtaattagctaattacttgatttttaaatcgaaactgcaaaaaagaggggagagctg

SEQ ID NO: 37434 - DNA, 1067 bp, Heterodera glycines
cacatttcttgacggcatttctctgcttaaccgcgttttttgtcccaatcattctttaggcatttcttccctttaataattttacttattttccattttttgacgatttgatttttctcgagcattacaaattcctttgattgttccgatatcccaactctcttttcagctgcattttacttcattttgaccacctcaattattgtgtgttgatatgtgctgtttttcttttgttttgtgatttttttctctgctatttattaaattatgcattttgtatttatcgcttcgggttatcatttcaattttcctccatttttatcatttcaattttattccatttttatcatttcaatttgattcaattttattccatttttatcatttcaatttgattcaattttcctccattttttatttctttttttaattcctttctattttcgaatgcattatccttttgctaattctctcacttattttttcattttgtaattaaatgaagaagatcatcattatcattactggtgggttttaattaaagcaataatttaccccattataaaaaattcatttatgcgcataatattaagaggtggttttgcgctgacacaattttttattggaaattgtgagcaaaatcgaattggtttgagaatttgtgagagtgacaaagggttattgagctattgggttttatttgatacaaaaaatgccgaattttttttcaaagagtaggaaaaaaatccattaacattatttttgggttttttaattgcggcattttcgtcccatttaatttgggattatttagacatttattaaatatcacacaatgtttttggtttgatggcattcattgtgtgggccttgaaatttaaaataagctccttgagggcgaggacaaaaaagtaaacagacaaattcaattaaaaaaagttcccccgagagagagaagaaaagagaggaaaggcgctttagtcccttttaaaacaaacatttcccgagatttggattttggccttttgccgtttccttttaaaaatgcaaaaaaaaacgagtcaaaa

SEQ ID NO: 37435 - DNA, 1059 bp, Heterodera glycines
agagagagagaggagaaaaaagggcagagacaacacggaaagggagagagatatagcgacagtgataaagcgtagagagagagagagaggatgagaggggatctgtgagaaaagggtgggagtaaagatagggaagatggtgaagtctatgagagagggtggatatggcgacagagataaagttatgagagcacgagaggtaaagagatagagagagaagacagagggagagagggcgagggatttctatgagaaagaatggataaagatagagagacagtgataaaatgaagagagcgagagatagtgagtgataaagtgaacagtgtgagagaaaggggagagtgagagagaaggcgagagatagagcgacagtgatagtggagagagagggagagcgagagagtggagagagatagagcgacagtgatagtggagagagagggagagcgagagagtggagagagatagagcgacagtgatagtggagagagagggagagcgagagagtggagagagagagagagcatgccttcacttctcgcctttgacttagaactttgaaaatcgtccgtcatcagccgttggtcaaacacgggcggaagtgtgacgtcaccagtggggcgtgaaaagggaataaagatcatcgccaaaaaacgtctcaccaattaattaaccaattaattgatcattgaggcgcctgccgacagatggagcgatgagcaaagcacacaaaaagtgccgttggcgaccatggggaaaggggcgggggcgttgtcgtcgaccaaagatttgaaaatgtgcaaaaattgcaaaatcagcgccacgcttggcgttctgctgacgaagtgccgcccccggtggatcgtccaaaggccaatttcaatcattaaacagaataatgcaacaaaaaattgttgttttattggcgttttctgtgctatgttcagcaaatggggagggggcataggttaagcaaaaatcattgataataaatttaaaattgcaaaaaaaaaaggaattctttggcgctctgacgccaacccccaggggaatcgg

SEQ ID NO: 37436 - DNA, 951 bp, Heterodera glycines
  misc_feature (777)..(777): n is a, c, g, or t
ctccactttttttagcccttttctcttttggcgtttcctatgctttgcacgtgaatttcctctgcattcgttgcaaaactctagcgagtgggcgagcaaatgcgctgcccacacaacaacaaatgtcggacgatggatggggcggggaggggcggagaaaccttcgcccaatgtgacttttggccgggggcggcccgtcctttctcatcaaatcgtccataaaatgagggggacacagtgaacccttctcattctcatccgcacctttttgtacggaaattgacctcagtttttgggtggttaactcttttcttgggacttcgattgactacgtggtgagaaagaaccagtccaaactctttgatcagatggacattttgtttgtttagcgctgcgctcaccgatttctcggcccaaaaattctccaaggccacttttgcaataattttgttagtttccccaggtaggaggggtcctcccccgtgccgtacacagctgacacatacatatgacaaccaaaacacaaacaaccacaacaacaaactctcctcagcccatccttgcgtatttaaggctgtttaaatctaaaattatcactttttatctgttcccatttcgagcctaaattattttgttctcatttaaaatcacaacagcctgaaatgtgcctgaatcgtgtggtattggggcctgaaattacgcgaaggccggcggcgatgccattctgggccgatttggcccagggcaataatgacaacagagacggggccaactggngagggagcgcggcatttcgaacattggctaagggagggggagtagagcccataaggtcggtcgaaggaaaaccagcgcaaggcgtagaagaggaaaagcctagcgaacccttgggaagagaaacgcgaattgagaccaaaggggagggcgtggcattcagcgccactaattttg

SEQ ID NO: 37437 - DNA, 1100 bp, Heterodera glycines
tgctaaataaaagaatttgttttgatctgacgtcagtttgtacatgaagcagctgtcaagtgaaccaaacaaagattttgcgaattttgttaaaaaatagaaagcacaaaaagatttaatcatatttttatttttgtgtgcaatttatttaagcatttcggttttattttattttgatttttccattttgtatttatttaataatatatgtataaaaaagcgcgttaaaattgctataattaatcttccgaccaataaaaaaatagtcataaacagaattcacaaaaaccggaatatttcaaatatcacattaattttgacattttttcagtaaaatattttaaataattgatcaactaaacgatgatgtgcgatcaatgaagaacttcctaaaaagtagggctggtcgggaccggcaattttgacaaaaaccgggactgggacttgccgggaccagaaaagtcgggatcgggaccgggaccaagtttttcgaccgggaccgggaccgcgagaaaagcctggaccgggaccaaccgggaattttcccaaaagaaaattttttggaaaaattttgaaaatagcattataagatggaaaaaacagttttgtgaagaaacttcgtcgaaaaaagaatgatccaggctatttaacgcgataaagaaataaaaattccgatcaaatttgttttcccatataaatccaacaagaaattgttttattaattttggttttttgaggcaatatgtccggcggtgtatgttcggtacataattttatgagatttattataagattatacaacaatatttggtcatattttcccaatgtggcattttttcattttgtattttttgacggtgtcgtaaatggcaaagattgacttgaatttgtaaatacctaacaccatttttcatgttcttatgagcaaatgtgatagcaaaatctagtctaattcgaaactgagctgaataatctccaaactgtaccaataattctgtttgatcagataaagtgcacaggagccacaggtatgagtcctccttatcgccttgatactgggattggggttatttgttaggttggttggcttttcaaggggg

SEQ ID NO: 37438 - DNA, 959 bp, Heterodera glycines
tataagataaatttaaaaaattctctgtgaaattaaatggcgattgcgcaccgcacttcctatcatgctcgagagcatttgtaacgtataaaatttctcaaaataagagatagtcatttttcttggatataagataaatttaaaaattctctgagaaattaaatggcgattgcgcaccgccctccctctcacgctcgagcgcatttgtaacgtataaaatttctcaaaataagagatagtcatttttcttggatataagataaatttaaaaattctctgagaaattaaatggcgattgcgcaccgcacttcctatcatgctcgagagcatttgtaacgtataaaatttctcaaaataagagatagtcatttttcttggatatagataaatttaaaaattctctgagaaattaaatggcgattgcgcaccgccctccctctcacgctcgagcgcttttgtaacgtataaaatttctcaaaataagagatagtcatttttcttggatataagataaatttaaaaattctctgtgaaattaaatggcgattgcgcaccgcacttcctatcatgctcgagagcatttgtaacgtataaaatttctcaaaataagagatagtcatttttcttggatataagataaatttaaaaattctctgagaaattaaatggcgattgcgcaccgccctccctctcacgctcgagcgcttttgtaacgtataaaatttctcaaaataagagatagtcatttttcttggatataagataaatttaaaaattctctgtgaaattaaatggcgattgcgcaccgcacttcctatcatgctcgagagcatttgtaacgtataaaatttctcaaaataagagatagtcatttttcttggatataagataaatttaaaattctctgtgaaataaaatggcgattgcgcaccgccctccctctcacgctcgagcgcttt

SEQ ID NO: 37439 - DNA, 961 bp, Heterodera glycines
  misc_feature (861)..(861): n is a, c, g, or t
  misc_feature (901)..(901): n is a, c, g, or t
ctgcgcgagtgttcagccgtttatttttgtgtcccccccaactaatcgatatcaacggaaattatcgatttgtgaacgcaacaatttttaaaacacgaaattatgaattgaaaaaacttaagaaaaacgatcggaataaaccccttggttctcttttgatcttcgaaaatttattagtgcgggaaataaaggactatgaaagtgtgcgaaaattttttggttttaatattttatcctttgttcacgattttatattacgaaaatttcgagatgatttttattttgggaaaactcttatttattttcggtaatgaaaagtgtcctttaaaatcgaagagagtgcgcgaataaatgcaaaacgaatagttgaaaaatattttttggaaataaatttttataaagaaaatgctttaacatgatagatgtgctaactatattatacactaattaaaagtcgaagcgaaggattattttaaaattagttgatatgaacaaaaatttaggttgcatattaaatcaaaaatgatcatcgcataggatattgccagtgggatttggatgaaaaattggtgaaactattaaaattttgcgcttccttttgtcctcccacccaaaggaaactgtctgtttttatatcgattaaatcagttgaaagcaagttaaaaaaaatttaaaaatgaaccaaatttattaaaacgagaaagttaaaaaggataaaaataaagatttcatactatttaaaatagatatggaaaggtatataaataatcttttaattttcaattttgacatttggtaaattttagaactcgaattttcaattttcatttcctatgataaggtgtgtataatatttcatanactttattaattttggactgccctctacggtaaggcgtanagaatatttctttctctatttttttcgctcacgtattttttaattactttttctaattca

SEQ ID NO: 37440 - DNA, 1650 bp, Heterodera glycines
  misc_feature (1587)..(1587): n is a, c, g, or t
  misc_feature (1627)..(1628): n is a, c, g, or t
atgccctcaaaagtctaaatcagatgacaacggttcgccatcctttccatggccaaccgaactcttttggccagggttggcaaccacatggcttggacttggcacattttgatgcgcggaaaatccttggaaatcattttaaacaaatatttacttaaatttttttgtttgcctttgcttgggtgtccaacatgcacatccgtaactgtaatgttcaattcttgaccaattgctttgattgcttggctttcttgttcaaattgtcctttcatattttgccattttgtgtcggtgcccgcatggccagcagcagcagcggccaagtcgaacatggcacgggcaaagcccaaattgtatggacactcgtcctcataattgatctccatttttgcaatgtcttaatgagttaatttagtcaatatttttaaattaattatactctcgtaaaattcacatctctccaaaaattttctttaattattttcgaaatttgtttaattactcttcagctgtcgatcgatttcgcccacaatttgtgcttctcctccgcttgggcatccgccgcgagagaacaaatcactttttattccatccacagtatttttcgcggttgagcatactgtagatttgtccacatcagcagcagagaaagtgtcaatgtatttggacatcacagcaaccacttgctgactgcccgggcagcacgggaattctgtggaatttaaatgtaataaataattttgttaaatacctttttggaaaaataaacatttacattgaatggtttaaatatttaaaatttgacatttttttatttatttgaatttacttggcattgcatggcaacagactaaaaagaccattgagaagatggagagcagcagagaagacatggcaaaaaatatttttatttaattaatgaataaaatttgaattgatgatattttttttgtgttttttctgtgcacttaaataccccctttttctgacttaattaattgacgtggcctttagtagacaaaaacatcaaaaaatcatttttgcggaaattgctgctggttttcttataatctacgctttcacatgaattttcaaagacttaggaaatgtatgcagagaattataaatattaatattttttttaaattattatatttttcataatatttttgaacatgaaatatttcatatgtaatttctcaacaattttaaaaattcgccatttttattgcaaaaatgtatttcggccgaaaaagcaagccaaaaattttatttttttttatcaaaaaactttcttatttcttttctataaataatcaaattaaaatattgatatttagaactgagaatttaagaaatgacttttttcgtacatttctttcactttttaagaaaatgccgaaaaattgccatctgtgaaataccaattcaaatacggtatcaaaataagttatggcccaattgttttaaaatttcgaaagttttttgaaaataatttttatgattgtttaatttaattatttatgcagtttttgtcaaaattggttgcccccatcagtttttgtcttatgattttttttataatanataaacggaaaaaggatgacctaatatccctattaattgnngttgtcataactaataaattcc

SEQ ID NO: 37441 - DNA, 1383 bp, Heterodera glycines
tccaacgcagaattaaagtacaggctatagggaagctactcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctactcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctactcccgaaggattcggtctccccataaatctgggcgcgtcggttcggggggactgccccgaaaacaaaaaaatcgattttttcaagtgtctgtttggggtactcaaacaattatggggagcaaaaatccaacgcagaattaaagtacaggctatagggaagctattcccgaaggattcggtctccccataaatctgggcgcatcggttcagggggactgccccgaaaacccaaaaaaaaattttttggataaaaattatttaaatgaactgactagataatatttaaaataggttatttctcttcctttcagtatccctgcaaagtttggtgcgcttctgatcagtttctgaaaaaaaagttaagcctaaactttttggcctgtttaaaaaggaattaaaaatttttaaaaatttattcatctccctttttgatagaaaaagcatcagagtgcctaaactagcatgtaaataaaatttggtgcgtttcagagcattttctgaaaaaaatatttatgaattaattatgcaaaaaacaaataaaaacgaaagactcagattttcgaaaatttttttaaaggaattaaaaatttttaaaaattttattcatctccctttttgatagaaaaagcatcagagtgcctaaactaacatgtaaataaaatttggtgcgtttcagaaccctttctgaaaaaatatttaagaattaattttgcaaaaaataaataaaaacgaaagactcagattttcgaaaatttttttgagccagctagctcggcgctcatttcagtgtaagttagtcctttaccggggagtatccctgcaaagtttggtacgcttctgctcaattagcaaaaaatatgagtgatcgaattttcactaaaaaagttaagcctacattttttggcatatttaaaaagcaattaaaaaatttttaaaatttaataattttcctgcaccgaaggtactcactcggcctcttcgcggcctcgtggtgggccttcgcccccccccccccc

SEQ ID NO: 37442 - DNA, 966 bp, Heterodera glycines
gaataaaaatcaatctttttaaaaaaattttttgatcccatccgatccttcgggtgcttgagaggtcagggatccgctccaacacattcccaaaatcaaaatttcccatgccaaaattaggctgattttgatgtgtgttaaaggtcgggggcggctgatagttcatctgcggcattggtggttgttgcacttgaacttgggattgagggcgaccaaaattttgttgaatcgctgctgtattttgctgacccggcattcgaaccggtatgttattggctcgacgcgcaaaaacagccgaatggtgtatttgctggtggatttcaacaccatgttgcgtcaaatttggtgccgggtttgtgttcggattttgatgagcactatttagctgaccaacgatgaccctcccaatttgttcggctaacaaccctatttcattaaggttttgcgggccaaccccaacacagcggttttcattgaccggagtcgaagttcttctaatgtttggatgatcgaagaagtcatcttcattttgggaatgtccaaagacaaaatttcgaaaaatttgttgggttgggcctgccctctctcccaaattttgtgtccaatccgttcggtttcgcataaaaccttggtttgcctactcttcttcgttttcgtcaaggctggcacgttcattttgtcgcaactgtcaagtgcgctgtcattgttcgggttcaaaaggcgccgtctcatttccatcgagtccagctgctccgaattctccaaattgggatccgccaccaccacgttttggttcatcacgcctaaagttctatttggtggattctcccgaaaaaaaacatttccatctctgtcgagcaatatcccttcattttgagctcgctgtctagtcaaacgagtatgattgagtgtccgttccaagttttccatttcaaaatcgactatttgcaccccccagggacttga

SEQ ID NO: 37443 - DNA, 616 bp, Heterodera glycines
tatcagtacaaaaacaggatttgtaaatcctattacgatagctgtactcattggcacataggctagacttgagccctggaaaaaactgtaatcctgtgcgctctaatatttggttatatttagttgaggaccgggttcaggtattgcagggtcttaatgcccggctcgggttcgggtccaataggttctgaaaaaaagttggccttcaccagcagttggcacagttgtccctcttcagaatgaaatgattattccaatttttaacacgtattttagcacatattttggggtttttagcacaaatttcagcatttttagaacaaattttattacatatttcaatatcccagctctagttatggtggtcaaaataaagaatacaaaaaggcaattaaaaatttttagattttttattcatctccctttttgatagtgaaagcatctgagtgcctaaaataacttgcaaataaaatttggtgcgtttcagagcagtttctgaaaaaaatatttatgaattaattatgcaaaaaacaaataaataatgaactctcttccttaataattttcctgcaccgaaggtactcactcggccgcttcgcggctcgggtggggcctt

SEQ ID NO: 37444 - DNA, 846 bp, Heterodera glycines
aaacaaaaaaatcgattttttcaagtgtccgtttggggtactcaaacaattatgggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaataaatcgattttttcaagtgtccgtttggggtactcaaacaattatggggagcaaaaatccaacgcagaattaaagtacaggctatagtgaagctattccggaaggattcggtctccccataaatctgggcgcatcggttcagggggactgccccgaaaacccaaaaaaaaattttttggataaaaattatttaaatgaactgactagataatatttaaaataggttatttctcttcctttcagtatccctgcaaagtttggtgcgcttctgatcagtttctgaaaaaaaagttaagcctaaactttttggcctgtttaaaaaggaattaaaaatttttaaaaattttattcatctccctttttgatagaaaaagcatcagagtgcctaaactaacatgtaaataaaatttggtgcgtttcaaaacctttctgaaaaatatttaagaattaattttgcaaaaataaataaaaaacgaaagactcagattttcgaaaattttttttgag

SEQ ID NO: 37445 - DNA, 385 bp, Heterodera glycines
ttggcaattgtgaggattattggtcccacaaaaaaaagaataaaaattaaaaaaaaccatttttagggggttatttgatgcactgagcacgaatatggcatccatttcgaccaatttcaaaccaggacccgaatacgaacaaaaagtcgaaaattcaatttttggattttgcagttttattctaaaattgattaaaactagcagaaaataaatcacaggtaattttaacagcaaaaataagtcattttatgtagattcgaacatatataaagtaaaaaaaaaaaaaaaaaaaattaaattttcgactttgttcgaattctggtccggggttcgaaatggatatcttattcgtgatcagcgaccttgaaaacctcaggaaagactt

SEQ ID NO: 37446 - DNA, 1147 bp, Heterodera glycines
  misc_feature (17)..(17): n is a, c, g, or t
  misc_feature (1138)..(1138): n is a, c, g, or t
ccgtgactccaaaaacnccgcaatttccttaatccgcaattgcgtccagccctgccgagcagccaactttacctggtaaaaataggcactgggagtgctctccccgacaccgttaaaatcgggcacgtcgatgaactgaaagttgtgcaggaaaccggggttggcacattggaattcgcgttgttcgaggacgtgtggcaaattgcccaaatttttataattccaattgtaaagagaggccaattcagcacgagcacgcccttgagcgtcgagctgaacggatggcacgcccaaacgaatgagacgggcgaaaagggactgctccatgttggcgaatttttggtaggcaacgttttgaacgacagggggaagctgatgatggtcgccaatctgcaagacatttgtcatctccaaacccattgtttctctaaactgaccataacccatcgcttcagccgcgaccgtccgtcctgggggtcctggagcagcagaggaatgaatgtctccacctccaaaatctgtgcagcctcctccatcaaaatattgtcgtagcgaaatccgaggtcgaccaactcgcgccgtctcagtgccgcgtgggtacaagtcatcgcgatgattttcgcttctttcacctgacaatgggttaaagcggagaagtcgttagttgtaagagttccctgccaaacaattacaagcaaataactcgcgcggtccctcccattgcgaagcaattcgaatgctctgaactcttccaacttcttgaaaatgtcttttatccgctcccatccgtccaacgcaatcgtcaaatcttcttcaaagtcacgtaactaaaagtgtgaaagattttgcgatttccttccctctatagtaaatttctctcacttcaaatttcaatgggagtaaattggattgatgtcgtcgattttcgaagaatttggaaaacggaaaatgctccgcgacaaattccttcggtaacgcattttgctggtgctgcttttgcatggtttgcacttgctccataaaatattcccatgtcttgcaaacctaaacaaattgagacaatcactcgcatatcaaattgagtcattcgcatgtgccaccctcttcactgcttccctctctccgttaagaatgcatntataatgaa

SEQ ID NO: 37447 - DNA, 1354 bp, Heterodera glycines
  misc_feature (21)..(21): n is a, c, g, or t
ttttatttgtataatattatnagtcgtaaaataaatattgatatatatagattgtaagaaggtttctttgactttttttaaatttcctatgttgcaaaaaatttataatgtaaaactaacttatatgaccgattcaaatattctttagagattgaacatctttaaattaataaatatttatttctcaaaaaatcacttgttgaaaacaagagaccaaggaagacttaaacaaaaaaaaaattcataaacacaaaaataaaactgaaagtctgataattaattgttaagaaatagaaatatgggtcttacaaaaatcatctcgaaaaataatccaaagttccagttacggattacaattacgcacaaatcgcaaaagcccgtaatccgtaattgctgggtccaaaaaggccgtaatttctctaatccataatccgtaattggtgcagccctgctcccaaatatttatagttttgctcaaaaatttgaattattttttttattgtaagatatttttcctaaagtactttatcattttgtcgtgcattcgttcccagttgagtttattttaatttctaaactcaatcagcaactattattttagacaaattatattaagaaatgcaattaatttttctaatttttcaaattaacactaatccaaaattcggcaattaaatttgaactatctttatttaataataaataataataatgcttttcgtttatataggtaataaaaatatatttaatagtcaattgctaatcgtaatattttgaaaatatctaaaaaaaataacagaattccttcatattctttttttttaaatttaacagattacaggacatgagaaagggattttttgacaactatcaatgaacttatagtataatgaataaataataattaataataaattttcaagttcaaaaaatattatatattttaaaaatcattttaaattttgaaataaataaattatatttcaaattaattatatatttttttcatattaaaaacaatgaaatagttttcgacaaaattggttattgataatatcaaattaaaaaacttagttttctattaaaagaaaactgcgaaattacgaaattaataaattaaattaattcaatagatttatataaataaattgtaaagataaagatttatctcttttatatttataagtttttaaaaaattctttttttgttctaaataaattaatattaccaaattttgcaattttattaatatttcttaaaacaaggcctaaaaataataaagaagtgcgaagaattttgaaaatttttccataaataacaaaaaaaagttaaaaagtccaaaacgctaaaaat

SEQ ID NO: 37448 - DNA, 867 bp, Heterodera glycines
tgtgtggtccacaaccaagtggctcgcggggaatgcgttggtcctaacagatccggccgtgggccgtacggagggggacagccgcgtcagcagcagaaccgcattaccgggatgggccccctgtgacccgaacccttggaatcatgaaggccaaaggtggtagatgatgagaccttaatttatcgcatatttatttgacattttatttgctattgcttagttataaatggactaaattgaatgctgtgtcttctggactctgtgagtatctttaaaatgtccaaaatcgaaaaacaatttctccaatgttcgttgtttgcccccccccccccctccctccccgtttttgattgtccaccgtttccccctcaaatggtcgccgccctttctctgctgactccgccccctcccatttcctttcgtttctttgtgaaatggcgacgaactccaaaacagcagaacaaatccgtcggtcctttttctctccgccctttctctgacaaaattcggccctctgaacgccctcggcgctttcgttctgtccgactcagtcgcgggcagtgatccgagcgaacgattttgagtcggtccaccgatcaaccgaatgatagtggggacggcgagtggccgcggcggagggacgacccccgcggcagtcccagcggtgaccaaagtgcgcacaaccgacggaggaggcgcagaggcggcaagtcttgtcgctgttcaccgagcacagaaagggcggaacagcggtggcaatggcactgcacttttggaactttctccgccgacggcgacgacactttttgggcggccaattcagtcccagcaatactgcacggaacagcagcgaccgccgctgaatgg

SEQ ID NO: 37449 - DNA, 648 bp, Heterodera glycines
tccgtctaaaccttcatttgtgtgccattcattcgtcgtttcaattgccaattgcaaaatcatttcattaaatatgaattttgtcacatttccatatcattcgcagtaaatgcaaaatgccaaggtgggtctcatatttttgcattgaatattcactaagtttggtttttcttgataacctttcataaatgcaattagcattttgtcattgacctaattcattaaaatggattagtaaaattaatttccctaaataattgctcaccgatggacttgcatttaaaattgaaattaaaaaatgcttagcaataattatataagaaattaaagagaaagaataaaccattatgtgctttcttaaataaaattaatgttccagtaaaattaaaaagcacattaattataattttcaatttatttacataaaagtcaattaaaaatatttttttattaagaaattgactaatatctataaaataattcaattatatttttaaattaaaatgaaaaaatggaaaatcacatggccttctaaaccgagcaaaaatttgattttaaataatgatcataagtagaataatccaataagccttatttatttaatataatttgtttatcatattaaataatgatgcaatatttaaaaat

SEQ ID NO: 37450 - DNA, 1715 bp, Heterodera glycines
  misc_feature (73)..(73): n is a, c, g, or t
atacatatttgtctcccctttctctttcattcctgctctgttccaatcgcaatttagaccaccactgatctgnagtcttaaatagagatcggacatggagcatgcccgtgcacgggttttacggaccccgtaccccgtgttttttaagggctgacacagatttcacggggtcacttagttttagcctgtgacccgtgtcgtttccaaccccgtagcccgtgtatgtggaaaatgccgatctctagtctaatctataatttaagtacataattcattttccattgtttttacagtcacctcttttcaggttattatgatattaaaattgaaagctccaattctgctgtattgttttgttcaatgtttaaggtgacaatctttaaattcttaatgatcgttgttatttttttttaaattagtgctgtcaaagtggacaatgccgagcaatccgaccaaccaactggcgattcttcctccggacaattcccaatttcgtatcctccaataaaatatgaaaacgatttggcctatgtggagaaaccgagtggcaacgagcgttgtctattctacgcggaaggactttctgtcgtcgtttttgccactaaaaaaagtcaatcggcgtgggcggactatcgctctgacaccaaagaaagtccgaagtataccgcgtcaattgaatgccaaggcaatatgaatgtgggcagcagctttgagtaatttacagttattgtaattcatgaatccataattctttaattttttcagtgtctatttgaaaattgacggcaaagcggaaggagttgtgagagctgacattggaaaaaaggacgcaaaaagtgtcttcactgtcgaaggagccgaatttatgtgtgtttcttctcttgtggtggtgacgctgtcccctccttcagactcaacttcaacgtcacacaagtcggcttttggcaattggttggtgccaccgtggaaagaattgaagtgaaaggctcttcggatttcctgaacaaagtaattttgttattatttttttattttttttataatattttaacaattcagaatttgaatgtcgacaaaaaatggactttggagccttcagttgttccatccacaaacattaacggcttcaaagattacagctttgcttgtggtcagaccaacccgatagtgtgggccctaaaggactcaaatgattacgcagtcggaattacgctgaacaatgtgcaggtagaaagaaagaaagaccatcaattataaaaaaaaacttcataaatccactcctttcattacataaattcttttcaatttatcttgttttggcctgtcaaaacggttggcagaaattaaggctctattgcagttcccacgagtataaaaaaaggcacgaccataaaataagttagcaatttaatgcaccatcactttttctagaagcatctcaattaaacattattgaaatcattcactagctctaagggtactttacagcacccgtttttaccaatttcgaacccctgacccgaactcgaacaaaaataaaattagaaaatttgtatggatgatatcctcatgggcatcttgctcatgagggtattattggtacagggagcctgtcaatttgttgtccctgtacagcttatgtagtgaatggtagcgctgatctgagcccggattcgtgatcagcgacctcaaaaaccccttaaaacttattttca

SEQ ID NO: 37451 - DNA, 1110 bp, Heterodera glycines
tgtgtttcccgtctttttgtccccttttaacttgccgacttccatttttttctttcaaatttgagtcaaaaatcggcaaatttattattctcttgggatttaatgtattttcaaacggataatttctgctagggttttacgcttgcgaatttatcattttattcttctaaattacctcatttgttaggaaatttttgcaaattttagtgatttggtatgtaattatctgacaaatatccattttctcgaccagtcgtaagtcttgggcagaattgaatttatgtctgtgcctcctttaatagtaatgtttaaaattagtgttactgcatttggcggcattttataggaagacaaaggagaaatggcataaaatttttgttgattttataagcaaacattgaaagagcagcatttttgtttatttgctcagtgagtacggcaaattgaaggaatgaatgaattcttttgcggcacaaaaaaggaaacacttatctccccccccctccattttaaaataaattttttctatgtttaattcagggcttgtactctctttccaaggacgggtatactgatttacaaggacacaacgggcaaatttcacgaaaatcaaggacattaaaaaattagttagaatttattaaaatgacttgtatttctcaccagaatgattttttcaattttttttttgtttccgctgatcactttactcgcttcaccgcatgcgcactttttgcggcgcgcttttttcaagaaacttttagggtccagcggtgccgatcaggcccgtagccaggggggggggggaaccacccgaaaacacaataaaaaatcaattaaaatgtttctccatttttaaatatagccaaaaagccaatttttaggttcaaaatcgtttaacagattgtgacaagatatccgaaatttcccggaggagcctgacggcactgccggacccaaaattccataaaattttgaaaatttatccaaaaattcagaaaattgatcattagtggactaaatatgttaacaaacaataattaaatattatacattaaatcgattttcactacttgattaaatatgagaaaataaatagattttgaataa

SEQ ID NO: 37452 - DNA, 1075 bp, Heterodera glycines
ctagtctaatctactcaaaccggttcagaattcaataaaaataacattcacggtgcgaaaaatggggtttgacaagtttattggggaaaaaagactttacaaaataatacccctgggagaagggagtgggaaacatgatttcaaaattttcaattttttatagtctaatctactcaaaacggttcagaattcaataaaaataacattcacggtgcgaaaaatggggtttgacaagtttattggggaaaaaaagactttacaaaataatacccctgggagaagggagtgggaaacatgatttcaaaattttcaattttttctagtctaatctactcaaaccggttcagaattcaataaaaataacattcacggtgcgaaaaatggggtttgaaaagtttattttgaaaaaaagactttacaaaataatacccctgggagaagggagtgggaaacatgatttcaaaattttcaattttttctagtctaatctactcaaaacggttcagaattcgataaaaataacattcacggtgcgaaaaatggggtttgaaaagtttattggggaaaaaaagactttacaaaataatacccctgggagaagggagtgggaaacatgatttcaaaattttcaattttttctagtctaatctactcaaaacggttcagaattcgataaaaataacattcacggtgcgaaaaatggggtttgaaaagtttattggggaaaaaaagactttacaaaataatacccctgggagaagggagtgggaaacatgatttcaaaatttttgttgaaatatttgtcgtgctctgaaggcggggagggggggggaccaaacccctcgggggacatacaaatgaaatagataaagctcaggttgttgagatcggtgagaattgttgttgagcagagacgaagcaaatggttcagatcatcaccatttggaaagtgcaaatagggaatgtttggcgcaaaaattggacagatttgactggccaaaacatcccaaattaaactgagattatcttgctgttcgcatgaagaagactgatcgaaagtcaaattgttgccgat

SEQ ID NO: 37453 - DNA, 766 bp, Heterodera glycines
ttataaactaatggggaaatttatgattttgagagagaaagtaaaaaataaataaattacgtgcttaaattatcttattatttttgtagatggtttttaattaaattgtaaaagccttgacgaattttgaaaatttactctttgtgccggattttctgagtcaaaaaatattcattagctcaattttcattaacactgttttttggcagagttttggctctcaaatctcgccgtgctcgagttcggcagataacaagagaattttcatagtaatttagtatattaaacaattacatgtaattagtcggctttattacaatgtaattattctatgtggccagaaaatacaacgaattaacaaggaaatggctctcaaatatggccaaaaaaaggctttgacgaaaatgatgaagccaagatcgaaaattaaatccttgtgctgactgtccaaacaaggccgaccgaggtcgatccgtttctagtcgattttttaaatttatttcgattttcggggaggattatattgaggagaggcggagggagttcggggagggttatattgaggagaggcggggggagttcggggagggttatattgaggagaggcggggggagttcggggagggttatattgaggagaggcggggggagttcggggagggttatattgaggagaggcggggggagttcggggagggttatattgcggagaggcggggggagttcggggagggttatattgaggagaggtggggggagttcgggg

SEQ ID NO: 37454 - DNA, 909 bp, Heterodera glycines
attgaattggcacgcaaattcagcgaatgtttcttttgtgttgtcaaattggcaattgtgccatttagaaaaaatacaaaattgaaaatggaataatcgaaaatgaatatggccaatcttcgcgtggcatcggcacttttcgacgcggttggccaacgcaatgggcgccattggtcggggactgataaagcctttttataggattattctggcacggccgacctttggccacaatggcatcttttacatataatgaggccacaacactctcccacaaatactcaaaccgccgacagttgggccaaatttgtcgcggcgtggcgtaatccaatcggtcgaaacgggtgaaatgaaatatttgaagtaaaatttggcaccaaaaaagtaaatgccaaaaattcaaaaattaatccgttcaaacaaagcgaaaattggaaaataacgacagaatttgacaccgaaaatatattgttggatggcaaccatttgaggaggtcgaagccgccgccgaatatttgtttttctcgcgcattttctgagggatgactgtgccggggagggaattttttggccaatttgccaaacaatcccaattagcggcactttctttggccaagcgaagggagaataagcttcatcttcttcccgccgttgttttttctgccttttctattgctgttttttgtggccacattcattcgtgccactttcttaaaatgcgcaaaatgccaatgttttggcatttgttgggcccaaagtgatctttgcttaattttggtctttgtttttggtcgaattttaaatttcaaataaaaatttatttaaaaaattgtttttgaagcaaataattattttgcaatcgaatatacgggaaagttgaattttttgcgtgccgccgggctgttgggt

SEQ ID NO: 37455 - DNA, 1157 bp, Heterodera glycines
  misc_feature (55)..(55): n is a, c, g, or t
  misc_feature (1133)..(1133): n is a, c, g, or t
  misc_feature (1136)..(1136): n is a, c, g, or t
ccgtaatttattttcagatttgaaattgaaaaacggatggcactcgtccaattgncgcaacggggaatatttttgaaattctatgcacccttttctatttaaaaagtcaaatccgggctcaaaacagaaaatgaacgcacctttttccaaatttcgaagcttttcaaattctgcctctaattttgatttggtctcttcgaactttgtcatttgtttccttaaaaaataacttttttctcaacaataaataataagaattatttaaaaggaaatattgatgaggtccataataaacccattaaaaaggtacacaaatctcttttttgtgacatgacatataaaaacaacaaaaataacaataaaaagtagaataaaaaaggaaataaacaaaataatgcaaaaactcaaattcttagggagccaacattaagccaatcattacaataaacggcgcttcgcagtttttttaaagagcggagaatccgtgaatttcaaataacccctctggcgctgttcgtcatgagtcgggaatctgatgtcccaataatggtcgggagtcttcggtaattgactgattgtgaggagaggagtccgcgaagactgcgaagaagagacggacgacttgcgactcgtctcgttctcccgtgtcaaacaaatgctcaacatggaaattccattcatttgattaattaactcaattttgacataaaattcacccgttgtccaatggtaacaaatgtttcggtttgttgtcgttggcttggaatggtctctttgttctgcagccgggatgagtgctgaagttgatttcacacctaaaaaacatacgttcactaataataatcatggaatgggtcggtcggacttcgtttccttcgccaaaatgcgactgcgcggactgtcctcccccgcctcggccattcctttggctgtgattccgtttcgttttgcctgcaaaatggaacggactgatcatttgcatcggcactctccgcgtgctcctctcacccattcacggcacacgtcccacagaaaagaggtcggcgcgtccgttttgactgcccgcggattgcagtgggagatggagcagcggaagcccgcgttgagcagggcggaccggaagacgttcattntgngcgaggggcattcatgacgac

SEQ ID NO: 37456 - DNA, 1460 bp, Heterodera glycines
  misc_feature (1349)..(1349): n is a, c, g, or t
ctgctagcctccagactggggtttgctgtccttctgttcagtggcgaatggggcatttgcaggcggagtgcgctgagatgctcggagtagctgcgtgagctcggtattgaggccagcctttcggggtctggtacccggatcgggggagtgctgtttactctgggtgaattgtgcaatggtttcgggtccgtgttgactcgagctgggggtcggtggcggtcgcgtgcgacacgtaccagcaaccagttcggtccagctcgggctctcagttgtgcgttctcggtgtaaaagccggtcatctgttcgacccgtcttgaaacacggaccaaggagtttagcgtatgcgcaagtcattgggtgttcaaaacccaaaggcgcaatgaaagtgaaggcttcttacggagctgatgtgtgatccctggcactgcggtgttggggcgcaacatagtcccgtctcgatcgcatgcgatggggcggagacagagcgtatgcgctgagacccgaaagatggtgaactattcctgagcaggatgaagccagaggaaactctggtggaagtccgaagcgattctgacgtgcaaatcgatcgtctgacttgggtataggggcgaaagactaatcgaaccatctagtagctggttccctccgaagtttcccccaggatagctggagctcgttaagcagttatactcggtaaagcgaatgattagaggacttggggacgaaatgtccttaacctattctcaaactctaaatgggtatgaagccagggttgcttgactctgaacccaggcgttgaatgtttgagctccaagtgggccatttttcggtaagcagaactcggcgatgtggggatgaaccaaacgtggagttaaggtgccaaagtgcccgctcattagaccccataaaaggtgttggttgatatagacagcaggacggtggccatcggaagtcggaatccgctaaggagtgtgtaacaactcacctcgccgaatcaactagccctgaaaatggatggcgctggagcgggccacctatactccaccgtcattggcttgtacacgtgcttgtcgcgtagtctggccatgacgtgtaggagggtcgtagtggttgcgttgaaggctttgggcgtgggcccggccggagcttccaccagtgcagatcttggtggtagtagcaaatattcaagtgagatccttgaagactgaagtggagaagggttccacgtgaacagcagttgaatgtgggtcagccgatcctaaggcaccggctaacgccgtaacacactacggatgacgacttttctgtgcttgcgcagttggtccatccggttgccgaaagggaagtgngttaacattcccacgccaggctagggaaatgacggttcgcaagagctgttttgcgcggtaacgcaaatgaactcgcagacgtcgtgtggagtccgagccagagttctcttt

SEQ ID NO: 37457 - DNA, 941 bp, Heterodera glycines
accttttggctagtcagcaatcgttgcttaacttgccagatcggacgggtgcgcatgattccactgttccaagcaccccaccaaaagcaaaacgatataaccaaaatataaaggaaaaattaaaaaaaaaatttttctccatcttcctttttgatactaaagcatcagagtgctaaaattaagttgtaaataaaatttggtgagctttagagcactttctgaaaaaaatatttatgaaacaaaaaaatcgattttttcaagtgtccgtttggggtactcaaacaattatggggagcaaaaatccaacgcagaattaaagtacaggctatagggaagctactcccgaaggattcggtctccccataaatctgggcgcatcggttcggggggactgccccgaaaacaaaaaaatcgattttttcaagtgagtgtccgtttggggtactcaaacaattatggggagcaaaaatccaacgcagaattaaagtactggctatagggaagctattcccgaaggattcggtctccccataaatctgggcgcatcggttcggggggactgccccgaaaacaaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacatttatggggagcaaaaatccaacgcagaattaaagtacagactatagggaagctattcccgaaggattcggtctccccataaatctgggcgcatcggttcggggggactgccccgaaaaaaaaaaatcgatttttttcagtgtccgtttgggggactcaa

SEQ ID NO: 37458 - DNA, 1566 bp, Heterodera glycines
  misc_feature (68)..(68): n is a, c, g, or t
tatgtgtgcaataaattgtattaagactttaataagatttattagtttgaccacgaactaaattttcnccattcaataaatggcttagtctgaattgctgtgaaatttgttttcgtcaattggatttccaattctttattgaattcttcatttgtgtcatagggagtaaagtcttctaacattgttcgattgataatttcaaccaatttgggccattccaccataaatcagaattttttaattcagataaagacattcctcgggattctatatctgctggattttatttcgattttatgtaatgaaattttaggtttatgttgctgtctgtcgtattttgatttcattaattctattctttacaaatgtcggtaattcttttttgtatttaagccaactaagtacacatttcgaatcagaccacaattatatgtttggtatttcaagtttagtttctttaataatgaattttgcaattcgtgtaccgattaataaggctaaaagttccaattttggaattgttaattcttttattggggctaatcttgttttggcaaaaactaagtatatttcatttgtttcgataaatttcaaataagcaactgatgcataagctgctcctgatgcgtcggaaaaaatatgtaattcgattggaagatttattgaatttttaaaaggatagcgttttaaatgaatttcttcctcatacgcaatttcgttccaattttttatttcttcatcgctaagtttgtcatcacactcttttttggatttccatagattttgaaagaatcttttatgtgcaaaattacgggtgaaatccaccccataggatcaaaatttatggcaattaaatgaattacatttcttttagttgttcccttggctatgattggaatatttattgggattgttaattcgtcattttcgacattccattttattccaagaagcttgctcaattttggtatttcagaaccttcaattttttgtatttcgttgttagattcttcatgatttgaaataaattctcttaaattcattgatgcaattttaaaaatttctttgatccaaaaatgtttaaattttatctcgttatgatcttcacacatcattacgaaatcatccacatatgcattttcagctaattctctgcataatttttcgaatttatcttttttatcggatagattcagatcagtgtcatgtgtatttaaatttttgaaattttcatacattggttcgattttggatagatggagttcaattactgctgctaacaaaaatggtgaagcattaacaccaaatggtagtctcttaaatcttcgaatttcaatgtctttcatttcgacatctcttttagttaaattgagttcatttattgtttcttttttaatccataagtatcttgtagtatctctgtcacttgtgtctaaaccaacttgtaaaaatgctttctcgatatcgccaattagtacatattttttgagtctgaatctcatgatcattccacataaatctggcattttcttcggaccttgaaatatttcgtcatttagagaatga

SEQ ID NO: 37459 - DNA, 290 bp, Heterodera glycines
  misc_feature (25)..(25): n is a, c, g, or t
taattattaacataaatattatttntgtgcacaatcgctcattacgaatcgttgccaattttcgttctttggtcgtcgtcatccattctctttcgctgtttctcaaatgaacataaagcgcttcttcggctgcgtgaccttggcgaatatctgttaattaagagcaattaaattagaaattggcacagcaatttggtaatgtaattattatccaaagccggtaatagtaccgatggtaccccccccccccctttttcgaaaaaataaaattttttcgagaaaagattgtg

SEQ ID NO: 37460 - DNA, 959 bp, Heterodera glycines
tagattagactagaaatcattgaaaatattgaaatcatgtttcccactcctttctgccgaggggtattatttggtaaagtattttttcctcaataaacttttcataccccatttttcgcaccgtgagtgttatttttacagaattatgaaccgtttagagtagatcagactagaaaaaattgaaaatttcgaaatcatatttccctctcccttctatcaggggtattattccgtaaagtctttttatccgcaattagcttgtgctcaactacatttttctctgccaggacgttgatttttattgtaatatctgcacagtctcggagtcgaatagacttgaaaatattgaaatttttgaaatcatgatttcctcttcattcttccagtagtaaatcggagatatgagtcaaaataattgaaggattcgtgatcgggggccccaaaaaccccagagaatacatttttatgactatcacaaaaaaaattttgcaaaacaaaagggtccccccttttgaaaaaattttcaaaagtggtaacttttagactagcgccgaaaattgtattttgaaactttcgacatcgctccaatttgccgaatgccgagccggcagcaaaccaagccatattatttaaatcaaaatttacgcaatttgcattttaatttggcattaggttttcttcatatgtgaaaatcaaaaaatgcatgttgcctttttgagatttgcctgaattttgaggaattgaaaaacgcacctaaattttcaaaaattttgttggaaaaaacctaaataagataagctaagatattcatttttaactatttcaattatcgcataaatttcgacccaattcattttaaaatttgtgcctatgcttggagcggggatagttgtttttggggttggcactcttttcgggtgagttgtctgttcttcgttttcctggtcccatgttttttc

SEQ ID NO: 37461 - DNA, 1256 bp, Heterodera glycines
  misc_feature (44)..(44): n is a, c, g, or t
aaacgaattgggcatttatttaaaaaacaaaagcgaaaattccncggagagttaacaaattaacgatgcttaatttaaatgttgacttgagtttattcattttttcatcagataaaaataaaataatgaaacgaccaaattttttgccttaaaatctctttgatctttggtcattttttcttttttctttggctgcgaatggcgggggttacggtatttgaaagtgtacggtagagtgggtacacaaattgatgagaagtgctgctttttcggcatggttttgccacaattcgcttctcctctctcttcccatttcagtaccatccccactttttcctaaatttacaaattaatttccttttgtttgtttttcattttcacatgtccgcgttcgccttccccagcagttcctcccaatttttcttctgttccgcgtttagtccccccgcgtgtttttgcagcaccgtcaaaaaggcgtcttttgtcttctgaaagtgccaaaaataagtgccgttttgaactgatcgaaggccaaacaaatggtgatcatctgaccgtccaataaatttcgtttcattacgtcaaaatatttgaggggaacgtccgcgtcgctgtaatgctctttaaaattggacattgctgagcgccacgagcgatcgtcggccaaattggagggcatttggacgaaagccttcaaatggacaaacgaaggtcaacacattgtatcggatgtgcatttccgacttgcaattcgttgatgcccaacatcacataccgctgggaccgtccgaccgcgtcagggtcaatgcccccgtaggcctcggcaacgtccgaatgcgctgagaaaagcctgaaaggcactgactgacaacctacacatgccaccgttcactcatcagtttcaataataatttgctagtttccattaattattccctaatagtaattgcccctctaagtccccccccccctttttgcccactctttgtaataatccgttgccgccggcttgccaactttcagctgttgcgcatgcttttgaagtaattcactgttcaccatttgatcaaaaattattttgctttatctatttgactgatttaatgttgcgggaaaaataataaaagaaaggaaacacaaaatggtgaataaaacggggggggggggcatcaaacaaagcggaaaaagggggcgggggaaaggggggatgagtctaattacgaagattcaaaagtgacaaaggggagggatcgtag

SEQ ID NO: 37462 - DNA, 1278 bp, Heterodera glycines
  misc_feature (1255)..(1255): n is a, c, g, or t
tgggaatgacatttggcaaattacacctaaatggcaatgtccacagggcatgtgaaaaagtacaaaaggaagtggtggagggaatctgatttcgaaaattggttctgaaaattggtgctaaaagttaatgaagagaaaaaaaaattattatttttcttaattacttttcggcatcactgtagttatgtagaaattcgcatgatgaccatgtaccgtacacaagtcaatggcaactcttacaataaaaaatttacataataaagaataagcctagcttagacttttaagcctaaagcttaggccaagtctaaacaaattgtacgagttgccttagtaccagttgtcatgacaccccgtaccaagggtggagcgcggacagaaaaatcccgcggatcgtgcaaacaaaaaaatttcgcacgtcgcagtcgcgctccacccttgccccgtacaaactttttttacaccttaaaataggtctaaaattattaattttcaaacatacttaatttaatttgtctctctgtagtccaaataagatcgcaaaaaacaattattcttgctaattattcgacatgaagcgaaccaacgcatcaaacatcactccgcctcgcgcaaaacgttcaatggcacctgcacaggacctggacccaaacgctgtcgcactcgcggagcaagaacgacaacgcaccctggtcttcattggcctcccggaaagcaatgccattcgcccatcggaacgtgttcaggaagacagggaagccgccaaaaaaatcctggaccatcttgaagttgaggcccaaccaaccgccgtctttcgactcggacgtacgcgcgcttcatattcttccttgagttgttctttggtcagcgctgggcggacgaacaggcggttcaggttttgtagagaacggagtcgagcacgcttgcgcttccatcctccgagtgccatgtgttggtgtgtggttgttggcatgaccaccttgagcgggcgtggtgttgttcgctgcgggtcgtaacgtcggctctaggaaaatccgacaccggaaaatacgacacaagcagtaaatccgacattggaagaaacgaccccaaccttaaattttaaaaataatttatgttttttttaaattgaattgattgcattagacgcgttcaattgtaaatgatctgtttttttcatttcataaactcgtttgttatttttacaaaaaaattaatataatatttttaaaaaaataaatttttttttcaaaanttctgatcggggggggggggggg

SEQ ID NO: 37463 - DNA, 876 bp, Heterodera glycines
atgagccccaagaaagggattgaaaaattctctcctccatgagaaaaagctgttaaaaattttaaacatttatccgtctgctgcactttatgtaaagactcctataaatgcacacatacgtaaatgaatgaaaatccattagtggacaatacaatctaatttgggtgagaccaaatgcataaatcaaatgagaatttttccacttacaggattttttttcaataattttcatataaaataacagttttatatcatagcaattttgatttttttaaatttattaattttgccatttttgctttaagtccatgttttttcactatttttgggaattttataagaaaattgcaataaaacgaaaattacatcggctttttgaaattttcaaaaaatatactaccaaaattcgaaagtttgagtttcatggaaggaggcaaaagaatacagataattaaacttaaatttttttttaaaatctacaaatttatatgacattttatggttgtttaaaatgttttttattttaatatattttgttttttagtccacgcttaacccacatttgtcgtttttctatacatacaacgcattgcctttttgttttctgagtgtccaagaatttttaacatagcctgctattaagtatagtccttctcttcataatatactaagaaatggatataatgtaaagcctcgggtgggaattgaacccactcctccaccaaatccttgcgcaactctaccattgagctaacaatgccgtagtgcgacatatgcggaccgacatttgcggaccgacttttgcggaccgacttttgcggaccgacatttgcggaccgacttttgcggaccactatttctgggaggtactgtcaa

SEQ ID NO: 37464 - DNA, 1366 bp, Heterodera glycines
aatttttaacgaattttcccagaaaaacggagaccacttccaaaacatagtttttcgagctctatcgactggtattttttttggaaaaatttcgattttttcccggaaatagaaaaaatttttggcctcagcgggacatttgagtcctgggcccataactcgtcaggggtcggttttagacaaaaaattccttagagcaaaattgtagagctttttaagctctatcgaacggtgtgctatatgcccggaaaatttcaaaaattttcgagctaggccccctagaaattttcagaattttttttatgggccaaaatgggggtgaaaattttttttctggggtattttgaggtgctgagcacgaatatgatgtttgtttttcgtttcatgatttttggaattttttaaaaattctttattttttggcaattttttggccctcgggattttgacctaatatttgaaaattcataacaaatcgaagggttgatcaattttacaggaataaagccttaaaaatagagaaaaatcaggagaattttatggactttatttttattttacatttttatcacatttttaaaaaaagatataaaaataaaagtgattttgggattcgggaccaaaggggggagcacatgatttttgagtggaaaattttttcgacaaaaatcttccaaaaacatgtctttaggggttatttgggccgctgatcacgaatacgtgatcagattttacttttgacatcgtttagacctcagaatccctgtgtgattggggattctgaggcatcatttttgggggggggggggcgaagttcgagtccggacggtgtaaattattttctttgtattttagatttatttttcaatgcttttagttaattaaaagataagatgtaaattttaaatttttgtaataaataatttcagtattattttttatctgtaaaaaataatatcatttgcaatttcttaaatatgcaaggcattcgatttttgattctgtaataagacccttttccctagtaatataattttaaaccatgttgaacctcttcttatcacttttgtatctcatcttggtcgtagtagtccctcttataatcgctcttgtaacttttataaactaataaataaataatttttatgataaatggactacatctcgatattccattcctttccaaaccaaccacaagcacttcgaacccaagggcacagccgggtggaggggtaccgataggcgccgtcgaggggaaaattagaaatagtggccctattccttaaaagattcacaccaaaaattgccaattttatacctttttagattaaaaatttaaaatacatagaaagaattgcgtgataaa

SEQ ID NO: 37465 - DNA, 791 bp, Heterodera glycines
ttttgttgtccttccatttcccgctgcgttctgtcgggaagtgcccggtttctccgactcgcgcaaaaacacatttttggcatctgctaaaattaaaaaaatactatcaagttaaaattaacttttaatccaaacatacccccgccaattttgaaaaatgccgtcgttgttggctttatgtcggtaatcatcggcttcttcatgccaacggaaaatgcgattttcgtgtcatcgttgcgaatcaattcctgcggctctttggcgacttcgtctccgtcctccgtgccctgcttctccttggctctaaaggggaaggcttttcatacgaattttcggcatttaaatgcctttggtcaaccaatccatcccccgccttccgcttgcctttcaatttgtctctgcaattgttcatgcattcgttcctcgtcgtccttttcctgtttggcgcgctgctgcaacttttgacgacgtaactcctcctcctggtcaatgtattgaatgtgccaacctcaaaaatttgctaaaaagtgaaaaaactaatcccatccgccacacctttctcattctcgtcaattttacatttgccggacttgcccaaatacatcacaaagccggtcaaagtgtgccacaccgtcgagttcatgtgcacatgacctttgtctttaatctgggggggggggggtaaggcgtgaagcaattatcaagtatgaccattaaactcacatattcctggtaaacttcgttggcacggatgcgttttgaaccaaaagtgtgacgaagaatctatcaaa

SEQ ID NO: 37466 - DNA, 935 bp, Heterodera glycines
gggctgcgcccctcccataggcacgggtttgtgcgcgaaacacccgctcggaacccgctcgctttcggggtcttatactacttctattctaatcattttgtctttgaatattgtagtactgttgactctaaattaattacttcattcagcttttttaattccaattgattcagttttcttttcccattttgttctattattatttactctacttttcaattcaatttcgagttatatgtttaaattaagctcatttacagcttatttcaaaagaataaaatattaaaccttttcctttataccctattcccatgtcttctattgcttcgactttcaagcaacaactaatcttttcttttcatccctttattgtcatgatttaatagtttgtgtttgaaataaataataaatacaattgccttttgcaattttatttttgtgatttcaagaattattctttatttattgtatttttaaaaaaatttattcaaacgaaacggaggaaggattgaataagcaacagttttttaaggggtggcattgaaattagcaaagacttttctgtttagagaggaaattggaataattttatgcaaaatcgtaaaaaaatatataaatggaaaattaaacaaatttaaataaaaatgtaattaaaagagaatttaaaatgacaaatttatgtaaaattttgtacacaaaaaggcgacgaaagagagggggtgggataaagcaagcgcaaaaaagcgaggagattggaggtaacttaattagagtttagcggtaccaaccgaaaactgtaaaaaatatgacaattattttgtgttttggcagtgattttttaaaaagctaaattcagtcgttgacttttttttaattgtgtaccaaatttcggtgacgcattctaattgaggcaacacaaatttttataagctgtt

SEQ ID NO: 37467 - DNA, 1010 bp, Heterodera glycines
ttccactgttccaagcaccccaccaaaagcaaaacgatataaccaaaatataaggaaaaattttttaaaaaattttttctccatcttcctttttgatactaaagcatcagagtgctaaaattaagttgtaaataaaatttggtgcgctttagagcactttctgaaaaaaatatttatgaaacaaaaaaatcgattttttcaagtgtccgtttggggtactcaaacatttatggggagcaaaaatccaacgcagaattaaagtacaggctatagggaagctactcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaataaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaaacaaaaaaaatcgattttttcaagtgtccgtttggggtactcaaacaattatgggggagcaaaaaaatccaacgcagaattaaagtacaggctatagggaagctatttcccggaaggattcgggctccccataaatctgggcgcattcggttcggggggactgccccgaaa

SEQ ID NO: 37468 - DNA, 1742 bp, Heterodera glycines
aaatcttgattgttttgctcaaatttataattgattgaattttgaaaaccagagggtccctcctccctttgttttaatgaaattaaaaatttctcactttgctactggcgctaacatttgagtcaccaaaaatctgtttaaacgggcccgctgaggtgccactcttcaacatggagggtgccgtggtgggctcgttcatatcaccggtcacaactgtgtttttttaaaaattcatttgactcacttatatttatttgttggtacataaaaaaagaagaaattctgtcttaaataatgtcaatgtcttcattaaaaaatttatgagaaaaaacggaaaaattgaaatgacaaaacaaatgaattaataaaaattattttacttttatttgcactttatttttaaaattatccatttatagcatccatgatatttttggcatgatttctgcggcattaatcactccgcaatttaatgagccggaaattttcctaaaacgggcattttcatgttttaatgatttaattcaattaattaatttttaattttcgtccccttattaattaaactcgcactgctcacttgaaaatttgcttggtcgattatttacttcgaaaatatctcacccccctcctcccgaagtgacaaaattttcgctggcggcataattcgtcattaagtaatttgaaaaaataaaagaaacttaaatttaataagttttgatcaaattttttttataattccgtaattctcttcaaacttgttcatttttggtttatttggcctatcgaattttgaaaattattattttatataaatttcattgaatatttaaatttatttgggtctttttgatcaaaatttttttgtttataatggcgccgtatatttcatgcctttaaattgtgtgaaatttgttatatattcatattgcattatattataaatgtttgtgtgctcctcgtgttaataaatgccttaaatgggccggccctaagctgttggttggcctccaatccaatcacaaaatgctttttgattttaatgttttgtatttttttaaaacgtttttcacattaattaaaatttatatattttgtgaaaattaatcaaggtttgttaacaggttctcagaaaattaccaatttttgtgacttatgaaaaaaaagatataaatgattggaatcggcggtgccgataggcgtcactgggaattttgaattttaatgagttttgcaaataaaatttgactcaacgattaaaaaacagggaaaaatcaataaatagcaaaattaaaattaaatgggccaaattccgatttttaagctttgtcttttaaaataaaagacatacgatcctgattttaggtacaataaatttatagaaatttatttttatttatttttaaattttttgattcttttccatgttttgtgaccttttctctgttttttcaatttaacaccgtctcccattcgtattcgaccggcaaaaattcccaacgcaaaggatcaccgtaatgctttaccgtaggagcctaaattattcagtgttaaaaatcgtattttagaaatgggtttcacttcaccttacgattcattcattccctaataattttcaattctttaaaagtctatcgcttttcgcattttggttagtcactatgataaattattactgatagtgattattagagctatgagtgtatacactaaaaccccctcaaatatgcccctaaaaattt

SEQ ID NO: 37469 - DNA, 1222 bp, Heterodera glycines
aggcaaaaaaaattaaataaataatgctaacttcataaaaacaaaattaaggaacaaataattaaagcttggatagaatatgatccttgtacaggaggatttggctctattacagtgtttacgcgtccaattaatacaaattatttaattatcagccagggtttcccagggccctagtccggtagtccgggccctgtattttttttggaaaatgtaaaatggtccggagtcctgttaaaataggactttttgatccggaatcctgtccgggtccgattcataaatccgggccctgttccgggttttttttcaaaattccaggctctacaaaaagacaaataaaataaaataaaacttgctttcagtgaatttgattttaattagatatattattttgttgttgattttaatttttgtttaagggccaaaagttcgagcggcccaaaacggcgatttcggaaatggacgaaacggccgaaggcaccgccaacacggcacattgagcaacaaccattgagcagcgaatcaaaagatggagcaattcttttttacgcatttaacaaatttagaagaattttgcgataaatttaaataaacgaaaaatttattaatttttaaattaattttcttttttttgctttgatcattttggaaatcgataaagtcaaaaacgttttaaattattgcttggaagcacaaataaccgagacttttctcgagtttttactctcgaaaatcactggcaattcatccatttaaatctttttagctcccatcaaaaatttccttcgaatactcattttaatttaagatttttcgatcgcccaaaattccttcaggagtgatcactctgatcagatgtcatcgtttgactcactctttccgtgtcaatcgtttggccattcgttcttcggctgacagttggcccttttccgtcgtttcacatttatttgtcattgtgttgcaaaacaaaaaaaaatgcttgggagtcgaactttgagctttaacttcacattggcctggccaatttgacacattttgccaaattaaataataaaataattaattttaattaatttaattaccgattttcaaatgtcaattaaattttcttacgtccgcttaatgcgatcacttcgttaaagcgattaaattgctgctcaatgtcaataaattgcacagatttgcaccccaacagaaagcaaacacagaaaaaggcaaa

SEQ ID NO: 37470 - DNA, 1091 bp, Heterodera glycines
  misc_feature (67)..(67): n is a, c, g, or t
  misc_feature (1027)..(1027): n is a, c, g, or t
gggcactcgttttccacccacgaaaatttatttaaatcaaacaatgatagaacttttcaaaaaaatncgtcggaatttataagaaactaaaaactttcctcgtgattatgtaaaatttatgataaattattaattttttcaaaaaatttctccgaaaatgacaaaattttcaacaaaaaaaaattcaggcgggaatagtcataaacgattgtttaggtggtcgctgtgttccaagaagccaatttggacccggcctatttgttcagtcagttggacccgggcgctcgcaagcagaacattgccaggtcgaaaccacaaaaccaacttcaaattagtcaaccgctcagggttttggttttcaggtttcgaaacggcgaatgctttctgttggttgtcactgacattgctgcgcgtggcgtcgacattcccttgttggactttgccgtcaatttccatttcccacccaaagcaaaactctttgtgcacagagtcggtaagtttaccaggcaaataattttcatcaaaaatgtaaacggtccattaaggccgagttgcccgcgcgggaaagacgggcacttccgtttcattagtgtcgcccgatgaaatgccatatttggtcgatttgttccttttcctcggccgtccattgcaatttgtcccctccgataagattggcagcaacattttcaattcctggaacaaaaacagttggaaattaacgacaaatcaagaattacatctattgcttcagctgattccgtgttaattggggcctttcccgacacaatggcacatttggagacggaatttttgcgttccattgagcagaattccattgaaattgtacgattcacttacccattaattttggtttttcactttggcactttaagatggatttgcagcgtaaagccgaaaatgcaatggccaagtatcagcggactcggcaacaaccatctgctgagtctgtgcgtagagtgaaggccgagttcagacacatttcgccgggcccacacccattttttgnggaccccgttctgtttccggatttggcattggaacaacgtacggttgacccaactgccatttct

SEQ ID NO: 37471 - DNA, 946 bp, Heterodera glycines
  misc_feature (34)..(34): n is a, c, g, or t
agacttatacaaaattgtctgataaatttatttntgttaaacaacatctgatctccgcaataataattcaaatttctataatttatttattttattccaaatattccggcggtgttcggttttgtgggaattaacgaaattttgtttgatctttttggaaatttttttcgctttttttgggtgtattttctgaaattttttcaggtcgattcttaggggtgtatttttaatttttattgagtttttattaaagaattttccgaaaagcctgaaaaaggagccaaaaatggcgaaatcggcacaaaaataggcattttcgcagttttgtcgtccatttttctttttttttcatttttaagacatcttattttttgtgaaaaatttgctaaacattagtcagccaattattttttcccgaaaatttaacctaggtagttcagcttcatatcagcaccaaaaaatcccgaatcaaaagtagaatgaatgtgataaggttaaaagtgagtttaaacaaatttaaaaactatttcaaaatgcatttaaaagctaaaatattatttggttgaaaaattagtcaccataaaaatgttcaaatttttaccattttcccttgaaacttggttaaattttgatgattgtaaaaaatcactattttctgccatatttcaagagaaaatggtcaaaaaattgattatttttaggtgatcaattttcaccaagtatagctttttatgtacaagtcgtatccccaccattacaaaagcaatttgatagtagtaaattttgtgctctatataatcgtgactagacattccgacagtaaaatacacaaaagataagaaaatgacgtcgccgaaggcgaccgattgtgccataatccacaggatggcattcgtgtgcgaaaaattcagaaaagctctatattcacaatatacagccgtcgcta

SEQ ID NO: 37472 - DNA, 1519 bp, Heterodera glycines
tgagtccctttcaacccaaacgattctctccctcccccccccacagattctccttccgcttgccttccaagaatatgacataaaaacaacggaaggaaaaagtctgccccttacattttcggaagttgaaattttgcttggacaaattggtgaagaaaaaaatgcgggaaatgggaaagaatttcaagtcgaattatcttccctggaagcgattacagaagcctttcctaaactcgcttcacaacttttaacctaattgactaacgccaataccacaagcaaaatatttggtcctcgtatttgtttagcaacacttttattggtttgtataaaataatacaattttatgttaaatgattgaagtatcaccatgacaaactcgttaagagaaattaactaacagaaagagaatacacgtaagtgttgtaataaattgagagatttgcaattaagtgaagcgaattggaatgaaatccgaccatcggattgcctcttatttgttagttagttatttgttgttgtaaacttctccatcccaacattgcccttcataattgtatcatcgaatttcacatttccccgactttgtcccacgttttccgtggctctgtcagcgctttgttttgtttttgcattaaaactctccgaatcagccgatgatgggccttcgattccagaagagttgtgagaatctttggatggacagaaagacgaaggagaaacacttgacgaagtggtcgaatgatggcttaggtaaaaattggccgaactctgaagctgatcaccgccatcaattagttcgttctggaattttggaccatatttttgcttacgaattgttagattcgcacctccgatgcgcattttttacggccacaaaatcttcggggttttcccttttgtcctgtgaacgcactttggcgagaccgaagcatcggatccgttaatttcttaaaactgactcgttttacttcgtcgaaattacggtcaccttgtctttatcttcgcgtttcttctcacattcgttcgcattgacatcaattgaagtggaccgttttgtatgttcgacagaacgatccaatgaaattgcctttgacaacggtcgaattggacaaacggaaggatttcgaatggtcgcggcgaggtcagcccaaacgggtgaacctgtgaagatgcaaatcaataaaatcaaatgagtcaagaacgtacgattgagtaggctcgagctggacaccgtcctttcgcctgatggcgaaatgtaagcatttaaatcggcagatcgacggcgactcgtccgtaatgcatgcatcgaaggcggcggactcttcagcagcatttgggagctgattcgagacaaacacacttcgcttgagagtccgttgaccttcagtgctactcgcttattacacaaagcgcgcgggccgttagcaagcgaatcgagttgaatttgaatgcgcgtgttcctcgggtgaacgacttggtctgtgtaggtcaccagtgactgtcacagtgacgggca

SEQ ID NO: 37473 - DNA, 1222 bp, Heterodera glycines
  misc_feature (70)..(70): n is a, c, g, or t
  misc_feature (195)..(195): n is a, c, g, or t
  misc_feature (953)..(953): n is a, c, g, or t
tgatatatcatcgctaccacatcaatcattttgttgctcaaatggtctgtgtgccgatgccaatgccacngatgaatgatgagaggccaagcacgggaggagaagaggaagaagaggaagagcagtctccaatccccaacagacggaccacaagaaattggcggggggggggggggggggggagacgcaacggcncatataaaagaagcgccacagtgccccggcaaagggtcaagagtctcgagccaaaatggggcctgagttgtgctgtgaccccgcatttagggaattcattgaatttatgagtgccttttggttgacacaaaaaatggtagatattattaaaaatcaatttcttccgaccaataagagcgctccattaaaactcattattgaaataaaattcaatgctatagctacagaaaattttttacgatcattagcatacaagaaaaacacttctaatcagtaaactcctttcatttggaattttattgcatctattctccaattttttgcacctaatcatcctcattatcttatttaagtcatccattttcccactttagcagttaaaaatcccagcaggccttaagccaaattttgtccaacacccaaaatgaatgtaccaaatcattaccgctaattaaaaaagtgtccataaaggcccagcagccaatttgtttccattcatccgtcccattcatttcttctttttccagtgatgatggttcgtgtcttctccatcatcatcgtcacttcctctgctgtttactcttctgtctgtcttcttctgtccactgttttggtcaccaaaagctgatcagccagccgaccgtcgtccgctccccgccccaactaagccaaaaatgggaggaaattggggggagatgggcccctaatgcgattgcgcactgctcgcgccgcactgttttaagcactataattggggnttcttccacccccctttccctcacaaaatccagcaccccccccccctaaaaagcgctatttgtccatctgtcacaatgcttttgttgagaacagaatgtgatgatcagcaggtaaaagggtgatgatgaagagaactaaaagtgatgggagagaaagaagaaaagaagccaatgggaaaacggatgaaatacagacgaattaatttaacacaaaaaggagactaaatccaaattgataattacatatattttgaattataccaaatttt

SEQ ID NO: 37474 - DNA, 1307 bp, Heterodera glycines
  misc_feature (1092)..(1092): n is a, c, g, or t
  misc_feature (1176)..(1176): n is a, c, g, or t
tttgggctgatattactgattcttcgacttattcacacaaaaattctcagaaatagggtcacaaattaaagtgtctaacgctatgtaccatgcatgttacaaattaacaagtggttaagaaaaaaccattcttctcaagttttcgttaattatacacatttttttcgtgtgcatttggcgacggttttatgtttgaccaatttgaaataattattatttaggcactgaacatcgccgaaatggccgaatcgaacatgaacgcatgccccgcattcggagtgtgtcccacatgccaatggcattgcccttgcagtaagtcaaattcataatttttttttttttcccccttcgatttttcgctgaaattcgatctctatttttttttcaattcacttcaaatatcgtttattcacatactcattttcaattccgaattaagtatccaaagttactgtattattatagcagcatttccatatgaactttgctcattacagtcacttaatgttgatgatttctaagccgcggccgatattatcgcgatgggaaaatggggcgtaaaaaaatttattacaacccgcataaagcattccgtctctccagccacaaatcattttcatttccaagctctttctaatcgcaaaacaatttcccagctactacttctactgcacacagccaaaaaactttcatacataagtatccgcgcagcctaaattgcacgcttcctttcccgtattactcaccactgcgcaaatctatctcattcccactgattagtcgtaagactataagaaaagtttttggtttttttttttttgagtgctcatttaactcattcaactaattaatctaagccaaatagtagaagtctaatacactgaaattatgtcatttgtgaactatcctctggatagaatggaagaccaagtaactattgcaattgttgaaagaaatttattccaaaatataagcgctcctccaaattctaatgccccaatctcacttattgataaggttcaccaaggtgtaatacgtcttgaggatgccaccaaccgcagtttaagggtaattaataggagggcgactcanaatactgatgccattaaccaaacaacagctgatatgaatgcaaacatggacacaattacgactaggttagatcaattggttgantaagtggatacacttgaatggtcagacaccaaatgatacaggacatcactacaagggaattgcaccatggtaaggcgaactgtcttcgaacccgaagaggacgaagaaatttctctatgtctcactactat

SEQ ID NO: 37475 - DNA, 1160 bp, Heterodera glycines
attttcacgtggcctcggcaaatttgggcggggattatcagagtccctaaataagcgaacgaattaataagaacagattccgaaaattgccgctggaattcgtcgctaagttaaattaccattaattctaaaaatgcaaaatcattgtccaaatctccggtagccttttccacgtttatcccccccccctcccttactttcccacaaacacatacgtatgtacaatgctgctccagcaatccttgtggccattctttttccgactaattaccattaatggatgccactttaccctccccccccctccgctcgtcaatctttcccccgctttggtctttcttcggcgccaattccatgcgtatttatttatttatttatttgtccacgccgtctcaaccttttggtgagctttgtttggccataattgagttagtccaatattcgcatccccgcctttgttcataggaatgaatgaacgaatgagtgaattgaattgaatgagtggcattcggccaaatgcccccccccccaatttctccgtctttcccttcacaaataattcatttcggtcgcgcctttcgtccggtcaaaaaatgccgccggcacccaatgccaaagtgtgaattgccggagttgtttatccgtttagcattcatttactttgtctaatccctcctctcattgactctctctcttccggtacggtcagcagttccatctaaattctgaattcttttgagtgcttttttgatcccatttttgtttttgtcttttaagacaaattttgggctcgtccttggtattttaagaatttttttgtcgcttttcccttagcttttcgttttctggccaaatgttctgctttttgttctttccaatgccatcgtttccttttcccctcaaattacactctttcgcccaatcctccaaagtttgtgcaacaaaatgtttaagttccttttgctctgccattaatagcttcatttccatttgcaaagcagcagaaaggcatcagtcattgctcagcaacttttcaaattgagcttttccttctcgcaattcgttcatccgatgagaagaaacgaatgaacgaatagaagcgaaggggggggaggaggagaagtcggaaatttactctcattttgacaccgttttaaaat

SEQ ID NO: 37476 - DNA, 993 bp, Heterodera glycines
ccgaattgaaatgcgcttcttttcttcccatggatcacatcgttcggtcagtgaaggaaaagcacagaacgatcacttaaaaaccggctcagagtgatgactagccgagaatgcatcgtggaagtgaaggtgagtgagcagcgtattgctaaacaatccgttaacattggcactcacttcattaattgcctcattagcaatcatccactttcttttaacaattcttttccattcattccactaattgcgtcattatcgcttaatttgtcgttcctttgcctaacctttctaattcgttcgctttatatttgatcatcctttctcttcttcgcaggtcgcctacctgcagtttctgctgcactgttacatcgacacggacatcgaactgaaggacgccagcaacggcgagtatttggacgccattttggaggatgccatcgcggatatgggcaaactgagcacgcggctgcgccagatggactaccagccgaagtttgggccggagatcgtcgcgttggagcggtacgtctgtcagacggtgacggaagtgttggtgcgcgtgtttgagcccgcctcttacggtcactcggcacacattgacattcgcgtgggtcatttggacaatggcacaccgaaaagaggcgcatttgcccatttagcagcagcaaaaacgcttttcgaccataatgcagcggctgagcgagttgcagaacggcgtgctgagggggcgacgccactcgaactgctccaagaactggtaccgtattgtggaatgtgcgaaaagactgacgaaatacggtaaggtcaaaagccaaaaagcaaagcctaacataaaaagttgtgaatgccaattgaaaattcagccaacgaatgcggcattttatcggccatgaacactttgggcgtcccacaaacccccggcgttccttcgaactcattcagtggcttccgcgcgatgactccgcgtcagcggtggcaatcggccgcgttctc

SEQ ID NO: 37477 - DNA, 636 bp, Heterodera glycines
ctcctcacatacacttttttttgccccactaaatttttccattttcgggaattttcattttttgttactaattgtaagtgtctataaaagggaaggcattggaaaatttgctctcatttgcattcgtctgtatattcatcaatttatatttgcccattgcgtcaaagcatcgttctgctgctccttcagctacaaaatatcacagcaaacggaagaagtcgtcacacgtggtggcatcatggagaagatcgtctacttcaagctgatgcaaattgtgctcactttcgcattcatttggcaactcatgtcacttcacgaattctgcggcacttttgccgacccaaaagtcaattcatttaccaaatttcactaatgatacataatgatgtgcttttttcaggcctgcatccatgacatctctgtgggccattgcaaacgctttgcgttcatcggaaaggactcaaaaagcggtgaattcggcgttgtgtttgaccatcacaaatggcacgaccaactgtcgatgagcagcaccaatggccgatcattcgaagaacagcaacaccaattcatggacgaattggccacgaaattgccacccgctggacgcctttgcattccgataacggtgaactagca

SEQ ID NO: 37478 - DNA, 960 bp, Heterodera glycines
aagaggaagaggcggcggaaggctcggaaagctggaaaggaagggaaaatgagaaaaaatattgccattttgtaggcaaaaaaaaaatgtcggggaaacggacggtcatccggggaaataggagaaatccgtcggaaaagatttacaccaaattctcaacaaaaaaatagcatggacaaatgtcactgggaatcggaaccaaaaaaaacttggaaaaataggggaattttgctcgggcggtgtctgtcacccgaacccttcaatttcttcaaaaaaaggattcagaaacaacgaattccgttgtttcaaagataatctgtaacaaatcctctcaaattacccaatcccaccataatgtcggcacatccaactgcgtgcggtccgttggcgagcagcggcaacacattgccaactggcggtggtggcggtggagaagtcgtgccattcggaggagttggcggtggagaagtcgtgccattcggaggagttggcggtggagaagtcgtgccattcaacggtggtgacggcgatggcgtcgttttggacggcaataatcccataacaaatattgatatgaaaaatttaaacggaataaattattttcgataaaaatggcacaacaaacacctctctatcagcagaatttgggttttttggtttgggaggagaagtccacgaaacggtggacccaaccaatttttgtcaaagtcgaccaaattaaacattcttggtatcattggatagcccttaagattctattttacgttgcaaaattccaaagaatttgatcatgttgaaaaaaagtgacaaaaacatttttgtttacaatttttagtcatcattttttttgaaaaatgaaatgttggttgtaggtaaaaaagcttaagagctattgaatgatataacaaggtaataatttgatctacttttacaaaagttaatgattagggctccaatttt

SEQ ID NO: 37479 - DNA, 1393 bp, Heterodera glycines
  misc_feature (1314)..(1314): n is a, c, g, or t
  misc_feature (1316)..(1316): n is a, c, g, or t
aaataaagatcggcgagggttcgcatatcgacgcaggatgcactacgtcctccccccctgtcgttatagaaattttaagaaaaaattgaaaaaattttatagagatttttcaaaaatttgatgatgctttttcaaaaacatcgctttaaaattttaatttttttttcttgaattttaaaaaaattttcaatttttttcgaaaagtttcaattttgcaattaaaaaatattccggaggaaatgaactgctccggcccaacgataatgattgtttagctttaacaaatttttcaaaaaattcattgcttaatatttctttttttacaaggccaccgatttttgcaagaacattaaaaaggcaattattatcttaaaatttggcacccatttaaaaaaaattttttttttttttgcattaattaatttttaaaatttttcaatttttcttttactatatgatttttaaaattttttagcttctttttttttgttgttgcaaaatcttggcattcataaatttcagcaagagacggatgacagcgacagtgccagcgactggagcatggtgccgaactcgtccgcgggcgcttcgtcggcagacgacgcggcggctgcggttgtgccaccgccaccaccaccctcaacgacgtcggtgtcgccaacccaaccgcaacaccaccacaaccatcaccataccgcgccatgtgtcgctcctcctgccgcttcctcctcctcctcctcctattacaagtcaaagcggcaccaccactgtgccggccgacgaggcgttgcggcggcggcgccacgcgcgaccgcgacaccagcggcaacaacccaatttgatcagcaacaacaacagcgtgcggcctatgtggcgttggaacaacagtaccaccagttgaacccgttgctgaacgctggtgggtggcataatttgggggcaactaattaattgcctaattacacaatttttactaattcttaattgacagccgcccaacaatttgcggtggacacgtcgcgggccgcgtgggcaaacgcagcagccggttggtgtgccaaaattggatttttttttaaatacacaccatcccaaaaaaaaacgagaaatcaccaataattagaagagatacacctcttatatcggcgtactattttctttttctctgctaacagagaaaaccagattttcttatttccaaataactttttgttttttcataactttttttttccgacgcattaaaaatgcattaaatttgtttagcgaaagcttttccgttccagtaactttcaaataatacaaaatcatccnantttgttgaaaaaaccttcaaaaacagtcattttttaataaaaatagtatgtcatggagcgggctcgaccctccgaaa

SEQ ID NO: 37480 - DNA, 1022 bp, Heterodera glycines
caagtcctgctggcggcccgatggcaataattcttaatggagaattccatcgtcgcataagcagcatgcaagcaggcacgacccagattcctggcttcggtcagttgtacattctggacccagtcgaagccatggagcaacgacgaaaaaatcccacattcacgggtgaaaaaattacgaacgaagaagagtttgtgcagggtcatcagcttagtgatgagacccttgaagttttggaacaaatgatccaagaaaatcacccagcagcatctgcttataagcaggctcgtgaacagctccaagagttgttaaaacaacaaaggactgaagagcttcggttcttcagaatgactttgttggatgagcgctctgctccgggtgctatgaaagacccgaagttgcatccccaccagataatcaccccctcaacgggtgaagggatgttcgcgattcatgcggatctcaacggtgccccggcaccaaaagggatatgggtggaaaacaagcaagggcagctgaacgaaattgctcctctcagtccatggactgatagcttaacctatccattgattaagcctaagggcgacgatggatataaaattggcattccatatgccaaacccgcacaaagaaagcggaaaagcgacatgtctgatgatatgtttgacaatcaagcaatgtcagatgatgacatttgcgataccgagtcaattgcatcgtctgggtctgaagcatcgatgcagtcagtgaccagtcgctatgacaaatcaaaaagatttgtctccctgcgcgattattgcaaatatcatctcgcaataagggatgaaaatttggagtggcaataccatcacattctttcatgtggcggtggtcttggacagcgctgggtcttagaccaagcgtccaaaatgactggcaaattgccacttttttgcgccgtccagacatggacaggcgcgtaagtacaccaaaaaatttgctgcagtacttggtgaacaatacacaagcagcagctcggcaaa

SEQ ID NO: 37481 - DNA, 1440 bp, Heterodera glycines
  misc_feature (1340)..(1340): n is a, c, g, or t
  misc_feature (1378)..(1378): n is a, c, g, or t
aacggcggatggccggcttggtgatgccttggatgttgtcacggagcacctgagaaatgagaaattcgaaacaactgaatgattggtatatttatttttgcattttttgggaaaattcaaccacttttaaccttttgttgaaaaagaatttccaaaattttagaggaattttattgttaaaaaaaatgaactcactttacgatggcgcttcgcgcctccctttccaagtccttttcctccctttccgcgtccggacattttagctgattggggatgagtgaagcgaattcaaatgagcaaaagaagaagagtgaggaagagaatgaccgtgggcgctatttatgctaagaaaaatggcggctaaattgttgaggcgcgcggagactcctttcgtgccaaaaaaaaaatccatttaaaattggacgccgttttactctctcactcacactctctcacgtccatttttctctgctcccaccggggatttgcattgtctgtcaatgggatgggcgttccctccactttagcgacataaaaggggctcactgtgccccattcgccactttcattagaaagcaaacgaatcgattcaccagctctcttcggcaaaaccttcgcctctccacatttcgacgacaaaatgcctccaaaaccatccggcaaaggagcgaagaaggcggttaagtcgaccaaggcggtgcgcacgggagacaaaaagcggagaaaggcccgcaaggagtcttactcggtaggtttttctgaattttttagggttttctgttttagttttccaatggcttaacaaaatgaaattataaatttaacccggctttccaggtgtacatctagctgtgctcaagcaggtccaccgggacaccggcatttcctccaaagcgatgtccatcatgaactcgtaaggcccaatttggcgtttttccgtcccaagattctcaattttcccatttttaaggtttgtcaatgacgtgttcgagcgcattgcggcggaagcctcgcgattggcccactacaacaagcggtccaccatctcatcgcgcgaaattcagacggccgtccgaatgattctgcccggcgagttggccaagcatgccgtgtccgaggggaccaaggcggtgacgaagtacacctcgtcaaaatgagcaggagatgatgaaagcggtggtgatcggacggaaaaaactatcccaaacggccctctttagggccacaatcactcaaatggacgcgaatgacactttttttcctgttttgtatttgaacgcaaataaattgactttacgcttcagtaaatttgggatttttggctaattaatgtgtgttanatggttataaattactttgcttttggattcactaattntttccgcctacactaatttttttgggattaaaagccaaccggttcagtaaattttcgcgagg

SEQ ID NO: 37482 - DNA, 1683 bp, Heterodera glycines
ccccccccccccccccccccccctcggatgttggattacggcgcggcctttactccggctctccgtcgctggatttgtatgacgggcgcgtattggctcccacgagcggaccatcgttgtgaccatcaactacaggtttaggcagagtatggtattgtagttcgagagtctccgtgttgaggagggctcgactcgagaaaaatctcgagttttcctttcgtctcgactctcggtctcgggttgcggggtcgagtctcgtcaattctttggtcaagaattgccaaaaactgatccagacgcccaaaaaagttttttgaacgccaataaatcactgtttaccggtcaatttcaaaaaaattggttacggtaaaaataggaaaaattttcaaagaaaactgtattcaggctaggtgcgtttggcttcctttatttgggcgacggaagcgccgcgccgggcaacatgggactgctggaccaacagttggcactgcgctggatcaacgacaacatcgcacagtttggtggcaacccgaacaaagtcacacttttcggtaaggttttttttggcattgtgccgcatgagaaaaattactatttttttttacaaaaatatgaaaatttgagcgattctatgccaaatttgaagttcaatgactaaggtcggaaatttatgtaaatattttgttgaaaacactccaaatttccaaaaaaaaaaacgttattttcccgtcaccaatgatcagcagctgatcattagggatcgaatttcaagtttttgtggttggaatttcaaaaaatatatgctttttattactctattaaaatagcattcaaaataaatttatatatatatatatatatatatatatatatatctactagcttatagaattatggaaaattttactccaaagcgtttgaaaatatttattattaaattctattcctaaactgaaattttaaaaagaaaacttggaaatatggagatttttcgggcattataatcacactttaaataaatacagtaggaaaaggaatactgtaaacatgggaagatttccgtatattaaatgcacacgaacaatatacagtaggaaattaattatttataaaacgatacagtaggaaaataaatactgtatataaacaggggaaagtgccggcggcgcgtcagcggcggcgcatttgttcgcgccggacagccaccgcctattccgctcgttgatcgccaaaagcggtgccatcgtgaacaactgggccacaaagccgaaggtggccatccgcgacatttcaatgcgactcgcgcaccggctgaactgctcgatgtcgacgatggtcgactggaaacggcgccggaggcaccggcaccgaccgcgacgacaacggcacgacaggcggcgcagaagcggaccgtcgccggacaacaacagcgatgacgaggagggcaccgttgcggtggctaatcaagtgatcgcctgcatgagccgtgtgcctgctcagatcatccaggtaggaaagttttttcggaaccccgctgggttaatccaaagatcccgtaagttccgaaaaaatccatctgtttgccaaccaggatccagcaaaatcctgctcgggatcccgtttttcgtgggtttcgtggtgcataggacgaggcacatttgagtagggacccaatatattttt

SEQ ID NO: 37483 - DNA, 951 bp, Heterodera glycines
atatttaaaatttttataattgatttttctttcccaaagaaaatttatgtttatttactttttatatttttaatttttataattttaattttattatactattatttttttaatttatttatttcattcttagtactcccggcttctcaaaaatcccgctcgacgcgcacatgcgtcatccatgctgcgcggcgcaccgggaacgccttcccgtgttccggcgcgttgccgtggccgtggcccccttgataagatgttcttcttctctggtagtcaaattttttgtaaaattttgcaaaaatttttcatatattaaaacatactctaactatttattttttaattttactaaatatattgtttttttgtgcaatttattctcatttttaattgtatatatttctcaaaacttttttgttcgttgtatagtttaattttttctcgatgtttaggaagacagatattatgcattatgcagtgaatgtactggactagaaattctcttataattcttcacttacgaaatattattcttttcaattcatttttttaaaatacttttaaataaatttcgtattggcactttttataatttcgtgtttcgtagtgttaatatatttttaaaatatttttggtttgggacttgtgatatgcataaacatttcaaagatagaaatacatactaatgtttagaatggttaataaataaataagaaattcgttgtcatccatttagaaacaacaattatttcttacaataaattactgactagtttttaatttatttttataaaaataaatatctttttaaaatcatgtccatttttaaagatcattatttatttgctagcaaaacaaataatgatttttttctgatgaaatttacaaaatttatttaacaattggggttttggtacgtatgtaggaatattataaaattattttattttt

SEQ ID NO: 37484 - DNA, 1228 bp, Heterodera glycines
aaaaggggacaaaggggcctgagtcagtggggtactggccaaaggcaacggaaacaaacaagggccaaagaggcgacaaaaatggcctggcaatggctaaacacaggcaaaataatgggatgggcggtccacagtgtccgggtgattggtggtgggtgggtaattctgattggtgggccaaccggtggttgggcgacagtgccgggtgagcaacgggcaacagatggacgggcaacggcgagggtagggcacaatcggaccgtgggggaggggggagcagggccaagaacgccaagccaattccggattttatcagtgcaagtcaccaaaatgcctgtggggatttatgggaagagagaaatggtgggcaaagcccacggattagcaattcatatttatgcgaaaaatgggaccattgggataatccccaaccaaaaaatatgtaaaaaatttgttttgcgtagaataggacaaaattccaaattaacttaaacaagcactgaatttgttggactgccgccaccaaataaactcaaatcaaaagcaaagtcaaagaccaccaattttataagagaaaatcataatatcggagatcaaaaccacaaaattaaaattaacaacgaacagccaaaacaaaagaaaaatagggagggaacaatttaatcaacaaaaaaaatgcggaattgcggactgggatcccgcaaaatcccgcgcgggatcccgtcccgcgccggtctctaaccttaatcacatcacctgtcttctgtgtacaaagagagagtgcacttggcattctcacaggcggcacgaacacgaaaaagcgcttcagggctccagctgagcatgtacccgtgctgacgcatgaattccgcaacgaaatgatcgaccgtaaatgccaaatttaattaagatcttcgttggtgacagttgtcacgccaacattggacgcaccgaagtcgaagatgagcacattgagtcattttgaaaattgttaatggctgggaaaagaaaacaaattcaaaatttaattattggctcattaaaattagtgatggatggtaaatttatgcggtgatcgtaaaaatccaacaaaaacagtaatccgcaaactaaaaattctttaaaaaatgcaagaatccattcaattttttggcaccattttgtgcttgactaccgtactcaatctctaccgtattcaatcgaagccgctgttggggcactgaaatga

SEQ ID NO: 37485 - DNA, 1216 bp, Heterodera glycines
gacaaattatcgccagtgccaaagttggaattcacttttatgggtgtgcattttgttgttgattttgttgttttgtcacttccgtccattccaaaattgaattttggggcgcagaatctccgaccaattttaaaagttttggagaataaattacaaaatttgatctatgagactaatttgattgaagaatatgatccgaaaaagagagcacatttgaaatggaagcttgaagaagagttatttttagacggtaattaaaaactaattaaaatttactaaggacgatcgacaggaattaaattaaaataatcaaaacgattagaaaaaatacgaacaatattaatttattaattatttaaaaaaatattggtcgaagaaaagaaattaaatttttgttttatttttaaaatataaaatatttaataaactttatattacacttttacaattgaataatattttttattatttgaaactgtaaaacatagaaaaaatagagattatgaaatttaagttcttcatcggattcgtctgtgtaaaattattctaaatgagaatgaaatattaatgacagcacattaaaatgtgtcttttttaaaatatttttgcaacttcatttaaacattcaaaatggaatagtgacaaatttataaaaaaattttgtctaataaataaaattataatttgaaaaaaagatttaattttaagacaccgatgaagacaaagtgcaacgaattttgaaccaaattgacaaaatgaataatgaagatgcatcgaaaaaatatcatgaattgaacaatgtttccaatgaaacaaaaagaatgaatcaaataaaagttgaaagtaatcgaaagacaattgaaaaaatgcgagcaaatttgaacgttttacggagtaataataattaaaaaatgaaaatattatttaaaaaattatttaaaattttagggcactcttacgaactaaaaattctcgaatttttgttacctaaagaagaattatcccgattaaatcatcttcttgatgaaactgtgatgattggaggaacactgacaaaattcagagcagtttatgctattttggaattatgggcaaaaagtaagtattaattaattaattaatttggttattaaaaaatattaaaaatttagaaaaacatatttttaacaaaaatattgggcattttaatgcgcaagtgatttgcattatgctgaca

SEQ ID NO: 37486 - DNA, 958 bp, Heterodera glycines
  misc_feature (116)..(116): n is a, c, g, or t
  misc_feature (205)..(205): n is a, c, g, or t
ttaaattttcatttttttagcttttttcgaaaaatttttgtcttttttcggcaggcactgcctctgacaatgttttttatttattagaaaaaataaattgattttttttcttttgnatttattttaattatatttcattcttaaattttttaataaacattttcaaactttcaccttattaatttaaggcgaattttgccttttntaataaattctcttgtgaaaaggcaaaaaaataggctcttttaaatatgcctatttaaattactttcattgctttcctttgcttacgaccataccacgttgaaagcacgccatcccgtccgtctggcaagttaagcaacgttgggccttcttagtacttggaacggagacgtcctgggaatcgaaggtgttgtaagcttttttcctttttcacttgtaaatttatttaaattttcaattttttttagctttttttcgaaaatttttttgtctttttttcggcaggcactgcctctgacaatgttttttatttatttagaaaaataaatttttttttcttgttgatttattttaattatatttcatccttaaattttttaataaacattttcaaactttcaccttattaatttaaggcgaattttgccttttttaataaattctcttgtgaaaaggcaaaaaaataggctcttttaaatatgcctatttaaattactttaattgctttcctttgcttacgaccataccacgttgaaagcacgccatcccgtccttctggcaagttaagcaacgttgggccttcttagtacttggaacggagacgtcctgggaatcgaaggtgttgtaagctttttttccttttttcacttgtaaatttatttaaattttcaatttttttagctttttttcgaaaaattttttgtctttttttcggcaggcactgcctctgacaatgttttttatttatttagaa

SEQ ID NO: 37487 - DNA, 1243 bp, Heterodera glycines
  misc_feature (52)..(52): n is a, c, g, or t
  misc_feature (108)..(108): n is a, c, g, or t
  misc_feature (111)..(111): n is a, c, g, or t
  misc_feature (1159)..(1160): n is a, c, g, or t
  misc_feature (1234)..(1234): n is a, c, g, or t
ggggaaaattaagatgatactgatgattagcgttctgtttcgatttggcgcntagtgcgatattatttctcatgtttcttggaaagtactcacgaagtatttcgattntgntaaataaaccatcagctgatataaagaaaagcattcttgtctgtccttttccaattatattgccatttcggcatcggtctaacaaagctcgcatggctttgggaaattcctcaggaattaattttcgttgtctaaagaaatgcgctagtgtcgggcattttgacattaaaatgccattaaggcaccgttgtagcaatgatggacgtggtccttggaaattcctcaggaattaatccctgaatttcttctattttcttatcactcacaaatcactggggaaaattaagatgattctgatgattagcgttcttgttcgattttggcgctagtgcgatatttattctcatggttcttggaaagtactcaggaagtatttcgatttttgtaaataaaccatcagctgatataaagaaaagcattgttgtctgtccttttccaattatattgccatttcggcatcggtctaacaaagctgcgcatggctttgggaaattcctcaggaattaattttcgttgtctaaagaaatgcgctagtgtcgggcattttgacattaaaatgccattaaggcaccgttgtagcaatgatgcacgtggtccttggaaattcctcaggaattaatccctgaatttcttctattttcttatcactcacaaatcactggggaaaattaagatgattctgatgattagcgttcttgttcgattttggcgctagtgcgatatttattctcatggttcttggaaagtactcaggaagtatttcgatttttgtaaataaaccatcagctgatataaagaaaagcattgttgtctgtccttttccaattatattgccatttcggcatcggtctaacaaagctgcgcatggctttgggaaattcctcaggaattaattttcgttgtctaaagaaatgtactagtgtcgggcattttgacattaaaatgccattaaggcaccgttgtagcaatgatgcacgtggtccttggaaattcctcaggaattaatccctgaatttcttctattttcttatcactcacaaatcactgnngggaaaattaagatgattctgatgatttagcgtcttgttcgattttggcgctagtgcgatatttattctcatgngtcttggaa

SEQ ID NO: 37488 - DNA, 987 bp, Heterodera glycines
  misc_feature (899)..(899): n is a, c, g, or t
gtttttatctgttggacgattcagtcctaaagacatctggccatttcagtcccgggtctgtaactcttcagggatggttgccgcaaaaaaattccttcggattcttccaatacagaccgagagctaccgattggtatatatttcgaccattttcggcttgggccatatgatcaatatttactaaatattttccttaatataaatattttcctaatttccatttccttttacatcccttatataagcccgatcatttttttatgtcagattttttgaaaaaaataataaatatcagctggaagacgaacaaatatacctctttggacttttgtcaatcgccaaagaatttattttatttgcaaatatttaaatattattaaataaataggcattttaactaaaacttaaggttatttattcctagcataaataacatttctaattcttcgtttattcaatattaaatgaacttatttgcttatttatagcgagtcgcaacccgactccgccgaatgctgccgtattgttgttcattcgcagcgagatgataaaacaaaaaaaattaaatccaaattatattttattattaaaaaaacaattttttgcaaaaaaaaattaaaaacaatgaatctatacagttatacataaataaaattaaatatttgaatgtgagatgatgaccgggactagtcttctttattaatttttctcatataatagtaatattcattcatttttgtatattacgaaatgatgactcaaagaaatcattaataaaaataataattcaaactaaatttcgaaataatttaattcaaaaaaaagaaaaaattaagcaaaaagaatattcaaaaaaattaaataataaaattgttttttatttagttttcgaatattanagagaaaattgagtaaaaaagacattaactaatatttaatttataaaatatctattttattaaaagttaattattttagtaacattga

SEQ ID NO: 37489 - DNA, 911 bp, Heterodera glycines
tagctgaagataaatccatattcacaatgttagggatagggtatctacagatgaaaaccttagcctcctcccgaggaggttaatttctaaagattcgagtattattttgataagtccaaataaattttggagtatgtttaaaatttaaaattttttattgaaacttcaaaacctttaatgataatatttttattttttatttttaaataactgatttagagaacacttaatattgtataattttttttgtagtcaaactatttatttaaaccaagtctttgcccttttagttttctttataaaaaacactttaatttccttatttttgatgctaaataaaagacaattattaacaattattattatggttgggaattttaggcataaaaccacgaaataggcacctaaaaaggcagacaaaatcgaaaataaattggttgttttggtttttaaatgtcaaaatgacgagtagttatcaaacctaaatttttttatgtgatttgttttttgtttggcccaaatcaacgctattgaaaatatctggtacgattttttaaaattaatttccctgttgataatatatgaaaaggtttaatttttccaaccttttccgggctcggcaaattcaaaatccggtttgaccggcttgggagaggacgagcccggaaatcggttgatttgaaaatgtcggtggtctctcgtaaaacaattaaaaccacactttagactaattgctttaacgataagcaaatcatttggttttaaccctttaacttttttagataatgccaaattatttgttgatcagtcaaaatcaaacataaacaatttgtatccttgcgtaaagtttggtttgtcctggtgacaaatcacgccaaatttcggtgacaaatttaaatcaaaattaagac

SEQ ID NO: 37490 - DNA, 912 bp, Heterodera glycines
cctcccccccttccccctccctcttccctccccgtccatttgccctctccccttttttctctcatttttcgtttttttttctttcccgccaaactaaaaacttttcacttggtgtggttaatctttccgctgaattttgggcgttgtgcagcagaacaaatctttggcctgctgcgctcgctccgctgataaatattctccgaccgtcggacacgcaacctttaaaattgttttttgtcctttttatcaaattttcttccttcggtgctttttcactgtgtgcaaatgtcggcggattacgccaaaagagtgattgaaaatgagcaattgaaaaatgatttgacaaacggacgaacggacggacagcagaggaataagccaaaacgccaacaaaaagaaaatggaaatggaaatgtgatcaaacatcactttggtgggagtttaaaattttgaaataccccaaaatttattgggttttgtttgaatttcaatttcccaaaatttcgtcaattaattggtaagcataaaatttaattatccctctgctgcttctgtttactcagtccatcagtgacttcctttcccttttccaacttcattcattatgaaagtcaaaaattaatttttaatcctccctcaaattgcgccccttttgtcagaaataaacggagaatacgcaattgacccattggtcttggggcaatttccccctaaatatgtccaaggctccaacaacacttacccccacaactcaatgtccaatgaaaaaagttgagagcttgaaaagaagcgagaaataatgaacacgattttaaaaaccggaaaatttacctgcctttctgagcttttccgcgtggcgataatctctttaccgcactcggattctctttgggtgagaaaaacgttcctcac

SEQ ID NO: 37491 - DNA, 846 bp, Heterodera glycines
  misc_feature (374)..(375): n is a, c, g, or t
ctggacaaaaatccaggaaaatccatgtccaggaaacatccaggttgccgaaaaatggcctggacctggacctggatccaggaaaaacccaggcctggatccaggtccaggtcgatctctagttttgaaattatctttttatatgaattataataatttgtcaatttaaaacattataattttttattttttcttaatcatttcattttgcttattgattatccatcctttatttaaaatttataattgtatgaatataatcttttctttacattctaatattctattaaatttttttcttcgttctcattgtttgctatgatcatgcttttttctctctttttttttttttgcgttgcccaattccccccccnncccccacccattttcatttttcattttattaatatgccttttttaataatactttttttttgcccttttgcattttcttaaatttattttcattttaggctaaagaaaaaaaatgaatttttatattatattttttcttgtgattttttccacctttttttgtcagctgctgattgtaggagcaacaggtaattctgaagtttgaaggtgatttttgaaataggtatttaaatctaattaaaatcacggcattgaaaaatgcctttttctttgctgcacataaaatttgcatggcattaattgttaaaagtcagggcttgcaattaattaaaaaaaagaacccaaaatttggattggagtcaaaaataatgaaggattcctataaataaagagatttgttagccatgcacgtagccagaaaaaagttcacgaggggagagcttttttttgctcttccgagccaaaaatttt

SEQ ID NO: 37492 - DNA, 1018 bp, Heterodera glycines
  misc_feature (30)..(30): n is a, c, g, or t
  misc_feature (960)..(960): n is a, c, g, or t
  misc_feature (1002)..(1002): n is a, c, g, or t
ggtccaaaagtgggtgtaactccgctggangatgcgttagaaaagaaagaaaaatatgttcggacagcttttgaagagctgcattgaatggctgcagtcgccgctgctgtacgcccacccgttgccgagttagggtcgagagcggcatgaaaaaagacaaaaaggaggaaaatgaaacaaattcgcggctttgccctcgcgttggagaaagcaatgcgcagaataactggggagacttagggttagcgcatcaattatttttttcagaatgtgatcggggtacaaaaatacgggtccaaaagtgggtgtaactccgcttggagatgcgttagaaaagaaagaaaaatatgttcggacagcttttgaagagctgcattgaatgctgcagtcgccgctgctgtacgcccacccgttgctgagttagggtcgagagcggcatgaaaaaagacaaaaaggaggaaaatgaaacaaattcgcggctttgccatcgcgttggagaaagcaatgcgcagaataactggggagacttagggttagcgcatcaattatttttttcagaatgtgatcggggtacaaaaatacgggtccaaaagtgggtgtaactccgcttggagatgcgttagaaaagaaagaaaaatatgttcggacagcttttgaagagctgcattgaatgctgcagtcgccgctgctgtacgcccacccgttgctgagttagggtcgagagcggcatgaaaaaagacaaaaaggaggaaaatgaaacaaattcgcggctttgccctcgcgttggagaaagcaatgcgcagaataactggggagacttagggttagcgcatcaattatttttttcagaatgtgatcggggtacaaaaatacgggtccaaaagtgggtgtaactccgcttggagatgcgttagaaaagaaagaaaaatatgttcggacagcttttgaagagctgcatgnaatgctgcagtcgccgctgctgtacgcccaccccgtgctgangtagggtcgagagcgg

SEQ ID NO: 37493 - DNA, 1180 bp, Heterodera glycines
aggaggagaagaagaagaagaaggagaagcagcagaacagtagtgccgatggaaaatgcttaatggcatttaggtaaatcaatcaatcaaagggttccctttccctgatcagtgatcagttctgttgctgctgatcggttagtgcccacccctagggatgtgcgagagtctcggttctcggttcccgactcgggaaatttcccgggtttttcgcttcccggtctcggattttagtcttggaaaccgagaaatttttacactgttaaggatgaccttttcggggagtgggtcgccggtaaagggagaaaagaggaaaaattattgaaacttttaataagttttcttaacaaaactctttaaaaaacccaaaaaaaaatttacggcggcgcctatcggcgtcgcggcccacaaattcccctaagatttcaaaattggaatctaaaattacccatttttcagtgaaatccgaagaaagatacatattcaaaatttcatttttttcagggcctaaggtcgtttcttatatactgccaagttgtaggaaaataaaaaatgtaagacatatatttcgtttcttggcccaatttcaaccaattaaatttcttggtatcattcaatagctttaagtgttgtctatcagaatataattttttaattttttttcttaagtatataaaaagttatggtgccaaaatttcaaaaaaacttgagtaagaattttttgggtataacttttttaaaagtcaatgaaatttttccaaaatttttaaattgagaaatcttacgactatctaatgatattaactaagttttggctcaattgcattttatgaccgtaaattttaaatgccaataattatattcgcatgaccattgcgaaaagcatagagatgccattaggtttatcagttttctcaataaaaatcacaatagagtcttaaaatatctattaatctatttaaacaatcaaactattatatctccccgatgtatcttccaagacaaacagataatttcatatacgtctactgatttactcagtaaaattccaaaagcctatcggacggttaaaatttcaaaaaattcaacaaaaggactatctattatttcttcccgtgtatccaacgagagaagcatagaatgtcatttacggagactgatttactcattaaaattccaa

SEQ ID NO: 37494 - DNA, 1227 bp, Heterodera glycines
ttgtgtccatagtttaatcgtcagcgaatttgaaaaaataatcatttatccaaccaacagaaagttatacagaatgagtcaaaaaaccaaatttaaatccgattttggacataggcgtaaatgtctgcctgcataggcttcatggaactggttcgaaatgatgaggaatgtttaatttctggcaaatgtctcaatggcgacaaattaaaaaaaattcattgtttacattaattaaaattggttattcccatgtctttagctagtggtatttaagaatttttcaaaaaaaaaaaatcttaggaaatcttttttttaggaaaaaatccaaaattatcgattttatagcacttttttcaatacgctgaatctaagttcctttaaattttcttataaaaaactaattttttttgtttgaaaaattctatgtgttttttgccccataactttgttttttttttgtcagctaaattcccaaatttggcagcattcgatagctctctatgtttagaatcgaaaatagccggatgaacaactcgcaaaaacttaacttttttataatttaaaaaatttccagacaacttcgccagtcagcaccgccggggcgggcgacagtttgccgaatgggacaacaacaaccgccgccaccgctggcgacgtcacccccaaaaccggtggtggaggagatgaggacgagaaaatggaggaggactacgtggggggagcagctgcgggcggcgccaccgctggcagcgtgccgccgaagaagacgtccaccggtgccgccgctactggttcagcaacggccgctggtgcaaagccaacagctgccgccgagcaaaggttcaaaatttcatcactggggagcaaaaagcaggaatttgtagccgtttttcgccaaaaaattacaaattttcgccattttgtctaaaaattcaaaaataagacaatgggagtcttgacatcgccggaaaaatttggaaatttttacacattttgttaggaaaattattaaaaaattacaggattattttatttacagtagtatggtaaaatggtgtacatggcataatttttacacatatgctcaaaatgctgttggttttcatcccccgaaaaatgccaaaccccccaaaatacttattttatcggtagtttagtaaaaaattcgtccatttaaaaacatttttttgcttattatttggttgactggtgtgaaaattagtgccg

SEQ ID NO: 37495 - DNA, 880 bp, Heterodera glycines
  misc_feature (21)..(21): n is a, c, g, or t
tttaaaaaaagttattgaccntggctgagaaatcaaaaaaaccaagtttttttttgaagagttaataatttttttgaaactttactaaactttttgaaattttgcaggctaattgatggcacctagagctatcgaatgatataaaaatttaaaaatttggtttcttttaagaaaagttatatgaaaaggtcagccgtgttccgggaaatttttttttgaataatttcctgaaaaatcagtgaaacttagtttttaatttaattaaattaaatttttaatttagttggaaaaaattgaccaaatgtttgagcaaggtatagcactggaagtaattgaacgaacattaaatgttccaactgtggaattgaaatgccgttttgcacgactttgtaagaaaatagcaataggcgttataaattaaaaaaataaatttaacattttttaaatataattattagggatgggaattttatgtaacacatatttttcctggattccccaaatgctctgaatagtagaaaaaaaacacattcttttttgtgtttgcgaacaaaaatcgggacttttatttatatatttttacatatttcgagctttttagcatatttacacatttcgggctttttgtacatattttggactttttagcaatttctccataaatttttgagaatttttaaaattaatcaaaatttcttgtgaaaaattaaaaaaaaatttttttttttgaaaatgtacccctaaaaaccatttttttcaaaaaaaaagagataccaaaaatcaatttttaaaatattaaaaatatgattctaagactatttagggcatttttatggcattttgtgcctttttcaccctttacgagaattttttccaaaaa

SEQ ID NO: 37496 - DNA, 974 bp, Heterodera glycines
tcttataccactttccgcgcaagacattttaccgaaaactcggcacttctttgctctcggttggagtgatattgactaagattaaatggccaattataaagaaagataaaccaactatttgtgtgtttagctctctgttaattatgacacgttgtctttaccttagtttgggttaattgtcatgagtcatgccattttgaggccagcattcttttatgaacctccgacacctttttaaaataatatgcattcactaataattcattcttcaattcaaatattagtatatttgatgcgttctgccaaagcaatttaagaaaatgttccatttactaaagtaactggtaaacctcgaccgacttgcataaataatttcattacaattattcgtttacttgaatatcttataccactttccgcgcaagacattttaccgaaaactcggcacttctttgctctcggttggagtgatattgactaagattaaatggccaattataaagaaagataaaccaactatttgtgtgtttagctctctgttaattatgacacgttgtctttaccttagtttgggttaattgtcatgagtcatgccattttgaggccagcattcttttatgaacctccgacacctttttaaaataatatgcattcactaataattcattcttcaattcaaatattagtatatttgatgcgttctgccaaagcaatttaagaaaatgttccatttactaaagtaactggtaaacctcgaccgacttgcataaataatttcattacaattattcgtttacttgaatatcttataccactttccgcgcaagacattttaccgaaaactcggcactactttgctctcggttggagtgatattgactaagattaaatggccaattataaagaaagataaccaactatttgtgtgtttagctctctgttattatgacacgttgtctttaccttagtttggg

SEQ ID NO: 37497 - DNA, 511 bp, Heterodera glycines
tgtttattggctgttgaagcgatgccaaattggggagacggcgacgattaattgggaggacgaaaagacgaacaatttgaacattgtcaaatttaatcttgatggagatgatggagatcgcattgggtcagtgagtagcaattgttgttgttgctttaatagtaaatttaaattgcccttaatttaggcgattgtctccaccaaaggcggcggacaaaatgaacacaaaaagtcgtccaaaaaagaaaagtaaaaagaaaagtgccaagcgcagcggtaaacggcggaagaaaaagtgaatgaattatttgatcgaccccccccctccccatttcgcccgcaaagggcccaaaatgtctgaccatttcgcgtcgagggtggggccggtgtaaaagaggtggggcggggtcgccggcgaaggggaaaaagagggaaatttctgaaaaatttggctattttcttaacaaaattcattaaaaattctgaaaactttcccaccggcggcgcctat

SEQ ID NO: 37498 - DNA, 926 bp, Heterodera glycines
ttttcggttcacaaaccaccaaccataatgctcaaataacccttatcattgaatgatattttgttgtcaaaacaatacaatgcattaataaaatttagggctaaaaaatctggggacattttttatgaaaagtattggtgaaaagccgaaaatgcatattaataaaaaaatagttttttattttatttcaaaaaaaattaataacatttttgtttattccatatcattttcattgtttttttaagaaatttttttttgtttattattctataaatttcacaatggaaaatcgctgcattcattttttgacatttaattataatttcaatttttgctagtaaaatttttcatcaaaaaatactaattcattttctatatttagcatgaaaagtaaagactttttgaattgagccaatttctaacacaatttattcgtttttggcatttttcctccgctctcaatttatttgatgtgccaaaatgagtgcctttttggcattttattggttacggcacataaaacaatcctccagttgaggcaaattactaacaattattttctaaaaatacatacctattttctttgtttttctggccatattaacaataaatcatcacactcaattaccaataaagctgtcatttaattccatttttcttcaatataattaaatatttttcttcataactcatacttttttgcctgctttacatagttattatgtgcatatatttttttctctttttattagtaacgaatgtttatttaaatgcaactaattaggacggcaaaatgacattaattggttgacaaatttaagcatgagtcagcttcataattttgtgcggatgaagacaaaaataaaaaacgtaaaaattaatttttagtgaaaattaaaaagatctggcccaggttcttagtggtg

SEQ ID NO: 37499 - DNA, 746 bp, Heterodera glycines
ctaattgcttttgaactgtgtctgaattttttcccaacatttcagaagcgctggccagatcaacaagggttgcgccattgttggccaacagatcattggccgtctgcaggttctgccgtgctttttgtactgtcacagttagaaccgaacgaattggggcagacattttagcaattttgaaaaaaggtttgattttatgtgttcagtggccggcttgggcaaaaaagtgaacttgggaaaaattgaaattagggccaattggggtcgaaaaattaaatggggaccgattggggtcaaagaatggaaaagcaagtgccgggataaaccccagagcaccagactcttaatcgctctgtcgcccaaggaatggggaaactgctgctcacaatggagaagaccgtcggagggtcgaaacgagcagtggcgacaggaatggagcaaaggcgaggagtgcttttgctggaaaaatcactgaaggatttttcctttcgtttggaataaagaaagaaagtttttttgtttttgttttttttatgggaaattaggaaacaaggatttgttctggtttggttcgactcggataaaattcccttagggacagggaagatcctagaaaattggctttggaggccttaagagtctgatagaaccgagttagttagaaatatcaactttactaaaaaaccaaagcaaaaataaatgtgaaaaaacaaggaaaatgatcaggtgaaatgatcacacaagat

SEQ ID NO: 37500 - DNA, 876 bp, Heterodera glycines
cagaataattacgccgatactaattgttctggaatttcttttactgcgcgattgattgggaaaaatttggaaaattggctttctctttttctgctcaacagtaataggaattccaactgcattctcagaataattacgccgatactaattgttctggaatttgtttctcggcgcgtttgtttgggaaaaatttggaaaattggctatctctttttctgcacaacagtaataggaattccaaccgcattctcagaataattacgccgatactaattgttctggaatttgtttctctgcgcgtttgtttgggaaaaatttggaaaattgactatctctttttctgctcaacagtaataggaattccaaccgcattctcagaataattacgccgatactaattgttctggaatttgtttctcggcgcgtttgtttggaaaaaatttggaaaattggctatctctttttctgctcaacagtaataggaattccaaccgcattctcagaataattacgccgatactaattgttctggaatttgtttctctgcgcgtttgtttgggaaaaatttggaaaattggctatctctttttctgctcaacagtaataggaattccaaccgcattctcagaataattacgccgatactaattgttctggaatttgtttctctgcgcgtttgtttgggaaaaatttggaaaattggctatctctttttctgctcaacagtaataggaattccaactgcattctcagaataattacgccaatactaattgttctggaatttgtttctcggcgcgtttgtttgggaataaatttgaaaattggctatctctttttctgctcaacgtaataggaattccaaccgcattctca

SEQ ID NO: 37501 - DNA, 1633 bp, Heterodera glycines
  misc_feature (1442)..(1442): n is a, c, g, or t
  misc_feature (1458)..(1458): n is a, c, g, or t
  misc_feature (1471)..(1471): n is a, c, g, or t
caggtctcaacaacactttccggaatatgaatacaaatgacgaacatttatgggaaaaaattttccatttatctgacaactcaacccatataaaattttggctaaatagtttgcgcaaattcaaatttaaaaaaaaacgacaatcgtgtgcactttacaacaacgtaatggcattgtgtgagcgcgcacaaatatgccaagatttgcgtgccaactcaaattccatgacaatgaatttgctgtgcccgaaaaattttcgctcaaaaatatcgtaataaaactaatttcaataaaagaaaaaagagggggcgttggcacaattggggcacaaaaaattttttttttgttttgtttgccagaaacgaatcctgtttggaatcacgcaatgtgtgtgcgcacagcgggcatgggggggggggcacacatcgccaaggtattgtggtgttaatatttaaatgggacggaattttccaatttaccccactcacattgacaaccacccgccaaacagacagattaatttaaatatttaagttaaaattaaacttaaatttttgcatttggcattttatttttcagtcactctgtccgcctaattgcctaaaagatttggtaaaaactttttggcgaatcttatgacagagaatgcggcgacccacaaccgttctcctgtataatctgtttacgtgcctgggatgcaaaaggattcgtatttcagaattccaattctaagtggtgaaatttccgatttccgatcttttttttttgcatcgatgaaaatcgaagtattttgattcgagcccaaggtacaagtcatttcaggcctgaattttcctgtgtttttgtacaggaaatccagggtcaaatatggaaaaaagccagatcaaggctaaacacgaaaaaaaacctcgatttcctggacaaaaataaattagaatgtcttatttcagctaactaatcctagtcttttagttataaaataatgattagatatatgaaaaaaaacatattatttttgtaaatcagataatagatgttcctaagcattattagaaaaacccaggcgcaggcctggatccaggcctcaaagagccaggatttttttctggacctcgctttttgtccaggaaatccaggtccaggtctaacatggaattccaggtccaggctcaggcttttttcaataagtcagtctctactaatttttttaagccattagattgaggacaaattttgattaatatacatgagaattcaacaggttcttggtccatcaatttaaataaatatttttttaactttattttttgggataaaaattcttttttgttaaaatttccaattttctgtgtttttttttacatttttatgacacatttcagcgccctggcaacggtgaatttgggaagaacatgcaatttttttttgcgttaattcatagnttatcatcataaaaancacacattttttnaacttccttcctttatctttttaattcaaaaaacttaaaaacattaaaattaattttcttttaaaattaaattaattaaaataatcaaataataacaattaaattttcttttctttttatttcataagggtagtttttaatattacaaaattttaaataacc

SEQ ID NO: 37502 - DNA, 898 bp, Heterodera glycines
gcttccgaatgatgccaaatttgtccgagtttggccgttttaaaaagtcaagaacccccttttcactcaaattttcgagttttaaaccggttcaaaattcagaatttcgaaaagatcctttaaaaaatgcgacaaaacgaaaaacgaaattaagttttattgttaagtttttggagcctcgacaattgcgtctatgtccaaaatcggattcaaactagaactttttttcttcaggacctgatagtctaaaaatcacattaagattaagaaaatacagtcttcaagtttattaggagcattaattctgctgttatggttttatttttttttgtctgagcttgtcagctgcacttacggggttgtcagaagcgggtagaagtgcggcgccgtccatttcgtcgggaaattcgtcggcaagttcgtcgggatgcggcaagtgtgcgtagatggttgaatttggaaaatcggaaggaccggggggccaccaggggaaagggccctgggcagcgccgggggcaaagaatgcctcgtaaaccaagggattctgctgggcgatcaccgccaccacttccaaatagtcgttggcaaatgcagaaacggaatgcagcactgaaaagtgggcggaagaattgggtgttaattatccaattaaggctaattaattgggtactaattcattaattaggtatcaaataactaaccaaatatttaattattggtcataattaattttgtcatttgaattttacaagcccaggcgtgggagcggatttcggaaagacaaatagattttcgggtcgaatccggccggggttttttgtaaaattccgaggtaggcttactagccgaaataaaaatcattcccggaatcgcgagaccaaaattcgtaattttttac

SEQ ID NO: 37503 - DNA, 979 bp, Heterodera glycines
  misc_feature (19)..(19): n is a, c, g, or t
tagcgattcaggcgcacantttgggcctgaattaagccattttccctttgatcggtacaaaattggccgaaaaagagatagccattttctgaggcccgaaggaaaatttgagagggctaatttatatgtaatattcgaaagtgccaagctaattagcgattcaggcgcacattggggcctgaattaagccattttccctttgatcggtacaaaattggccgaaaaagagatagccattttctgaggcccgaaggaaaatttgagagggctaatttatatgtaatattcgaaagtgcaaagctaattagcgattcaggcgcacattggggcctgaattaagccattttccctttgatcggtacaaaattggccgaaaaagagatagccattttctgaggcccgaaggaaaatttgagagggctaatttatatgtaatattcgaaagtgcaaagctaattagcgattcaggcgcacattggggcctgaattaagccattttccctttgatcggtacaaaattggccgaaaaagagatagccattttctgaggcccgaaggaaaatttgagagggctaatttatatgtaatattcgaaagtgccaagctaattagcgattcaggcgcacattggggcctgaattaagccattttccctttgatcagtacaaaattggccgaaaaagagatagccattttctgaggcccgaaggaaaatttgagagggctaatttatatgtaatattcgaaagtgccaagctaattagcgattcaggcgcacattggggcctgaattaagccattttccctttgatcggtacaaaattggccgaaaaagagatagccattttctgaggcccgaaggaaaatttgagagggctaatttatatgtaatattcgaaagtgccaagctaattagcgattcaggcgcacattggggcctgaattaagccattttcccctttgatcggtacaaaattgg

SEQ ID NO: 37504 - DNA, 1066 bp, Heterodera glycines
aaattctacggccaaaatgaccacttcaacttcggcaagaagcgcaaggaagtaccggccggtccaacacacaacattcggcccgactttgacaaggcggattggcgagacattgaaatattcaaacatgtgcgcgaatacgagcggaagacgaagggggacaaggaggtgcactggaaggaggaggaacactttgtgccgaacagaatgaaggggggcaaatgatggattggattggacggatgaatcatttgcaattcaaaggatcgatcaatcgatcaaaaaggactttggtcgaaaatgctctcaaatcagaatcttgggcttatgtaagtaaaggaaacctcctaattgatttgtatatttttgaatctgttgacagattccaaagattgcattatttttcgattaattattgtatcatagaaaattccatttgttattcattttccttatgtgtgttcaatttataggttggtatgtctccctttttatttctttacactattataattgtgatgagagtttattggaacacttaatttgatgtcatttgcataatttattcaacgaaaatgtcttttgcctatggaaagtccattcagcagaatggtggtcccaaccgtgtcacattcattctgcgaaaaggtgcaattttcttcactgggatggttattggaacagtcgttgtttttgtatgttttcaaaaaagaatttgttcttcaggtttaaacattgttgttgcttcagaaggcatttaagccaacgcgtcccttcgacgaagcggcagaacgtggaaaaagggagctgttggagaaatacacggaggagtacaacgcgttgcaggaagagctgaggcaggcggaagagcagcagcggaacggagggatgccgaagaggcggaagcgagaaaggcttagccgatgacaataataatgatcaatttgggtggaagggttgtaaatcctctgaagtaggatcacactgctaattaaacattttgaatttcacatttgtgcctaaaggaagtatgttgggtcatcagacagtagtactgttttctttt

SEQ ID NO: 37505 - DNA, 1080 bp, Heterodera glycines
  misc_feature (1051)..(1051): n is a, c, g, or t
aaaagggatttgaccggcactccaataagaaaaatttggttcgcgctacagaaatggacgaacttttcacaatggaatggcccaagctatttgtaggacactcgaacacctcggcaaaattcaaattttttcaaaagtgttttgtccgattttattgagataaaatcataaattttaggcacaaattttgtccccaaatgacctggacggacttgagcgatcaattgacgatttcaaagtgtttttggcagagcaggaccggatgagtgcctttctctcaaagaaacccaaggcccatcttctactcttccactttgtgccatttgcacgacttcattggccttttggatgagcagggtgaaaaacaaattgcttaattagcacaaatttttaatattttcaaggtgatgaagcgcttcattcggtgtggcgaagactcgaacaatggtggaaatgtatgcctgacgcggaacaaattttgcaacaattggagcaccatttcgtcaacaattggctgctggacaccggaaggattgacgaattgaagcgggtttgttttttcaaaaggtttcccttttctgaattctcatctttagaattatgaagaaaggaagggcgaggatgacacggatgaagaagtggcggaagaaattgatgacgaatgccaaattgatgtaatttaacaaatttggattaaaggatgattttcaaaaaaaaagtgaagaaacaaaatgttttatcatttttgtttatttttcagaatatttatttgtcattttacaagtcttcttttgcttaaaatcaccaaaaacgtccgttaacatgcatcggattcgaacctggaaccccccttttggtgactagcacatataccactgagacaaaaattgaaatctttttggaactgggaggcaaaaactgaaacggtatgttaatgagaggaaccgttttagattttgttgaacattatgcgttttacccactcgaaggttcagtctcgaaggcatttagcctacccatttttgttccttgaaaggatccatcgtttggntttcgaccccacttgactttttcgaccct

SEQ ID NO: 37506 - DNA, 783 bp, Heterodera glycines
attctcattaattcataagtgtattaatagaatttttctatttcgcattttatgcgcattttttaacaatcgataagatagatatttaaaaatgagatgagataaaatgaatggaaattattattcaaaaaagaaaatggttttagaaatttttttatttaaaatgttaattcaaccattttttataaatttgttaacaaattttgatcaaaaatagtaaatttttattggcttttcatttactttaaaatttacgatctctatggcacttatttttttcaccttttacttcattaaatgtttttaatcaaatattttcatactttcagtttttacctttcactctagttttcttcagtaactttcactcaaacccccattcttaccagtgaatttttggtattccggtacccgtacctaccgggtcgggtaccgggtattggattttcaaaaaaccgagaccgggtccgggtattgaaaagaccgggtatccgggtctggacccggtcgggtacccggacccggccaaccctaatattaacttaataagaatttttttctccatttctataaatttttaattgttatacgtcattttataagaacacaaattatttggttaaaaaagattcgtaaagtttaaagaacaatgaaggtaaaacggaacatagagaataaaaaaatataaaatgattattatatatcatttattttttttattctttaatctcaagtttgcatatccccgttctttgttaaaattagcggaagtttctctttttt

SEQ ID NO: 37507 - DNA, 1465 bp, Heterodera glycines
  misc_feature (1460)..(1460): n is a, c, g, or t
tacacggcgagtcaattttgggctccaagcgcaaataagtttattatctatttagtaatcagaacgccaaaactttgcaaaacttaaaatttattggggactttcccttgtaaaaatggaagagccgatctcgagttagaaaagaaactttcaaaaaacaaaagagaattcgatagagagggccgaaaaactagcctaggcaaaatttcaagaaaatcgcaactctggaaaaatttttacgactgggcaaagttttttctttttctctatttgggcgtactatttccttgtctctaacatataaaataacacatgaatcatttatttgccaataaactattttttaaatttttttttaactttgaaatattcttcagaattttcccttcaaaatgagcacaaaatggttttatttgatctattattaatagggctgccaaaaatatgcacgaaaagtggccaaaatatgcgcataaatatgcaaataaaattgccaaatatgcaccaaatatgcacaaaaaaacttgaaaattaggggtgcaaatttaataaaaaaatttttttttcactagtgcatttgccaatgagctacatttcctttataaaattctccttagcaaatatttgacattttttaaatcaaaaattttctcatgaaaaataaatttggggaaacaatttttgaaaaaattttccaattcttagcatgtattttaaaaaagaaaaaaaagcgacaataaatctttttatggataattattagggttgtaaattatatggactaaaaaacgcgaaatatggacattaaatatggactaaaaaagcccgaaatatggactaaaaaggccaaaaatggccaaatatggaccaaaatatggataaaaaatgccaaaatatatgttgtaaacccccaaaaatcccaaaaaaggtgtgcatatttaatatttgcttaaataaacctaaaaagtacaataaacaaccaaaaaatggggtttaaaacttaaaaatgcatattttttattgttgttcgttgtatcaaaaacacctccaagtttgccaaatttcgaaaaaattctcattaaaaaaaaagaaatgttcgcaaaaaaatgacgaaaatatttattgaaaatgccaaaatgacgacgaaaactcaaatttttcgtgttttgtggggtgtaatttttaaaaatttccaaaaagttgatctttaggggtgtatttttcgtttttttttcatttttcttgtgaaaatttccaaaaaatggccaaaatatggactaaaaacccaaaaatggcgaaatatggatttattcccgaaaacccccaaaatatggatttatatggactaaaaaccttcaccaaatcaaaaaattttaacgcagaaatgctatttttaagcccctttcttcatagcatatgcgcagaaagaatatgttaatcccatataatttacaaccctnaataa

SEQ ID NO: 37508 - DNA, 940 bp, Heterodera glycines
  misc_feature (835)..(835): n is a, c, g, or t
  misc_feature (848)..(848): n is a, c, g, or t
  misc_feature (853)..(853): n is a, c, g, or t
  misc_feature (879)..(879): n is a, c, g, or t
ttttatttacaccctctcaaaagcattcctttcggcggcttcttcagccaattaatctgcgaaaaggagcaattgggcaaaaagcaaaatggaaaggactgactaatgagcccatggaaatgttttgcaaaaggaaaccaatttaattggtgcctttttttctgcgattcaattaaaataagaacaagaaaagtcaaccaaaaatagaaatttaaaaaagaaaaaagggaattaaattttcaaaaaaaaaacactgaaaaagggaaaatgagcgcaaattattgtaaagaaagcaaagaaaggccggccaacaaaagcagcaaataactcgagatgagctgttgcattgattcttttttaatttgactgaatccgccaaaaatgaacgcattttccccttctctttttatgtccccggggaaaaattgggctgaaattttgcgccggaaggaaaggaaaggggcggcggttgtaaaagaattgtaacggacgcaaaacaaaacaaaacactgatgagaagaagagaagggaaggaaggaaatgcaacaaacttttgacgaaagaaaatgtcatcaaagccaaaggatttgcttagataagctaaagtttttttttgccattttgggagaaaaaaagcggaggatggcattggcatttaacatcaaacgcaaagcgaaaaagaaaaaaagagtgaacgacggcacttccgcccaattaaaagaaaaacaatcaaagtccaagcaaattatcatttaaattttattgtaaaaagcaattagagaaaaaaagcaaaaattaattaattattgtaattaattgcaattattatcattanacaaatgagtaanaaggngaagagaacaaaatttgagagataanagaaaaacaaagaattagagaaatgccaaaagtgaattgccaaatgaaaaacacctgcaaa

SEQ ID NO: 37509 - DNA, 1471 bp, Heterodera glycines
  misc_feature (22)..(22): n is a, c, g, or t
tagtgatgagcaaaggagaaanaagcaaaaacagcaaaaaagaagtgaaaagagaaaaagaaaaagcacataaaaagaaatatgaaagggtagaagaaaaaaattgttatgaatatttttacggaaactagaccaaattttccaaaatttagaatcaaaatttagaagacttgcatctttttatagagaaaggaaaaaattcagggtgatgtgaaaagcacaaatgtgttgaaatggggaaaatttcctaaaaaattcttagggggtttgaaaaattttttgttgttgttgttgaattgaatgaacggacagaaagagtaaaatttgtaataactaaacgcaaaaagatgagaagtaggtaaatcataaaccccataatttgtgatttcaaaaaacgaaaaatacacccctaaaaatcgaatttttgacttcagccgcccccccccccgaagccaagggtctggctaagcccttgctgctgttgtctgatttgtaactataaatattgattgttcctattttttggtctgataccgctcgtatagagaattttaaacagccgagagaagagtgacaggacatttgaacagtagtcagttcgtcagtgaacatttgcacactaagtcatttggacagaagcggacaattgggcattacgacagcgaatggaagtttatttattgttataaattgcttagcattgaaactttattattattctttttaagattgcttacaaattagcattgaaactagatatttttgaggtcctaagaatttgaaaaaaatttcattgctaaagaaatttataataaatacggcttaaacaaactgaataccaaaaaatttggttcttgcgactattttagaccctcgatctcgattcacatttaccttgacagcagtcggctgaatcagtacagactggtttgataagtaaagttgaaagttaccacgcaaagacagatgtaattggttttttctacttttttaacttttttcaggaaaacgatttacaaaattgatgaaaaagaaagcagtggttcaagttctgggatattttttcttgttttgaaaagacgcaaaattttatcaactatttaatactgtttataatttaataccctcctcataatgattaatttaaggcaccatctccaagtccatctgccgtgaagacaagacaaaaagccgaagtggaattaaatgaatatttacgggatcaaaaaatcaaatccagggccaacccatcattatactgggaaacaaattcacaaatggccattgattggtgaagttgcactcaaaaatctttctccgcctgcaacaagttcagaaagtgagaggattttatcaacggcctgcctgatttcagatgactagagaaagagtttgttccagaaatcttgcaaaacttttgttttttcaccataacttgcttttaactggtttctcaattggatgatttttg

SEQ ID NO: 37510 - DNA, 1308 bp, Heterodera glycines
ccatgatcttcagaggtgttgaatttataaaaaatttaatacatttatcactataaaacatctaattaatttaaaaaaataataaataatttttttgaacatttaaaatatttaattttaaaataatttgtcatgcatcaatttttttaatttaaaaaactattaaaaaattatcaaaatatttacaaatctttgttaaaaaattatatttcctctattaaaaataatcaacaaaaaatacagtatgttaagccgttaaacacttataagcaagcatattaagaagtaattatgtaatctaaggatggctaaaatcggattagattgtttacaaaattttaaaaaattggtgtttataagaaaattatgagttttttaattttttgttcgaattcgattagctgttcgggattggtccgaaatttcagatcagcgatccgccaatctgaaaacccacatcaataatttttaagattcgcattaaaatttatcagaaaattattaattaattaatagttaaatattgcaatagatgtttgagtttaaaacacaaataaacactcccataaccacctgtgcatcattttttcaatgaatacaagttaattaaaaggcatttattcgtatcttaatggttcatatatttaaatcaaaaaattaacatttgaatagtttgatgaaaataaaaacactgatgattttatcataatcatagataaaggaactggtgaattatcaaatgaaataaaaaaattaatttaattaaaaaaagattaaacaaagatttttttttattgaattacaattgacatatcaaagcaaaaaattcaaaaaatatatttaataaaacgaatcaaaaaatatataaatgataaaaatctcaagttgatgaaacccctgattaatacaagaaatttcatagcccaatttaaaatgcaaatattattttaggagggaaatctattaatgttgaaaaaatacaattaatatatttatatgcgccgacaacaattgtaatcccgtcacaattttgcattttgcaatacgggcaatggtaagctcgggaattgttttaaaattttttaataaaataaaataaactttaaaagatttaaaaaccaaaacaaaataaaaagtaattaattttagaaattatttaagacaataaaaaagaatttaacatactaaggaaccaaaaaaagaaaattatactaagattacaattttaaacaatgaaatttgacaattaatattattgagatgatttatgtattgagatataactttttaatatttaagatggataaa

SEQ ID NO: 37511 - DNA, 1323 bp, Heterodera glycines
  misc_feature (1314)..(1314): n is a, c, g, or t
tggtaagttttattttccgttttaagcggtgacattcgtgatgccaatttggctttggtgaagagtattcgcaaccgtgcctcatatttcgctgagcttctccacaattcgatgaaggcacttattaattttcaattgttactttatttttcattgttagggcattggcacccgcgacaccgatttggtaaggaaatggacgaacggataagcgaatgctccaaatttatacaaattatataaaatgctggctttttgcacctttcacagattcgtctcgtcgtcacccgctccgaagtcgacttggccgacattcgccaggcatatcaaaatatgtacggcacttcactggaaaatgccatcgctagcgactgctctggcgcttataaggtaaggcccatcgcgagaaaaattccggggatgggagaatccgctggacagcccctctttcaatttttgattataagagaatatgtaatgtttgttatacaataaaaagctacatttaaaaaatcgtcgtattttgacattatgcaaatgatatttatttaacccaatttataattgtaagaaagcgatttcatgaagcgaaaacattgattttccaggatggtttggtcgctattgtgaagggatattaccactgattgcttggcactgctgtgaagaactttcaaacgataaaaaagttaaaataaaatagcggttgctaattactaataatttaagtgtgtgaatatgtatcactttgtattgtaatgacccatttcgaaaataataacttgcctgccaatgtgccgcataaataaacattaattggtacttaatagtatgttattgctgttaacaataagtttctgtgcttttatgttaagtattatattggtttttaaattaatctgttggcttcaagtcgacacggattttgcaaatgctatcgagaaaaattagttaatatgaaaaagagccaaaaatgggcactctttctttattaggtaaagtgtcaaatttctggcaatccttaagaattggtgtcccgccgaaaaaaaatgttaaaaatttttcggttattttttctaggaaattcatccagatttcattgcctttttatcgatcgaaattttatttttcggaatttcctttgtatttttcggcattttcttcgctaaaattcaaaaaaaaggtaactgtacagaaaaaaatatattctgatttgttattgtgttattgttagttagggctcaaaatttgtctaattttggacataaaattaaatttttttaaatatatttttttgttttattaaaatccccnaaatgtcgg

SEQ ID NO: 37512 - DNA, 1117 bp, Heterodera glycines
  misc_feature (69)..(69): n is a, c, g, or t
ataataaaatataattgtttgcaaatcccagttggtcccggcttttctggtccggttttgcctaattcncgtgctattttaaaggttttatgaacttaaaaattagataattttttttttctatttaggctcaatttctactttttccatcaaaatccaaatgatagaatttaaataagattttttcatttttaataaaaattattcgtactttttttcattatttatttattataattactgtttttttaagattttgaattatgattatatttttataattgtttggcacaatttcaaaatcttttaaatttattttttatttgtttaatttaaacaatttaaagaaataattgcttaaaataattgtttacaccgttttattgcacctttatactcttttacttcaatgctttattttttacattcactaatactttataatttgaatacgcacaaaaattccatattaatgatttgtatttaaaaaaatatatttttatttttattatgataaaacatttgctgttcataaatttatctcagccctcacttttcttataaattttgaaattacttgtatggaatttgtctttaatattaattattcatttttaccatgacgaattgaatttcttctgtattgtggactttccagcttcgttaaattcctttaaaattgttatattcgttaaattgtgccgaagacatattgatcaccgaggacacagtaaaggaaagtgagaaaacgaattaatagacaaataaaaaaagtccgagaaataaaagaaatcggtagacaaaattttgtagaatgaaatgtacaaaattcaaacatttcaacttaaggggggaggtgttgtgtagtgaattatcatacattcaaatttacgccaaaataatgctcatttattcaccatactgtatcgcccatttcatgcatttaaggagtggactttcttcactctttagactcagcccacatcacccatttgactctgtcctttcattcattggcccggtcaataaagccttttgacacggaaaattgtgagataaaaataaacaaaaataggaatttatagattgaagggtgctctttcttctgataccaaaa

SEQ ID NO: 37513 - DNA, 1235 bp, Heterodera glycines
  misc_feature (19)..(20): n is a, c, g, or t
  misc_feature (41)..(42): n is a, c, g, or t
  misc_feature (44)..(44): n is a, c, g, or t
  misc_feature (59)..(60): n is a, c, g, or t
gagattaagtagctgaatnntgtgagattctctatttacanntntcatttatcacttgnnaaattctcaaaaatttcagctcatttatcatggaaatataaattgtataggcgtcgcagaaggatcgagtcgataagcgccaataattttccatttattattttggtttggccagcttgtataattcttacaatttcagctcattacccccttaaaataaactgtataagtgttgcggaagtatggagttgataaacgctaataatctccgatttacaatttacttaagcaaattaatacagatacatttggaggaaaatgagctgaaaatgtgaaaatttcacaaagatggtcgtgaaaataataagtcggagattattggcgctatcaactcaatatttccgcaacgcagttagagtttatatttagaagataattagctgaaattttgagaatttcacaaggatggtcgtgaaaataataaatcagagaatattattaacccgatccttctacaatattgctgcagtatttatttagagattaagtagctgaaattgtgagattctctatttacatttcattatcactttgaaattctcaaaatttcagctcattatcatggaaatataaattgtataggcgtcgcagaaggatcgagtcgataagcgccaataattttccatttattattttggtttggccagcttgtataattcttacaatttcagctcattacccccttaaaataaactgtataagtgttgcggaagtatggagttgataaacgctaataatctccgatttacaatttacttaagcaaattaatacagatacatttggaggaaaatgagctgaaaatgtgaaaatttcacaaagatggtcgtgaaaataataagtcggagattattggcgctatcaactcaatatttccgcaacgcagttagagtttatatttagaagataattagctgaaattttgagaatttcacaaggatggtcgtgaaaataataaatcagagaatattattaacccgatccttctacaatattgctgcagtatttatttagagattaagtagctgaaattgtgagattctctatttacatttcattatcactttgaaattctcaaaatttcagctcattatcatggaaatataaattgtataggcgtcgcagaaggatcgagtcaataagcgccaataattttccatttattattttggtttgg

SEQ ID NO: 37514 - DNA, 1034 bp, Heterodera glycines
aatgaagtaagacaccgaattgtctctcattttttctttagtttgaagaaataaaaaaaaatttgaaaattactgattacgggaaatacggcatttttgaccccgtcatgacggattatggaatccataattaagaaaatcgccgtaattacgggtttccgtaattgaaaatccagttacacccagcatgctcggtagcttaatggtagagcttcccacggattgtgtggtcgattgggttcaattcccacagaagttgccaattatttatttgcatttctgttattgtaaaggaaaaaatgggaataatcagtgaatgattttgactggtcggtggacaatttgtgttggaattgatcaccaccactttttggcattccgacacatttgattttgtcatttttatgtgcatcataataataaaataatgagaattttcattgtaaagatcacctccgccgcaaaatgtgtcgaactgtttggtgtgtgcaacaattaccgtgtcgactaccgatcgtttgacgcacagccaattctcggcttggaaccacactttcatacggtaatggagttggccattggcacggcacagttcagccactttctgctcgagatcagcaatggcgtgacccttctcgagctcaatggccaactgggattggtaaaaaataatgtaaataattttagggtgacattactcacattttcaaaaaatcttgtcacgccgtcaccaactcgcactgctcttggacaaaaacgtgccaaacttttcgggtcaaacacctaaatcttaggagaatgagtaaattgtcgtcaagactctcgagagttttatctgattttcaatttataatatcggaaaatataaatttcacttcacccaaataaaatatggcctaagaagtgaaaagataatccatttatttttgggtttcttctataaactatttttggttactgatcaaaaatcaatttttttttcattcattttaaaaataaataaataatataaaatttttaaattaaaaaaaaaa

SEQ ID NO: 37515 - DNA, 1386 bp, Heterodera glycines
  misc_feature (36)..(37): n is a, c, g, or t
  misc_feature (1290)..(1290): n is a, c, g, or t
  misc_feature (1308)..(1308): n is a, c, g, or t
  misc_feature (1346)..(1346): n is a, c, g, or t
  misc_feature (1374)..(1374): n is a, c, g, or t
gatataataatttgaataaaaattaatttatttacnnaatgttaaaagattttactctttattataatcaaaaattttttattataatacgagataaataattatttattaattatttataaatatataataatacaaatatttaattttgcgttgaatgcaaaccatctactatgaacatcgtggagacaacaagattgaaaatattaaaggaagaattagttcacgatgtttaaaatataaaaatatattgcaaaacttaaaaaagatcactcactgatcactaacccattttagcttatcagtcagtaaacagataaataacgtacaattttatttatgccttattaataaaattgtatgaattgttaaatttttccttaatataattttaaagtaaatttatttatattaaatattgaattttctataatttgttactagacgattaatttaacaatttcaatttattttactgtttttttaaattttttcttttataattattttattattattattattattgtaagcttaatatcagctcttcatattacttgcttaaaccaaatattttcaaattttttaatcaagggtgtaggacgattctctttattatttcatttaaaatactatctcatttgcatttatataattagaatgaatcaattcataattttaaaaaacagtaataatgcttctctctttttcacttctattacacttttaaattaatttacttttattttctatttccgataatttttatatattttggaatggtatttttttaataataaacatacattcctagatattagatacaattaaagataaaaaattataattctttataaaaataaaaaatattttttgtattttcttgctctgctttagaaaaattatcatttgttttaactatttttaatcttattgtaaaattgctgttttgtattcaatccaattttttttcttatttttaggattaattcatgttcaactgcccaataaaattgctctttttttatgcgatatttaatttaaatattcgtgttatgatttgcttacattagatgttaaattaatatataataagtttattctttggcctttttattcaaaattttttaaatttataataaaatgtttttataaataattttttaaatttgaaatttattataattatcattttatttaacgattgaatgtacaaattatattcgtatagtttgaattatagttgaatttttaattttccatttctttcaataaaattttttttataanattccacattttcagtanacactacgattacagaaaaaaccgaagtttttgcgttnataattactttaatttctgtattatcanttatatacaaaa

SEQ ID NO: 37516 - DNA, 1328 bp, Heterodera glycines
aacgagataaagaaatcaaaatttgatactcttgaacaaagtttttaatattttcgtcaaaaattttctatttaataattttttgaggaacgccttttttgatgttttgagtaaaaacgaccccagaaccgatgaaacggtgcatttttccttcctaaaaaattttcaattagcaagcattttttaaaaattttccaattattgcgcagcttcgtttggaagcccatgaatttttttttgaattctgctaaataattttcattgtttgtttttgtatacaaaaaattttttaaataaaatttacactttgggccaaaatctgataaaaatctcatccgaaatttggacatttttttgtttgaaaaagagcaacttaaaaaacagatgttaaagcaaaaaaaaggtcactacttcacctttttgttgactttaattaattggcaaatgcatatcgcaaaaagaaaacttaaaaattaaagccatttaatttttggctaataataagcgtgttaactttttgtcccttctaagttcaatgggatattagggatgaatgatgaaaattttttgctattatagcttagttatgaataatttggaagcaacaaatttatctgctcgattgatctcattaaaataaattttctagatcacatcttgtcaaatgcgttttccgtcttgggcatggaaaaatgccgagatcgcttatggcgataaaaatttttaaggactgcggttaaaattgttgcaaatcaaggattatattttacataacaaaccaggactcggattgtaccaagtaactttccaagtataggcatgccaatttccaagtacataacggggaaaatttgtaaaattcaagtacacataaaaatttgaacaaaaacaaaaaaaattgaaaagggaattttccttaaatattttctattttttccggaattattttatctggagctgagcgggaccgggacctggtcgggaaatcccggtttttcaggtcccggtcccggtttttgaaaaaaaggaaaccccggtcccggttttgccagtcccggtcccggcgggactaaataagcactggtaagaatgtgggtctgggtgagaaaagagaagaaaattggtggaggagaaatttttgagaaaaaaatttaattatttatttagcatttgttcatccacaaatgtggtctagttgctaaaccttcctgaccttcaatatttgtctctcgggttcaattcctcaacggaacaaaaacttttttcatattttctttatacttatttcaattgaaatttaattaataaataaaatattccaattttta

SEQ ID NO: 37517 - DNA, 979 bp, Heterodera glycines
atacgaacaaagacgatttataatgatgatgattgatatataggtaaagtagggcgacaataagcaagaataaaagccaaaataatcaactttttccaaaaattaaatgagcttcaatattattttcattgttaacaaataaaaaaaatagaggtgatgagtgataaagggtgacgcaaattcagaccaaggaagatgtgtgaagcattactaaaaaagattataaacaattaaaagaataatattattaaaagcttatcatcattttcaaatattcggcaaagaacatttatacaaaaaattaaatacggcaccaaccgagtgcaatataatatatgaaattaaaggaaaatttattcagaaatcttgtccaaaaagttgtaaatttttaattgcgtatccctaataaaaaaaaagagtgaagccacgccacccagaaccagagacttgtgacaacagggcaacagcagttttaaatggtcaaaaaatgataaagtattactttttaataaataaaaagcaaaatacttagtaataacaataataaaaataaaaagctgatcaataatatacaaattttaatcttaaatattattgttcttaattttttaactataaattatcagaatgcataaatactagaattttgattaaatgagagaactaaaatcctacctaaaacataaaattgatcaaaaattcatcagaaagatagtaaaatattttatgcattaaaatattgattattgaataatgattatttttctttgagttaattcaagaacaaaccaataaattctcgtaaccaacatttatatgaaatataatgaatatgaaaaacaataatctaaataacatttactaaaaaaataacaaaaaactcagttcatttacgtcaaatcaactcttcgacaacatgaattacagctaagacaagttaagaatagaaaaaatactcaaagaaaattataatgaaaaa

SEQ ID NO: 37518 - DNA, 952 bp, Heterodera glycines
aatatgtaataaaatatggtgctaaaaaatgctgaaatatgtgctaaaaacccccaaaaatgccaaaatatgtgctaaaatatgtgttaaaaattgaaaaaataagtgtgtttttgcataaaaattcccaaaaatctcattctttatcatttttagcccatacaacgcaaatcaaatacatttcgaagtgtttggggtaaaattgtctttttttgataaatcatttctataaattgaaagttccagcagagaacttcgaaatccaatgacgaattaatgaattcgagatttcattagtttctacaatcgaagaaaaaattttttaatttgaaaattatgttaataattatgaaaaaagtcgatttttaggggtgtatttttcaattttcttgtatttttattgcaatttttctcaaaaatgccaaaatatgtgcaaaatatgtgccaaaccccaaaatatgtgctaacatatttttgtgccaaaacgccaaaatatgtgtttttatgtttttataagtcgctctaaatcaaaaattgttcggagataatgctatttttgggcttctctcgccataactaagccgcaaaaaaaatatgtaaaaacataaaaatccggtctctagttataactcaagtcctaggcagctctttctaaccaaaatgctaaatttattcttttttctattgattctaaatgttcaaagtgattttgtacccttataaccaaaattattagaatttgcgaattacatgatttttaatgtgttagagacatgaaaatagtacgccaaaaagagaggaaaagaaatacttttttaggttttatcttataactttttaaaacaacatttaagcgatgataaatgttgtctttttacatcattaaaatgaagagatagtacgccaaagtgagagaaattataaagaaaaagagaaacgaccaaatagtacc

SEQ ID NO: 37519 - DNA, 649 bp, Heterodera glycines
tgactgatcagacagacagcgcaagtgaaaaaggggtagctttgattgtttcgcatggaacaaacacaccacacacatttggtgataaggtgtgatttaaaaaggcagtgtttaaaaggctttttgtccaccgcttatctcccgggccaatctttcgcataataagcagtgaaactgcttttccccttgccattacctctccccctttccccaattgcttttccttgacattacctttccctccattttcccatttcccctaattgcttttccccattccctccccccccccccatttccctttggcccctccgccggtcaatcgcagggaatgtccacctgctgctgatcgccgctcttccgatcgttcttctctcatccgccaatgttcacttatccctgcccatcttccggttttctttctccgtacgtccgtttctttcaaatgcaatttaataaatttcacaattaatgcagtgattccccaatttctcttttcgtttcgaatggatatgcctgccttttatggcaattttttgcaatgatttggaacttttgctgtcgtccacccatctttttgtatttgtcgcgcactgaccattccctctccctctcccctccctcgcccctcctctgtctgttgcccctc

SEQ ID NO: 37520 - DNA, 901 bp, Heterodera glycines
  misc_feature (838)..(838): n is a, c, g, or t
aatctttggctcgtttccaaaatgtgcgatccaatatttgactgtaatgctgtctctgtttttgcaatcagtagttttaaaaatcatttttgggtattgacgcaatttggagatccacaataaatatgctgggcatagaaatcttaatctctgcgaactttacgtgttttcgaaaagggttattttattataaaattccctctactttccataatctttggttaatttttgacaaaccttattcttacaagcatttaactgtttccatttttagacctgcgaccccatttttgccaagcacagttacggacgtgaagtatgcctaaaaactttaccaatttcatggtttttcttacaataaattgaaaagattttgacattcttgctgatcagtccattccgtcggtctcttttaaatttgttcgacttttctctctgaaatttcatactcaaaaaaattcggcgcgcaatttccaaaccttgaaaaaaattttggccatgatttctgtttaatttttgccgatttctaacaaatcacttgctcaggatttgcttgcgatgatgggcagaaacacgatgaagccgccgcttgacatcaaacgctgcccattctttgtggacagtgcacagacgcccatcattctgatgccgttcacggacattgaaatggttttttaatcaatttttagcttatagtccgacaaaacaaaatcgtgcattttaataataaatttgcacaattgggttacagtttgcttttcacacctttcaactccttttttggtagacggtattctcctttctattagttctactacattgcccctaacccagtggnggattagcgggcaagttggcatttgccatttgaaccgaaaaaatttttaaagaaaaaattgaa

SEQ ID NO: 37521 - DNA, 995 bp, Heterodera glycines
  misc_feature (816)..(816): n is a, c, g, or t
gtccggagaaataaaaattaccagctatttgaaatgcagtgggaaagcacagcgagtcgcttaaatgcacaccctttgacacgtaaaatattccaaaaaaagagatagtgattttttctggattaggccggagaaataaaaattaccagctatttgaaatgcagtgggcaagcacagcgagtcgcttaaatgcacaccctttgacacgtaaaatattccaaaaaaaaagagatagtgattttttctggattaggccggagaaataaaaattaccagctatttgaaatgcagtgggcaagcacagcgagtcgcttaaatgcacaccctttgacacgtaaaatattccaaaaaaagagatagtgattttttctggattaggccggagaaataaaaattaccagctatttgaaatgcagtgggcaagcacagcgagtcgcttaaatgcacaccctttgacacgtaaaatattccaaaaaaagagatagtgattttttctggattaggccggagaaataaaaattaccagctatttgaaatgcagtgggcaagcacagcgagtcgcttaaatgcacaccctttgacacgtaaaatattccaaaaaaagagatagtgattttttctggattaggccggagaaataaaaattaccagctatttgaaatgcagtgggcaagcacagcgagtcgcttaaatgcacaccctttgacacgtaaaatattccaaaaaaagagatagtgattttttctggattaggccggagaaataaaaattaccagctatttgaaatgcagtgggcaagcacagcgagtcgcttanatgcacaccctttgacacgtaaaatattccaaaaaaagagatagtgattttttctggattaggccggagaaataaatattaccagctatttgaaatgcagtgggcaagcacagcgagtcgcttaatgcacacccttgacacgtaaatattccaaaaagagatagtgattttttctggat

SEQ ID NO: 37522 - DNA, 755 bp, Heterodera glycines
attaatttaaagtgagcaaatataaccattaaaagcatattaaaattaactttggttaattagtttttggaaaagtcaagtaaaaaagtgccaaatattatggtggtttaatttaatatttaaattaaaatgatcagacagaaaaaagaggatgtgataagtgatcagaggacccacctggaagtaatcagccaatttgagaagcatcagcacatttgtggctaaaaattggaatcatattttaaaaaaattatattttcaaccccataaaaatggaagagtattttttaggggattgaatagaataagtacagtatcatgaattacggttgggcataaaaggtccgttcagataagtgatggcctccaaaaactccatgaattggtccatgtccacgcccaattcgtccaaagtgatcattcgctgctgcttctccttcatctccacgctgagcatgcgactgatcaccggggaaacggacatcagccaatgggcggacacagcaacctgatcagaatggttatcagtgctttgaccaaaatttcttagggatctgatcaaattttatcagtgatctatcaaatctcatttttaaaatcggggcaatgcccaattttatcagtgatcatttgccttataggggatgtgagaggaatgccattttgatctttctgattttcacctgtttgtcgccaattttcaccgtcaaatcgtcgtcaggtgagctgctggatggcgccgggaagggacttaa

SEQ ID NO: 37523 - DNA, 996 bp, Heterodera glycines
  misc_feature (745)..(745): n is a, c, g, or t
  misc_feature (763)..(763): n is a, c, g, or t
  misc_feature (768)..(768): n is a, c, g, or t
  misc_feature (858)..(858): n is a, c, g, or t
gcgaagcggccgaatgtcccccaaaaaattaaaaaacgggcgcgaagcgcccatcctgaggccgcgaagcggccgaatatcccccaaaaaattaaaaacgggcgcgaagcgcccgtcctgaggctgcgaagcggccgaatgtcccccaaaaaattaaaaaacgggcgcgaagcgcccgtcttgaggctgcgatgaattgctaaattacatcactttctagcgacgcggcgaagccgcgtccctgagcgcgaagcgctttccccacagcaacagaactcaattgataatgtttttgtatgttttaaaataacaaatgagggccatatattaccaagccacgcatgcacaccatagccaactgctcaccctagttactatatatgttatattgacaaggagtttcgttgctaaaaccattttctcccggccgaaggccgggagcgccctgaaagtagtggaagggtcttacaactttttgaggagcatccgggaaaaatataggttttcaggtccaagggccaactgagtaccagggactgatttctcattttttcgtgcgtttgacggcccctaactttttttgtaaaactcgaatcaaaaagtgcccgctgtgagggcactccaccaaagtgtcctctaaatgctggtattttttaaaattttttttgagcaaacccctggcctgcaaaaaatggcaactgaagcgtgctcaaaaagtacacttcattaccaggtgaataccgcngccagggtttgatctgangcggngggtggccagcgaacttattgtagagctttggaagctcgattttttgaaattttaaaatttcgaaaatttttcaaatttttcaagttagngctaaaaaccggtttttcgggtttttgaattttatgattttttaacgattttcccgggaaaacgaagacacttccaaacatagtttttcgagctctatcgattggtaatttttttgaaaaaatttcgattttttcccg

SEQ ID NO: 37524 - DNA, 1125 bp, Heterodera glycines
  misc_feature (970)..(970): n is a, c, g, or t
ttattcagaattagttatttttaacagtcaaattattgtaaatacattcatgcggtattttcgtctccttttacaatacagtatttaataccgtaccttcaaatttcaaacgttttctcttttctcctcttttttttgtcgttatttacagtacgaccaattggttattacacagttgccactttaattttcggacttgtcaagtaataaatggcgatatttgaaccagtatgttaattctgttccttttgtcaggaatttaataaccttttttcacttttgccagccaatatgatattaaaactgatgatttgaacaaaatctcaccctcgcttttttttaaacaatgtcactttttaatgctccccaattttaataccgtgctcgcacaaagtcaatggaaaatgaggaaatctccgcgcgctgaaattgtcgtgccaatcttctccgaatttgcttctggttccagttaattcctccgaaatgtcgtgccaatcttctccgaggctctccgatgtaatgaggctttttgggccaatggtgccttttttggaacgacttttcgactctccgttcagctgtgtctgatcagtcagtaaagtgcaaatcaattgatgatattttattttgagaactagggttagagaaatatgtgattgctttttgctaaaattgtgaaaatttaatactaaattgtacagagttaatatttaatcagtgaaaattatttaatattttcttgagtcgagagtctcgagagtggaaatcaaatggcctaggattaacgagatcccaaatgagctttcattttcgcctgagcacaaatgttttattatttgccttattactttactttgcccgtcttttactgattaattattctgttgggagaattgggaaattttcgcgatttgggcgattttcgcaacacattcctgattaattgttgtgtgatcacttttaagctggncatccgattcatttttgtcccaattctcgtgattggcgattttttctttacatttggtagtcacattcttttaatccccctttctgatccccgctatttttttccaatcgggcccctaatgatcatccccaacggcgcctggttgaagcaatgtt

SEQ ID NO: 37525 - DNA, 937 bp, Heterodera glycines
ttccaggggagtggtgggggaatacggagcattgtattaattcgttttcccttcccgcggtgggacgaaaacaaaaaaagtgaactatttttaacagaattaaagattttgttgcccatcgaagaaaaccccgcttgtccactttttaataaatatgattggaaaataatcgacaaatatggtgttttacagctaatgaatgcatatataaaagaccgtatttgtaatatttcaagaacaagcaattactctcacatcaatcaatgagagaaagggatgcaaaagaaatgatgcaatcgtatgctattatttggaattgattgattggcaatttaatgttccaataaattagacaaacaattggtatagtatttttcatattttagaagtatttttcatattttagaaattaattacattctataaaattaaatgattataaacatcttaaaacagctaaagttaaatcccactttattgtccattttttgaaaggcttccattcatttgaagcccaaatttgaggaaacggtcgtcgacttagtggtggtgatgattgtcgcaaacatattctgcaccgtcgactccaacgcgggcagtgctcgccgtccgccgcttccgcccgatttgcacagttggaagagtcgtctgacctgcgcgtccccccgggggtggtagcgcgtgttgttcaacgcctcttcagcgatgtttctgcaaaaaacggataagagagagaatggtgatttaaacgaagtttgcatattaaaacagtctttttacttactttgcctcgcttcggccaatgtcctcgcgaatttggaggagaacggtgagaaactccgcgggaatgtcgggaaacttgcgcatcatcgtcgacgcctccaaggagagtaaatgttttgtcccgcaaatccaacacttcccgcactgcggaaag

SEQ ID NO: 37526 - DNA, 1037 bp, Heterodera glycines
atgcttcactatcaaaaagggagatgaataaaaatctaaaatttttaatgcttttaaatatgcgaaaaattttaggcttaactttttttttataaactgatcagaagcgaaccagattttgcgagagcatcaaaaagacaaggaaaagcactgctatgatgctaactccagtaattctgaatttaaaattttttattaatttttaaagcttcactattttatttttttagcaaaatcaattcataaatattttttcagaaactgctctgaaacgcaccaaatgttaattaaaagttaaataaggctctctgatgctttttctatcaaaagggagatgaataaaatttttaaaaatttttaattcctttttaaacaggccaaaaagtttaggcttatattttaaaaagtttcatcgaacctagcgcactaaaatcgatataatctctccaaattttgcaggccttctccattgtaaaggactaacttaacctgaaaaaatgccaacgcttgttgtttttaaaatttttcaaaattctgactttttcattacttatttattttttgcaaaattaattcataagtattttttcagaaagtgctctgaaacgcaccaaatgttaattaaaagttaaataaggctctctgatgctttttctatcaaaagggagatgaataaatattttaaaaatttttaattcctttttaaacaggccaaaaagtttaggcttatattttaaaaagtttcatcgaacctagcgcactaaaatcgatataatctctccaaattttgcaggccttctccattgtaaaggactaacttaacctgaaaaaatgccaacgcttgttgtttttaaaatttttcgaaattctgactttttcattacttatttattattttgcaaaattaattcataaatattttttagaacgtgctctgaaacgcaccaaatgttaattaaaagttaaataaggctctctgatgctttttctatcaaaagggagatgaataaatattttaaaaatttttaattcctttt

SEQ ID NO: 37527 - DNA, 333 bp, Heterodera glycines
cgttttaatgaattttaccattttggtcttttagttggagagggctctgcgagaaaccattacgcgtgcagctgaccaactttgggtgcagcagctgcaaaactcagtgactgctcggaatggctgtgcctccgcaagtgccgaagtccgagtggcggacaaattgaacttcaaattttgcatcgaatttaggtgccgcatttaaaattgttaatgatttgttttgacattctaacatggaagcctttttaaggtccataacttattgcgaaatgccggcccatctccaggaaaatttgttccgactgatcaattctttgtgaatggatggcg

SEQ ID NO: 37528 - DNA, 1173 bp, Heterodera glycines
atcaaggcatcactaaatttaaattctcccaaaatttaaatatttcttactaagaaatttcctaagttttttatgaaaaatttctagatttgaaaaaaaattttttaattttttcgggggggggggggggggtacgacacggggggggggggaaacgacctgctccggttacggacatttagtgagtcaatgtatgattattacgtcagaagacacagcgtcgctggcaccacccgcaccgcccggaggccgctgcttcttagccacaggcattgtcaccaccatgatgtcatcatcgtcatctccaccagcactggcttcagcagtgccagcaccgccatagtcaccaaccgccgcagccgcagcgactccaacattttggtcgtccgagtccacgcccattgtgtcgggtggcagcggcaagcgccacgagccgtcacggagcagttcaatctcgtcatcgccggaagcgacggcggacagcacttgctcgaagtagctgaagaagcaagcgtattttcatggtaaatgaattaataaatacgcacgcgtcaatgatcagcttggagtagatggcattccggtcacacaccggacacttccaagttggtcgcttctccgacatcatcaggtagctgttcaggtcgaagcactgcaagtgcgtgcactcggctgctcgtgatggtattttgatgcgagtgcgcatcaactaaaatttgcgtaaaattatgatttcaatttttttaaaattttttgggggagggaggaggttaaatgccctaaaacccaagccctaattaaagaagaaaagaaacagcaattttatttttatatttcaattttctattcaccggatccatcagtgagattttcaacgagtccatttgcacgtcatcctcgtccccgttgaggcgtcggacaattatctgtttggtcttctccagcggacggcgcgcattcggattgttgagaatgcgattcagcagaatttccgagttcaatcgcctcaccaaagtcacctgtgaaagaataaagtgcaatcaaaaacgtaaccgggggctgggagatggctttaccccccaatgaaatgaaaaaaagtaattaattaatcaagcggggagaaaaacaaagagataggctacgccccggaggaggcaaagtacaagtccgagt

SEQ ID NO: 37529 - DNA, 869 bp, Heterodera glycines
ggtcatttaatttaatttataaaaaaaatatccggcacgtaaaatattgaaaattacgattttttttaggtaatttttggtcttcgcaaaatgtcggcaaaaattcgtgccgaaatgaagcgcaatgggccaaatgcaattgacttaattgagccaataaatgtgctggtcggctcatcaataaaccttcttttgtatgggaattcattggaagaggcaaataaaaaaatattattttttaaattattaaatgtaattacattaattaattgttttcaggggaatatggacaatttttgtactgtcaaggaaaatatgaaacaacttttacaactatttccatggtataattttttttccaattatttaattagatttgaaatataaaattttgcttttaggaaaacaacacagattgtctgtggcacaaatttatggttagctatttgcatttaatttttacatttttaaggcattactacaataacagaccactttttttatcgattgatttccaccccaaacctattggcttcttttggggcgagagagtgcaccgtctaacctctccagcgacgagagagtgcaccgtctaacccaccagcagacccgtgcctatgggctgctcggtcccgcctcgacacgaattggctgctcggtcccgataatatccgagatctcgacacgagatctcggctattatcggttcgagatcccggtctctgtcgtgtggtgcgcgagaatttaagcagaaaatttaaaaactgaagtggactcgaacctgggaggcgaatcctgacacgttaaccacttggccaactagtcgttggaagaaaaagattaaatgttgtatttgtgatggtgaaaag

SEQ ID NO: 37530 - DNA, 1264 bp, Heterodera glycines
  misc_feature (1035)..(1035): n is a, c, g, or t
  misc_feature (1196)..(1196): n is a, c, g, or t
gaacgaatgggcgaaccctttcgatcgcaattaattaattatttaactgacagtttttacgtagaattttaatttcaattaaattttagaaacatttgccgtttcggtgccttttgtgcttgccgatttatctgactttccatgcgttaattccttttgtctttctctcttttttctccttttcttttgtgttttccttctcaaattatgctaattagttaattaccttccccgattttctaattgtttttaatgacttattgtttcattttgctaaatgaacgaatggatatcgcccagtttaataagcgacgaatgaatgatgggacagacaaagaaagaaagcctcgggggcaaagtgttcgctgatcagagacaattcaatcattctgagcgatcggcacactgcacgtgatcatttccggttatatgaccaaagagacaataattaaaagtgacgaattcgatttttgatttattacccctaatttatttaattacccctctcctcctctcccgcaattcgttcgcttttacttttccaatttggtatcagttttctcatttgcccttcagcgcccaccgtttccgtccgccaattttgagcgccttctccagccgactttgcaccaccgtcacttccccccgggggtcgtcggcgccgccgctttgccattgctcggcaattagcacaacggaggacggcgcatcggaagagacagccggcgaagagggcgacattctgtggttgttgttgttttgctgctgttgttgtgtaactgcgggcgatgggccgttgctgagctcatcgatgagacgaaaatcggccgaaagaacggccggcggcgacgcactgatcagcattggctgatccctgagattaaacgaactaatcactgatcagaggcagggaaacggagtttggcaatgaaaaaaccaaataaatcaacaacaaaaaaacattttaaaagacagagagagagaagtaagagaaaagtgatcggaaggatgagggggaaagggggtggaaatgcnggtgggagaaaccaaatcaaatcaaatggacggcgaaggaagtgatggggtggtgacgggtgggggggaagcgtctccgctccatcccccgcagcaaaagcgccccgaggcatttgggtaaattctttcgcgaaaaatttgcggaaggaatgctaaactanatggaatcaacggcagcagacggggaaaggcagtgagcacaatttgttgttggggggggggcgacacg

SEQ ID NO: 37531 - DNA, 921 bp, Heterodera glycines
aaattttgaaaatttgattaaaatttgttgacagattttcaccaaaaaatcatcaaattttgtgatttttgtatcatttttctaatgagaaataagagttttggcgcgccgctgagaacagtttttcatcaaattaccaaattttgcgattttgggccattttctaagaaaaataggagttttgggggcgcggcggtgtcgataggcgccgccggggaaaaaattggaaattttgatcatttataaacagtttttcactgaaaattagccaatttataggtaaaattttgaaaaattttatgggaatttaatccaattcttaggggtgtaaaagtcgcatttcgcgccaaaaagcgaaatgcgaaaagcgaaatgcgaaacgccaaaaaatgcgaataatgcgaaaggcgaaatgcgaaaagcgaaacctcggcccatccctggtacatacagtctttaacaaaattctaagtccaagaattttttgaactttacctacttcacatggaccaattgagctcctcaattttttatcaagcataccctccacattaatattaagattgacagaaaaaaaattgaaagtgcagaagaaaaaaattttaatgaattttcacgaaagttgcccaaatttgctgttacaaaaatataggtccaagatttcgaaacatataactttttttctagggtaagaaaggaccaaaaaaaattcatattattataacttttatgcttatcaaaaagccaattgcacccagcgatcagatcaatccttcggggtgatcgggagtgatgaaaattttaacacccccaggggaattgagctttttctgaaaattttcaaacacattaaaactgcacccaatcaacatgaacttcatacgcagacatcctacaagcatttctgattgaaaaagacca

SEQ ID NO: 37532 - DNA, 1256 bp, Heterodera glycines
attagcatcggggtacgagatagaaattgtcctaaaaagagataaccatttagcatcgaggttacgagatagaaaattgtcttaaaaagagatagccatttttctgagaattaattcacaatttccgcagctcttacggtaatggaaaaaattttgaagaggctctcaggaacggattagcatcggggttacgagatagaaaattgtcctaaaaagagatagccatttttctgagaattaattcacaatttctgcagctcttagggtaatggaaaaaattttgaagaggctctccggaacggattagcatcggggttacgagatagaaaattgtcctaaaaagagatagccatttttctgagaattaattcacaatttctgcagctcttagggtaatggaaaaaattttgaagaggctctccggaacggattagcatcggggttacgagatagaaaattgtcctaaaaagagataaccatttttctgagaattaattcacaatttccgcagctcttagggtaatggaaaaaattttgaagaggctctccggaacggattagcatcggggttacgagatagaaaattgtcttaaaaagagatagccatttttctgagaattaattcacaatttcagcagctcttagggtaatggaaaaaattttgaagaggctatccggaacggattagcatcggggttacgagatagaaaattgtcctaaaaagagatagccatttttctgagaattaattcacaatttctgcagctcttagggtaatggaaaaaattttgaagaggctctccggaacggattagcatcggggttacgagatagaaaattgtcctaaaaagagataaccatttagcatcggggttacgagatagaaaattgtcttaaaaagagatagccatttttctgagaattaattcacaatttccgcagctcttacggtaatggaaaaaattttgaagaggctctcaggaacggattagcatcggggttacgagatagaaaattgtcctaaaaagagatagccatttttctgagaattaattcacaatttctgcagctcttagggtaatggaaaaaattttgaagaggctctccggaacggattagcatcggggttacgagatagaaaattgtcctaaaaagagataaccatttttctgagaattaattcacaatttcgcagctcttagggtaatggaaaaaattttgaagaggctctccggaacagattagcatcggggtta

SEQ ID NO: 37533 - DNA, 89 bp, Heterodera glycines
tgttcgagccggtcagcgacgcctatacccgcgagtcggtgcgcgggcagatccattccctggtgctggaactgtcgaaggtcgagccg

SEQ ID NO: 37534 - DNA, 1114 bp, Heterodera glycines
  misc_feature (53)..(53): n is a, c, g, or t
  misc_feature (73)..(73): n is a, c, g, or t
aatatatgtttatttaaattatttaaataataataattttatttatttatttntaagtgatccaatacgtccncattccaatgctgccactttcgtcgttagaagatcgtttccaaggcattccatggccacaattttctgcatccactcgtgaagcatacatggaaatcagtgaaaaaaaattcatttaaaattcaaatgaattaattttctaatttccagcaaaggatcggcctcggatgaaaaactattacagtaattttgaaaaaaaataaataaaaaaaactatgtaaaaatttaaggaaattcatttattcaattttggagcggatttgtgccagtactgaatcggatgggtggaaaggatgtttcggaggtgtgtaaattaattcaaatttacaatttttcccaattaaaaattcacatttttgaaggaccatcatcttttgccctcccattttgaccgtacaacattttttggcgttccgcgtccgttcggcgccatttcaaacattccatttcccccaccgccgccacccccaccaccgacaccgtttccgaaggaattgcatgacaaaatgatggcacagggtgccgccaatggttgggcctagtttttggaggcgttttttgaaatttaatttttagcggcgttttctacaacaaaaaggccgggcacggaatcaggcgaatcggtaaaacgtgccgaaaaaaaggattaaaaaatttttttgtccgattagcaaatgtatccatccaaaatgccggacaatggcatcatcagtaaaacggcggaatttaatccgaattggggttggatggtgttgatcggtgtcacattaactgtcatcaacctgtgcattctgattgccatctccagaaaggtgtgactaagtttttttttaaaattttccaaaaaatcgcaagaatttttttttgaagtgcattcgacaacactccgagggcaaaaagaagtttcaatatcagagctatgcaagcggtggcgtgccacctccattgccacccatggacatgaattatgcattgatggcacaacaggtgggcaaaaaaataaatttttaaatttaaattttaataaattagtgccaaaaac

SEQ ID NO: 37535 - DNA, 964 bp, Heterodera glycines
ttttgcataattaattcataaatatttttttcagaaactgctctgaaacgcaccaaattttatttgcaagttattttaggcactcagatgctttcactatcaaaaagggagatgaataaaaaatctaaaaatttttaattgctttttaaatatgcgaaaaattttaggcttaactttttttttataaactgatcagaagcgaaccagattttgcgagggcatcaaaaagacaaggaaaagcactgctatgatgctaactccagtaattctgaatttaaaattttttattaatttttaaagcttcactattttatttttttagcaaaatcaattcataaatattttttcagaaactgctctgaaacgcaccaaatgttaattaaaagttaaataaggctctctgatgctttttctatcaaaagggagatgaataaaatttttaaaaatttttaattcctttttaaacaggccaaaaagtttaggcttatattttaaaaagtttcatcgaacctagcgcactaaaatcgatataatctctccaaattttgcaggccttctccattgtaaaggactaacttaacctgaaaaaatgccaacgcttgttgtttttaaaatttttcgaaattctgactttttcattacttatttattttttgcaaaattaattcataagtattttttcagaaagtgctctgaaacgcaccaaatgttaattaaaagttaaataaggctctctgatgctttttctatcaaaagggagatgaataaatattttaaaaatttttaattcctttttaaacaggccaaaaagtttaggcttatattttaaaaagtttcatcgaacctagcgcactaaaatcgatataatctctccaaattttgcaggccttctccattgaaaaggactaacttaacctgaaaaaatgcaacgcttgttgtttttaaaatttttcgaaattctgac

SEQ ID NO: 37536 - DNA, 1025 bp, Heterodera glycines
  misc_feature (958)..(958): n is a, c, g, or t
tgccgtaattctcagcggaggaccaaattcagtttatgtggacaatgcgcccgtgtacgacccggaactgctcggtggtcgtcttccgctgctcggcatttgctacgggttccaagtccggtccaaatgattcatatttattgccagaatttgagtgcattttttccttcccattttagctaatcaacaaacacttcggtggctccgtcagtttgcagccgcggcgggaggatgggcgaactcagatccaagtcagcccaaagtcggaccttttccactcgttgaagccggaccaatttgtgctgctcacccacggggacggagtgacaccggaaacgtcagccaaaaatgggtttcaaccaattggcttcagcggggaatttgtggcgggtaattaattaattggggttaatgaacaacaaaaacttgagtattcagccatcgaaaatactgaacggcgcatttatggtcttcaatttcatccgggtaagagaacaaatatttaaatgggaattggcaagggatttacgtattttgcaaatagttcgaacccgcactttttcagaagccgacctcaccgaccagggtattcaaatcatcgacaatttccttcgtcggatttgctcactgaagtgccattacacactgcgcaatcgcgaacaaatgtgcgaggaacgcattcgaagtgcggtgggagagaagggcgaagtgctcgttttggtgtcgggcggcgtcgactccaccgtttgtgccgcgttgtgcaccaaagcattgggcgcagagaaagtggtaagggttgaaggcacggatttgaaacctccgacaaatttttccattccaaacgattattttttgttttctggcggcgattctttagcgttaagacctcccaattgactttccggctttagcatgccattcacattgacaatgggttcatgcggttgaacgagtccgnccgagtgatgaattctttgcatgacttaaaggtgagtaagcaaattccaaaaaaatcttcaaattca

SEQ ID NO: 37537 - DNA, 1247 bp, Heterodera glycines
taaattcatattatgacttaattgtgtacattgtctgaagaagagcatgcagagagagttcggactgagcaaaaaacgaatcgaagtcgagcattctctcaagtttagacggatggacttggtgcaagttgcaacgagacaacagttcgggaaaaatgttttcacgatcggacaaactgtgcccaacccaacggacgatgagactggattgaaatatgaactttgccatactggttttaaagttataaatacttaaggtagacatcggcacggacgttgctcgcatgccgtggcatttcaagcaattcgaccaatttgatgggttcccagccaagcacatcagcattttccaaaagacatctgaaacggcttttgctcttaacacacaatagaccgaacaacccatttatatttgagtcgaagaattcgttggcatgcttttgcaagcgcggcaaattgtaacgggaggccaaatcacgaattgccaagcaatttgcaacatcaatgtaacgcatcagataatcagcacagtaatttttcaagcggatcatctaaaaaaactttaaaatgggaatctaattttgcaaaacccactagcaaattattcgccaattttaacaattccacaacaatggctctgtcaattgtcactgagccgctatacatataattgagaatgcgatcgaacacagtcggatcttgacaattgactataatctgaagggaataacaaataacaaaggattccaattaacaaacgctctttaccttctctttcgcaattttgttgtgacgcaaaattgaatcaaaatacggactatgggcagccaaaaccattctgtgagcactgaactggcggtctttaacgaaaatacatgcatcacaaaacctaaaagaactaacaaatgaagctgtgttgtctaaaaggaaaaccttccagtgattcgctggtaatgcatccgttccaacattggacaagcatttggttctttgaatgacattggactgagacttgcagcaccatcttttgagcaagaaggaagcgtcatccggaaaataccaagtttagaaaatttgatttccactaatttgaaacactcgagaatggaattttttttttgtttcattaaatttgaattactcccgccgggtctacgggtaaaaatttataacattttttacgggagttcccagttccgttcccggaaaagtttccgaactcccgctccccgaaattttttttttta

SEQ ID NO: 37538 - DNA, 1336 bp, Heterodera glycines
  misc_feature (14)..(14): n is a, c, g, or t
aattatttttaatntaattaatttatttttccgctttttctgtacctccatccgttcgaccgcttcgcgtgccgccgccacgttcagcagaccgccgccgcttatgccacctccgttctccaccatcgatgccaacagcgatccgccgctgccggacgaacacgggggcaactcgttcagctctttctacaataaacattattatacgcatatattttaaatttcccatcctgtacaaattgacccgaattagcctaagtttttctcattttttttgacccaaattgccgcaaaattagatatttgtagaattaattaaaaaatcaacaacaaattaaaagttgcccttcctttgattatgaggaaaagtgccactttctggatatgggtgtgattcacttattcattcgttttattctccgaactcccaaccccaagcgaagattgcagtgccatttgctgctgttgctggcgccggtgtgccaattcggcgagtgccgcgttcaccgccgccattgtctgcgctgtgtcctgcgactgaccaatgccgctgccgctcatcgccgctgatggcccagcagcggcaccgctggtggtcatggagtgttgctgctgctgctggtggcccaacgcgacaatggcatttgggccaacgacgggacggccggcgaactgttggaagggcgactgaccgacgacgacacccaccgatggagccaactctaccccttggggctgcttgtggtggaacttgcgagcatgacgcacacgacggcagctgaatttaaaaaaatttccaaaatccaaattcaaacagagatttaccgcgccgccaatttgcgcattgcctcgcgaaagtactccttgaactcgttctccttcccgacccggtcaaacagcaccttttggcatacatctgcaaaataaattaacagtccatgtttcgaatttgcatgcctaatcgtctcaatcaaaatgaaatgtttgtaaaaaatgaatgtacagtaaatgtagatgatgcccggaagtggcaaattgctgtagcttgagtgatttggcatggcaaacgttgtcttggccataagtcgggagccgaacacgcgtttctccgccagctttttgcacaattgggccattgtttcggcaacgctttggttctcatgctttttgttttgcagcacttgttggatcacttgttgctcggacatcggtttgaaatcttatcaaagagttcaattacaattgaaaattacgtcaatttaaataattatggcacttacacgggtcgttttgtgcctccgccactgggatttggattcgctgaatttgctcttcg

SEQ ID NO: 37539 - DNA, 1758 bp, Heterodera glycines
  misc_feature (164)..(164): n is a, c, g, or t
  misc_feature (171)..(171): n is a, c, g, or t
aaaaatatggaaatcattttaaaaattttattttttaatatttccgaattaaaatcatacatttccatttaaaaagaaattaggcgcaaatggtgcatttaatgaattcaaattaaaacaccgcaaaaaatgatatttcaaacttaatttttaataataacccncaaaatntaagaaattctaaagtctgaataagtagaaatattcggtaggcgcttctctcaccgccaatttgcctttgctgtcaccgccaacagtcgacggcggaggcgttcttcaagcagttcaacccgcccaaactgttgctgccgcctccgccactaccgccgcttcttcggccgatgaggcagcggctgtcggggcgaacggcgaagcggcggacgccgtgcaaaaccaactgccgctgtcggtgatgaacaattacttctccatcggcgcggacgcacatgtcgcactccaattccaccagtcacggagtgcaaacccgcagatgctcaactcgcgcttcaaaaatcgcatcgcttacggaggccttggcaccatcgacctgttcaagcgcacatggaaggtggttggcggcattcatcggcgatagggggagtggggaggaataggcacggcccaagaagggtggcatgacaacactcgcacaaaaagggaactcgtacaatggcttaggctaggcctaagcttcagactaggcataggcttagacttgtttggcttaggctttattttgtaaatttttattgtacgaattacctttagtacgagttgccattaatccccaagaggggttggcacaactccaaatttaagggtttatgctaaatcagttgggcatgaatgggggagtactgggttggcacagtcggagaacagtgacatccaaatttggtgggtaggagcgtttggcacgttcactgaaccgattgagagagattggcacggctcagaacaaatgtcactacagaacccaaccaaatacataattgtttatcccttaggacctttccgagtacattaatgttgagtgtgacggggtggacatcaccgccaaaattcgcgagttcaaattccactgcattctgttccacaacatctctttctacgccggcggcaccgtcccgtggggtgccggcgacggagtgcaagtgaggcgattaatgtgttaattagtagtttttggcaaaagcattcaaacaattagttggcaaataatgccattggcattttggcaaaataaatttggcattctgctcaccaattttactgctccgatttgaggagaactgtggcgaagtgttctcccgtccgtcgccatgtgatggcaaaattgaggtgctcggcttcaccaccgccactttggccgccctccaaatgggcggcaaaggcgagcgcatcgcgcagtgctcaaaggtgcgcattgagacgagcaagccgatcccgatgcaagtggacggggtaagcaaaaggacacaatgggggggggcacagggataaatgacaaagagcggaagaatggataaaatgaggagaaacgacaaaatggggacaaatggacaaagagggacagctggaaaagggcggcaaattgggggcgggagtaattaggaatcgaaagttgcaatttggaggtaaatcagccccttctcctttcaattcaggagccgtgtctgctcggcccatcgcttattcatctttcattccacaacaaaggtaaagccattaaacagttaattatctttattatctatc

SEQ ID NO: 37540 - DNA, 929 bp, Heterodera glycines
ggctccgcacgggcgaccatctcatttttggcggacgacggatacggcggcactcagcgctatttccgcgacatcagtgtgccccagcatggcgtgcagctgagtttcgttgacctgactaatttgaacgagttgcgaaaggccattgagaccaaataccaaagtgagtgccgacaaacgcagcgaaaggggcattcattccgattttgcttacagatggtttggttcgagtcgccttcaaatccgctgctcaaagtggtcgacattgcggcggtgtccaaaattgtgaaggcacacaattccgaatgccttgtgcttgtcgacaatacggttagcctattattggcacagcaatgctttgcattggcccctccttcagtttatgtctccgttcttccaaaaccctttggcattgggtgccgatgtcgtgctgcactcgctgaccaaatatatcaacggccattccgacgtggtgatgggctgtctgataaccgacagcgaaaggctcgaggcgcactttctcttccaacaattgggtcagtccacgcattacaattaattaactaattaattctgttgcccgttcagcggtcggttctgtgccctcctcatttgacgtttatttggtgctccgtggcatcaaaacactgcaccttcggatgcgtcagcatcattccaacgcgatttctgtcgcgcgttggctggagacggacccgcgcgttgagagggtaattagttggctaattagttaatcgagtgaatgcggaatcatggataatcagcagcagaagtaattgaaggtttcccttcttaggtgctttaccctgaacttgaatcgcatccccagcacgaagtgcacaaaaaacagaccagcggaatgtccggaatgatcacagtttatttgcgcaccgactggaaggatctcgaag

SEQ ID NO: 37541 - DNA, 989 bp, Heterodera glycines
gcccagaaaaattgtagattcagaattttaatggtaataatagaagaagtacataaatctagaaataagcatattgcagtgattgggaagaaagatttaagtgattaaatactgaatttttggggccatcaactcctttgtttttgccagagtttgtgtgccacaaataaaaaatgcgggaatagaggaagaagaaccaaacaaagatgaacgatgaaaaacactttcaggaagcgctaggtgattattggagcccagaaaaattgtagattcagaattttaatggtaataatagaagaagaggtacataaatctagaaataagcatattgcagtgattgggaagaaagatttaagtgattaaatactgaatttttggggccatcaactcctttgtttttgccagtttgtgtgccacaaataaaaaatgcgggaatagaggaagaagaaccaaacaaagatgaacgatgaaaaacactttcaggaggcgcccggtggttggttattggagcctagaaaaattgtagattcagaattttaatggtaataatagaagaggtacataaatttagaaataagcatattgcagtgattgggaagaaagatttaagtgattaaatactgaatttttggggccatcaactcctttgtttttgccatagtttgtgtgccacaaataaaaaatgcgggaatagaggaagaagaaccaaacaaagatgaacgatgaaaaacactttcaggaagcgctaggtgattattggagcccagaaaagttgtagattcagaattttaatggtaataatagaagaggtacataaatctagaaataagcatattgcagtgattgggaagaaagatttaagtgattaaatactgaatttttgcggccatcaactcctttgtttttgccagagtttgtgtgccacaaataataaatgcgggaatagaggaagaagaaccaaacaagatgaacgatgaaaaacactttca

SEQ ID NO: 37542 - DNA, 1750 bp, Heterodera glycines
  misc_feature (12)..(12): n is a, c, g, or t
  misc_feature (1727)..(1727): n is a, c, g, or t
cagcagcaacancggagttcatcaccagcagcagtcttaccccgcggttggcggtggtccattgccaacggctgctccaccggcttcgtcgcccagtgtcatcgcagtcggaggtggtggcatgcttcatcccggctcaaatgcggcagctgcggcgggcatggcacgcgctccgacattcaatcaccacacccagcagcaacagcaaatgtttaacaaccaaagcgcggcggcattctatgccgcttatcaacaccagtttttccaggttttatttttttgaaaacagtgctcttttatacaaaaacaaatttgaccatatgaccccaaattttccctacgccggatccaaatttccttttattttttgccaaggcttacaattagcctcaaaattttcaaatttttgcaaaaatgactaaaatttcccgtttttcccacggtagacaaaaattcaggaaacttacatttgacaaacaatttttgaccgaaagagaaaaaaaagttccaactgctcctcccgaaatttttttaagtttacgggcctgggacaaaaaatatagttttgtatataacctgaaaaccaaatccaatgttatatcttcgtaatttcagatggcaccgcataactttgtcaacccacaagcggcgcacctccatcaccagcaaccgccgaacaatccgttggccgctgccgcctcagccgccgctgctgcagctgatgctgcacaacagcatcatcagccacaacatcatcaccaaacagcagaatgggcaagcagcacaacagcagcaacatgttcatcccaatctgtaccagcgacagcagcaaccggctgttgtccccagcatggcgccggtgggcaatccgtgcgcgaccttcgcaccgtcgaactgccattctacgaccagatcaaagtgagctggttttctaacaaaaagaaattttctatttattaacaaaaagttgtcatttctcagcagatttttatcaattattttggttttaataatgtctgattgtgagtgagaatttttcttgtttcaaaaatttaaatttttggcatacaatttggttaagaattatcccccccccgtcccggccgggctttcattgcaatttgtttaggtgattgtgccaataactgaactgcctccgtatccggtgcctattcgacctggcgatgcgcgtgcttcgcattcgtttagcgtacccagtgaggacatacaaaaggtgcactatcgcattgaggaacaaccactgccacggtaattgtcgtctctctctctctcttgccaatctcgagcaatttgggctctaccaataagtagcagatttttttagaatttctgaattattcctttggagaaatgataaatcatctttttgaaattaataattcacaattaactctcacgtaagtgttgttggcaatttaattcagtcccatacaattttcagttacgagctccagttgcgcatgtttttgttggagaccagtgaggagcagcaggacgcttttccgcccggctcgacggtgcgagtcgatgaacacggagtgcaattgccggtctgtcggcagctcattcaaatttatattggcattatatttgccatagttattattattacttttgctgatcaatatcaacctaatcacaaattcagccagtgattccaaccaacaaaccgaacgcggaacagaaacgttaccctcgcccggtgnaacatcagactctagaggtcccc

SEQ ID NO: 37543 - DNA, 979 bp, Heterodera glycines
  misc_feature (969)..(969): n is a, c, g, or t
agcggactgaaaattccgccggagcgtcgccgtgaacttctcgcgctctccggcgggggtggcgaatcggaggacgagcgaacgtcgtccatttctgaacaaccaccagcaaaaaaagcgacgacaacaatgaaaaagccatcagtgaccatccaaaaagaggaggaaaagcagccagcacaagccaaatcaaaatcgccatctccgcgaccagcaaagtcaccgtcaccgaatccgaaagaggtgggtactgtacaaatggtaccggtgccgtccgcgtgcatcattaccatattccctccggcgggtcgccgggaagtggtcgaccaattcggcatttgcttctactcttttaaatgcattttcagtgtgtgctaattagccacttaagtattcatgatacggtgtcctgaatttgatgagaccgtaatcatcgaaaattccgtaaatttatgagccgacaattccaacgcctaatttttgcagttttttccgtttattttcattttgaagcttttttgaattaaattgcatatattttggcagttattccgttgcaactaacaaagctaatcaacaaaatgccaagtcaacagccgcggcgcgtaattttgaaaaaaacgaatcgcattttttggatggaataaatttattgcgatcagttgccctcacataattattggcggtgaaattgggtgctttgtttacttatcccctccggggatgcctttcatttcatatccccccccccctagggcgaatgcctttcctccctctacattttgtgctttttctttttcattgagcgaaatcaacgcttcaagaccccgactctccccctcacccccgcccattcgtcgatccatttttttcgcactttttgccactccaagcccgatcatttgatgaagccgccactgatcggtggaagcacaacagctccagcagcagcagacggacgacgacccngcgatgaatg

SEQ ID NO: 37544 - DNA, 830 bp, Heterodera glycines
  misc_feature (807)..(807): n is a, c, g, or t
ttgattatgtttaatttcatttgaatttgcgaattatattcgaaatgcgtaagcattgattttccacgtataatcatttatattgtacatgtatttttatgcaattaacatggtcactttattgatctataagatgacatgggttttaatttttacattcaaaatcgtaaaataaaatggaaaaaacgtaaggtctcgggtgggaatcgaacccactcgtccacccaatccgtgggaagctctaccattgagtaccgaggcacattcgctttttctttttatgggtcttatcaatccgcgcttaaacaggtgctgtgatttttggaaaaatccaatttgatccgtaaggaagaggccttacccgggaacaagttgtttttgaaaatggcccggaccggctgatttgaaaatctaggtctctagttttaaggcacaaaaaataggttcatcagtgcctaataattcaagaataaaattttaattacaataattttcgcactgcaatttagtttctcgagagttcgggaatgtatgtatttaaattttaaacgcaaatggacgggaaaatattgatgaaacaaaagttttcgaggtaatagatagaaaaactcacaggtaaggtacaggtattttaaaactgagtccaagcacaaaaccaaggtaaaatggttttttttcccgctaagctacacgtattaagtgcgcaaaaattttaggtatttatctaaacatccgaaccctagtcatatgaatcgccaaaaatcacgaaaagtcataaaagacgaaaaaatgcaaaaaattcatganaattagtcaaaagttaacatttt

SEQ ID NO: 37545 - DNA, 887 bp, Heterodera glycines
  misc_feature (863)..(863): n is a, c, g, or t
aattaacttttttgatgtaatttattcttaagttacttttttagtttgtttaaattatttttttaattttataacagatgtttctggaaataaattaataaacttttttttaaacttgcatttaatttatattaaggtttttcttttgaaataaatcaattttttattattaaattatttttagtttgttatatttatattatgtgttgaatattatatttctcaaaatagcttaaatcttgtcttgatcaaattgtgatccatacaagttgagtctatttttattttatgctaattttaacaatcaatttagattcaatgcaatgaaattaaaattgttcttctataattatttgtgtatttaatataattgtttttgtttaacttaatcattttttattttatttattcacaatctctaattattctttgattacatttattttcctgaaaattattgtaacatcttattaattgtaaaaatttttaattccttattaaattatattggtataaattctaaaagttagtaagctttaacattatttaatagcttttttattaccattgtaaataattctacactttttatcatttaagttgttggttttacattaaaagaatattttagtattttatttattttataattaatatatttttgctaatagaacattccattattaaatatttatcagttcatgtcgcataaaattgtttatggccgaacagatctagagatttatttatcaaaccttctgaatgctttaatgtccccttttatagatttaacacaaaatataaataggcaaaaatttattccctttgcagggcgggctacaaaattatggaataacttatanagaaattattaaaataaattcttt

SEQ ID NO: 37546 - DNA, 1153 bp, Heterodera glycines
  misc_feature (13)..(13): n is a, c, g, or t
  misc_feature (1037)..(1037): n is a, c, g, or t
  misc_feature (1094)..(1094): n is a, c, g, or t
  misc_feature (1106)..(1106): n is a, c, g, or t
tgcaggtcgaaanatcggagctgtcaaaccaaataaaattggcattgcctttatcgtcaagtgttgtggttactccttcaaattggcaaaaaaataaaggaaatcgaaaattttgtgggaaaaccgtaactcgagattaatcggaaccaaaaaaaaaccaaattttggatacaaattgggaagagattaaggaattatttttaaaaaagattgggatggggatcacggatttatttcaaaaaaattagaaatccttgaaacatgatcaaaaattcacagtttttctaataatggaatttgttagttaaccatttgctattgtagtacatcatttaagcattgtacacgtaaaaaaattgctttgttcttccattggttcgttagtctcaatggtttctcaattatttttgtttttctctctttatgatgttactttttttattttttcgactcatcgtgtgaatgactccgtggcgcagtggttagcgcgcccgtctgcctgtccttacggcaatgggtccatttgggttcattgtcatagggggtataagtgcgggagaggcgtgggttcgattccccgccggggtttcttttttcaattatattacaatgataattaattaattttttttaatggtcccaccttcgtttttccatttttctttccatcgaaaaattacaaatgtttcccataacaatttgcttgtccacccgagcactggcagcagcacaggaaattcgcaaggctttttaaaatttattttattaaattttattttaattaaaaaaacaatttttgtgacggtttgacaggtgctgatcatccacaaaaatttgtaaaataagcagaaaaagccaacaatggtgaacagagtctgcgacaagagaagaacaaataacaaagtcaaattttttggattaatttttaaattattttttaattcaaaattacgcacatataaaacagcgatgaaagcaacaaaaattgcgatttttgtccacaacccaaaaattgcaacggaatgaatggacacaanaagaattatggccaaattttgaagtcgcaatttttggtgttgtttaaagagaaacgnaaattgagatangcagaacagcaaaagaggagccaacagagaaactgaaattggaaaaa

SEQ ID NO: 37547 - DNA, 513 bp, Heterodera glycines
gcgagattctcgactcgggagatttctcgggcttttagtcttggataccgtgaaattttgaaatttgacttaaagaaagcttcgctgaaaatctattaaaagtcaaaatttccaactttttctacagtggtagggttaaactccgtctaggaacagaaaggaggaagagacgccggaagggaaggcaaacggtgggggaggaagaacagcagctggagaaatatggcatgacatgtcattatttattaacatggaatgattaaacaattgtttagttttggaggactctgaaaaaaacaacgggaaactttattccttttagttggagataaagcgagttatggctgatcaaaataaacaatgcaaaaaaggcactgaacatatcagtatacattttgaattagcgcgcaaaattacgccatttggtgttgtgagcaattttgtctgaaactggagcgaactcatagtgacgctggagcgtacgtgccaggaaatttcgacagtgaccgattt

SEQ ID NO: 37548 - DNA, 1014 bp, Heterodera glycines
  misc_feature (1010)..(1010): n is a, c, g, or t
attatctctaattatccactcgtctccattaatccccccgtctccaattaccccccccccctttctgaggaggttgaacaataatccccccggggggttaattagagatatatgcacacgcaaggggtgtctcaggacaagggccatacgacggacgattgagacaggggggggggggtgtcttcggtgattttttttgtttttcacggaattttttgcggcgcgctttttcattttgaaaatttagtgctatttgtgacagattttttcaaaaaaatggattttttccaattttgagaaaaattggatttattaattagaatattcattccggttccaagtccggtagggaaggtttgaggacagaaatttttcacaaaagaaaaagtaaaattttcttacatatttaaatttttacagtagcctaaaaaactaaaataacattttctgttatttttttaaataagtaaaaaaaaaaatctaaaaatggttattttagagtaaaatctcagccaagtcattagtgcccagaatctgaaaggaaggggacagagatttgaagattgaccggggcgggggtcccgggaccttttttccggcactccttgtccacaatttttaaccgaagctcaaaaattatgttaaaaatttatttttcaaaattttgatctttgataagtatttaaaataaagatttacgaaaaagccaaaattttatgaaatattgtataaattaaaaaaattcccaatgaaaaaaaacagtgaataacaaaaccaaaaatttattcactgctgctggttgcagttgccaataaggcacattttgaggatttttctactataaatctttattctcaaacccgagaaagtctttcgaattttttatcgtaccacaactcactaaaatgtttcaagttaattcattaaatttaaaaaattaattgaaaaaattcgcttcgttccgacatggaagtctagttttttgcttttttaaattattgataaaagantttt

SEQ ID NO: 37549 - DNA, 756 bp, Heterodera glycines
agatcacatgcgattttcggcactctgataattttagcgttcataatgggatgtataaaggcgattgtagaaggaattggaagcgctaaaattgtttgaggagctttttgagcgtaattacgattttacttacaccattttttgctaggcttagatcacatgcgattttcggcactctgataattttagcgctcataatgggatgtataaaggcgattgtagaaggaattggaagcgctaaaattgtttgagaagctttttgagcgtaattacgattttacttacaccattttttgctaggcttagatcacatgcgattttcggcactctgataattttagcgttcataatgggatgtataaaggcgattgtagaaggaattggaagcgctaaaattgtttgaggagctttttgagcgtaattacgattttacttacaccatttttttgctaggcttagatcacatgcgattttcggcactctgataattttagcgctcataatgggatgtataaaggcgattgtagaaggaattggatgcgctaaaattgtttgagaagctttttgagcgtaattacgattttacttacaccattttttgctaggcttagatcacatgcgattttcggcactctgataattttagcgttcataatgagatgtataaaggcgattgtagaaggaattggaagcgctaaaattgtttgaggagctttttgagcgtaattacgattttacttacaccattttttgcta

SEQ ID NO: 37550 - DNA, 1261 bp, Heterodera glycines
  misc_feature (25)..(25): n is a, c, g, or t
  misc_feature (102)..(102): n is a, c, g, or t
aaaatgatattatatatagattaantaataaactataaaataaaaaatctaaaaaagaaaaacgtttatcttattagtgcaattaaatgtaaataaatttangcagagaatatttatgttgaaatattacaaaatgtgattaaattttatattcaagtgaaaataaataaatgaataaattataaaatcgacgctaatgatgtgtgggaattgactaaaataagtacagcgcaagaagttgaaataaattttaaaaaatgattgcgtattatttcaaaattacttcccattaaagtgattatggtgttatcgtacctttgataagcccaccacagaaagtacaatacgtggaataatatcctttattccgaaggtacatgtttaacaatggtgagcttccccgattcggagcggggaagggagggggtcgggatccggatccaacggccaggtggagtgatgtgtggatggacaaaggaaaagcctacacaagcacattgggggaggagacaaagggaaggaccgccccaggcaaattgtcatatggctataagcaaagaagagggagagaagaaaaggagtagagacaatgaggaaaagagtaaatgattagatattagtcatcaagggcccccagattgaccgtccccggtcaatgaatagcgaagtacaatcaaatgaatattaatcgatttgtgggaagagagaaaatgagcagttttcgctcctcgtcgtcctcctcctcaggacctaacgaaacctcgtcttcatgttgggacacttttttccaatcttcttccgaatcaattaacacaatttccttcttttttgcttcttcttttccttttttgtctttcttttctttttcctcttcattaacctccttcaaatctctttcatttccaattccttttaattccttttcatccttcttttctccatcctccgtctcttgtacttcttttacatttgttggcactttattcccttccactttttcagtttttgtcaatctttttctcttccttgacacttccttctttttcaattcaaccaattccttttttaacttttctacctcattttgcagcattttttgcgagtcttccaagcgttttgctttcgcctcctccacttttttaaccttcagttcaacttcctccgtgtctgacaatgattcgtacattggttcagcgcatgtaaacccgtttgaattctgaattgtttttgaatttgcttgttcatttttattttcaaattc

SEQ ID NO: 37551 - DNA, 923 bp, Heterodera glycines
cattttccgaaatgatagcgccgaccctaattttttccgaatttttttctgggcgagtttgatgtcgaaaattttggaaaaacgcctatctctttttctgatcatcagtctgaagaattccaaccacattttcggaatgatagcgccgaccctaattttttccgaatttttttctgggcgagtttgatgtcgaaaattttggaaaaacgcctatctctttttctgatcatcagtctgaagaattccaaccacattttcggaatgatagcgccgaccttaattttttccgaatttctttctgggcgagtttgatgtcgaaaattttggaaaaacgcctatctctttttctgatcatcagtctgaagaattccaaccacattttccgaatgatagcgccgaccctaattttttccgaatttctttctgggcgagtttgatgtcgaaaattttggaaaaacgcctatctctttttctgatcatcagtctgaagaattccaaccacattttcggaatgatagcgccgaccctaattttttccgaatttctttctgggcgagtttgatgtcgaaaattttggaaaaacgcctatctctttttctgatcatcagtctgaagaattccaaccacattttccgaatgatagcgccgaccttaattttttccgaatttctttctgggcgagtttgatgtcgaaaattttggaaaaacgcctatctctttttctgatcatcagtctgaagaattccaaccacattttcggaatgatagcgccgaccctaattttttccgaatttctttctgggtgagtttgatgtcgaaaattttggaaaaacgcctatctctttttctgatcatcagtctgaagaattccaaccacattttcggaatgatagcgccgaccctaattttttccgaatttcttt

SEQ ID NO: 37552 - DNA, 1332 bp, Heterodera glycines
agtgactccgtagcccatcgctcaattaatttattaatgtcagtagtaacccaccccacaactgtaaatacagagacgtaaaggataaaattaataaattactcatttcattgcgtgttagagtggtaaaataaagcgatcggattatgtttaaaattattagtataaaaatgcggttaagtgtcctaaacattcattaattctgctatggttctcgtcagcgtctcttgcgctcaggtgctgagctgtcctgttaaatcgctacgcgatcggcttaatcaccctgaggatcggaacattgttttgaagcacatcactggacgcaaagtgcgcacaacatacaatgataggaatgggatgaaaaaaactttcttcgtcggtggaatttcaacccagtcggcagcctctcttcctgcatacgggcatttgcgccaaccatttaacgtcaatgtggctgcgcatttttacgcgcggcaccgtataaagctacactttccctatacaccatgcataattgaacgattttcgggaggaggggaggatcggcattacccaatggaactgctcgaacttgtcgatgataacaacgacggaaaagacaatgaacgatggttgggacgtctgttcagagaaattggcgagagcgatcagcaatctgcaaattcatcatcatcaagtcaaaacctgtgcctatcaaatgatgaagagattggggaaaataatggacgtaatgaatgtagtcagaatgcgcgacccatattttggtgaaagttaatttttcaactccctaactaattatgcacatttctaccataaagcgaccactttaattatttaatttaaaattgaattttaaattcattaatatttcataaagtgtgtcttctattgcctaattatgttcttttctacctaaaaatgacctctccaaatgcttaattatttgaaaattccatcttccaatcattaattattcatcaattctttattaatacaacaaataaaagcacataaacagataaattatacatattcagtataaaaagagaaataattgtacatatgtgtgggtgcgtatgagtgtgggtgtgtatgtgtatgggtgagagagagagacagagatgaatgaaggtgaacaaaatacattacaaagagtgaccaaaattcatcacacaaaaattatcccctataattcccttccccacgtacgggcgataacgtttttgcgttggcgtggacacgacacgccctccctccgtgatgtttgggcggaggaaattggggtatgtgacgtggtgggggtcagtgtcacccggagtcgcgtatcgcacc

SEQ ID NO: 37553 - DNA, 1152 bp, Heterodera glycines
  misc_feature (25)..(25): n is a, c, g, or t
ggggggggggctttttttgtatctntagagaatgaccattttttgaagtcgcaaggtttttgaataaatttaacatattttggtcaatttaggattttaaattttgactttttgttcgaattcgggttcgcggttcggaattcaccaaaaaattttcaaaaaaaaagtcgacattttttgaaaatctcctaaaaatagctcaaaatcgcaaagttcgtcacttttcgttaacaaattgtattaagaaatgcaaaaattttccggcggcgcctatcggcaccgctggaccccctgttccccaaaagtcttttgaacgcaaaaaaaagtggcgtgaaaagcaaaaaaaaaaggtcgtcgcctgggcggaggtacctccccacaccaagccgaaattctgggaccgtccctgctattctacatacttataattgtttacaaaaaagaatctttttaacttttggttaattttcacaacttttttttgcactttttcgtgacttttttgccggtttttgactttttttcagtcgactttaaatttgatttcttcttaggaaaaaattttttttgaggagggggggggcttctaactcaggggtggcttctaggcacggcaactaatatcactgcgactaatgaaagcggcaacgaaatgacacagcaattaatagggctgctaattttatgtaaatacatattttttcctggtttctccatgctctaaatataggaaaaacactttttttttgtgtttgcgaacaaacgttgggacttttatttacatatttttacatattttgggatttttcattaaatatgtacatatttttatacatattttggctttttcgtacacatttcgcaatttttcgtacatatttttcatttttttttacatattttgaggatttttgagaatttatagaaattttttgtaaaaaatttaaaaatttttttttgaaaatgtatccctaaaaaatcgattttttttcaaaaaatgatatatcaaaaattaatttgtaaaatattcaaatgtgattctaagcctattttggtcgtttttatggcattttgtgcctatttcactttttacgaagaatttttttccaaaaataaccattaaaaaaatttatttacatattttcctacata

SEQ ID NO: 37554 - DNA, 965 bp, Heterodera glycines
tcaaacaccctattagtgcttgctgtgccgagagccggcaggcaatggatggctttcaatctgcaaaaaattagattggcaatatgtggttgtaaaaaactttttgggtatggaatttttttttgaagtgagtcaacccccttattagtgttttgctgtgccgagaaccggcagccaatggatggctttcaatctgcaagaaattagattggcaatatgtggttgtaaaaaacttttgggtatggaattattttttgaagtgagtcaaacaccctattagtgctttgctgtgccgagacccggcaggcaatggatagctttaaatctgcaagaaattagattggcaataagtggttgtaaaaaacttgtgtaaggaattattttttgaagtgaatcaaacaccctattagtgctttgctgtgccgagaaccggcaggcaatggatggctttcaatctgcaagaaattagattggcaatatgtggttgtaaaaaacttttgggtatggaattattttttgaagtgagtcaaacaccgtattagtgcattagtgctttgctgtgccgagaaccggcaggcaatggatagctttaaatctacaagaaattagattggcaataagtggttgtaaaaaacttttgggtaatgaattattttttgaagaaagtcaaacaccctattagtgctttgctgtgccgagaccggcaggcaatggatggctttcaatctgcaagaaattagattggcaatatgtggttgtaaaaaacttttgggtatggaattattttttgaagtgagtcaaacaccctattagtgctttgctgtggcgagaaccggcaggcaatggatggctttaaatctgcaagaaattaaattggcaataagtggttgtaaaaaacttgtgtaaggaattattttttgaagtgaatcaaacaccctattagtgctttgctgtgccgagaaccg

SEQ ID NO: 37555 - DNA, 796 bp, Heterodera glycines
  misc_feature (14)..(15): n is a, c, g, or t
tctagagtcacatnnttcttgtaaaaagcaaaatgggagaaattaaaattatgaaaaataatttaaataaaatgcgcagagatttgtacagaaattttgaagaaacgaaaataaaaattttggaaattttaaaaaaagacggagaaaaaatgggaaaattaaaagaagaaaatgaccaaaaattcgaagtgcaaaaagcgacgcatcgaaaaacatttgaaaatgtaacgaaaaatatcgaagacgaagccgaaattgggcagatgaaaagggaatgttcgctgtttttccaaaggttcgaagaatgccatcggttcacagaagagaaaatttacgaattggcgacgaaaaacggcgaaattcggaaaaatttgatgcaaataaatgtcggaggaaaagcgcttcaaacggtgggccttcaaattcgccttacgcttttcgacggcatcgaaagagcgatggaaagtgagcaaagcatttggggaaatgaaaaatgagaattttaggtgaaaattcagagttttcccgttttgaaattgtgtccgagtttttgagtttgggctaaagaactatgattaatctatgagtaatcgctaaatttttatcaaagcaggaaatctgatacttccactaattcaaaattaaaattttctttaaaaatcgtaaatatattttttaattattttaaaattttaaatctttttgtctatttttttttggattgtttgtggatcctttgtccgtgggtcctttgtcactttacctaagctcttagggggggggggggaggatgagt

SEQ ID NO: 37556 - DNA, 1399 bp, Heterodera glycines
attcctggaaaatcgaattttgcggtgggtgagggtgagtgagtatatgggaaatgaaagttgtgctgttcgagaccgaaatttcccgagactcgatacgagatcgagaccccaaagtaccgagacttttctcgagttcaggctcgagaccgacagtctccaacgcacttattaggggaaaggggtaaaattcagaaaaacggaataaataaaactgtatacataaaggtagccagagatattcacgagcccaacactaatgactgataattgctctcccccggttccctaatgggttttggatattacccaccgctcgttcatattgttggacaatctgaaaatttatttgaaagcatttaaattaggggattttttatttatattttctttgaattatttactttaatacacatgaacacggagatcggaaaagtgatgattgtgatgatgtaggacagaacgatcagaatctttgcgcaaattctgaaaacatttaaaaaattatttaaaattaaattaaaaaattatttatgttaattactcacccgtacggctccgtgtcgtccgcgttcggcgatgcccacgcggcaattttgccgcttccgctttgtgccggcggatggatggcctgaggatttaattagggttaagctccgacccttggggagggaaaagtcgggaatcgtggagggaaattcctcgacaaaatttgtcgagattggttggagaaattttaaaaatttcgggaacaccctcgtcgggtaggaatttctcaaaaaagcctaatcctaagcctaacagtcgaaaaaaggaaactttttataaggcaaaaagtctcagaaactcatttaaacacaatttcccctaatatggagtgaaatagacgaaattagtaatttcccgcatcgggtcgaggcttaatcctaaatttaataagccgaattattagtccgatgatttgttttaaagacatcgatagatatgatcagttcaatatggatatccataatcgtcttcctcttaattaccccaccacctccaattagtagcaattaattacccattcattgccccgcttaattgcccccacctgttgcgactgctcgatggccacggcggtgttctgtggcggatgaccaccatcttccggattcagttcagcagttgatgaagacattttgggtttattaaattattaaatggaacggaaattctctccctataaaaatcaatttttatttgtttaataatgaatgctaattatcaaatttaaaattatacaaaaaaagtatttcaaattaaaattttctgaacatgtcaatttttaagttatattgttaattcattttctacctaataaatggtcgtcatgacaataaaaaaaaggcgagcctaa

SEQ ID NO: 37557 - DNA, 1174 bp, Heterodera glycines
  misc_feature (1078)..(1078): n is a, c, g, or t
  misc_feature (1105)..(1105): n is a, c, g, or t
  misc_feature (1108)..(1108): n is a, c, g, or t
  misc_feature (1131)..(1131): n is a, c, g, or t
  misc_feature (1137)..(1137): n is a, c, g, or t
aaaaaatagaattttttttttttcgggggcagtcccccccgaaccaatgcgcccaaatttatggggaggccgaatctttcgggaataacttcctataagcccgtcctttatttcagcgttggtttttgcttccccataaatgttggagtacaccaaacggacactgaaaaaaataaattttttgttttcggggcagtccccctgaaccgatgcgcccagatttatggcggagaccgaatccttcgggaatagcttccctatagtctgtactttaattctgcgttggatttttgctccccataaatgtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctccccataaatgtttgagtaccccaaacggacacttgaaaaaatcgatttatttttgttttcggggcagtccccccgaaccgatgcgcccagatttatggggagaccgaatctttcgggaatagcttccctatagcctgtactttaattctgcgttggatttttgctccccataaatgtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctccccataaatgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggagcagtccccccgaaccgatgcgcccagatttatggggagaccgaatcccttcggaatagcttncctatagcctgtactttaattctgcgntgnatttttgctccccataattgttngagtanccccaaacgacacttgaaaaaatcgatttttttgttt

SEQ ID NO: 37558 - DNA, 954 bp, Heterodera glycines
aacaaccggaaatatttcacgtttcatgttgccaactactgaaaaaaacaaccagagaagattaaagtttcatgttgccaagaaccggaagatttcacgtttcatgttgccaacaaccggcagatttcccatttcatgttgcaacaaccggaatatttcacgtttcatgttgcaacaactgggagattttcatttgatgttgccatgattttccgtttaatgttgccaactaccgaaaaaacaacctgaagatttcacgtttcatgttgccaacaaccgggagatttcccatttcatgttgcaacaaccggaatatttcacgtttcatgttgccacaaccggaagactttcatttgatgttgccatgattttccgtttaatgttgccaacaaccgggagatttcccatttcatgttgcaacaaccggaatatttcacgtttcatgttgccacaaccggaagactttcatttgatgttgccatgattttccgtttaatgttgccaacaaccgggagatttcccatttcatgttgcaacaaccggaatatttcacgtttcatgttgccacaaccggaagactttcatttgatgttgccatgattttccgtttaatgttgccaacaaccggaaaaataaccggaatatttcacgtttcatgttgccaactactgaaaaaacaaccagagaagattaaagtttcatgttgccaagaaccggaagatttcacgtttcatgttgccaacaaccggcagatttcccatttcatgttgcaacaaccggaatatttcatgttgccacaaccgggagattttcatttgatgttgccatgattttccgtttaatgttgccaactaccgaaaaaacaacctgaagatttcacgtttcatgttgccaacaaccgggagatttcccatttcatgttgcaacaaccggaatatttcacgtttcatgttg

SEQ ID NO: 37559 - DNA, 1271 bp, Heterodera glycines
  misc_feature (49)..(49): n is a, c, g, or t
  misc_feature (81)..(81): n is a, c, g, or t
gtacacgcatcgattatgaagccgcgcatgcactagcaacgaagtcctntgcgcgaagcgctcatgtaatgcatattcttntcatctctcacaagtaaactgtctacaccgtgcaatcactgtgcaaagcatacggtctacaccgagcaactactgtgcaaagcatactgtctacaccgagcaattactgcgcgacacgctagtttatatactactaaagaaacaaggcaactcatttccaaaaacaaaatctccttacggtttgccgggaggggttcgaaatttcgaccttgggggcaacttttgacggcgcattcaggaaaactatagattttccgatccgagggccaactgagcgccaggcgccgaaaagtcatttttttaaaaatttttttgccgtttttggaattcaaaaattttttaaaggcctaattgaaaaatcggcctcgtaaaggcactcggttggactttttgggatattttttgtttcttgaccgaacccctagggcttaccagtttttctggaaaactgcgcaaaaatgggtcacttttttgggccatttcagcgccggccgaataactcgccagatattgatgataggaggtcggtgtaagcggcttttttgtacagcttgacgagctctatccaaccatgtttttggatttctgaaattttcagaaattttcgagctaggccccctcgaaaattttccgtttttgaattttatgattttttacagatttttctggggaaaacggagaccactttcaagcaaccgtttttcatgctctatcgattggtgtcattttcagaaaaatttttcaaaaattttttggaaatagaaaatttttggttgctaggcctcaatttcagttctggcgcaataactcgtcaggagttgattttatcaaaaaatcgtctaagagcttttttgtagagaattttaagcccaatctaatgtgctttatctcatgtttttaccatgagtttaaaaaaagttataaaattaattgtgattttgaaactcaaaaccataggggggaccccatggttttgcatttcatgaaaaatttttttgctcctaaattagccaaaatgcatttttatggcataatttgaggtgctgaatacgtatatacgctttattttgtgtttcagactttttggaaggtggttaaaattttttgaaaaatcgtcaaaatttgagccccggaaaatcctgtgaaatatggaaaattcataaatctcttcgtttttgatcaaatttagt

SEQ ID NO: 37560 - DNA, 994 bp, Heterodera glycines
tttcgaggcagtccccatgaatcgatgcgcacagatttatggggagaccgaatccttgcgggaatagcttccctatagtctgtagtttaattgtgcgttggatttttgcttttaatattatctagtcagttcatttaaataatttttatccaaaaaatttttttttgggttttcggggcagtccccctgaaccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctccccataattgtttgagtaccccaaacggacactcacttgaaaaaatcgatttttttgttttcggggcagtccccccgaaccgatgcgcccagatttatggggagaccgaatccttcgggaatagcttccctatagtctgtactttaattctgcgttggatttttgctccccataaatgtttgagtaccccaaacggacacttgaaaaaatcgatttttttgttttcggggcagtccccccgaaccgatgcgcccagatttatggggagaccgaagccttccggaatagcttccctatagcctgtactttaattctgcgttggatttttgctccctccccataattgtttgagtaccccaaacggacacttgaataaatcgattttt

SEQ ID NO: 37561 - DNA, 1113 bp, Heterodera glycines
cgaaattgccaaaacggattggagccttttaaaatcgtgaataaaaaacattaaattttcggcatactaaaaaatggggctccctaatttaagctgtttccggaggtttacaagggtgctaattacgtatctgaacttggatttgcccaattccgaactccggacccgattttgaataaaaaaaaatcagttttttttaaatacgcgttaaaatcggtcaaatttggcgcaaattgcgttttttttagcttaaattttaaaaaaaaattaaattaaattagggaccccccccattctttaggatttccaaattttccttaccccaaaaggggggcaattgcatttgtgaacgtgtacatgagcatagtgctggaatatcctccaacattaatgatcataatgatgatcaatgaccgtaacaatcgtgtgttcgtctgttggcttactgtaataaatatatttgagttggcaaaagtgcaaaattggcacatttttaccgccatttttgcaccggataatcacaaagattgccatataacaacaggcgctgcacagagaaagaatgtaaatgccatcagtaaaaaaatcgttcacatagtcttgaaaactttcggacactaagccagtggttggcctaaattaaaattaaattagaaaaagtatttaaatttagcgccatactttcccgcattttggaaagcaaatttaagcaaattgtacacaataaaagctccgtaatttatacaaatgaaaagatggctgaacaaatattggtacttgtattttgtgaaaatgaccgaatgcctaaaaaataaaataatttataaataaataaaatatatttataaaataatccaaacaatcaaaaaccattaattatattttatttttctcacttaaaaggcaatgcaacagcaaaaagtcggtcaaaagcagcacaaaacattgccattaagccgcaattgaaagcgaaaatcattggctaaaaattggaacatttaaaattaaatttgaaaaattcaaaatataccgtcataattaagtcagcagtgagcaaactgacaaaatttgtgcccgaaatgacaacaaccaggaaaaaagtgtgcccaattt

SEQ ID NO: 37562 - DNA, 341 bp, Heterodera glycines
tgcggacatctacatttttgaattgaaaaaaaattcgctatttacgactttctttttctccatactgaccatcatactcacactccccccaccctttctcctccttcatttttttttcctttccttctccaaccctctcctccctctcttgatagtttaaactgaaggcgggaaacggcaatctgatccccatcaagctagcttctgcaggtcctgttcgagcggacgaccggggatcgatccccgatttagtaatatagatgactccggaattgcaagcatgaaatcttgtaattgcactactatctgctatgaagtcgcataaataaacctgcccctac

SEQ ID NO: 37563 - DNA, 1380 bp, Heterodera glycines
  misc_feature (1280)..(1280): n is a, c, g, or t
  misc_feature (1362)..(1362): n is a, c, g, or t
gggaaaaaaaagcaaagtcaaagacaaaaccttaaagcactagccgattgaaataaatgggaaaaaaaagcaaagtcaaagacaaaaccttaaagcactagccgattgaaataaatcggaaaaaaaagcaaagtcaaagacaaaaccttaaagcactagccgatcgaaataaacggaaaaaaaagcaaagtcaaagacaaaataggaactttatacaaatttaaaaaagtaatattttgtatatcgtatacgcatttaatcaaatttctactttctttataaacgttagctaattagtcagcgtctatttattttctgtaaaaatttgcctctttatttaaaattaaattaatataatttcatgaaataagacactaaatgtatagagaatgaattaacgtggtcgatcggaataaatggaaaaaaaagcaaagtcaaagacaaaaccttaaagcactagccgattgaaataaatggaaaaaaaagcaaagtcaaaacacaaaaccttaaagcactagccgattgaaataaatggaaaaaaaagcaaagtcaaaacacaaaaccctaaagcactagccgattgaaataaatggaaaaaaaagcaaagtcaagaacttattctacctaatttcatggtgactgacgaggcatttgactcccttaagagagccttcccttctcatgtacttgtacctaaaatgttgttggcacaaaaagtaaagggggaaaaagaagacaaatcatccgatcaagggctaagtctcaacagatcgcagtgtaaaagctgctctactgctaacaaccccctgaccagtagtcaagtcgtatacaagtgattttgcgccccgacgttccaccatggcacacgagtgctacggctttggcaatgtgcgagcaattaagcacgcacatcgggccagatgctggggcatttgtgctgcaccgcaagcggcgcataagtagtgcctcccgacaccggggagcaagaatattgctatcttgcctaggcgggattctgacttagaggcgttcagtcataatccctcagatggtagcttcgcaccattggtctatcgaccaagcacatgaaccaaatgtctgaacctgcggttcctctcgtactaagcaggattactatcatagcaacaggtctttagtagggtaaaactaacctgtctcacgacggtctaaacccagctcacgttccctattggtgggtgaacaatccaacgcttggcgaattctgcttcgcaatgataggaagagccgacatcgaaggnatcaaaagcgacgtcgctatggacgcttggccgccacaagccagttatccctgtggtaacttttctgacacctcttgctggnaactttacactttcaaaa

SEQ ID NO: 37564 - DNA, 473 bp, Heterodera glycines
cggcacccaaacgatgaagcaccagcagcaacggcaccaactcaccaacaaaatgccaacatcgatgccagcaacaacaacaacaacgcgaggtgtgtgagattttggtaaaatgcaaccggacaaaaacgtcgcttggacaaatgtcgatgggaatgggatataacgtcccagcaaagacaaggaatttttttgtttccagaaatttagcaaattaggttccaacgacaatttattttattttattaaaacaaaaagaaataaaagtagagtaaaattcttttgttagggaaagcctcaacaaagaatttttaatttatagaaacaatgttggtgcataaaacaaaaattttttgataaaaagtcacagtttgagaaaaattttctgttttttttgggtcttgctcttgcgtttcgggaaattctcggtctcaaaccagggacgcgcggggtacgtacccccccccccccca

SEQ ID NO: 37565 - DNA, 1147 bp, Heterodera glycines
  misc_feature (97)..(97): n is a, c, g, or t
  misc_feature (123)..(123): n is a, c, g, or t
  misc_feature (132)..(132): n is a, c, g, or t
  misc_feature (1091)..(1091): n is a, c, g, or t
  misc_feature (1106)..(1106): n is a, c, g, or t
  misc_feature (1134)..(1134): n is a, c, g, or t
tttgagaaatttatacgtacaaaagcgctcgagcgtgagagggaggcggtgcgcaatcgccattttattctcagagatttttaaatttatctatatnccaagaaaaatgactatctcttattntgagaaatnttatacgttacaaaagcgctcgagcgtgagagggagggcggtgcgcaatcgccatttatttctcagagaatttttaaatttatcttatatccaagaaaaatgactatctcttcttttgagaaattttatacgttacaaaagcgctcgagcatgagagggagggcggtgcgcaatcgccatttaatttctcagagaatttttaaatttatcttatatccaagaaaaatgactatctcttattttgagaaattttatacgttacaaaagctctcgagcgtgagaggaagggcggtgcgcaatcgccatttaatttctcagagaatttttaaatttatcttatatccaagaaaaatgactatctcttattttgagaaattttatacgttacaaaagcgctcgagcatgagaggaagtgcggtgcgcaatcgccatttaatttctcagagaatttttaaatttatcttatatccaagaaaaatgactatctcttattttgagaaattttatacgttacaaaagcgctcgagcgtgagagggagggcggtgcgcaatcgccatttaatttctcagagaatttttaaatttatcttatatccaagaaaaatgaatatctcttcttttgagaaattttatacgttacaaaagcgctcgagcgtgagagggagggcggtgcgcaatcgccatttaatttctcagagaatttttaaatttatctatatccaagaaaaatgactatctcttcttttgagaaattttatacgttacaaaagcgctcgagcgtgagagggagggcggtgcgcaatcgccatttaatttctcagagaatttttaaatttatcttatatccaagaaaaatgactatctcttattttgagaaattttatacgttacaaatgctctcgagcatgatagggagggggcggtgcgcaatcgccatttaatttctcagagaatttttnatttatctatatccnagaaaatgactatctctttctttgaganattttatacgtta

SEQ ID NO: 37566 - DNA, 1225 bp, Heterodera glycines
  misc_feature (88)..(88): n is a, c, g, or t
  misc_feature (1158)..(1158): n is a, c, g, or t
  misc_feature (1191)..(1191): n is a, c, g, or t
cgagtgagtacatcggtgcaggaaattattaattgtaaaatttttaattgctttttcaatatgccaaaaaatgtaggcttactgtttntagtgaaaattcgatcactcatatttcttgctaattgagcagaagcgtaccaaactttgcagggatactctccggtaaaggactaacttacactgatatgagcgccgagctagctggctcaaaaaaatttttcgaaaatctgagtctttcgtttttatttatttgcaaaattaattcataaatattttttcagaaagggttctgaaacgcaccaaattttattcacatgttagtttaggcactctgatgctttttctatcaataatggaggtgaaaaaagactttacaaaataataccctttgggagaaagtttaggcgtaacatgatgtgaaaattttcaattttttctagtctaatctactcaaaacggttcagaattcaataaaaataacattcacggtgcgaaaaatggggtttgacaagtttattggggaaaaaaagactttacaaaataatacccctgggagaagggagtgggaaacatgatttcaaaattttcaattttttctagtctaatctactcaaaccggttcagaattcaataaaaataacattcacggtgcgaaaaaaggggtttgaaaagtttattttgaaaaaaagactttacaaaataatacccctgggagaagggagtgggaaacatgatttcaaaattttcaattttttctagtctaatctactcaaaacggttcagaattcaataaaaataacattcacggtgcgaaaaatggggtttgacaagtttattggggaaaaaaagactttacaaaataatacccctgggagaagggagtgggaaacatgatttcaaaattttcaattttttctagtctaatctactcaaaccggttcagaattcaataaaaataacattcacggtgcgaaaaaaggggtttgaaaagtttattttgaaaaaaagactttacaaaataatacccctgggagaagggagtgggaaacatgatttcaaaattttcaattttttatagtctaatctactcaaaacggttcagaattcaataaaaataacattcacggtgcgaaaaatggggtttgacaagtttattgnggaaaaaaagactttacaaaataatacccctgngagaagggagtgggaaacatgatttcaaaatttt

SEQ ID NO: 37567 - DNA, 1429 bp, Heterodera glycines
tttgtctactttttttttattcatgaatttagtgattcaattattttagcatttggtccaccaccagtggcacgattagcaccagccgaggttgattggatgagcatttcatcctatattttatatcataatttttttttttttgcattttaccgcatgaatttcgttgtaaatgtgttggacttccccctgataaggttgcattggttgcagttggtacaaaatttgttgttgttgttgcggcgctggaggttgcggcagacgatttgtttgttcttcttgcggttgttgttgttgaaattgcggagtttgatgcggcaggatttgttgtgaagttgcctgttcgtgctgctgctgttgaatgagtgattgttgttgttgctgttgttgttgcggcgatcctacgctttgattttgcaaaattgtttgttgcggttgctgcggttccggcgcagcgttttggaattgttgcagttgttgttgttgttgctggtggtggtcaaggtgttggtagtcatgatcttggggttgctgcacaaattggtgacgctgatatgcaatgttttgttgcggttgctgagttggagtgaacggcagaaattgtggttgttgctggcgtcgctgaacattttgttgttgttgttgttgttgatggcggtgttcagtgtgaaaaggaaaggcagggaccaaaacaaattgctggtgttgcaccaacggggcacctgcttgattcatgtcagctgctgcaaaaactaaaaaattcgcatacaattaaataattttaaaaaatccgtaaaaaagtttttttaccattttgccccatttcgctaaaacccgctccggttcgttggtgtacacgaaaaaatgggcgttgtaatgcgcgcacgtgaccagaaaaaaaaagaaaataaatcgtattacattttacaataaaagtttaataaaaattgtttttttacctcctctaaattgcctatttccgctacgaaaacgcggttgccattcatgctggtgatggccaaggctgttatcgtggtgcgtaccatgatagcgctggccctgtgttttttttttaaaaatagatgaatatttgatagcatttttgagaggcacatttcccatattttaaaagctcatgtcagaaaatcgatcaaaaaataaggcaaaataataataataaattttaatcatttaccaaaaatcgaaaaggaaaagaaacagtttactattctttttaagcccaattcactttttaaaattctgttgtatctgaaaaatttaacactatttaaaaaccatttagcaaacagtctcaaattagttccattttttgtaggttaatttacaatataattttagaaagttactcgaaaaaatataaaacacaaaaatggcattttgagccttttttgagagcgtagtaattcaa

SEQ ID NO: 37568 - DNA, 1085 bp, Heterodera glycines
  misc_feature (51)..(51): n is a, c, g, or t
  misc_feature (183)..(183): n is a, c, g, or t
ttaaagtttttggcaagttaattattgtgaaatgaaaaagtaatgaaaacncatttaaaaaaagagtgataagaagccaaaattaaattatttttgataaatgaattgattaaagacgatatttaaccattagagagaattaattgaaataaaacaattaaaataaattgaaaattaaatttntaaaaaattattcaaaaaaattatttgtactattaccattttttgaataagaagtgtgtagcgctcagaaagtgcacgatgttgggttgaccaaaagctaagattaaaaaaaatatttatttaaatttaattttttttttaatttttagccaccgttcaaattgctgaaaaatacgcgctttgcattccacattgaagcggattgattcagagagtgtgtccaatatgacatcaatcgcaattgtcatgaacactcgagtgtctaaaccggagaattaattatgtaaatcgtatttgaaaatttggactataatttatatgtttttattagttatttatcaataaaaataaattaaaaataattactttaaatttatgagtgtttattttttaaaagaaaatattttattttatttaaaaaaaatttttttttcccttattaatactttctaaaaattttttcattattatttgaatttttttcatttcatattttacaaattttaatcttttaaatgcataaattaaataaaattaatataatatagatttgatatttaattaatttgatatttaatattttattatttctgaatgcctcttggtgtttctgtgttcagcacttcaaaattgtgatcgcttggattccaacgtgcttccgcaataaatacgaagggattttgttggccttcgccagcactttttaattctaataaatgcctaaaaaattgaatttttttaaaattaaataattcaaaaattaaattttttttataaaaaaattccatgaaaaaaaaattgaaaaaaaaaattcagcgatttttttgaaaattttttttataatgttttgaaaaaatcgctagaaaaaattttcaaaatttttataaatttgcaaagttttt

SEQ ID NO: 37569 - DNA, 731 bp, Heterodera glycines
  misc_feature (701)..(701): n is a, c, g, or t
tcgtttttcttcgctttctgtttctcactgcttgtcaacaatatgtccatcttttcatcagttagtttgagtaaaacaccccaaagtcacgagaatcctccaaatttttgcgcaaaatgtcgataaatctctgatcatattcaacaagtgcttcgttgccttgggttctttaaaaacataaaaaaattaaatttaaggttgtgataaaaattgtttgcttgccattacaaaacatggaatttatttgcgaaccagtcaaacagatcaggatttactttttaatgatttatggattttaattttgcgagaaatttcataaatcctagataaggacaggacctacaacaccaaatatgcaaaaaaaaaaagagagaaaaaccgagtgaacatttgtcaatgtttttaagttgtccttgtttgaaggggtcgagtcttcgaaccaacccaaaaaattaatcaatttaatagaattatcagactcatcctacacagagaaatcaggctatcagaatttgaaggctttgatgcgattgaaaactcaaacgatgatgaaattaggcatcatctaagaaggtctttgcaataccgacttaggtgcaatgatttcggaaccggaatgatgatccagataactataagttttttcgctcacatggccgcccttgtgaaaggaattttctttttttataatgataaaatanatttctgcttatttttttagattctatttg

SEQ ID NO: 37570 - DNA, 1632 bp, Heterodera glycines
  misc_feature (1585)..(1585): n is a, c, g, or t
agcttgctgcctgcggtcctggaaacactgaatttaggcaatactatagaaaggaagctatgcaaaattccacttcttttaattttcagatatttctgacggaatgccttcagcctattcgcctcggtacgtggaggccgcgtggtacgaatggtgggagcgccgcggtttctttcggcccgaatacggcggacggaatctcgagtttgcttttttgtttttttaacgggttcaaactttttcgcttggccaaaagtgacctaagtgctgcattattgtgcgatgtttgaataatgcgaacaatgtttttcagtgctccgaacccaaatggccaatttaccattgtcattccgccaccgaatgtgaccggcactttgcacttgggccacgcactgtccaccgctgttgaggacaccatcgcaagatggtcagcaaaaaaatacgcacaattactagtataggtaaaaacggtagacggctcttctctcccttcgaattttgaccctattactccaattaattaggagtaggaaatttaattgaaataaaaatttttcctccgtttttggcatcgaatgtgcggtcggactgtgctgtttgtgcccggctgtgaccatgcgggaattgccacccaagtggtggtggagaagaagctgaagcgcgagcggggactcagtcggcacgacctcggccgggccgactttgtgaaggaagtgtggaagtggaagaacgagtgagtgctgcgggcatcggattcatttttcaatgggaaacttgcgctgttttttcattttgatcgttttttttattcgttcagaaaagggcacataatttatgaccaactgaaaaaaatgggcgccggcgtcgattgggaccgagtggtgttcatgatggacccggtaaacccaataaattcgaatgaaaattttaagaaattttttggcatcgaataaaccccatttgatcgtcttttcctagaaaatcatgcgcgctgttactgaagcatttgtgcgaatgcacgagaagggtgtcatttaccgaagcaaacggctcgtcaattggtcatgcgcattaagttcagccatttcggaaattgaggtacaataaactgacttttctaatagcacagtgacgaagatataaaaagtgatcaaaaaattcaaatttgaacttttttttaaaaaacgaatcatttgtgagaaagttttgattttcaaagcatcgcattttgattccattctcctaaaagaacgttttgttttatttcaggtggaaaagcgtgagattaccggtcgcactttgctctccgtgccgggccatgccgaaaaggtcgaggtcggcgtgttggtgttgttcgcctacccactggaggaggaagtggtggaggaggacggcagcaaaacccgtgaaattgttgtggctaccacgcggctggagacaatgctcggcgacgtggccattgcagtccatccggaggacgcgcggtacaaacgaatcattggcaaagtgtgttttgtgggagattaatcgaaaaacaattggcattaatcggtgaaatgtactttcaaattggtttttaaaacanggggtaagaaataggctgttcaagattatataactttccaatttttg

SEQ ID NO: 37571 - DNA, 1022 bp, Heterodera glycines
tgattggagtgtcagtgccaaagtgaaaaaaaggggggcaaagagagggaaaagagtgggcggaagagcaatggcacggactgttcatcagcagaagagaggcaaaaggaagggaggaaaaaatgccaaagggaagaggaaacgattgtggcaaaggcaaaatgaattaaatggataataaataaatagtttcattaaagcaaataaaagacccaaacttttttggtttatacaacaaaagggaatgaatgccctaccgtatgccttgggattgttttgttaatttactgtctgttgtatatttatgctggtcttgtttttttgagtctgccactgctgatcaaccagcagtgtttgtcgtatttgttgtgattaccgtatgctgacagtgctgagtcatttcgccaattgtcgcggaaagagtggccatttccaaggccaactcccactaacaaaagcggagagcactctgtccattggcaaatgcaaaattggcaaatgaatgggactgtgtgccattctcgatggaaaaacattgccttttgccgccggcaattcattcgtattaatcaaaatatttcccgacggattttctccgtttgacgtccctcccgagcgaagaagggaaataagccgaattgggcactaaatttggacattggtcaccggcggattggattgtcgacgtcaacaattgcacaatcgaaggccaagtcggcggacaacaccaaagggacgtcggcatgcgcttttccgagagggaaattggggggagaggaaatgggggaaaagagagggggcgggggatgcgcaaaacgatgggcaattagaaagagtgccaatgccaaagtcgacggtgccaaccaaaaccatgaaaatagcgcaaaatggtggacggaccgaaggcgcaatgggagggaaagtccgcgaaaggtggaaccaaagcaattccataataaaaagtttgaccgggaaagtcaatcatatgaaagagacaattaaatgaataccaatgaatgtca

SEQ ID NO: 37572 - DNA, 53 bp, Heterodera glycines
tactgcgcccccagcctcgacaccgccatcaaggagacggtctaccaccagga

SEQ ID NO: 37573 - DNA, 1324 bp, Heterodera glycines
tcaaggtatattcattcgtgtcccttttttcggctggggtgacatttgtgtcacgggatttaccatccatgtcatttaagggctcagcgcagctgatgctaaaatcgcggaaagtaacttctccagcgcaatgaaaggtttcactacttttgaaatagagatttcaattaccaaaatttgcaggacagggtttgttcgcctgctggcactaccattgctggactgcgtgagcttgaacgctctggggtcagatcggcattcattgaagcattaagcgcttccactcgtcgtgccactgaaatggctccgaagacaaactaacaatttttctggttttgataattttttcgtcaataaataattgtttttgtaactatgcatatgtttttttaatccgtaacttctacttttacaaatatttctttattttctgatttatttttttttttaattttgtgggttccgatgagttgcaattccccccattcaaatagccagaaggagcaccaaaaattgctagaaaaagaaccaataaaagagaaaaggagacggagaccgctgactaaaggccttagatcggaactgaggaccttggtctgtcgagggcgtttaacgttttgaattccatccattgtcagttggagaatgccattttggattccgattccgcgcttctttcatcggttttctctcaagatgacacaactctcggtaattgtttttttttctatttttgaatatgcttttttaagttgcacctctgtcggcccttctcttttatctccaggagcttggtcataatattacacggttcaatgttttgtcaaattttgctctcgaaagcaccgccaaccgaactcgaatttttacaattgaaaacaaggaaaagcaacttttggtacgaataaatcctcacattcgcatgcacaatgatgagaaaaccgtttttgtggtcagtgataaatattaatgagcattttccttttaaatttggtttccattaggacaatttacctcctttctgtacgtccgatcgactgaaaaaacgagctgaattttttggtcgtgtggttaacattcgaatgccacagattgggcgactccaacgccgaatcgctcaaatgattggcggcgtttggccggtccattccggatttgcttttgttcagtttgtctctaaaacggcagaaaaacgcttttgtaaggtgtgtgagtcaagaaatgaaaacgatttccaaatcacgaatcatagctgaaaagaaaattatcaaattaagcgatatgcaacgaacagccgactaaaacgaattcacccaccacggac

SEQ ID NO: 37574 - DNA, 949 bp, Heterodera glycines
tttgttgaacttttgttattttcgcaccgcaaaatgattcgactttttgttagaattcgggtccgggattcaaaattggtcgaaatggatgtcagattcgtgaccagcgaccccgaaaaccccctagaaatgtttataaattgatttaaaaattatttttttatgggctgtaaacgacataagtaccagggttgccgcgggttacccgaaacccgacatttttctcgacccgaaacccacccgatgattttggtcgggtttcaatgaattttgggaattaatttttgagaaatttttaggtcgattcttaggtgtgtatttttcgttttatcgcattttttgttaataattttgggtaaaacgccaaaatagatttttaatatttttgtaattttttctcgaaaacaaaatcaatgattttggaaaaaccgagctcattgtctggttcattggccgactaagaatcatcacttgaggtcaaaaaccagcattttggaaaatattattcaaaatgaaaaaatcaataaaaatgtttcttgctgcgcgctttttccgaaaaatttttttgaacaaggggccggcgcggaaccaatttttgagattttgagccaatttttcatgaaaaaaatgttttttttgcggagggagggggttaagtgcattttatacctcccacacttcagaaaaaagtggattatttaccatatacctaattccgagcccaagaatatgagctgctaccgaccctgaaaatcagttgaaacgttttggcgggtcttttgctttaggcatttttaactgtttttgattaaaaatattagccgaaggtttggtgatgaaaggcgtggttttttctaggacaatccttcgtctgtctctctgtccgttgtctttcgtcagctgttcgatggacagaggaaggaagcacagactgacaatcagtgaaaca

SEQ ID NO: 37575 - DNA, 1458 bp, Heterodera glycines
acagaaatgaaattgttgcccactttgatttctctgtccatctcgcccttcacccgcccgtcctccagccgtggcaatgccgtgccagtgatgttcatctccagccgggcaagcacttggcccgcgtgttttatccatggtgaaatgtgcatgtccatgaacagacgcgaagtgatgttcagcgccgattcggaggggaggaacaaaacggaggataaattggtgggatggaagcgcaggtcgacgtgctggttgggatgaagccgttccaacggggggaagaagcggccaatgcacagttggaagaaggcacagctaacacagcggggaataaagggggataaagcccagccattcactaattagttgaccaattagtaacaagggcaaagatccttggaaatcacttgtaatgagtctatcggaattgacgaaccaaagccaaaatcaatcgcttaaattttaccaaatggaacagaaaatcactaattagtgattatttctaattataaagcaactgaaaagccgatcaaaatttataactattaaactgaacttgttgaaaagaaggacattggatttgcaacttttcctgagtgagaattacagcctcttttttgaacctcatcagtcggtaaaatgtcatttaatcccaaaagcccctaacgctaatccaatgcttttcctaagtgccacaattcggttttgccacattaattgcactgatcgcttctctctctctcctctgctctctgctgctgcttttacttacttaccttgtgctcaagaatttggcgaagtgtccgccgtcaaaggtcggcccaatgacaaattggacgtattttgcgtcctgaagcgatcggagcaaacagtcaatcactgtgcggtccaaccacagcgatgccattggcacattggcgggcaacggcatcggtagagggacgggggcggagaagggacacggggaccgcatgggcaccgaactgttgtcattgttgtgttgcacgtacacctctacaagcgcgaatgtttggagaaatgaactaaaatggggcgaggggaaaaaggaatgaacttattgattggtaaacagatcgccggtgatcaacatttgagcagggttagagtgaaaatgcttttggtgtccgatcagaatcagagattcataaaaaatttttatgtataatgaacgaggattctggtaaaatctgaatccaattttggagtcgaccaaattaccaagcgactttataaaaaaccgattaaaatttttgagcattccgttgaaaagcagtgttcttctggtcactatttattaataatcagttttaagcaagccattcaccaaatataaattaattttgtgggcattattataccttatcgattgatcgttcacaaaatttctattgatctgttgggcaagaatttcagactcaaaattacgcttatagatta

SEQ ID NO: 37576 - DNA, 978 bp, Heterodera glycines
  misc_feature (54)..(54): n is a, c, g, or t
tctcttatttgaatgaaatttaattcctttttttttggtcaaaaccgacaaggnttgtttcacgacccttccaaaatctcagaaaaaacgccacgaatcgcggtccgctccacccctgctgatgtcaaattaatgtttaccccccactaaaaaccttacatacgagaaattcaaataatcaagtgaaaaaaaaagactcactactctcatccgcgatgtccttcattccctgtgtttgtatactattttccatgctttactttgttaacaaaatattccgagagtgaataaagtagcaaaaaagtggcttttacatacgtgacaatataacgtaatgaaaagggcatttgttttcacagagaagtaaaacttctttattaagagatcataatgggacaatagatttcgccaaacaacaatataagaaggaatgaaatatatattgaaaatttaaataacgctaaaaaaaattttatgaaacgaattttattttaatttgtattgaaaaaaaagaatttttcgtggttttttctttagtaagtttctgacagtgacagttatgttttggttttttagttttcaaacaaattcttttcacttgcatttacggttttttgaccattgaatccttttttcacgatgttttattttattttgataatcggtcttttacattttttcattccttttcaagaacttaatttgaggattacattggaaataaattaattagacttcaaaatgggcatttcccaagacagatggcacaagcggcgaaagactggggggaagcgaaaccccattcacaaaaaacgaaagttcgaaatgggacggccggcagcaaatactaaggttttctgaattaaacatgtgttgttttattttcgttatttatcaaataatatttcattagattggtcctaaacgaattcatttggtgcgttgtcgtggcgggaacattaaacatcgcggacttcg

SEQ ID NO: 37577 - DNA, 902 bp, Heterodera glycines
  misc_feature (162)..(162): n is a, c, g, or t
atagtgacgaaaaagtgccaaaatagtgacaaaatagtgaaaaaagtccaaaatagtgacgaatagtgacataattttcatccaaaatgagcaaaaataatttttattcactatttgcagttgcaaatgagtaggactgggatttttaagaccaaaaaaccncaaaatagttacctaaaaaaatttttaaaattaaaaatttttgtcaagaaagtaaatttttgagaaaattttttttcatttcataggagtatataaattcattgaaaataacgtaaaaatgcacaaaaaataatgtacaccgcccggattcgaacctgccgccccccccccccccagaagatgactcagaatccccaatcacacagggattctgagggcttaacgatctaataactgaaatctgatgtcagattagtgatcagcagcctcaaatagccctaatgacatgtttttggaagatttttgtcgaaaaaattttttcactcaaaaatcatgtgctcccccctttggtcccgaattccaaaatcacttttatttttataactttttacaaaaaaatgataaaaggatgaaataaaatttattaaataaagaaaaaaattgcggattttttcagtatttaaaatttcaaaaacacctttacagaaccgagttctgaatttttttctgaaaaatcgaaaatttccagaatttctggaataactttttttgtttttgtggtataaatttcaaataaacctcataaaattctcccgattttttgctatttttaaagctttaattcacttaaattgagcagtccttcattgagttatgaattttcaaattttaacccatttccccaggaccaaaaaaattgaaaaatattttcgaatttttaaaaaattccaaaaaatatg

SEQ ID NO: 37578 - DNA, 615 bp, Heterodera glycines
ctctctcacttcaactgttatttcattttctcttctcctctctcactctttatcctttcctctattgtctcctcactctctctctctatcgtttcctctcttctctcctcttctcaccttttctctctccattcttctctcctttcctctctctccccctcctttcctctcttttctcctcagtctctcgccctccattcctctcttccctcgaatctctcctctcctcattctctctctatcgtttcctctcttctctcctctctcttattttatcatttactcaattctcttctctcctctctctctctcattttatcctttcctctattctctcctctcctcactctctatcgttaactctctctcttcttttctctctctctccttttctatcatctttcctttcttctctccattcctcctctctcttatctctctatccaatttctctctctcctccctttctctctcactcgttctttctctctcactcgttctctctctatccccctctcactatcgcttcctcttttctctctctctctttctctcactttctcccctctctctatatcctttcctctcttctctctcatttccccacttctctcc

SEQ ID NO: 37579 - DNA, 1025 bp, Heterodera glycines
  misc_feature (972)..(972): n is a, c, g, or t
  misc_feature (995)..(995): n is a, c, g, or t
  misc_feature (1004)..(1004): n is a, c, g, or t
  misc_feature (1009)..(1009): n is a, c, g, or t
  misc_feature (1017)..(1017): n is a, c, g, or t
aaaaatcacgggtcattcgatagtgcgagaattccccggagaactccaaaaataatgtcaaatgattttttgaactcgcatctctaaaattttgtcatcccatcagaactcattttagcgaaggtgtaaaggtggccttcgtaagacaattttactttttgttttttggttgcaattgggttagccatttctgaaaagaatgtacatcaaattggttaactattaaaaaataataggatttggaataagtaaaattgtaaaaaatgagcgagtgttaattaaacctaacttatgccaagtggcgagggatccctcaggcttagtttttagaatcttaatttttaaaaaagcacatttttctatttttgggttggggcccaaacgaccccggggcccaaacgctctggtccccttaaaaatggcaagttgatccctcctaattcatcataataattttatacgcaaagcgtgacgccgccaaaataaaaacaacaataagataaagcaaaatggtcacatatgagagtggttcataaatgtgtaaaacgatccaaatcaattgagtcaagaagtttagaaaaaacagttgaattttgtaacctaacttctttaggtaataacctatagaagcgagaagcacgaacaaaaaatgaatggtatctaacattagttgagcaaaaagttggcttaattaaattacccagtctactagaaaaattgggttgaggtttattatatttaatttggacaaatccattagttatttcatggaaaagtcctagatcaatttttaatctccttttttggagagactccatgttataaattgaaagcaattcgtcgtagttaggtatgtcaacataaaaatttgagcgtctaaaaacaattcttaaaaaagttttctgaacattttctatttttctaatatttttcttcaaatgcggatttaaaaacgggggatgcaaattctanaattggcctacaataaacattanataaataantgagntattttangggtactt

SEQ ID NO: 37580 - DNA, 136 bp, Heterodera glycines
cctggcagggtcgaaaatggaggaaaagcgacgaaatgatcagaagcagaagaagccacagtgacttgtgaatgaaaaatagtggcggaaagaaggaaaacatctccgttttataaagccgaaaaaaggaacacag

SEQ ID NO: 37581 - DNA, 756 bp, Heterodera glycines
ttttacaatgtaaaaaattgtgtttccgattgtgttccattccggaatgtatttttagtccaaaatccattccggaaggtatttttagacccaaattttacaaatgtaaaaaattgtgtttccgattgtgttccatacccggaaggtatttttagacccaaattttacaaatgtaaaaaattgtgtttccgattgtgttccattccggaatgtatttttagtccaaaatccattccggaaggtatttttagacccaaattttacaaatgtaaaaaattgtgtttccgattgtgttccattccggaaggtatttttagacccaaattggtatttttagacccaaattttacaaatgtaaaaattgtatttccgattgtgttccatacccggaaggtatttttagacccaaattttacaaatgtaaaaaattgtgtttacgattctgttccattccggaaggtatttttagacccaattttgtaaaaaattgtgtttccgattctgttccattccggaaggtatttttagacccaaattttacaaatgtaaaaaattgtgtttccgattgtgttccattccggaatgtatttttagaccaaaatccattccggaaggtatttttagacccaaattttacaaatgtaaaaaattgtgtttccgattgtgttccattccggaaggtatttttagacccaaattttacaaatgtaaaaaattgtgtttccgattgtgttccattccggaatgtatttttag

SEQ ID NO: 37582 - DNA, 602 bp, Heterodera glycines
tgcatctatttggcacatggatacacttgcaagtgggccaaatggaattgaggcgggggcgcaattaatgaaactcatcaattaaatcataattaacctttgcttttcccctttttgtttaagatgcttcgccaattatacagatgaaaacacgcaaatgccgcgacgcaattgcacaacggcagtgcccgttggcatttttcaaccacaaagcaccgccggtggcattcttccgtttcttctccctttgctgttggcactgcttttcctgctgctcgccctttggtcattttctcctttttattatgataatcccttcttttcagctgttgtctctgggcactttctcgaatgcgatggctcggcggcaaaaaaagggcattcgatgcgttggacacgcgggcgagcgacgagtcattgtacggacaggcactgaccatcccacgggcgagacttgacgaggcgagtggcggtggatggactcattacggagcatttacaataaatcactctaatcactaactaattaattaccccctttaactcatttgttaaccccaaaagccttctgcccaattaagacattgactcaatggccagca

SEQ ID NO: 37583 - DNA, 1117 bp, Heterodera glycines
aaaccctagagaagtgtcgttcaacctacgccatttttgctatggtgcgctcttttgccgaaaacgtacgatcccaatgattttttgaaaagcgaaacttctgactcaaaacacctcaaaccctagagaagtgtcgttcaaactacgccatttttgctatggtgcgctcttttgccgaaaacgtacgatcctaatgattttttagaaaagcgaaacttctgactcaaaacacctcaaaccctagagaagtgtcgttcaaactacgccatttttgctatggtgcgctcttttgccgaaaacgtacgatcctaacgagctttttgaaaagcgaaacttctgactcaaaacacctcaaaccctagagaagtgtcgttcaaactacgccatttttgctatggtgcgctcttttgccgaaaacgtacgatcccaacgagctttttgaaaagcgaaacttctgactcaaaacacctcaaaccctagagaagtgtcgttcaaactacgccatttttgctatggtgcgctcttttgccgaaaacgtacgatcccaacgagctttttgaaaagcgaaacttctgactcaaaacacctcaaaccctagagaagtgtcgttcaaactacgccatttttgctatggtgcgctcttttgccgaaaacgtacgatcccaacgagctttttgaaaagcgaaacttctgactcaaaacacctcaaaccctagagaagtgtcgttcaaactacgccatttttgctatggtgcgctcttttgccgaaaacgtacgatcccaacgatttttttgaaaagcgaaacatctgactcaaaacacctcaaaccctagagaagtgtcgttcaacctccgccatttttgctatggtgcgctcttttgccgaaaacgtacgatcccaacgagctttttgaaaagcgaaacttctgactcaaaacacctcaaaccctagagaagtgtcgttcaaactacgccatttttgctatggtgcgctcttttgccgataacgtacgatcctaacgagctttttgaaaagcgaaacttctgactgcaaacacctcaaaccctagagaagtgtcgttgcaactacgccatttttgctatggtgcgctctttt

SEQ ID NO: 37584 - DNA, 1453 bp, Heterodera glycines
  misc_feature (1134)..(1134): n is a, c, g, or t
atgcacataagtgattcctttctcaaaaatgtcttcacaaaaacacattagattctaatacattaaaacaataaataagttattgcatctttaacgtgcatatacatcaaataagctccattcccagtccaaggtccaatcccagcaatttcccgtagaaaagatgtggtttttccccatctaaattcaaaaatcgagaggaaattgacaaaaaaccccacgggtttcttgaacatcctcttgaggtccaccttttctttgcctgaaaatggcaaggatataaaattaagttcatatatgtaaatttgcaaggaagtacttaatttgccataaaaatctgtcttattattaagttaaaagcctatcgttaacattggaaaaaaaacgtggagaatttgatttgttccaacactcacgagtaagggcgatggctgcaatttgcccaccacacaccatccgcggatgcaaaactcgtggaatacgtggttacgatgccaaagcatacgtctaaaaagaaagtgtcaaaaaacgaacaaaaccgtgacaaactttttcttctggcagttcaagagcttcggtcatcactcctccattcgcttcatccaacgaattgaaattgttttggttggacgacggtttatgcaaattattcccgcagacggcgcacatatccgactcgagaaccctaaaatggtgaaaaaaacagtgaacaattccgttttgttggtaccgttttggcaatccgtcatgagtaaaatactagaaaaataataataatgtgttaatctctccatttcatttttaaaaccccgattttgcaggccaatctgtcggtcagagaatgtgccaaatcacgtccaagcacaccgtaataaaggcaataaaacaacaaatgcacgccaaaatccaagctcagattactgctaattccttaaaaagccttttttgaatttttagaaaatttaattttaccgaacaccgaatttattccaatgacagtaaagacgagtgaaaagtaaccgacaataccaaaaatgtaactgagtttatgcatgaacaaagtatttgtagacgagcctaaaagggaaatggacgaatttcccttttttgcgtaaaagccactgaaaacctggngagttgatccggaaattgccggctgattgaccctccgccaaacgtaaaatatttgaagaagtgaacacagtccaggaaagaatgaatcaccaccagccatttttaagtgacaccataaaagggattagccaaagaccgaccaaagtggcgaactgaaccaaaatcatatttattgttagacaaagccctttcagcgaaaccaccacccgttttttacccggtatgagcgaaaatgtcttctcttcacaacatcaagattattttgtgcacaaccattgagacaatgaaaatgatgaacatttccgcatgccatcgcatc

SEQ ID NO: 37585 - DNA, 356 bp, Heterodera glycines
aaactagagatcgacctgtacctggatccaggcctgtatttttcctggatccaggtacaggtacaggccagggatgggccaaattgaaaaataaaaagcgaaatgcgaaaagcgaaatttgcgaaactgaaaaatgcgaaatgaaaaaaaagcgaaatgcgaaaagccaaaatatgcgaaaatgcgaaaagcgaaatgcgaaaagcgaaattttttctacaactttttaatagttaaaatcataaagcaaaaatcatttttaaaattttattccaaatttaaaaatcaataaaacacttttttgaggcgcgctttttccaaaaaaactttttgggaaggggggggggggcaggcgg

SEQ ID NO: 37586 - DNA, 1273 bp, Heterodera glycines
ctctcatatgcaaagttccacggtggtttgcaattcttctagctaatgacgcctgctgtttggtggccaatccgatggtggttaatctattagcaagttcgctttattttgtacgtgagcacaataattggaccacttactgttaattaaaagcattttatatagaaaagttagcaattatgataggaagagctggaattggtttgccgacatcaagaagagagataacgagaggcgagagagaaaactgagagagggagaagagatgaagagatagagagagagagcataaaagaaaggagggcgaggaagaagagagagagagagcataaaaggaatacattaaacttttcgggcttagttgcaacgtggataaaaagatgagttttattaataaaaacaaaattactgtctccctccttcttgtaattgaccatcaattgttcggcacccgtaatttcgaggtcactgtgacaagcggaggaatcccaacaattcttttgcggtggaattgaaacagtctttggaatggtctaaattcaattttgaaataaatcaattatcatttagttactcaatcgttttgttcatacactcaaaagtttgaaaaaagtaaactaagagccgagcagttcagtgattgccattattttgaaaaaatgccttatttcgaaccaatttttaatcaaagatcccaaaattgacgttctttgttcgttttttaaattttgagtgtagaaaaacggagaagtcacacaccatttattatcaaatgatttatcattccaaataaataattcaccaaaaaagcgaatttgaaattcgggccaaaatttgcttcaattttatcacccggcgaacccaaagaaacgcaagggaacaaacgatcagccgaaggagggaagaacaaatcagatggatctgaaagtgttctttttgtaaatgaataattaaattaaaaaggccattaattctctattctaccgacccaatcgctgtccatttttcgtgaaaatgagacgtcgagtggccaaattaatgccaagtccgatgacatcgccacgagaacaatccgcttttttataatcccagcagaaagtgtcaatgtagaaaaggccatcgcttcgacatccacagccgttcgaaagtccgacaaattcgttcaatggcattgctttggtggcgaggccaattgaaatatactttttgacattaaaaatctccaattcgtagtagaaaatgccgaaattggcgtgcggaatcggatttttcc

SEQ ID NO: 37587 - DNA, 975 bp, Heterodera glycines
ctttttctatcaaaaagggagatgaataaaatttttatttttttttaattcctttttaaacaggccaaaaagtttaggcttaacttttttttcagaaactgatcagaagcgcaccaaactttgcagggatactgaaaggaagagaaataacctattttaaatattatctagtcagttcatttaaataatttttatccaaaaaatttttttttgggttttcggggcagtccccctgaaccgatgcgcccagatttatggggagaccgaatccttcgggaatagcttccctatagtctgtactttaattctgcgttggatttttgctccccataaatgtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgatttatttttgttttcggggcagtccccccgaaccgatgcgcccagatttatggggagaccgaatctttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttccggaatagcttccctatagtctgtactttaattctgcgttggatttttgctccccataaatgtttgagtaccccaaacggacacttgaaaaaatcgatttttttgttttcggggcagtccccccgacccgatgcgccccagatttatggggagaccgaatccttccggaatagcttccctatagcctggactttaattctgcgttgg

SEQ ID NO: 37588 - DNA, 1101 bp, Heterodera glycines
cgtttttcgggggggggggggcgacgccgagacttgggacttggtgtttctcattctgatggtgtcattgccttcgttttgccttaacactcaattttttgactcatagttccgctcatttcctttgctgtttaggttcggttccagttgttggtttgcgcatggggagaacgaacttcgctctgtctctgctggttcgtccttttcttcgcccatcgggagccgtaaaccgcgttcgttgttgccacgcccgcctccgccgctgatgttcaaccattttttgacccatggtttcgctcatttcctttgctgtttaggttcggttccagttgttggtttgcgcatggggagaacgaacctcgctctgtttctgctggttcgtccttttcttcgcccatcgggagccgtaaaccgcgttcgttgttgccacgcccgcctccgtcgctgctgttcaacattttccccaaaaatccctgattttcccgagaatgctttttttttccgcactcaccgtttttaatttttgaaatcaaatttacattttttattgtcaaagtttttcaaactttcgaataaatttatgatctgtttacaattctttttagagaatctattttataagattttaaacatagctcgacctgggcctggttctaggtcccatcgtaacttccacttgccgaatcgggctcttgtgcagactgtcataacccatttatttcatttcagtgctttcgctataaataccgacacaattttttatcgtgtcattgctaataatattttattttgactgtttttgctgtgcataattatggaaattgaactcagtcaaaatgaaactgctcacaatcggacacaaaaggcggacggcgaaaacgatgtgaaggaattggtcagcacttcgttcgccgcaatgggaaacgggcgcagtttcaacgcattgcttaagggggtcggtttgtgcagaattatggccggacatttgcaagaagtcaacaattttggcggagttttggactctattgaaattagtttgaattttttggtcaacttttgaaacaacaaaaatttttgaaattttgcgcataataaggactc

SEQ ID NO: 37589 - DNA, 1560 bp, Heterodera glycines
  misc_feature (16)..(16): n is a, c, g, or t
  misc_feature (26)..(26): n is a, c, g, or t
  misc_feature (119)..(119): n is a, c, g, or t
aaaacctgaagggatntagcaatgcnttaatcagtggacggaaaagcagggaaaacgaccagagaaatgcgaggtaaagcgtaggaaaagcgacccgggacaccttaattaataaaatntaattaattaattagcaatcaattgcttttacaatgtccactcgtttggacaggtccacgccggagccgaagagatggcgcaaccgtcgcatggccctgccaaagacggcgaacggtcgctcacgccgacggcgctttgaggacgaacagccacttctgcgccgcgggaagaatgtgttgttctccagactcagcggcggatggtcgccgttggcatcgccgacgaagccgacgatggcactgttgttgttgctgttattgttgttgttattggtgcccggcacagtgagcagttgtttctgtggttgttgttggctcttagtgggcgatttgggtgcaaaaaagtccgggtgataaatgttgggagggggcggacagagacattcctgaatacggtaggggggtaatcaatttaccgtatttactcgattatagcccacagggactctattgttcaactcccctcagaagggggtgctttaatcgcgaggggggttctaatcgagtaaatacggtaatacggtatgaggaagggaaatggtaatcgccgaatgaattaattaaatcgatgtaatgattaatgatggatggatgcgcttatgactgatcacagaatgcttttgttggttggcttcttcattcacctgctgaaatgccatgctcagtcgtccgatgcccgactttccccgcttctcaatgttcataaattcccttcgcccatagtaattgacgagcgcatactccaaaagagcggcaaaaatgaaggcgaggcatgcgccgatccaaacgtcgacggccttttcaatttggcattttaatttttggattttaataatttgaattttttaaacattttaaaattggaacatttgttaaacactcactttaatatatgaaacgggcggtaatttagagttgatgccggatgcttgagtggtcattgttagcagcccaaaatgaattaaaattaaaaaaggagagagagagagagagagagagagagagagagttttgttttgcttacgttgtaacgcccaacgaaacgcgtgccggcactaaaaaagttaaagcaaaaattgttaaattaattaaaaaaagatattgtaaaatgcataaacctgcatctttgtcaagccaaaatgacacctaaaaaattggccatttgcaaaattaatttatttttaaatttatctaacccacgaaacgacgactaacataacacctgccaatgaaagaatgtaataacaatgggaattgatcatttgttaaaggtccaaatcaccaacagggaatgtacagttggatcaaataatagctgaaaaaggggggcaatcaaaaaacaggacaaaaaaggtacaatcagttcattttatctttttcaatcaaaagcagggctgggcgtaactgggtttcagttacggcatccgtaacccgtcatgac

SEQ ID NO: 37590 - DNA, 680 bp, Heterodera glycines
gttgtaccccttttaatcactgttgtacctcttttaatcacatttgtacctcttaatccctgtgtgattgtccgtctgagttcaactaaattttaaaaacgggcgcgaagcgcccgtctgagttcaacaaatttagaaaacgggcgcgaggcgcccgtcttgagcctcgattggactaaaaacccttaataattttttaactccaaccaattcgatcaatttgaatcgcttcacagcctaggtagagaagctcaagaagcgcgaagcgcttttaatctctgttatacctcttctgatcactgttgtatctcaaatcgtatagttccacgtcgaaatgtcactcaccattacgcccgtcaatcccattcacatgcatttcattttcgccaaccgtcaattcatcgatatttaagcccctgtcaatcatcccaccttatcagcacaatttatggggaggcaaaaatcatgccaccattgccttctcttctcccccaattcaatcgatcattttatgtaaaattgtaaattgtacaattttccccccattcattcattcatttttgctcatttatatgggcgaaggtttaattacccaagttttagatccggataaatttgttgtttttattcgcttttgaatttgggtacattttgcctatcgatcactcgccgaccccgac

SEQ ID NO: 37591 - DNA, 1099 bp, Heterodera glycines
cgcggatggacgccgttgtggagcggatacagcttcgcaatggttagcgaaacggaggcggaaaagccgagactctcgggactaattggaacggataaagaaaagccgagacttttgggtcatttaaggtcatagttttagcgaatgttatccaatgtaatgccaagcacacctcccttccgccaattccctgttttaattttcttttccgcagcataccgccgctggcgctgagggcaccgggcagaatttcgagtcgccggggagttgtctggagacattcttcgcggtgccattcatcgaatgccatggcaagggcacgtgcaattattacgccaccaatcacggcttttggttggccgtcgttgaacaggtggacacagttgggcacacgatacaggcatactgtactgtcagaaagggttacggttactgcgcaattcaaattttaaattattttttaatttccactacagtacaaccaattccgaaaaccgatgccacaaacgctgaaagcgggcggactgaaggacagagtgtcgaggtgccaagtgtgccggaaaggcggcggaacgccccactgaaaagcgccgcgaggcatcgaattccgcgcgaatgattccccccaatgcgcttcgattgtgttgtgtgtgccgttacaaaagcctttcctaccgtaatgggctgcactttgcttttctcagtccgttcccttttcgctttgtttaattgccgcccatttgcgggggattcgcccccccccccccaatttgacaaaggttggggtcggaattcttcgcggatactttcgttgttttccccttttgttccttccgcttcatgtgatttttattgctttccgcctgccaattaattaattaccccgaccaattaattacttatccaattgttcacccatttctgtaaaatctttatttaatggaaaaatttatgcaaaaatgcaaatcttttaaaaaattatatattctttcactgccatttccattaatattttgaccaaaagcaaaaggttcatcaaattcatgtgtcatttttattcgccttttttattttataaaaataaaaagacctgccaggc

SEQ ID NO: 37592 - DNA, 1100 bp, Heterodera glycines
gctcattatgtgcttcattaccaccaatgccttcccttaacggacttggagaattcatgaaactgttcaaaaagtctccggaacaacagcacttccagcagatgggaaggccgtgcagcagcggaacggtgaatgtgcagcagaggcacaacggatgcgaaggtgattaatagatgaaacaaagacaatgtaccaaattaaataaatatcaattgataaatatttaagtgacaattggcaccaaacgccaacggagcacttgcacaaaaagaagcattggcacggatgaggtaaaagctatttgaaagtcatttgtaaaaaaaattaatgacaatttcagcactctgattttattggtgccgaagtagtgaagaaagcggcactatcaaagccctatgaacaatttgagttgcagaaaccgagtcaaattggttagtttttaaaattcatttgtacataattatactaattaatgtctcggcattttcagttggcacaaaagtggcctcaactttggccacttcttccgtggtggtcatttctcctccgccacctcagaacatgctgaccccgcccaattcggaccagtccgtttactcaacgagcaatccaagcccaaacaacacaagcagaacgagcagtaacagcaccagctgcaacggtagtcagctaggcaatggcggaaacatttctttgagatttattaacttaatgacacctttttagttgtgcgtccactcgccgtcaatgtcgggaacagatatgcacaacaaccgcagaaccatcagcaacagtgccaggaaatgcttcgccatactgtggatgtccagcagcaacagcacattcatttggaacataatcagcacgttcagaaagtcagtaataaattacagattaatttcaaatttaaaaatagtatcattagccagcagaaggagggcttacaatgaaagtgcggttaattgtcactaattgtaagcactggctgcccctcctcatatctgaaagaaaaaaagcatatggcaaagctaacaaaatccatttgataatgggaaaatcattgacaatttgaaatttttctcaattaatttcgacctgca

SEQ ID NO: 37593 - DNA, 705 bp, Heterodera glycines
atgaaaaaactttctgtcccgttgaggaattgaaccctatagacaaacactgaaggtcagaaggtttagccactacaacacataagattatggaggaatactttaaatgaaataaaaaaaatatttttttttctaaaaaatttctcattcctctccaattcccttctcttttctcaccagacccccattcttaccagtgcttaaaaatgcgcggcgcaccgcgcaaaaaaaaaaaccgcggccgcgcaccgcgcatcgcgcattcaaattgccgcggccgcgaccgcggatcgcgcaaaaaaaaacgccgcgaatcgcggatcgcgcatcgcggatcgcggccgcgctccagccctgatcagcaacaaccacccaacaacgacaacaacaaccggattagttgttgtgtgttggcattgtgctcctcttcttctgatgggactgaattggctgcgatgagttcggctcaaagaatggagaaacaaacaaacaattagcagcagcttaattgtgcaattcactgatactttctgtcccattatttaaaatcgttttgagttgggaatttgttttttggctgagattagtaaaagagtaaattcagtcaacaaattgtctgattgtttttttaaatgatggtgaaacggaagttaatccgatcaaaagagcgatccgattgaatattaagcagcggctgacaccatc

SEQ ID NO: 37594 - DNA, 1124 bp, Heterodera glycines
  misc_feature (1106)..(1106): n is a, c, g, or t
gatagataaagcatatttccttaaatgatgaacgaaaccagctgcaactcatcggtattagaacaacaaatgttttatagcagaagcaacagcatgggcacacagcagcagcgaattcagcaccaacgacaacaaaacggacaacgggaagaacaacaacggggaacatgaacaattccaagaacggattgaacacgcgcaaaactgtggtgggacgacagcaacggcacttacacgaacaattagcaacgaatttgccaacaacaacaccagcagcagcagctgttcacaaagacagcaacaggtgggcacaattaattaattaattggctaatttaattttgtaaaattattaattaattctttaattatgttgtaaaattagccaaagaattttgaattttggtcagttaaaaaacggccttttatcgttattccgctaattaagtaagcaggaaaaaaggacaatttaaaaaaaatcattcggttcttttttagtgagtccatttcatctgcttcctttcatttccttcgctaatgcttttgatcccttttctcgagtgtttttaaaaatattttttactattacaattgtctaatccctccccctttatcttaccgtttcccaccacttccttttgtacgtcctcagcagggataaaagcccggctggcagacgaacagccaaacgaaaagcaaagcgaaaagcattgccatgataaaaaacataatctcttggcttccgcaaaaatctataaaattagcgcgatgatttttgatattgccaacagtgtaaaaagcacatggactgagaatttgacgttcaatttggggggggggggagttcgggtggtgcaaagggattaaaatgcgaattagggattttggacggggattttgccgccaaagaagcaatccctccttaaaacgatgtgaaaaaggataattagcaaaaatggaaaaaagaaattggggaagccggtggaatgatgatgcgaaaatacaaaaaaagaaggtatattaaaataattgaaaaattctgtgggataattggttaaattttaaaattgtataaaatctaaaaaacataaatttaattctcccanaaattgaattttaattat

SEQ ID NO: 37595 - DNA, 667 bp, Heterodera glycines
gtctcaaccaaaaatcctttacttttgttcattttcctttgaaaaatatgtttttggcataatgtctttaactttaaatggtcaaaatttcaatttctcccccggcggagcctgtcggcaccgctgggcctccaaaacttttttctttttaaaaaattggcccaaaaaagcaaaaaatggtcatttttggttaaaatctgttaacaaatcgcctcaaattttcaaaatttttcccggcggcgcctatcggcaccgccggacccacttctttcttccccaaaagttttttggaaaaagggcgccgcaaaaaaaaatttattattttttcattaaacataggttttcaaaaataaaaaactttaaaataaattttttttgaaaaattgaattttatgtatttttttcggcgcattgtcttttctatggcgacattttctggtgcaccaaatttctacatataatagatgaaattttaagggttttttttcccaaattaacatgtgaaaatttaaatttttgccaatccggaatccggttccggatctggcaatttgaaaatctggattgaccggattatgagagatcggatccggaatccggttgtttttgaaaatgccaatccggtccggtccggcagatttggaaatctcgaactctaataataaat

SEQ ID NO: 37596 - DNA, 1010 bp, Heterodera glycines
tgccgagggcgctgatccaaaattgggagcgaagcaatggaagcgatggaaaaaggttggatttgtggaggacgaaaagccaaagttgaagcggaccaatgcgaaacggtggagcaaatgaatgaaatgagggaaatgaatgaatgccgtcgcactcaaacggccaatgatcaaagaaaaaacattttgaaatggaaaaatttaaaattcaatcctacacagaaatatgaagttgctgaaaaagtgttgaaatgaaaatcattcaaaagctatgaaaagagggatttgctaaattttggggagaggggtctcaaaattgatggcattttagtattaaggaagaaaaacattgacatttctatgcttgtccatagattaaagaggtcttttcaagataatagcagattataagacattaatctgctgatcattgatttattcaattgaaattaccccaaaaaacattcaggagcgggaggctcaaaacatacaattaattaattataattaaatgaaatggattggtgggctaagcaattaaatcgtccgtttgttgccccggcaatcatccaatcaaggagggattttataaattctcaaggctaagggaggcgagtgtccaactcagtgaaatgcttaccaaaataatttgatttaattaaatcagagaatttcttctcacctttaaagaatcaatcagttttttccagtaaaattttttattataccggagatcaaaaaaaatcgaatttaaacaaaaaatgattaaaaaagcatcggctgatcagtcttctgtcggccattgattgaatgatcagactttgtgcgccccgtgctgcgaaatgaaatgctgtcgttgcacaaatgtgctggcattgtacacgaccaattcaaaccaaatgttaatcacctgataaacaaaaatgaaaatggcgtaatttaaatttaatttgaagtgtaaatataaaagtgccgaaaataaaaacaaatgcccctaaaagcttttacct

SEQ ID NO: 37597 - DNA, 453 bp, Heterodera glycines
  misc_feature (21)..(21): n is a, c, g, or t
aaatgtttatctattgaaatntcggtactcaaaaatgccttctatgctaaaacagctccgacaattaattaattcatatacctgcagttttgaaagtataatcaagaaaaattaataaataaaaaaacaggttcatcataggatggaggatattcaatggccatttttccccaaatcatattgggcatttatgtttcgtcttccgttttgcttctttcactgtgacatcaatggccaatgtcactttgtcctcgctttggtcgtaaaagcctttgcttgggttcatcagttccttaattaccccataattggtcaattaagggaatgtttaattgtcactcacagcaattgaaatgtaattgtatccccagttgttcgatttattgtcaaaaacatggtcatcgagttttcttccgaaatccggcactccgttcttttgcgaaacaattcgaa

SEQ ID NO: 37598 - DNA, 1013 bp, Heterodera glycines
tttaaaaataaattataaattaatacaaacatattttattactgaccggcactgatggtcctaatgcctttattgggtttgtttttgccactcaaaaagtgtacatgagagtgaatgaattgtgtcagtgccaatgctcaaaaaagaattttttttttttgtaaattccacgtcaactttaaaattgcacctcgtccaaaatgttgaccaatctgctgctgattcatcgtaaaaactggctgcagctgaacaaatttggcaaactgttcaagctccagtacgacagagtcctcatatttctaggagggaaaaactttgagttttatatattgtaaaaaatgaaatcggttttctccaactcctcacaccagtgttaagcctagcagcaccccacccgggtgcatttggagaaaaccgattgattttttttaaatacccccgatttgaaggatatcaacaattggtcaaagtgcgggtttgcttttggcatctttgtctcgtcaaacatgcgtcggaattctttccgttccgccatcggaattccacgcctggaaatggaaatagtttagcttggtcaatcaaaatattaaaaaaaggaatcacacattttcgtttctcgctcctttttggccaattccatttggaccaaataacgcaaaaatgagttctgtattttgtcaacaccatcactgtcgagacggactatgaaagaaaaggatcaatcggtaatagatttgttattcgttagtatgttttgctacctgctgtaaatgcaagattcttggccagcgattctcggtccaattcattgaacgatttcttcaatcttttaaataaagatttatttatatagaaatcaaaaattataaattaaaattaaaaattaaatttaaaggatttaagttctcacaaatctttatatgtgaaagaacacaattttccgtagcgctactcaaaattgcattttttgaaaaattatcatacatgaaaaaagggaagggggggggtcaacc

SEQ ID NO: 37599 - DNA, 1174 bp, Heterodera glycines
  misc_feature (55)..(55): n is a, c, g, or t
  misc_feature (123)..(123): n is a, c, g, or t
agaataatagtaaaaataaaattaagaatttttctaaaatgttaaaagaaaatanccggttatttttttttgtttaaaataaaaaataagttaaaatttaaaaaattaaaatattataatganaattgtaatttattaaaacaactaatattcgttaaatgagataactataaatttctatatcacgaatgtatcaaattagaatatagtttttttaatttatgagttaatattctaataaaaaaaaatttatagcagagagtcggattgctgcataaaatattaaacaatttaatttttaaaatagcaatgaattagattaagtattaattataattattccatacaactatgatactgaattcaaaaattattaatatatcaatcttctattattacaaaaaaattaatatgttaaatacatctaaaatgttaatcaaaaatttaaaatttaatgtttcctttttaggtattttagtgaattatgtaatattgaatgtgatttttgattaaaagcaaataaatttttggcaatttaataattttattcaattatttatgcaatttttttttattaatcttacacaaatcatctcattaatttttaattcaatatttttatttgtgccattaatgtatgatttatatttaatttcttttttgcaaaatcattcaaaattacgattaattatttttaatatctatttaatatatttttattcagagttttcctttccaattttttgcaaaagttcattattttcattattatttatagaaacataatattttttgcataatcaatttttttaattaattacttgtgaagcgctcaggcgttttggtggtatttaacgtgaacactaaataaaaattatatatgtttaaaataaaattaaaacgaaaatatttgatataatttggttatttagatatattaataaataccttcttagggaaaaaataacaatatacaaaaaatttattgtaagtttgttgcatataaaagtgaaatttcaattccgtctaagaaataaattactttttaaagtagatcaaggctctcaattaagaatgttatttttatacaaaaaataaaaatttttaggttataaatagttatgccttttaataggaacaaattaaaagcttagttttttaaaagttttatttt

SEQ ID NO: 37600 - DNA, 137 bp, Heterodera glycines
gaaggctcgatcggcatggtgcgttcggcccagaccaagtccaacgacccgcagtattcggcactgttcaactacaagaacgacgaaggcaccttcggcgtgatggtgcagggcttcagccagaagcgcgagctgcg

SEQ ID NO: 37601 - DNA, 881 bp, Heterodera glycines
aatctattaagttctatttcaaaatttgaaccaaaaacatttcgccagaatataactagtgttgtataattttcttatttttgttgcttttaattttctttcttttttggtgcttttcttttaataggtaaatacaatgaaatattctttgctccgaccgtttgtgaatcgaatttttacgcccggcaaagagcagcagcaattggtgcaacgaaaccaaaatgaatttggaatggtcaaaacaaacgccgggcaatcggccattttattgcgatttgtcagttggataagcggcagggaacaaattgagcagcacttcagccgattcgggaagataaaggagacgctaatgttttatgtatgcttttcgaataaagaaaccaaaaacatttactgaaccatccgaaaatggagcccttggcgctatatgcaaagcatttcttgttttcaaaatgtccgattaaatgatgccatgataacattttacaagtcatctgaatggcggtattttcaccttatgaggggattctttttaatttttaatttttgaacttcgaatttcgctaaaaaattcattaaaaaaataaatatataaataaaacatttgaattaatttcataattattttaattatttaatgaagtttaaattaacagaaatttgggttgaataattattaaaaaagaaataagaaaaatagaaaattttgtgatttatctattttatgtgatttaaataaaaaatacaaattcttagataataaatacattaaagaaaattattttctttaatttaatattattattttaaattcattttaattggcttttcagggggaaaaaaagaaatagaaaagtttattttaaaaaatcaaaaatttg

SEQ ID NO: 37602 - DNA, 124 bp, Heterodera glycines
actgtgttctttttgcgagttcgtattatatgcaaaaattcagatggttaattactacatatatttaaaattggaatttcaatttttttggttaaaatttgaatagtttttcgttggcatttat

SEQ ID NO: 37603 - DNA, 643 bp, Heterodera glycines
ttggaatagcaagtaatatagtttgtcaaaaaatttttgaccaaaattgttctgttgaaggatgcggcgagtgccattcggcccggtgcagggtgtgcgaaaaattgagggaacggaattgtgaaaggatgcgcatgggactaccctacggtcgcatcatccgcgaatttgggccgatgaccagagaacagcagctcagtgcaacggcagcgcgcaacccaatggaagccgcacttcaagctggtagcgaaacgacagccgtatttcgttgggggaaccctttggcacctgtccagttccccaccactttgttatacccaaatataaggggatgtgtttgtgtactgtagagatggcgcaattttttggggcctgtgggcacgtgggactgtgccgtcagtgtttgcttattcacttaaaaatttcacccagtcctgataaatgtccctattgtcgagtgtgcaccacattttacatgcagcattaaatatttgtcagttctttttgccatattatattttgaataaatgtacgaaaaaatttatttttaaatgatgaaaataaatggtgaaataaatggtaaaattaaatggtgaaatttaaatgatgagaaatggtgaaattttattggtgaaattaaatg

SEQ ID NO: 37604 - DNA, 909 bp, Heterodera glycines
gactcaacccaccaacatttcaatcactggggactccacctaccaagatttcaatctctgagactcaacccatcaacatttcaatctctgagactcaattctcaggctttccaatcgctggaactcaacccaccagcatttcaatctctgagactcaattctcaggctttccaatcgctggaactcaacccaccagcatttcaatctctaagactcaattatcagactttccaatcgctggaactcagcccaccaacatttcaatcactgggactcaacccaccaacatttcaatcactgggactcaacccaccaacatttcaatctatgagatcaattctcaggctttccaatcgctggaactcaacccaccagcatttcaatctctgggactcaaatctccggcattccaaacaatggactcaaatctccggcattctaaacactgggactcaacccaccaactttcaatgacattccaatcgctggaactcaacccaccagcatttcaatctctaagactcaattatcagactttccaatcgctggaactcaacccaccagcatttcaatctctgggactcaaatctccggcattccaaacaatggactcaaatctccggcattctaaacactgggactcaacccaccaactttcaatgacattccaatcactgggactcaacccaccagtatttcaatcgccaggactcaatccaccagcattccaatcactgggactcaacccaccagcatttcaatctctgggactcaatccaccacatttcaatctctgagactcaattatcagactttcgaatcgctgggactcagcccaccagcattttaatctctgggactcaaacctccggcattccaaacaatggactcaaatctccggaattctaa

SEQ ID NO: 37605 - DNA, 1474 bp, Heterodera glycines
aattcgccaaattttgaaatttaagggtctattccgttaattttcgatgaaaatcgaaaaagcactggaaatatgggaaaattactaaattggaaaaaagcaaaattttatgccaaaaactcaaaacctttacgttattaaattgcgtttcgtttaaattttacgaaattctttttcatttttttccattttgtaaatttttcaaaattatacatagatattttttatgaaatttgttcaaataaattcatgaaatggttaaaaatcgcaagtttgctcatttttttggtgtaaatctgtaaacaaattgcaatcaaatctaaaaaattcccggcgacgcctatcggaaccgccggatcccccccccccctccctgtttccaaaaaaattttttttttgaaatctgaacgcagataattaacaagtaccaatattttaccctcacttccattgtatttattaaaccaatttttatcaaaaaatttaaaaaatacttatacgtatacggatccgtattttttctggatacggattttacggactacggattttccgtatttttagtccgtaaatacttaatccgtatcggtgtcaagtacgtaatactgatacttatccgtattttcgcaaaattccgatctctactcttaaactattacccaattttcctttcgtttaaattcaaaattcaattttttgactaagtcatgaaaatttaatatatttcaaaataatttagacaaaaaccccaagaaaaaaaacaaaaaattatcagaaattcattttttggacaaaatctgttaaccgacccatccaaattttcaaaattttttccggcggcgccttataaatgacaagaaattgatgaatttgattgtttcaaatgaaaaatatgacagttaactgattttgtacgcattttatgatcttttaaaaaatgaggatttttcatgccaaatgaggattttttgaggtattttagtggcaaatgaggattttttacggctgaaatgaggattttcaaaatttattcgtaaaacttttttcctcatcatttcggtttctcactttcagaatcttaatattttcagaattgctacgtacagttaaaatttcagatcgattggttcatgggaagtggtcaaactcccaaaaaatagggtgtccttattctaatgcaacacagtgtagttacaagaaggacctttttgaaaattttttcacttttttttgacataattttttttttgtttaaaaagtcctgaaagtaagtaccgggagtggtaattagggatgatatttataggcactaaaaaccgtcaaaataggtaggccttaggctctaaaaaacccccaaaataggccctaaaaatggaaaataggcactaaaaacctcgtttttaggggtgtaaaatgacaaaatgtattcaaaaaagtaaaaaaattaggccaaatcagtactgagatatataat

SEQ ID NO: 37606 - DNA, 1011 bp, Heterodera glycines
accaaatttttatatcaggctcttctaaaatgtgaggatttgtttctcgtagtgtgtttagttgggtttggatggaattcgatatattgttgatctgattaaaatgtctttctacgtctctcccggcgcgttctgcggccctctttgcgacatcaatttttgagtctttggtatcttcagccttggcttctctcttcccacgttgttttttgattttgtaatgatgtgtgaatgcttcgttaattttatttcccaatcccccggcggttttaaaattcatgtccggtaaataaacttgaatggggacattgttgtcattttcccatacttttataaactcttgaccatttataccgagagcggtgaatgagtaggggtaaataattgatgagagagctactgaccaatttgtgcccaattccaaagtctcggggaggcgtactgtgaattttgacgtagtgttctcctgccccggtgtgttcgaaggtagtacaatgtaaaaatcatccatctgttttcactaattcctggttataaaatataccttttattaaatttccttccaaatcttcgatcctgtatgaatcgggtgtcgtcgaattggcaacaacgattttaaacaattcttcggtaaagtttgggaggtacccctttgaaaattttcccttttccttggtaatacgaacgatatcaccgattttaaattttttctttttcgaaattttaaattccctagccttatataatttttcccagagcgcacgggcattttcaaaattaattgaagacggtttggctcccagtgttctattcacactgttgttaatgtttgttattattttgtctattacgtcgacccatcgaagagtgtctttctttgtaaaatatctgtacaagcgctcctttattgtccgatttgccctttcacgactccggcgtgcagatcaggactatacattacatttttgatgatgaattttttctcaaaatattttttcatttttcctgctt

SEQ ID NO: 37607 - DNA, 1011 bp, Heterodera glycines
  misc_feature (852)..(852): n is a, c, g, or t
  misc_feature (875)..(875): n is a, c, g, or t
  misc_feature (908)..(908): n is a, c, g, or t
tagcaattttaaatagaaaaaattttgcatatcgatagagaaaaaaatctgcatattgtaatacagccattttatgttttatacactttttcatgagatataaataaaacatgaaaatgcatttcttttcctctcattttgacatattattttcacatctctacatatcaaaaaacacaaatttgcaaacgctaacaatttttgttaaaatgatataaaaatgttaaaattttaatttcttattttattatctataaataaacatctgatttaacttatttgaagtgaattggaagctttgatctctgattatgaactagatcaaacataaagacactttgtttttcatttgagtgtgttggcgttttgttgtttacgccaattactttttggcaatttttttcgttttttaccgtccatgactgggactggagtgaattcatgttctctactgccaaccattgcatatttttttcccaaaagtgcgaattacctctgaagcgccaacaacaaggtaattgtcgtcgcgtttggcgccggcattgccgtttggtgagtcgtctgatcccctttcatttaattaatttctaatgccatttttccatatttaggtatttgcgtaagatgatgcgtaagcgagaggaggaagaggaacaggaggatgaggcgccgccgggggacgaggccccgcccccgcggaggacgaggaggacgcggaaaatgacggcgggccgggcccgcagcaggcgcagccccagaaaaaacctttgccggattttttcgttcaggaggaccctcgagacggtgccaattagcggcgacgaaaaacttatttctccatttttggacaanaagctgtaaacaaatcgaattanacattacaaagttttcccggtggcgcctattgncgccgccgtatcaccccccctgtcccacaaaatttttgaagaagcgcgccgcaaaaaaagcgtttttaaagcagaaaaaaattcaaattaagtatcaaaatta

SEQ ID NO: 37608 - DNA, 1157 bp, Heterodera glycines
  misc_feature (439)..(439): n is a, c, g, or t
  misc_feature (527)..(527): n is a, c, g, or t
ccgaagatgttcatttgtcacatcgaatgatgagcaaatgttggcaaaaactgatggattgaaggaggagagcgtgtacaccaggggtgggacaccgacagaaaaatcgcacggtcgcggatcgttaaattaaaaacttaaaatttcattggtcgtcaaaaaaagagggataaatgacaatcggcggtgagtaatgtaattaattagtgcttgaagtggctattatgggaaataagaagaattttaggtgaacatctctttggtgtataaaacatgtaaattaggctaccgttggatcgaatgaatggttattaaaatttttacggtccctttgggaaatgtgaaagctttttcggcgctatatgaaagtggccgatttgattttagcaaaacacaggggggattttcaagtaaatttaaaatattaaatctttcttgnctgacttttgcctcccgtcggcgtcggttcccacgcgcgggcgccgcttcgtctgattgggctgttggtcagctgcctgttgcattgnctcttgctttttgtgttcctccccttgcttgccaacttgtacatcatcttcggctgtgccatttggcggtgccttttcctgtgccaccggtggcttttccgagttttccgctgtctttagctctggtgcctttttgggctcgtccgcctggttttcctcttccttcggcttcttctccgacttcggcttctcatcgactccttccggcttcttctttggttcggcttggtcgtccgctgccccctttggctttttctccccattcgatcaaaattcatgtcagtataagtttcggttgctgatcaaaaaagtccattgcaccacagtgaccagatcactccttcaggatgttcaagaaaaccttaaaatggcttggaatcgggaaaattttagaaaaaaattcataaggggctggaaaaatttttttcatggatgactaatgtgacggacagaatagcacaaaatttgctacaaaatgcaaaagataagtctaagctttagatcaatatttactgtatgtgtaaaaggccaagcgacaattttgagaaattttacagactccttaaagaatattcaaatttcagaaattgaaagaattttatttacaggaatatgaggcctaccttggcc

SEQ ID NO: 37609 - DNA, 839 bp, Heterodera glycines
acaatgaatggccagagggtgggggaggggaaagattaaaatggcaaatgagcaaaaatgggcaaacaatgaaagaaaggaattaaataaaaggaaaaatagttgaaatttttttgaaaagatcgaaaattaatttgaaaattggaaaaaatgttatgaaaattaaaattgtttaaaaataataacgacaaatgatagttaaaaggtgttttttttttttgcaaatttaagtaaatgaaataattaagattttctatttagattattttcaaatgaaataattaaaattaaatcaatttcattatttagaggttattaatacaattattattatttttttaatattttaataatttttatttagaattagtttaattttaaaatatataaaaaatatattttgagttaaataaaggtctaacgaattttttccttgtaataactaaataaatctttgaaatttgtttttttaataattatagttcattttcaccttttaaagatttttaaaaggaattagtaattaaaaattgaaaatttttcagataaaaatttttttaaaatatattttaatgaaatttcttagatttttaaatttttatataaaatattttaaaccgattttaaaccgaatgaaaggctaacaatgtttcaaaaaatggtacaaaatttgcatattttttttgcttggatcaaaggggcatatggatgaaaatgcggaacaatggagggaaagggggggagggggcagaatttgaattttcaatggctgtcaaaaaatgcgtccaatttttcgattttttttttcaccgctatgacaaattcttccgacggattga

SEQ ID NO: 37610 - DNA, 948 bp, Heterodera glycines
tcctactctttcctcctcgtcaccctctctctctccccatttttctcttcttgctctactctctctacctcttcacctatgcgctattttgatgcatttattccctacccattcccgttgacctttttctcgtattagaaggaaatccttttttcctgctgaactgtggtgtactaaacagcacaaaaatttttttttaccttctttagagttctaagatcggctttttgtatatgtctattttacatatttttcatattacccggtttatatcccagatttgtgcaaaaaatctaataatataaaagatgtactcagattttcgaaattttcccagtctcgggcaaccaagtctttgataatatttcatcaaaaatcgttgggtaattagcggttgaaagtttttcatatttttgataaatctctcatttaaaatcaaatattaaatgaaatgcgtgctgcttccgctggcatcggccatctttttagaaaattggaattaggaatgatcaaaactttgaatttttaatacaaaagtttaatgcagaaaatgaagaaatacttatttaaaaaaaaaattaaaatatttgaataatatttgaagaaagttgtaggagaaaacaattagctaattagttttatttaaaatgacaaataattttttatattttttcggttaaattttttatgtagatttttaaaattaattttaaaaattaaaagttttttaatattctttaattaaataaaaccgacaatttaatttaaattgtgaaatatttaactaaaaatttaatatgtcattttcagttttaaaaattcaaattttcaatttaatttaagcatatttattttaaaaattcaaatttacattaatttaaacatttttattgcaattataaatttatcagcggaatttttgctcttttccatgtcgcttttgacctt

SEQ ID NO: 37611 - DNA, 1395 bp, Heterodera glycines
gtttcattggcattggcaggtgcggtgccaaaaataaatatttgtcgaataaaaataataaaattaattagttttcgttcttaattagggtgggttcaaaaatttaataaaaaactaagaaattttttataagaaaataaaaaatctagcaatttttcaaatgaattaattactgtttttttcaaaattttccaaaaaataaatcgctgcgaaaatttttaaaattttcgcaatttaaaatttttttgtttttttttcaaaaaaaaatttattcggggataaacgttagaagcccccagcgggtcttttcaattgataaagctccattgccgggagttaatcaacagacggttttctactgtagttcttacaattagcagaaaaatacagtaatttcaaaagattcaactaaaggtacggtatatgtttaattggttggtttaattaattgattaattggttgccaattaacacaattcaaaatcacagtgcattcacttcgtgccgtccccgtgtcggctgctcgtcaaatcacccaatttgctgttgaccatcaccttccactgcacatacatttggaggagcaaccggcagaattttaatttaaataataatatttaaatattttattgaataatcgatgtttttttgccggaaatcgaataaatgaatggtaatgttagggggttcgaaacgggtcaaaatggatgtcatatatcctcttttttaaatgggatacaccatctaaagtgttaccaaattgattttgaggccgaattggaacaatgcgtcctgaccgactcgcaggggcgtgagccaagccaactgttgctccaagaaattctgccggtgccatattttattgaaatttgataaaaaaaatttcaattcgggcaccacctttttgaagccatcgccgcgtccactggactttctcaccgttgtccactgcacttacacccagcgccattccatggatggtacggccccgtaattacgaatttagaaatatatgggaaatgcgttaaccattaattgccggccgactttttgttttcgggaatagggttcggggatttgttttcgagtgacgaatgtcacaatcatgatcgatcagtgacaccaaaagcccctggcattgtattatacaaaattctcaggacatttgtttggacaacattttttaagacatttagacaatttttcggggcatttgttttttgttcagaatttgctgctcgcggtgcccacatttgtgtgtgcccgtgcacggaaggctttctcggcgacggagtgccaaagctggcggctggcgatcgcttatgtgtgggcaccgattgcacaatcgaaatcgtacattaattagtaactttattttaaaattgtttttcattt

SEQ ID NO: 37612 - DNA, 853 bp, Heterodera glycines
attcatctccctttttgatagaaaaagcatcagagtgccttatgccccgaaaacaaaaaaatcgattttttcaagtgtccgtttggggtactcaaacaattatggggagcaaaaatccaacgcaaaaataaagtagaggctatagcgaagctattcccgaaggattcggtctccacataaatctgggcgcatcggttcggggggactgccccgaaaacaaaaaaatcgattttttcaagtgtccgtttggggtactcaaacaattatggggagcaaaaatccaacgcagaattaaagtacagactatagggaagctattcccgaaggattcggtctccccataaatctgggcgcatcggttcaggggactgccccgaaaaccaaaaaaaaaatttttttggataaaaattatttaaatgaactgactagataatatttaaaataggttatttctcttcctttcagtatccctgcaaagtttggtgcgcttctgatcagtttctgaaaaaaaagttaagcctaaactttttggcctgtttaaaaaggaattaaaaatttttaaaaattttattcatctccctttttgatagaaaaagcatcagagtgcctaaactaacacgaaaacaaaaaatcgattttttcaagtgtccattttctgaaaaaaaacaattatggggagcaaaaatccaaggtaaaaataaagtagaggtatttttttcatttatcaccgaaggattcggtctcaccagaaactcaccaaatgttcggggggactgccccgaaccctacaaatgcttataaattttcttagaattttttgcctggaggaacacagttcttcacacttaccaca

SEQ ID NO: 37613 - DNA, 1728 bp, Heterodera glycines
  misc_feature (14)..(14): n is a, c, g, or t
  misc_feature (125)..(125): n is a, c, g, or t
aggatcggctgacncacattcaactgctgttcacgtggacccttctccacttcagtcttcaaggatctcacttgaatatttgctactaccaccaagatctgcactggtgaagctccggccgggcncacgcccaaagccttcaacgcaaccaccacgaccctcctacacgtcatggccagactacgcgacaagcacgtgtacaagccaatgacggtggagtataggtggcccgctccagcgccatccattttcagggctagttgattcggcaggtgagttgttacacactccttagcggattccgacttccatggccaccgtcctgctgtctatatcaaccaacaccttttatggggtctaatgagcgggcactttggcaccttaactccacgtttggttcatcccacatcgccagttctgcttaccaaaaatggcccacttggagctcaaacattcaacgcctgggttcagagtcaagcaaccctggcttcatacccatttagagtttgagaataggttaaggacatttcgtccccaagtcctctaatcattcgctttaccgagtataactgcttaacgagctccagctatcctgggggaaacttcggagggaaccagctactagatggttcgattagtctttcgcccctatacccaagtcagacgatcgatttgcacgtcagaatcgcttcggacttccaccagagtttcctctggcttcatcctgctcaggaatagttcaccatctttcgggtctcagcgcatacgctctgtctccgccccatcgcatgcgatcgagacgggactatgttgcgccccaacaccgcagtgccagggatcacacatcagctccgtaagaagccttcactttcattgcgcctttgggttttgaacacccaaatgacttgcgcatacgctaaactccttggtccgtgtttcaagacgggtcgaacagatgaccggcttttacaccgagaacgcacaactgagagcccgagctggaccgaactggttgctggtacgtgtcgcacgcgaccgccaccgacccccagctcgagtcaacacggacccgaaaccattgcacaattcacccagagtaaacagcactcccccgatccgggtaccagaccccgaaaggctggcctcaagaccgagctcacgcagctactccgagcatctcagcgcactccgcctgcaaatgccccattcgccactgaacagaaggacagcaaaccccagtctggaggctagcaggccaacgtacagcaacaaacgggtgaatgcagaccagatacgccagctctgtccgtttccacctcatcggtttcacgtcctctttaactctctcttcaaagtgctttgcaactttccctcacggtacttgttcgctatcggactcgtggccgtatttagtcttagatgaagtttaccacctgatttgggctgcgatcccaaacaacccgactccaagacacgtaaagatgggtaggcaccgccagttggacaggtcttgcaccttctctggagccccggtcaagggaaacttgaacaagcgggccaacccaagctcacggtctatacgctacacctcgcaaccccagaggagctgcgattcagcgctggactcttcccagttcactcgccgttactacgggaatcctcgttagtttcttttcctccgcttactgatatgcttaagttcagcgggtgttcacgtctgagttcagg

SEQ ID NO: 37614 - DNA, 1069 bp, Heterodera glycines
tcgttggcatttgtgccggttgaagatctgacgttggcattggccgcgttggaaacttttttgccggacccactccagggcgtacttgactggtcagtgcatgcaaattttggcgcgcgcgcattttgattcattcaaaccgcgcggattgggttttggcatttttatttagacgggggggtgctcgcgttccatttttggctaaaatgcttgttgtcaaaacaggtttgtgatcaactacattggccgtccccgtttcgatggttctcgctcacagcccaccttcccgcctgagcaatggagtgtgcatcaacgggtgctggaacatgtggactggaccaacaatgccgtgatcacattccatcgccgactgcagggccggctggccactgggtgcatcagtcaggtgcagttttgaagggcaagtgggaaatgcccccaaaacccaagcgagccaggcccgtagttgtgtttttggcggcactatcaaatttggccattcttttgccactattcaatttggccgttctttttggcactgtccaatttgggcatttctttcttggcactggcgaatttgggcattcttttttggcactgtccaattttggcatctctttttttggcactatccaatttggccatttcctcccccctcccacacttcacgccatgctttccttttagacactttggcgctttgttgacatggtgcgcaaggagcagcgggtggtggacgctgaatttgcgagcttcgtttccggcgaagagccgccggcacgaccccgtaaaagtctgaacgcggacgaacgcattgtgcgcctagttcaaagctttgccaacatgaacagtgtggcggcgctaccaaatgcgcaccattacgcggcacggccgccccaaaacccgaacacaataatcgaatttctgatcgccatgtcacgcaattacggggccgaactttgaagaacataacgaaacgagaatctgatttatgtctaacctgaactgcttgtccacccctccaccaaaaggtcgagaaaaatttcaggaaaaaattcaaaattttaag

SEQ ID NO: 37615 - DNA, 747 bp, Heterodera glycines
ctcgtcgttcacgtaggctcccatctgtacgatttgcctcgctcccctctccatctcatcgatcatctccgtcaagatcgccacgttatccttagctgccggtaagtgtagcagctgagcccgaattgcacgttgcaagtcgtttgtgtcgccaaatcgctccttcagcagttgtacctcaaccgggtaattgccatccgatggtgggtacacctccaccgctctccgcgccggcgatccttcttttaggcaccgcagcagatgaagctgcttttcgaatcccgggattggtttgtcgtccaccgcccgctggaagtaggcccaaaaggtggtccaatcctccggtttcccggaaaacgtcggtggctgcaatcgaaccgtttcgaaagtcgtcaatgtttctgctcgagtttccgaacgatggtgatgtgagggagctgctccctgagttcggaggcgttcccgagtgggatgctcctccctccgagtacggacatgataggatgcccgagggaatgcttgtccctggtcattgagcgtgagtcgctcaaatcgttgctgttcggcttgcatcggttgctgagcttgtggctgctgttgcgtcgggggttcgttctctcccccttggttcctggccatccattccctaaccgggttgttcactcgatcgctggccactgagggggcatttgggcggcgttggataagtgcggccatgtttggcatgacggatggggccaccctgtt

SEQ ID NO: 37616 - DNA, 1756 bp, Heterodera glycines
ataaaagcattttcatttcttgagctcttttctcccataaatagatttttctttctttcatattcaatcggctctcttcaaaattgatttttgtataaaattcaaactagcgggtgcgtgaaccgtcggctatttagctgggaaaaagcgcttcgcgctttcggagcttcgctacctagactgtgaagcgattcaaattgatcgaattggttggagatttttttttgaatttttaaaaaattattatgggtttttagtccacatcgaggctcaagacgggcgcttcgcgcccgtttttcaatttttgttggccttggacgggcgcttcgcgcccgttttttaaatccgttgaactcatacgggcgcttcgcgcccgttttttagcttgttaggccgcttcgcggccttagtcgggcgcttcgcgcccgtttttcaattttattggccttggacgggcgctttgcgcccttttttaaatccgttgaactcatacgggcgcttcacgcccgttttttagcttgttaggccgcttcgcggccttagtcgggcgcttcgcgcccgtttttcaaattattggccttggacgggcgctttgcgcccttttttaaatccgttgaactcatacgggcgcttcgcgcccgttttttagcttgttaggccgcttcgcggccttagtcgggcgcttcgcgcccgtttttcaaaatttgttgaccttacagggattagaagaggtacaactgtgattaggagaggtacaatggtgattaaaagtggtacaacagtgatcagaagagtacaactgtgattaaaataggtataacagtgatcagaagatgtacaatggtgattagaagaggtacaacggtgatcagaagaggtacaccagtgatcagaagaggtacatcagattagaagaggtaaactttgattagaagaggtggaacaatgattagaagaggtacagcagtgattagaagaggttcaacagtgattagaagtagtacaacagtgattagaagaggtacaacagtgattagaagagatacaacagtgattagaagtagtacaaatttgattagaaggggtacaacagtgatgagaagaggtacagcagttattagagaggcacaacagtaaatagaagaggtacaacagtaattagaagaggttcaacagtgattagaagtagtacaacagtgattagaagaggtacaacagtgattagaagagatacaacagtgattagaagtagtacaaatttgattagaaggggtacaacagtgatgagaagaggtacagcagttattagagaggcacaacagtaaatagaagaggtacaacagtaattagaagaggtacaacagtgattagaagtagtacaaatttgattagaaggggtacaacagtgattaattagtaaattcattaaattaaaatgaaaatattttttaacaaatttaatttaaaaaaatacaagaaattctatcaattaaaaaaataattaatttaaacttataaaatgtattcatcaaaaaaaaaattaatttaaatataattttttatttattaactcaacaaaatattttaaattaattaaaatcattgaaaataacgtaaaaatgcacagaaaaataatgttacaccgtccggactcgaactttgccccccccccaaaatgatgcctcagaatccccatcacacagggattctgaggtcttaacgatgtcaaaagtaaaatctgatcacatatccatga

SEQ ID NO: 37617 - DNA, 957 bp, Heterodera glycines
  misc_feature (22)..(22): n is a, c, g, or t
tcaacatttgggcttaaaatcncggagaaaagtcaattgctttaatgttttcgggatttacctatagaattaaagaataacactgacaacttattaactgaaaattataggtgaatcacaagaaaattcaacattcgggcttaaaatccggagaaaagtcaaatggtgcaatgttttcgggatttacctatagaattaaagaataaaactgacaacttattaactgaaaattataggtgaatttgggcttaaaatccggagaaaagtcaattggtgcaatgttttcgggatttacctatagaattaaagaataaaactgacaacttattaactgaaaattataggtgaatcacaagaaaattcaacattcgggcttaaaatccggagaaaagtcaattggtgcaatgttttcgggatttacctatagaattaaagaataaaactgacaacttattaactgaaaattataggtgaatcacaagaaaattcaacattcgggcttaaaatccggagaaaagtcaaatggtgcaatgttttcgggatttacctatagaattaaagaataaaactgacaacttattaactgaaaattataggtgaataacaagaaaattcaacatttgggcttaaaatccggagaaaagtcaattggtgcaatgttttcgggatttacctatagaattaaagaataaaactgacaacttattaactgaaaattataggtgaatcacaagaaaattcaacattcgggcttaaaatccggagaaaagtcaattggtgcaatgttttcgggatttacctatagaattaaagaataaaactgacaacttattaactgaaaattataggtgaatcacaagaaaattcaacattcgggcttataatccggagagaagtcaaatggtgcaatgttttcgggattacctatagaattaaagaataaaactgacaacttat

SEQ ID NO: 37618 - DNA, 1199 bp, Heterodera glycines
cggcacaacaaatgtaagatagggagagagagaatgcctcttgtttaattgaattcattttcccacaagttttacctcgtcgcccacaatttggatcggtcggccgagaaagcggtgatttttatttattttaatgaaatttattccgagcgaagcaattaaattttattaatcataattagtgcatttgattaaggcaattgcaattgacaacattcgagtggccattgtaagtgaatttagagtagaaattcaattacttaaacatttatgccccgcccccatcaattaattgcccaattagtgcgacccccgggcagtctttgacccggaggagtccgattacgccgaattggctgaaggcgaacggatggccgtgccgcatgcccccataccgtcgttcgctgcagaatccaacgaattttacgcggatgaatcgtccgatgggagaagggaaacgacctgatcaaacaattgatcagatatgatcgatggcactccaaaaatggattctttgatctcattagcccccacccctcaagcaataattgattacactaattaatgtctttcgtttcttgtcgcgattacctccaaatgaatttcattaacaaagtaaaaaataaaatattaattaaatcagggctggcagatgaaaattttcaaaagcatcatttggcaggcaaaaaagcctcattttgagtcaaaaagccacaaaatgaggataaatcctcagatctgccagccctgaattaaattaatactgtcgccaatctttatatttccgccgcgcgcttggggatgggggtgggccaagctgaggcgggattggttcccgctcctcttcaccgctctcgtccctttttcctctgctcactccgctcgctgtgccgtaaagggaatggccccctttttcgccgttcgctctgatgggtctgatgctgctgaccgatccgatcagcgccaaagggggacgagaatgggaggggggaggggtgacaatgtgcagcgatttgctgcttgcttaacggcaccaccgacaaagtttggcgaagggcttgtcggacccctttgactcgacgaccacgggtttcgactcccgttcactgcggcggacactccggctggtgggagtccgctatgatcgatgcgcgcttctccggctggtgggagttgcgctgacgaacggcactgtcctt

SEQ ID NO: 37619 - DNA, 1063 bp, Heterodera glycines
  misc_feature (34)..(34): n is a, c, g, or t
  misc_feature (980)..(980): n is a, c, g, or t
  misc_feature (1038)..(1038): n is a, c, g, or t
atcacttcatcaaattcgtccgccattttcgccncccttcgttttgcttccgtttaaattgtccgtttcagtcgtccctttttcctgcttcatttctcgccaccgtcttcctttggcttccttcccaaatccttcaattgcccggccgttcctccgaatattttaggcgttcgacctttgcccaccccgtgggcgatgggagtgttattggcgacattaatatccactcgacgaagcatcttttaagcagtgtttaaaaagcgtacctgaaaaaatgctatgtattagtcgaaattaatgtgaaatgccaagaaacaaatggcaaaatcgtaagccataaaaacatgctcatttgaagctttaaaggaataccagcaaagtccattcaattgttttattttaccaaaaaattaacaaaaaactttattatttcgtatgtatcacagattcacaatttaaaatttagagacattcaaagatcacaacaaatcaatgccaatggttatttatgcaaaaagagtccacaaaagaacgtagagaacagaagtcagaattgacagacggaaaaggaaggcggagaaagaactttgagtggggaagggaaattggtgaacctgaaaagtgccacaatttgttttagtatttttttgtggttaaacacctgaattgttcggtcaacgctcacagagacaagggcacaacgaaaatcggcgcaaatccccggcaaaaaacagcgctttgaaggcaaattgtgcgaaatagtttcaccgatatggcctaaatctttgacgtcgcacgaccgttgaggcaaaaatgaaagggcggtgacaaaagagcaatgagtttggcgaagaacagacagaggagagagcgaaagtgtgtcgaatagcgcgacacttccgcccatcgacccaaccgcggagaaacggccacactcactgagttccaagcaagaaaccgtctaaaataacgtaaccgcnagcattggattatcaccatatttttatattcatttaaatattgtctgttacttctttnaaagcgacttttgttccgaccattc

SEQ ID NO: 37620 - DNA, 1014 bp, Heterodera glycines
tggaagcgctaaaatgtttgagaagcttttgagcgtaattacgattttacttagaccattttttctaggcttagatcacatgcgattttcggcactctgataattttagcgctcataatgggatgtataaaggcgattgtagaaggaattggaagcgctaaaattgtttgagaagctttttgagcgtaattacgatttttacttagaccattttttctaggcttagatcacatgcgattttcggcactctgataattttagcgctcataatgggatgtataaaggcgattgtagaaggaattggaagcgctaaaattgtttgagaagctttttgagcgtaattacgatttttacttagaccatttttttctaggcttagatcacatgcgattttcggcactctgataattttagcgctcataatgggatgtataaaggcgattgtagaaggaattggaagcgctaaaattgtttgagaagctttttgagcgtaattacgatttttacttagaccatttttttctaggcttagatcacatgcgattttcggcactctgataattttagcgctcataatgggatgtataaaggcgattgtagaaggaattggaagcgctaaaattgtttgagaagctttttgagcgtaattacgatttttacttgaccatttttttctaggcttagatcacatgcgattttcggcactctgataattttagcgctcataatgggatgtataaaggcgattgtagaaggaattggaagcgctaaaattgtttgagaagctttttgagcgtaattacgatttttacttagaccatttttttctaggcttagatcacatgcgattttcggcaatctgataattttagcgctcataatgggatgtataaaggcgattgtagaaggaattggaagcgctcaaattgtttgagaagctttttgagcgtaattacgatttttacttagaccattttttctaagcttagatcacatgcgattttcggcactctg

SEQ ID NO: 37621 - DNA, 1118 bp, Heterodera glycines
gaaaaacacattaacattttctcccccattcccaaaaagtctcaggaaaaaagtgcccggaagaagcgttgtgaaaagtaaaaaacacaattatctcaaaatcgcaaaatcctcctttttcggtgaaaagctgttaacaaattacacccataattttaaatatcgttcaaatttattccggtgacaaatacaagccatttgaataaatattaatcatttttcattgcatataataaaaattttaaatgtccttggatttcatcaattttccccattatgtacttgaaaatcggcatacccattcttggaaacggatcatggacgatggcagccctgcataaagccaagcctttgtctttggatcctttgtgaggacagcgacaacgaatatattttaaaaatttgatttaaatagcgctacatagattatggaggaaaacaatttttgacccctaagaaccaaacccgtttaattgcatataattttatttcaaatttttttatttttaatataaaaataaattaaatttttgtttattttttaaaacaacaaatatatttatatattctttcaataatattcgaaataactttgaattcctatttttttttttacatatttaatatttatcattttgtaaatagacatttatttaaagttatgttttattaatttttattttgttggtataaataaaaatgcttattcagttttaaatttgattatcacactacttaagtaataataatatgtttttgaatattattatttttttatttaatcaaatcactcttgttaagttctgtctcttttttaaagttctgaagaatagctttttatcgttttgaaaattttataaaattttattttgatttactaactatttgttgggaaaggtactcaattgttccgcttattttatttatttcctttctattttgccctcccccactctctctgttctcccttccataaatacccccgtccctttgaccatccgttcattccctcatttatttgtatttgtgcactttctcccaatcgatatttgcccccattttctcttctttatttaaattgtgtcttcacccacctttgaataaataaatatttattc

SEQ ID NO: 37622 - DNA, 1698 bp, Heterodera glycines
tttttttctgaatttgtaaaaaaattaatttcgttttaaataaaataaataattaattttcaacgttgttttttattaataaaaagagtatttaaatttaaaaattttttaaattaaaatgcattcgatttttaatattaataaaaaaaagttcctatttatttaattttaaatcatgttgacctttttcacgttgttgtgccacttctaataggcaattgcctaaaaaaggaaaccctagtaatttgcaattccatgcagtttttcttatttaaatgcgatttgatgacggcgtctgacagcggacaatccgacagtaaaataaaataccgtcgccgaagggaagcgattgtgccatagtcctaggacgggcattcttgtacgatggaatggcaacaaaaagtgcttatgaattcaacaaatgtgcagccatcgcttaaaaatagcaaaccaaactaatttgcatcataataatttttagactgcatccacattttttaatgatgcccacaggcaaatcaaatgctataaaatagtaattactgcatagaaaactatcataatattttaaagcattatgctggcgcgtttcttacaaatgcaaattatgcccatttttcgattttaaacaaaaattggcatggttttgcttaaagaatgcaattttaaacttttcgtattattcgacagtcctgcgttttttaatttgccttcaaaaatttcaaaaaaaaaaataaggaattcgaaaaatcgtaatcgagagacagtttaaaatttggttgcttttgagcaaaggtatacgatttttaaaacaaatggaaaagattattgcaaaatgttatgttcaccctaaaacagattttttatttttcaaatgtaataataattataattttacagaaaatgtattttaatttgcttttgttttgtgcttttttcgtttctttggcgagaacagcagcacagaccgtccaacaacatgaacatgttcatttgtggaaaatcactcactccgaaatgaaaaagccgagttatttgcttggtcagtttatttaataaaatattaaaatgtgtgttccccttcccttcccttaccgtagacaaaccaatgcaaaaaagcaaaagcaaactaaataaaaattttttaaatttttaaaacatttccctgatcaactagctgaataggctcacaattaccaattagcaggttccatattttgacatatgtttgcattctggactttcgggtttattccaatttattttctttacatatctaaaataatactctaattaagcttatttaggtacgacgcatgtcccatggaagatactgtataacaaatgtaagttcttcaattactgtgccgttttacaaaaatgacgaatttttattccaaataaaagaggagttcttgggaatgccaattttacttgggtaataaattcgaaattttgattttcctaattcgagaggctgcatttcctgctgaaggtaccggccactttggcaccgttagttaggcgtcaaacgctataacatttttatttgtcatttcattagataatcatgcaatgattttaaagcgctttaaagacactattattatctactaatttccataagcatttttcagttccaaaaaatataaaaagggcaatcctcgagacggattttgttgtcactgaagcaaacag

SEQ ID NO: 37623 - DNA, 1313 bp, Heterodera glycines
  misc_feature (1077)..(1077): n is a, c, g, or t
tgaattacttaatctgaaggtgcttaaagcgaatttttttgggcagcggacgatcgggcaacggaaaatacgcagaagtgccataattgatggtaatcacagatagcttcggttttgttccaatgcccttgctaatttcgattggtctccaaattgtcaattcgcttttgccattgaaatgtttgtccaccaacgcattgaaacgtggcgaaataagtgccaatttgaggccaagttgagcatggtcaaaactggggaaaatgtccatccaaacgtcgttgcaaatccaactgaaatgggaaaacagtttagtcaaataaatgacgaatttgtgacttttaaaagccttttaccgtcggttcatttttgaggcaattagcacaatttggacgagttccgaatgatgtcacacaaatagcagaagaattaattgcgttggaagttttatttttatataatgagaaaagcggaaaaccaaaaattttaacgaaaatcacattttatccaacaatttttgaattttgttcgtcttaaattgttgccaatggccaatgggaggcgaaaaatcattgataaaaacggaaggcgcggaaacattttgacataaaaaggccaaaccgttttttattagcctataaaatttcaaaaagtttcgttaagtttcaaaaaagttataacttgagaagctcaaaaaaccaagttttttacaacattttagctcataactttcttgaaacttaacgaaactttttgaaattctgtaggctaatagaaaacatctagaactatcgaatgatataaggaattaaaaatttgattgattttcacacatgaacgcggcgaattgctgctaattttcaccaattgctacagaagaaatattatacctaatttattcaaattaacaaaaaacggaattcctaggccaaaattttcacaaattggaggtacttttccgttattatgcatcccctaaaaatgttacgaccaaattctatttatccccctgggggataaatggagactgggggattatttttcaaacccctcctagactgggggattaatggagattgngggataattagagcaaatacggtattttaatgcggtatttacatatagattttcagcaaaatatgtacagtagcccaagccttaatggtgtcccgctcaccgcactccttttccaaattttttggacgtttttaaaatgtaataggtaaaaaatgagaaaaaggggcacagtaaaaaaagaatggatgggaaatacgggtatttatctatttatataccggtgggctggtcatttt

SEQ ID NO: 37624 - DNA, 1386 bp, Heterodera glycines
aattacttaatttgaaaatgagttgcactacagtaagccgttatcccttccttactgtaatgtttggaggcaatttccgcacccgcgccctctcacgctcgcgctcgatttcggcccaataaagcctaacaaaatgttttcttaatttgggaataaatttatggggtttaatttgtgtttcccttttggcaaaattaattagctgttttttcatggactgaccagtccggtgaatgtcggttgtcgcgaagttggcggacgtgaaggcggcagaaaagttggcaacggagtcgggccaatgcgacgcgtttcatacggtggacggcgaggctttgtaacggtggaaggcggggtctgtgaagagtctaacggcacggagggcgttgttgtgttgcgcaccaatgccgttgggttattaacgcccacggggccaaattggacatggacggtgaaggaggagcctaaagagggtaaatccgattttttcaaaattgaggctcgactttatggcaaatgctcctcacttaccccccactgtcacttggccattttcgtccctctgttcgtcttcaccaccaccagcagcattcttcctgtgccgttgttgttcttgccacatgacttctgtactattcgtcgcagttggtgtttttgccgttgcaaaaaaccgttgcaattggcgtggcgttgagaagtttcggctcagaaacggcttcggctgttgctgcttactcggtgttcctttcttaatggcatttaattagtcggtgttggtttcttaattactttaaaatgcatttgtttttgtttttattttcgtttgtccccaccctttgcgattgtttgcgtttctccgccatttttgccattgtcgcgcgcgacccgtgccgtcgtcgcctcccccatcgacgaacatcatcaaagacaccgccgcgggggttgggcccgtcgttggcatcgctgtcggcatgttgtccattgtgcgcgaaatgtcgcggatattgtccaatttttcgaacagagaataaatcagagttgcctgacaaacggaaagcgaaatttaattaaataaaagaaatactaaaatccaattaaatttattaattatgataaatgtcgataattaatgatactttatagcggatttgatgaagcgaagaggcgaaagctgaaatgaaataaaggggaaggggtggataggagggactactctttttggacgaatgttttaagcgatgaaaatttattttttgccaacggtaattgcggtaagccccccgattttggaaattttgccgcttcctcgaccacgattgaaacgcctgtaagcattttgctcttgacgggggtgaggaatgattggcgatggaatttgcacattgagca

SEQ ID NO: 37625 - DNA, 447 bp, Heterodera glycines
tttcggcgctagttacaagaaggacctttttgaatttttttccctttttgaaaattttttttgttttatttactcataatatgaacattaaacattaacagtacaattatggcgaataaaaagtatattcacgattttttatcaaaaaaaaaattttgcaaaaaagggtccaccctttggtttttgataaaaattcaaaatctaaagtctaaaataatacctttttgaatttttttgcacttttttttcaattattaaataacgtgaaatgcgtaccatctggtaaaaaaataaattgtgtaaaaaaatttttttcaaaaaagtgaaaaattttcaaaaaggtccttcttgtaactagcgctgctttttctaagcaactgctaaccgatttgatgagtctctcggcgaaagtggacaatctatcggcgaaagtggacaatctctcgg

SEQ ID NO: 37626 - DNA, 684 bp, Heterodera glycines
gttggatttggatatcgaatgcaagagttatagtggaaaaatgtgcgctcgtactattacgaaccgttctaaacctgacccctggtcgttacagcacatgaaaataaaataagtaatactagtagttaatgatcaccatttaactaataattataacaaagattatataaattgttattattatagtaagaatattttattggtccatctacaaaatatatgaactatcttttaataaatataaatcgtaaaaatataattttattttattttttgatataaatttaataataaaatgtaaattaattattttaattagaaaaatagaagaattataaaagaaattgaaatatttgtaattaaagtagctcatatgtaagcatgaataaactagaatcaatatcaatattaataaaaatgcatatgcgaaaataaaaataaatttattatgtaaataaaaaaaatttcttaaataatttaatataaatacataaattattgcaaaatacatcattatagttagcaatataaattttaatttttttgctaaataaaaataataattataatttgaaaaaaaacattaaataattcacaaatataattttaaatctatttattattaatattaaaaaagaaataaaatatcttaaattaaataattgttattaaataatttataaa

SEQ ID NO: 37627 - DNA, 849 bp, Heterodera glycines
aattacatggttttcttcaaatttacttattcatttactaaccctatctaatgattgattgatttcttttgagggttttttcctagtaatttttaaatgtttttattttatttaaagcttactcacttttcaatataatttttttatattcttttattcttatttttaaataaaataaatatacttttttccattcaagacttccttgtcatttctcgcaatacaatcggaagcccagcagatgcccaactcgtcgctgcgactccttgcgccccaacccgttcacaacaatcacttaccccagtcagaaacaaactgtgttggagtgtttcagaaaatgatgagcgatgacaaaattttgctgtgattttgatggtcgacaaaaattccgaatgctttttttatttattaattgatcggaataaaaaaacggcgctatatggagagtcaccgattttgaaaattacttacactttatttgtatctctttatttttgttaagattctttcattgatatgagaagatattacaataagataacgctgaattggaaccgattgtataatgcgatggtctcattgtgaatttataaaaatttattttaaaattacattatttaatgaataaaatattaataaaataatatgagtccttcattttcgtatctacgtctggagaaaatgaacaacatatatatatatatatatatatatatatttaactcaactgatctattagatgaaattatctttcctcaatcataaataaaaataataatattcaatatattctattttaaaattaaaaatcattaaaaaatataattattgaaaaatcaagctttacat

SEQ ID NO: 37628 - DNA, 950 bp, Heterodera glycines
cttttaatcgtctcttttgcgtcccttaatctttcagtgagccgagttactgcggtctaaacacgtttttggtagaattgcggccagaatttaaaaatacagtttgctatggcttcgcatcacccgcttcaacgggtgctcagtgtaaatatcgactggccattcaaattctgcctttccagccttatggaaagatattatggaacttttggttccatctcagttgtcaacgccgcgactgcatcgttattatatcagtcgatagaattttcgaatcgcttttaaatcgtctcttttgcgtcccttaatcttcactctgagccgagttactgcggtctaaacacgtttttggtagaattgcggccagaatttaaaaatacagtttgctatggcttcgcatcacccgcttcaacgggtgctcagtgtaaatatcgactggccattcaaattctgcctttccagccttatggaaagatattatggaacttttggttccatctcagttgtcaacgccgcgactgcatcgttattatatcagtcgatagaattttcgaatcgcttttaaatcgtctcttttgcgtcccttaatcttcactctgagccgagttactgcggtctaaacacgtttttggtagaattgcggccagaatttaaaaatacagtttgctatggcttcgcatcacccgcttcaacgggtgctcagtgtaaatatcgactggccattcaaattctgcctttccagccttatggaaagatattatggaacttttggttccatctcagttgtcaacgccgcgactgcatcgttattatatcagtcgatagaattttcgaatcgcttttaaatcgtctcttttgcgtcccttaatcttcactctgagccgagttactgcggtctaaacacgtttttggtagaattgcggccagaatttaaaaatacagtttgctat

SEQ ID NO: 37629 - DNA, 126 bp, Heterodera glycines
gaaaaacagcgccacaaaaaaagcgacttaaaaacaaaaaatttaaaaaacaagttttggtcattttttgaataaaatctgttaacaaatccgaagacaattttcaaaattttttcggcggcgcct

SEQ ID NO: 37630 - DNA, 987 bp, Heterodera glycines
tttttccccccccccccatttttccttttttcccttcccccccccccattcccccccccccattccctcgtcccgttcatcttccaccgccaccgccctttttccgtccgtccgtctccgggcttccaaccacacacaacacaacacacaaacactcactcactcacctcacctcatttccctttcatttccagtcagctggtccgccaattcgtctggcaaaaagagagaaaatgtaaaagagcccccgcggggtggcggagggaacaaatgtcgttttgtgtgtgtgcgttgcgttgtgtctggatgggacgatatggggtggcggatcttagccgacgatggcaatggacagacggacggactgtggcaagaaattcctgtccttctcctcactcccctcgttttctctgtaatgcacacactgtttagcagtcgctctgtttctctaagtttcatactatcttgtcaccctatgacttctctcccccgtgtttctcggtccgatcattttatttcacttttttgtctgccaaaaattctttcttttctcacaatattttacacatcttagcccccctctctgcactaacttgtcactctctcaatgcctctctgctgtgctattttaccgcactttttccaccctccgtctgttcctccctctcccttcatgcagaagaagacgaaaaaaagtgaatgatgagggaggaagtgaagtgaagaatgaatgatgtgatgggtggtggtggtgcaattccatagaattgttcctcttcttcccccattttcctcctcttccgccccacccccgaggggatgtgctgctcccgcccccttctccccctccctcgcaccattgtgtactttttggcaccccttctacgccaaagaggggggtggcaggggggatggagatgaaatgagacacatgcacactgattacctgcgtataaaaaaaggtaggacaaaaaaatggggacggtg

SEQ ID NO: 37631 - DNA, 850 bp, Heterodera glycines
ctgtgaccaggacaattggccgacacattgctgaacctcatggttggtggtggcattaggggggaaacggaagcacccccccccccccccggatcatttcccccatcatgtttgtattaaagcagttgtcacacttaccgcatatccaggaataatgtttatcgcttaatgtcacaaattttgtacttgatgaaagcgcacaaccatgtgcaaacgtatgttagagaaacaaccaaaagcatctggagggtagttctacttgactgatttttgttccaagcctactttactcagtctgtcatccgtatgaaacaacacaaaggcgctctggttgacaagtgcgtaggcatattggataaacacaagcttacgacaagtatgaagtgttacaaaattagagctccaaaagaaatgactaaatattcattagatatattgtgtacatgcgtctaggtctaaattattctaagttgaggaacggactacccctgtttcctcgaacagaggaagtgatactgtatgaatgttgccagaacccgcgacgaactgtaatagtgttacactgagatgaacaaagagaagatccattattacacgcatagtcgagaggcggcacgctcttttctgatataaccataataaacatgttcataactccagagaggggacgactttgtatgaggtaagttatattgcagctactgatatactaattgaaaaaatgtatcatgaaatattactcgtataagtataagttagatagattctcttaattaattatatcgccatattatatgaatagaaaaaatgaaaattttattataggaccaagcgatacaagggatgatat

SEQ ID NO: 37632 - DNA, 872 bp, Heterodera glycines
gaatattttacgtgtcaaagggtgtgcatttaagcgactcgctgtgcttgcccactgcatttcaaatagctggtaatttttatttctccggcctaatccagaaaaaatcactatctctttttttggaatattttacgtgtcaaagggtgtgcatttaagcgactcgctgtgcttgcccactgcatttcaaatagctggtaatttttatttctccggcccaatccagaaaaaatcactatctctttttttggaatattttacgtgtcaaagggtgtgcatttaagcgactcgctgtgcttgcccactgcatttcaaatagctggtaatttttatttctccggcctaatccagaaaaaatcactatctctttttttggaatattttacgtgtcaaagggtgtgcatttaagcgactcgctgtgcttgcccactgcatttcaaatagctggtaatttttatttctccggcctaatccagaaaaaatcactatctctttttttggaatattttacgtgtcaaagggtgtgcatttaagcgactcgctgtgcttgcccactgcatttcaaatagctggtaatatttatttctccggcctaatccagaaaaaatcactatctcttttttggaatattttacgtgtcaaagggtgtgcatttaagcgactcgctgtgcttgcccactgcatttcaaatagctggtaatttttatttctccggcctaatccagaaaaaatcactatctctttttttggaatattttacgtgtcaaagggtgtgcatttaagcgactcgctgtgaggcccactgcatttcaaatagctggtaatttttatttagaagggcctaatccagaaaaaatcactatctctttttt

SEQ ID NO: 37633 - DNA, 989 bp, Heterodera glycines
taaagggcatattttccgcattaaaaatgaaattataaacaaatgtgggcctcccccccccccccctttcccttgcttatcgctgtgaatcaatcagatgattttttgtttggtttattttagttttttaagctaccgtatttggttttttagaacaaattgcaattttagcatttttattctatttttgtcactcaaaataattgaaaaataactaattaaaattaattattatttaaaattgatatttcgcttctcagcaaaaatgcagcaaattcccattctttccctctccaatttcctccccattttctcacttatttcggtgccctttttattgtcctttccttccacggccttcggttgctcttgtgcacccaccaaattcaatgagtcaatgtgtgtggccaaatggggtaaaacaaagccgagggataaacaaataaatgaatcaatggacgggtgggaaattggaggaaaattcgacttaatttatggaaatcgatcagcagaatgatcggtttgattgtaaatttctgtttttgttggtcaatttgtccggattaactcacttttttttgttttcattttgttaagtgtcccatgtgaaggtgttgcaaaacacaacaacaacaaactcccaccgcattttcactgtccgacatttggaagtgttcaaagtttgtcctaattaaccaatttggccattaaatagtccattttgacgaaatgcccccccccccatagagtcccaacggcaccgctcacaatgaccaactgattgggaaggaaagtgccgtttggactcccatttttacggcggcgtgcggagtgagagaattggacactgaaaaggaatatcttttggctggtgggctttggctccgttcatggcgaataattttcacgttcatcgccttaggcactgtggacaatttgggaacaaagaagattaatctttgtctgtttattccaatcgaagacggaca

SEQ ID NO: 37634 - DNA, 1049 bp, Heterodera glycines
ttctatcaattaaaaaaataactaatttaaacttataacctttattcatcaaaaaaattaatttaaatataattttttatttattaactcaacaaaatattttaaattaatttaaatcactgtaaataacgtaaaaatgcacagaaaaataatgtacaccgtccggattcgaacctgccccctccccccccccctcagaatccccaatcacacagggattctgagggcttaacgatgtaataattgaaatctgatcacgtattcgtgatcagcggcccaaataaccactaaagacatgtttttggaagatttttgtgaaaaaaaattttcccactcaaaaatcatgtgcacccccctttggtctcgaatctcaaaatcatttttaattttgtaacaattttcaaaaaagtgataaaaatgtaaaataaaattcataaaatcgagcaaaaaattgcggatttttgtagtattttaattttacagaatggcttttcagaactgagttatgcaattttttctgaaaattcgaatttttccagaaattctggaataactttttttcttttgaagatagaaataccagataaatcccataaaattctccttatttttctctatttttaaagctttattgcatgaaattcatcctaaattgaaatgagttacgaagtttcaaaattttacccaaaatcccgagggccaaaaaattgccaaatatttttgaatttttaaaaaattctaaaatttcctaaactgaaaatgaacatcagattcgtgctcagcaccttaaaaatacccagaaaaaaatttttcaccatatttttcaaccaaaaaaaattttccgaaaatttctagggggcctagctcgaaaatttttgaaaatttccggccatataatacactattcgatagcattttaaaagctctacaattttgcactaaggcgttttttcgataaaaccaacccctaacgagttatggacccgggactcaaatgtcccgctcaggccaaaaaaaatttctatttccgggaaaagcagaaatttttc

SEQ ID NO: 37635 - DNA, 803 bp, Heterodera glycines
tttctctctctctctctctctcctcttttctttctctctctctctcctcttttctctctctctctctcctcttttctctctctctctctctcatcttctctttctctctctcctcttgtgacatacattacgaaaattatatataggattgcttatttttaaggtgtggcagccccccgtgggcgggaaagggggcgcttgtggcgagacggatggagcgccgcgagccgccagcgagcccaatgggcaacaaaaaagaaagaagaaaaggattattaaaataatcctcatggtataaattgctaattagaaaaataacttttaaaaattaaggtctttatccccttggcggcggcccaggcggcccgcgccgccgcgaaccagcggcgccgggagaaagaggagtatcgcgactcccagcgtgagtttataaaaaagtggggggggggcaacaaaaatttgtggaattttaatgcataaaatctattcctaggcgagcgatggcttcgtgaggaagaaatcgtcgatgaggcgatgaggcgggacgctgccgcccgccgcccaccgaccccgcccccggagggggatacggtatttaaattttatttaagtgttcccatatgaatttttaaggtttggcagccccccgtgggcaggggaggtggagggcgcgccgtctgagttgaccggctacgaatacaatttgatgggcatcgactcaattccggaggaggattaactgaccaacgagtgggattttagaacattagacgatgacgaattcctcgattatccattatgct

SEQ ID NO: 37636 - DNA, 1035 bp, Heterodera glycines
caagaatttttttcgttagcatttcaaatatcgtgtgcgtgtttggtagagccagactagagaaggcaaatgttggtaccaagtttgcggtcaaatccccaagagaaaaaagagatagccattttttcggcaagaatttttttcgttagcatttcaaatatcgtgtgagtgtttggtagagccagactagagaaggcaaatgttggtaccaagtttgcggtcaaatccccaggagaaaaaagagatagccattttttgggcaagaatttttttcgttagcatttcaaatatcgtgtgagtgtttggtagagccagactagagaaggcaaatgttggtaccaagtttgcggtcaaatccccaggagaaaaaagagatagccattttttgggcaagaatttttttcgttagcatttcaaatatcgtgtgagtgtttggtagagccagactagagaaggaaaatgttggtaccaagtttgcggtcaaatccccaagagaaaaaagagacagccattttttcggcaagaatttttttcgttagcatttcaaatatcgtgtgagtgtttggtagagccagactagagaaggcaaatgttactacataaggcacctatctttttttttttttggtagcctacagtacccttttggggggcgtgcgccggggggggggggcgcggtcggcgtcgcggggggggggacgcggtcgtcgtcgtcgtcgtcgtctgtggcggggggggggacgcggtcgtcgtcgtcgtcgtctgtgggggggggggacgcgatcggcggtcgtcgacgttggggggggggggcgtacgcttgggcgtacgcgtccgaggcgtacgcattgagccttttttggggggcgtgcgccggggggggggggggggggcgaatgtgatctgtgaggcaatgttttgaacttttgtgtggtcaaatcatccattttaaattgtagtttgttttaacgagatgggcgggcggatccccgggagtgtaacaaatggatttcacgttttaactttaaatttgtt

SEQ ID NO: 37637 - DNA, 1342 bp, Heterodera glycines
caatatttaatcattgacataaaaaatttttttaaggtttaaaatataatattttcacaaaaaataaataaagtaaaaatttaaaaaaaaatcataatttttcaaaaaaaaactttttcccgttcccggcgggattcccgttcaaattgacgtgatttttgcgggaacgtgaaaaaggcgggaatcccgccccgttctttttcgttttcccgttcgggtgtcccggaaaaattttcttacagggctctagtttttgagtaacttcatagaaccgaatgaaaatttctctcacttcccttacttttctttccatcttttattaaataaaaccaggggtgccattcgtccttgaatggcaaggccgtcctggaaattgggccctctcacatgaaatttgaaagtatccttgaattcaagatgtccttgaagatgagcattcaaagaaataattaaaaattttaagttttgaccttttatgtcaaatttttattaacttattgcattattggtacataacctggtattaaattgcacaaaaattcccaaaatttttccaggcggcgctatcgacaccgccgggatctctctttatattttttaaattagattcaaaagacacaccaaaagcgttaaaaattatcaattttggaaaaatctattaacaatttcttccccccccccccattcccaaaaagtctttcggaaaaagcgctcgcaagaagtgttgtgaaaagtaaaaaatggtcatccccattatctcaaaatcgcaaaatccgcctttttttgctgaaaatctgttaaaaatggcactctaattttcaaaaaatttaatagaactttccccttacttggaaaccggtatacccatccttggaaagggaagttgcccgacccgagccctgtcttaattgtccttttgcgcttcccctccctctcccattctttcaccatttgttccactttttccaaaagtgtcttctgttcattttgcagctgcgtgaattggtcgatggaagcttaaataattaaaaagtcattttcagaatatttctggtcgttttaaatagggcccattaccgtattccctcttcctccattaccatatttcctagtgctgaattcctatattaccgtagtattcccttgatattaccgtatttgccctttgcgtcctcctcctgcttttcctgctgctccttcttttgctgttgttgttcctggccaatcttctcgacctgcgtcttcactgagctcagctcatccatcatttgctgctgcttcatctcactttgaagtgccttctgaagggaaaggccaaatgccctttttcaatcgttttttt

SEQ ID NO: 37638 - DNA, 1241 bp, Heterodera glycines
attcgcggcctcagacgggcgcttcgcgcccgttttttaggctgttaggcaacttcgcggcctcagtcgggcgcttcgcgcctgtttttcaatttttgttggccttgtacgggcgcttagcgcccgttatttaaactttgtttacctcaaacgggcgcttcgcgcccgtttttttttactgttaggctgcctcgcagccttagtcgggcgcttcgcgccccgtttttccaaattttgttggccttgtacgggagcttagcgcccgttatttaaactttgtttacctcaaacggccgcttcgcgcccgtttttaaatattgacgcggcattcggccgcttcgcggcctcagtcgggcgcttcgcgcccgtttttccaaatttcttgaccttattgggattataagaggtacaataaatggtagaagaggtaaaatagtgattagaagaggtacaacagtgattagaagaggtagaagggtaattagaagaggtacatcagtttaaattttatttttttacaaattcaatgtaaattgaaacatgatattctttaattttttattcaaaatttaaaaattatttttaataaaattttcaccaaaaaataatttaattcaaatgaaaaatttttatttattattaataaaattaaaaatattttaaatgaacaaaaattgaaaaacagaaaataaatggtagaaaattaatgtacaccgtccggatccgaacctgccccctcccccctcaaaatgatgcctcagaatccccaatcacacagggattctgaggtcttatcgatgttaaaagtaaaatctgatcacgtattcgtgatcagcgtcataaaatagccctaatgacatgtttttgaaagatttttggtgaaaaaattttttcactcaaaaatcctggttacccccctttggtcccgaatcccaaaatcacttttatttttgtaacatctctcaaaaaagtgataaaaatgtaaaataaaatttatattatagagaaaaaaattgcgtatttttgtagtattttacttttcccgaatagcttttcagaaggcagctacgaatttttttctgaaaaatcgaaaatttcaagaaattctgagaataacttttttcttttttgtgataaaaaactcaaataaactcccatacaattctccttattttttctctattttttaagctttattcctcgttaaaattgatcaaccccttccatttggtatgaatttt

SEQ ID NO: 37639 - DNA, 743 bp, Heterodera glycines
tttttttgggttttcggggcagtccccctgaaccgatgcgcccagatttatggggagaccgaatccttcgggaatagcttccctatagtctgtactttaattctgcgttggatttttgctccccataaatgtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagtctgtactttaattctgcgttggatttttgctccccataaatgtttgagtaccccaaacggacacttgaaaaaatcgatttttttgttttcggggcagtccccccgaaccgatgcgccagatttatggggagaccgaatccttcgggaatagcttccctatagtctgtactttaatctgcgttggatttttgctccccataattgtttgagtacccaaacggacacttgaaaaaatcgatttttttatttcataaatattttttcagaaaatgctctgaaacgcaccaaattttatttacatgttagtttaggcactctgatgcttt

SEQ ID NO: 37640 - DNA, 955 bp, Heterodera glycines
  misc_feature (855)..(856): n is a, c, g, or t
  misc_feature (899)..(899): n is a, c, g, or t
ccattttagcggaagatgggttcgactttcgcgagattaaggttggttggctctgccatatatctatctgtgataatgtgctcttttcaaggagttcacgcagcttctccattcccctcgacgagtgccgccgccgcgttacatttgccacatttgttatcagcctggccattacatcaggtggtgcagagagagagtgtatttacgaaaggctcatttaaaattaccagaaaagcgacaacccttccaaaatttaaccaaatattctttcttaagtgactgtcccgctcgcttcaacagtccctatgaggagctgacgccgtaccaaggccgcaagaagtttgtttttaggcttaaaaatatatattaagcacaagttacacaattctttcaggtgctatggcgaatttgtgagtgcttttggctctttttttaaatttttaaaataattgacaatttttaaagcaatgtgaacagtgcaaacgcaaatggacatcgcagaacagtgtggcgaatgaaggtgagggagggaggagcaaggaattctgaatgagaatttatgaataattaataattgcgtaatttcgtcgcattttagcgcaaagctgcatcaaatgccacgtgccggtctttccgcacaaacaggttgggtaaatggcacttaattgtgttcaataattaactcctcctttcttccatgttcagcttcccgtggacaaggctgtcgcattgggattggtgagaattttttgttccctttttagttgttttcaaaaacgtatgctgggtcatggttttttggaggacccggaaaaaaaatgagtggtataaattatcccggtgctttccctcagnngtaactgcagcggcttccggtcaccaacattggctccacttcncgcgagaatctcatcgaccagtggaccgccgctggcattttcattgacgacacacc

SEQ ID NO: 37641 - DNA, 1197 bp, Heterodera glycines
atatttcaacacacaaacaggagtgagtttccgaatcattttgaattctccgccggcgacctcatttttattgaaaagcgtaaaaactatgaatggttggagggcgagtgccaatcaaacggccgaaagggcattttcccgcaaaatttcgtggacattgtcgttccgctgcgcgacgaagaagaggtggaggggaattttttttttatattaaaaattggtattagaaaaacataaaaaatatttcctaattatgtggtgagttgcattgaaaaacataaaacaaaattacaaaaaaaaaatgttggtgcaagccgcaggattcgaacctgcgccctccgaagaggactgcgacctgaacgcagcgccttagaccactcggccagacttgcccttgcaatacacttaaatttatttaatataatcaaacttaccaaaaggatgattcattcttttattcgacaggtgaccactgattgtgaattatctcttcctttttcttcttttgcgaatggagccaatgttaacgaccaaatcgggttttattttatgttttttctaatccatgccttggccaaatggttgtcaatttaatattttcagtgttgcctcggctctttacgattttgagccgcgttttgccgatgaattgcgactacgaattggtgaaagtgttcaggtgttggagttggttggcacagaatgggccaaatgcaggtatttttacgaaactttaattttttttggatttccatacaaattaattaaactttcccaaagggagacaacaagcggatttgtcggcattgtgccacagcgttttcttaacattttcttcgatgcgacagccgatgaagaaagtcactttggggaatcgtcaacaagggaaaatgaaagatccaacgatttgaccggtgtttcgttttcacacgcctctaaataaatgcccttttcattttgtcagaccaactcaaaccgtgggatgttccgattttccaatcttcgaatgtccccagcatccaaaaacaaggatcattttcctgtcgctcttctctttccggttacgattccgctcaatgggtcgactcgacagacgccgccatttcccatcggccaccgcctcgtccacctccgccaaaattatgccaaacaacatcggaagtgacgtcacccagacgacactttcatcagtcccac

SEQ ID NO: 37642 - DNA, 906 bp, Heterodera glycines
agcatgggcagaggggcgcggagagcaatggccattctatttccacagggattttttaaatttattctctatgccagaaaaatggctatctctttttcgcgagaaattttgtaccatacaaatgctcccagcatgggcagaggggcgcggagagcaatggccattctattctacagggaatttttaaatttattctctatgccagaaaaatggctatctcttttttgcgagaaattttgtaccatacaaatgttcccagcatgggcagaggggcgcggagagcaatggccattctattctacagggaatttttaaatttattctctatgccagaaaaatggctatctcttttttgcgagaaattttgtaccatacaaatgttcccagcatgggcagaggggcgcggagagcaatggccattctattctacagggaatttttaaatttattctctatgccagaaaaatggctatctcttttttgcgagaaattttgtaccatacaaatgttcccagcatgggcagaggggcgcggagagcaatggccattctattctacagggaatttttaaatttattctctatgccagaaaaatggctatctcttttttgcgagaaattttgtaccatacaaatgttcccagcgtgggcagaggggcgcggagagcaatggccattctattctacagggaatttttaaatttattctctatgccagaaaaatggctatctcttttttgcgagaaattttgtaccatacaaatgttcccagcatgggcagaggggcgcggagagcaatggccattctattctacagggaatttttaaatttattctctatgccagaaaaatggctatctcttttttgcgagaaattttgtaccatacaaatgttcccagcatgggc

SEQ ID NO: 37643 - DNA, 378 bp, Heterodera glycines
ggcacacgggagggagggagggcaatgaatgttcgtcataaaagaaaaggccgccgcggcagtcgatgggcaatgaaatgccgccgtgtgcagtgccgttgtcgtccgctttccgcaagggaacagcagcagcacagaaacgggacggacggacacggcattgaattttcatcgtccggcgggcgcgggggggggggggggggaagtgcggaagaagaggtagaaaaggtaccgtgtgcaattgaaatgtatctgcccccacggcgccatcatcgtcacccctgggggggggggggcggcaaaaaagcaattcaaacagtgccaaaggcgggaggcggggggggggaggggggcaatgaatataccccaccacttaat

SEQ ID NO: 37644 - DNA, 953 bp, Heterodera glycines
ccatttcattttttgatcagcagttccatcgataagataatctcatcctcttcgaatttctttttacagtgacgcagaaaataaaaaaataataaataggaaattattgcgctaccatttgtcaattgaaaatttaaattggaaattgaatcgcaaagaaattaaaaattaaattataaatatttttttcttcattttaatcacaatttaattttttccgtttattttcagcactttgcccaaggattctgtgcccgtggaatgggaacatttttccgccaaggaagtcatcgtcgatccgaagtaaattttgggaaattgcccggggcaattcacacaaattgaacatccgaaagttctcctgctttggtcaacggactgcgaagcaaatcgttgcattaaattagctcaatttgttgtagcaattcctccaaaagtgcaattgaaattttcggggggggggggggggaaagatcaaagaatacaaacaaattgaatttaaaaaaattgttttaagaatggcacacacttatgtgactgaattggccggcggcattccgtccgctcgcggcacaaaatattcctacacttatgagtcccgagttgaggaggaggggaacaacgaattgttggaacagagccaacgaaggcgggaggagacggacgaggaggagatgaaacagcaacagccgatcaccgagttgaggagggaagaggaggagcacgagttgggcagggaattgaggagaggggaggacggcacggaaagacactgtacatctacgcaaaaggtaggcagagaagcagagcgatcgacaatcgatttgatcggacaatgccaaatcaaataagccaaccgatccttttttgcttactgaagatcacccgagtgaccaaaatcaccacgacaaggcaagtgaaacaaatcccggtgaatcccggccgacgttttc

SEQ ID NO: 37645 - DNA, 858 bp, Heterodera glycines
ctgcgtctctgcccattggatattttcaatcgcctgcagtgattgatagatgcgatttgtgttgggtgggcagaagagatatgcgattggatgagatgaatgcagcgggcttataagcaagtttagaaggagaagagccccccccccccctccaacagaagggacaaagccgggaaaagccgtttccacagagtagcagcagcagccatctgctgcagtttattactctttggcaaagctaataaagagattaatatgtggacaaaattctaaataattgagaaaacgcaaatttgattttaaaggaaataagggaaaaaatttggattccaacgaccacccaaaattttatcaaatgcaataaaaaggatgaagcagtgcgaaattttcttgttattaatttctcgagaaaaaaaggtggcaggggtcaatattaatttttgtggaggggggggggggaggtcggcgtcttttttttgttgcttttcacacgctttttgtgatgcgctttttgaaaaaaaaactggggaacttagtgggagggattcggcggtgcgatagacgccactggggggaaattttgaaaatttgatgcaactcataaaaattttttttatggatcttaaattttttttcttccaaccgatcataataagagaattacatatttttaatgaaaatttaaacataatatttttctaatgtcttctcacaaaatctaggtcccattcaactatattaaaagtaataaatataaaaaatgtaaataaataaaatttaaaagaaatatatatatatatatttatgattaatagaattggaattttgttttactgaaattttttatttacttattac

SEQ ID NO: 37646 - DNA, 1455 bp, Heterodera glycines
  misc_feature (8)..(9): n is a, c, g, or t
  misc_feature (25)..(26): n is a, c, g, or t
gcctgcannggtccttctcaaatannttgaattttgattaaaataattcaccactttccgttcataaattacaatcccggccgaccaaatgtccagttttgtcgaaatctgtaattaaaataaattttgatttaaaaaactgaatccagttccaatttctaatttatgaaatataagttttcaaatttaaaaatgactcaaatccataaatttgcgaattttattattacttctagataatccaactttatttttgctgatagataattaaaatgacaattaatttaaacacataaaaaatattcaaatatttataaattgcaaattatgtataaacctttttgtccaaatattccggtgccatgtatcgtccattagctgtttgtgagaagtgatgatgaccctcaatttcatcgtcattaattttttcaatgtttcgccccatttccaaaaagaatgccccctccagtccgatcagcttcaatggtgtgctttcgactttggagaaaagtcttcgaacagaaacagcattgtttttattagacaccaccaaattttcggggttaaaattcaaatgcaccgcaactgaaaaataaaaaattttaacttatggcaagagaaaaaagaattgaaaaagttaaaaaatcggtatttctatttctcatgaatttttttgggtagattttttatattaaatcataaattcgggcgattttcggaggtcgctgctgatcaggtgatcaaaacacattagttagctgtgatcaatgcacatttctgaccaagaaattattttaaaatttaaaaattaattaaataattcgttgataattatgattaatagctatgaaaaataaatatttaatgtgtttaaattttttatttatacctcggtgtaaatcggctagtggcatcataatttccttgattgaatttccaatttttgtcttataaattttttgataggaatccccaaaatataatctcatttttcaatattgtaggcatcaactcatgaattgccaccaaattcaatttgctcttgccttcttcgctaatttgaccactaaaaatcatttcaattattttttaaattatttttaatttaaataattaatttcatactatacaaaaataatgccttaaaattgctcactggccaaataagtccatgatgtgctcatgtctgttcatttcatccacctttagtcgattcaaaattttaattgcattttcataaccttttttgggatatttttcgtttttgtaaattttaatggctatacatttatcgaccggcaaaaaggcggtattgacagagtcagattctgtgcccgtataaccgacatataccttaaaaatttttattaaaaaagtttttcaaattgactgagatttatgcttactttattttagtagtttttagagcaaataaattacgaaaagcttaaccaa

SEQ ID NO: 37647 - DNA, 1440 bp, Heterodera glycines
ttccccccccccccccccgccttccctcactcgaatctcaccccgggccccattggtcgcggacgccgctctcccaaaatttctcgcgcaaatacacagccgcggggtgaaacggctgagtgcgtccgcagaggaattctccggaaatggccacttcctggacatggccttcgtccgcttcgttttctgtgtgtccccgatagtccatcacgttcggactccgtgccaagtcgggggcgtcgaatcggtcggggtaaatgccggagggcgacggaggtagcggaaaaccgaggagaatggactctgaaggattctggactcaccttcccaattttcttcccttctctccccgtcccctctctccattaacctggcattttgtcataagcaaatctttcgttgaccaattcgccggagaatggcacaaattcggccgattcgtccgccttttggcccatcgtccgctgctcttccacccacacatccactcgcttattccttccctttctccccaattcgatttcttccatttggtcttccgtccatttattccgtccctttcttcccaattcgatttcttccgattgctcttccgcttcagtttcaatgatcgctctttgtgccgcttttcgttttggcagtgccgtgccctttcgctttcggcttttcgtcggcgttgtcacttcacttcccgcaaaggaaagtgccgaactcaccgacgctgtcgaatgacgtcttctggtcgctgctttctccacttggcttccgtcgctttcttccgatgcaaaaatccgtctgactctgcccaatctttgcgggtcctcctccgctgactcggtcactttccgcaccaacggagtcccccttcgacggctaattggcgtcaattgttgtgccgattcgtcagaaattggtgccaaattgcgtggaaatggggttggccttcgactacgtatgggagacaacgccggggcaattggggacaaaggcaccgccgttttcgccggagggggcggcggcgggggcgctttcgcctgcggcgctttctcttcgggttctgcgccgacggatcctccccggtcgatggccttttgccgaattgcatccgcaaaagacaccggcgactttccgccaccgcccttccacaaaggcggcggcggtggcggcggaggcggcggcgcaccgccaagggacccttgaaaagtgattggcatgagtaaaccagagtaattaaagactttaatggtaattaaggttcgcacttgacttaaacagtgccccggggggcggcggcggtggcggcggaggcggcgcaacggcccaaacgaagcacaaagagaggaaaagcacaaaaggattttccaagtgaattatcatttccttaagtcattagaatcctttttaaatgttaacgatggattttggggtttaaataaatta

SEQ ID NO: 37648 - DNA, 731 bp, Heterodera glycines
agtcagttcattaaaataatttttatcaaaaaaatttttttttgggttttcggggcagtccccctgaaccgatgcgcccagatttatggggagaccgaatccttcgggaatagcttccctatagcctgtacttaatttctgcgttggatttttgctccccataattgtttgagtaccccaaacggacacttgaaaaaatcgatttttttgttttaggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggagtagcttccctatagcctgtactttaattctgcgttggatttttgctccccataaatgtttgagtaccccaaacggacacttgaaaaaatcgatttttttgttttaggggcagtccccccgaaccgatgcgcccagatttatggggagaccgaatccttcgggaatagcttccctatagcctgtactttaattctgcgttggatttttgctcccacataattgtttgagtaccccaaacggacacttgaacaaagaaagttttttgttttcggggcagtccccccgaaccgatg

SEQ ID NO: 37649 - DNA, 1132 bp, Heterodera glycines
  misc_feature (18)..(18): n is a, c, g, or t
  misc_feature (27)..(27): n is a, c, g, or t
  misc_feature (59)..(59): n is a, c, g, or t
  misc_feature (85)..(85): n is a, c, g, or t
  misc_feature (105)..(105): n is a, c, g, or t
gaaatcatgtttccactncccttctcncaggggtattatttgtaaaagtcttttttccncaataaacttttcaaaccccattttncgcaccgtgaatgttatttntattgattctgaaccggtttgagtagattagactagaaaaaattgaaaattttgaaatcatgtttcccactcccttctcccaggggtattattttgtaaagtctttttttccccaataaacttgtcaaaccccatttttcgcaccgtgaatgttatttttattgaattctgaaccgttttgagtagattagactataaaaaattgaaaattttgaaatcatgtttcccactcccttctcccaggggtattattttgtaaagtctttttttccccaataaacttgtcaaaccccatttttcgcaccgtgaatgttatttttattgaattctgaaccggtttgagtagattagactagaaaaaattgaaaattttgaaatcatgtttcccactcccttctcccaggggtattattttgtaaagtcttttttccccaataaacttgtcaaaccccatttttcgcaccgtgaatgttatttttattgaattctgagccgttttgagtagattagactagaaaaaattgaaaattttgaaatcatgtttcccactcccttctcccaggggtattattttgtaaagtctttttttccccaataaacttttcataccccatttttcgcaccgtgaatgttatttttattgaattctgaaccggtttgagtagattagactagaaaaaattgaaaattttgaaatcatgtttcccactcccttctcccaggggtattattttgtagtctttttttccccaataaacttttcaaaccccatttttcgcaccgtgaatgttatttttatcgaattctgaaccgttttgagtagattagactagaaaaaattgaaaattttgaaatcatgtttcccactcccttctcccaggggtattatttggtaaagtctttttttccccaataaattttccataccccatttttcgcaccgagatggttatttttattgaattctgaacccgtttgagaaaattagactaaaaaaaaattgaaaatttttgaaatcattgttccc

SEQ ID NO: 37650 - DNA, 1464 bp, Heterodera glycines
  misc_feature (1422)..(1422): n is a, c, g, or t
  misc_feature (1436)..(1436): n is a, c, g, or t
tttttcttctttttcttcccatttttctccaaatatttcgtcaaatgatttctgttgcaattttttatccactgatccaacataattgatattaattagggcgctcaaaaaaacagttaaagagaataataagcataatttcatttccaagataagatatttctaaaaataaataaatttaaagcattaaaatgaatttattattttaatttgacagctattattcacggcaaatacttatagaattcataaattttctcactaattatataataaataattttaaatatattgtaatgaaataaaaataaagtaatttaattcactattaaataaacaattttatccctactgatcaaaaatatttctgttattccctactttctttgcaatttcaatgacaacagtagagtagaaattaattatttaatttttatttacaatatttattttgctaatgttaaatcgcgaagtaacagaagaaaatttttaataaaaagtcagatattttcctgattatgcaaaaatcgtgcaaaaatcatttgatataattactatttattatcttgatcgctaaaagaaaagattttaacacaaataaaattgattatattagaatagtgatttgatttaaaaagacggaaaatccattttcaattagacatccaattcatttaattctacagtttggctttatcttaattgcacagtttggttatgtttgggcaactaaaatttaaaatctttcaaaaacaaaaactaacggtttgagcagaagcggatttatatagatataaaatgtaaaactagaacaaaaacgccaaaatattgaccaattatatgtaaaagttaaatatggatcacataataatacgaaaaaatggacaaaacgccaaaagatggataaataattacaaattattatgcaccaatttttatgaaaaataatattttttttaaacttaacgaaaagaagaagaaaatatggacaaaaacttattgatgaataaatttattttttattttgaattttttattaaaataatgagcctatttttttgtcttctttaccaatttcggagtagaaaatgcgtcatgaaaattttattgtcttaaaaattaaaaatttttgaaaaaatcattaaatcttcaaataacataattaatgctcctaataaactagagaactaagatttcttaattttaatgcagtttaggctatcagagcttgaaaaaattcaacctagaatccgatttttgacataagcgcaaatgtcggggccgcgaatgtcgcacagaataatctcatttttcaatgaatgaaaattttttgggcaaataaaatttgatttttttttatttccggtattttgttcaacaaaatctttatttttttttaaggcgtcgatcggagagggactncacgaaattcttanaaatcatccgttttcattctcaaacatt

SEQ ID NO: 37651 - DNA, 1187 bp, Heterodera glycines
  misc_feature (121)..(121): n is a, c, g, or t
ccccccccccccaaaaaaaaattaaaaataatcgaaaatatttggagtttgaggagcaaaagatgtcgtcgttgatagacgatcgtatgaaaattgggtgttggacgaccctcccccttcncctctgacattgttctacttacgagggccgaattaggccgaccctttacaaatatatgatcaataccttatctattgtcggaactttttagtttttttctgaatatggtgacattatgaaaaatttgcttcaaaaatgccgtgaattggacaaatgggctactgccaaggccattgtgctcgcattggtcagcagttacaatgaattaagggtgagaaaatcgactatcttttagattctattcgttttattcagctgattccgcaagacaccgtcgaccacgaaagtggagattctcaggcacttcccaaccaagaaaccatcgtggaccaggacagcgaacacttccaagcattgcgagaactcgccaaacgtttggctctttcgtttggagtggacagtttcaaaaacagggaggctcttgctgttatccaccacgtaaataaaagaaatgtttcgaaattaccagatttttaaatgacaattaaaggatggcatcaaatttgcgttgagtttggaccaaaacaggaagaaaacagagcggacgtatccaaatttgtcattcttcgaaatactgcaggaattttcgccaaaacttcatcgtgtggacaaaacggcagtgtgagaacaaaataacaaatagcaaacttaagaaactgcttcagtttgcggtaccttgacaaaaattgttcgccggacgaacagctaagggacggcgaagcgtggcaaacttaccaattgtacaggtcggcaatccgattacgaagccattaaccaatagccaatcatacagttttctgttccaggaactcattggcgaaggctgagtgaatgggcaagcgaacacagacttttcaacgtcattgttcgattgatctcagattgaaacgaatcacctcttttctcttctcgatttgagtgagctttacatttactcattccttttacttttcactgaaaatttatatgaaatatacatgtttttgataatttccgatgataaaattgttaaattatgcactaattttctaattctatacttttcatcggtaattccgcaatcgaa

SEQ ID NO: 37652 - DNA, 1058 bp, Heterodera glycines
tttgccgtaaaaaaatgagaaaaaagagataaccatttctgttcaagaattttttttgtttgcgtttcaaatatcgtaagattgtttgatagggccagacaagagaaggcaactgttggtaccaagtttgccgtaaaaaaatgagaaaaaagagataaccatttttggtcaagaattttttttgtttgcgtttcaaatatcgtaagattgtttgatagggccagacaaaagaaggcaactgttggtaccaattttgcggtaaaaaaatgagaaaaaagagatagccattttttggtcaagaattttttttgtttgcgtttcaaatatcgtaagattgtttgatagggccagacaagagaaggcaactgttggtaccaagtttgcggtaaaaaaatgagaaaaaagagataaccattttttggtcaagaattttttttgtttgcgtttcaaatatcgtaagattgtttgatagggccagacaagagaaggcaactgttggtaccaagtttgcggtaaaaaaatgagaaaaaagagataaccatttttggtcaagaattttttttgtttgcgtttcaaatatcgtaagattgtttgatagggccagacaaaagaaggcaactgttggtaccaagtttgcggtaaaaaaatgagaaaaaagagataaccatttttggagaatttttttgtttgcgtttcaaatatcgtaagattgtttgatagggccagacaagagaaggcaactgttggtaccaagtttgccgtaaaaaatgagaaaaagagataaccatttttggtcaagaatttttttgtttgcgttttcaatatcgtaagattgtttgatagggccagaccaaagaaggccactgttggtacccagtttgcggaaaaaaatgagaaaaagaaaaaaacattttttggtcaagaattttttttgtttgcgttttcaataccgtaagaatggttgatagggccagacaagaaaaggaaactgttggtaccaagtttgccgaaaaaaatgaaaaaaaagagaaaaccatttttggttaaaaatttttttt

SEQ ID NO: 37653 - DNA, 1134 bp, Heterodera glycines
  misc_feature (34)..(34): n is a, c, g, or t
aaaaacgaaaaatacacccaagaatcgatttttntgggaattttaaaaatacacccctaagaatcgacccaaaaatttctaaaaataaaccccctaagaaatgaaaaattttccaaattcatctccaaaatgtatttatttattttcttgacaagaatatatgctttaaaaaattatttatctcaatactgacttggcctaatttttttacttttttgaataattttacacccctagaaatgattttttaatgcctattttgggggttttttagagcctaaagcctacctattttggcggtttttagtgcctataaatgtgagccctaataagtaaggccgcaacttttagtgaaaaaacttttttttgctctattgttttgaagaaaggagctcaaaaaacgcatttctgcattaaaattttttcatttggacgtcacttttcgtcactagaaatcactattttggggttttgtcactaaaatagttaaaaatcactattttggcgttttgtcactattttttcactatttcgacattttttggaaaattccttaacaaaaatgcaataaaaccaaaaaatacacccctaagaatcgacctaaaaaaatttcaaaaaatacacccctaaaaatcgagctaaaatttttcaaaatatactcctatgaaatgaaaaaaaattttctcaaaaatttactttcttggcaaaaatttttaattttaaaaatttttttaggtaactaatttggtttttttggtcttaaaaatcccagtcctactcatttgcaactgcaatcagtgaataaaaattattttggcttattttttggctgaaaattatgtcactatttcggactttttgtcactatttcttcactattttggcattttttactcactattttagttaaatatttcgggatttttcgtcactaaaagttgcgggccctactaacaagaactatagactcctttcaaactaaaagcttcgaatttaaattcagaaaactaaacgaaaaatttggaaagggggggaaaatggaaatccaaactaaaatgggcccttgcaaattaattttaaatcggaattaaatcgctaatttaatacctaaaaattaaaaattggttttaattt

SEQ ID NO: 37654 - DNA, 1039 bp, Heterodera glycines
  misc_feature (983)..(983): n is a, c, g, or t
  misc_feature (1031)..(1031): n is a, c, g, or t
cgagaaaaataaaatatccaaaaattccatcttcattttttgcagatggattgattttattagagaatggcattgggtaattaaaactttttaattgtatcatttgggttgatttgagggtgatttcttaacagattttcactaaaatgatcaattttgtgattttaagccaatttaagaaaaaattttggaatttttaatgcatttttattaagaaatttgttcaaattttcatcaattgaccgaaatttgagttggtcattagtttattactataaattgcccctttttatttaaatgaaatttggcacaaatttgggcaggttgagccaacccgtcgccgattgatgcccacaacattgggcattgcgcttgtgcatggctaccaacgcgtggaccccgacttgattttgccaacaatgcgtgccaatgttgagcgccaattggacctaattgccaagggaaaagcggactatcagacggtggacaaatcattaattaactaactaattgcgctataactaatttaattaccaatttcaagacggagaaaaatcattaattgactaatgaattatctgactaatgttgtattattaatgagttaaggcattttctttcagaataataaataaaataattagtaaattaaatttttaaaatttaaaaaatctcaaaatatttaactattgaaattgcgtaaaatatatttgtacttattttttctaaatttaatttcagatcaagaaccaaacacttgagatttttcggcagaaatttctcaattttgtgcagaacataaatttggttgacgcactttttggaggtgaatgtcgccaattaattgggcccattaaccaattaattaggcccattaaacaatttttaaattcaccattttaccccattagattcatttacatcgctggccgactcgggcaaaccgtcagcaatgtggcaatggcggcgctacatgaagctgntcgagacgctggcccaacgattgtattgcccgatttgcgatgtgattntttggcac

SEQ ID NO: 37655 - DNA, 818 bp, Heterodera glycines
aaaataggttatttctcttcctttcagtatccctgcaaagtttggtgcgcttctgatcagtttctgaaaaaaaagttaagcctaaactttttggcctgtttaaaaaggaattaaaaatttttaaaaattttattcatctccctttttgatagaaaaagcatcagagtgcctaaactaacatgtaaataaaatttggtgcgtttcagaaccctttctgaaaaaatatttaagaattaattttgcaaaaaataaataaaaacgaaagactcagattttcgaaaatttttttgagccagctagctcggcgctcatttcagtgtaagttagtcctttaccggggagtatccctgcaaagtttggtacgcttctgctcaattagcaaaaaatatgagtgatcgaattttcactaaaaaagttaagcctacattttttggcatatttaaaaagcaattaaaaaatttttaaaatttaataatttacctgcaccgaaggtactcactcggcctcttcgcggcctcgtggtgggccttcgcccccccccccgacgaccttaatagcacgacaaatatttcaacaaaaattttgaaatcatgtttcccactcccttctcccaggagtattattttgtaaagtctttttttccccaataaacttttcagaccccatttttcgcaccgtgaatggtatttttatcgaattctgaaccggtttgagaagattagactataaaaaattgaaaaatttgaaatcatgtttcccactccctttctcccagggggattattttgtaaaggctttttttccccaataaacttttt

SEQ ID NO: 37656 - DNA, 973 bp, Heterodera glycines
  misc_feature (864)..(864): n is a, c, g, or t
aaaattctttaatcctttttaaaagtctttttttgtaaccaatttcccatttgccaatgtttactttttttgctcgagttccagctgccacttttaaaatttgatgtgattggccatctccataaatttatgatgtttgactgaaaaagggagcaaaccaaatgaatttttgacttggaactggtttatataagtaagcttcgctttttaaacttctttaaatgctccgaaattttatattttattttaaaaataaaaatttcattaatttttggacaaattgggctgatcgatagtctcggtctcgatcaagagtttagtggtcagttcttgttacccaaactccttacctatctcaataaatgctttcgggatagttaaattctcgatcacgatcttaattcttgaccctcgcaaaatttggtctcagttttactgtttccggaggtttcaaagaattgtaaaaaaaaaacgcaatttaaattccccgaattttgatccacaatttaataaataaatcaaggcgctctaaaacttccaaaaagaaaaaattccaaaaaactgtgattaattttaatagcaaagttttccccctttcttttggcaggttttcccccattttataggggggaggcgacgcatagccacacaaaattagctcaattttcgcagcagcagctccacaacacaacccaaccaacctctcatcactcacattatttattgtgtgtgtgtccccacccaaattcaatcatttgaatgaatgaatgaattaatacacccccggggggcggcgattgacgcagcgcccgccgcacacgcaaattattttcgcgcactcatcagcagcgggcggcggcggcnggcgatgggtacgccgccggcaattcattttcgttcgttgtttgaatggattaattttcgccgcgcgtccccccccccccccgcgtcggtcgtcccaaatttcaaattt

SEQ ID NO: 37657 - DNA, 914 bp, Heterodera glycines
aggaatattttaaaacgatttcgttttgttttggcattatgataccgaataacttttcggaaattatcggaaacaaaattggagaaattcgaataattttttgactgcaaatttttttccttttttgaattgggttcaaaaaaattttaagagaatttttgattattaatttgaagtcttgaatttatttgacaaatccaagacttaaaactgggagaagcaaggggctgtggctgggggcctaaaatttgggccacattggagaattaattctgatttctgaaaaagtcccagaaataactattttttctttccataccttcttgtagagctcgagctgctctttccaatggtcttatcccggtctcgatccgtgccgaactcacaaagttatggagtgaaatgtgaaatattgttttcaccacaaggcattttttctgaaaaccggattcaaaaatctggggtttggtataaccgttttagaaatagcgtagaaaacagcttcgatatcaagaaaccaagtcaagtccagaaaggaatattttaaaacgatttcgttttgttttggcattatgataccgaataactttcggaaattatggaaacaaaattggagaaattcgaataattttttgactgcaaatttttttccttttttgaattgggttcaaaaaaattttaagagaatttttgattattaatttgaagtcttgaatttatttgacaaatccaagacttaaaactgggagaagcaaggggctgtggctgggggcctaaaatttgggccacattggagaattaattctgatttctgaaaaagtcccagaaataactattttttctttccataccttcttgtagagctcgagctgctctttcccatggtctatcccggtctcgatccgtgccgaact

SEQ ID NO: 37658 - DNA, 980 bp, Heterodera glycines
tttaaaaatttccctgtggaataggattggccattcctctccgcgcccctttggcccatgctgggaacattttgtatggtccaaaatttctcgcaaaaaagagataaccatttttctggcatagagaataaatttaaaaattccctgtagaatagaatggccattgctctccgcgcccctctgcccatgctgggaacatttgtatggtacaaaatttctcgcaaaaaagagatagccatttttctggcatagagaataaatttaaaaattccctgtagaatagaatggccattgctctccgcgcccctctgcccatgctgggaaccatttgtatggtacaaaatttctcgcaaaaaagagataaccatttttctggcatagagaataaatttaaaaattccctgtagaatagaatggccattgctctccgcgcccctctgcccatgctgggaacatttgtatggtacaaaatttctcgcaaaaaagagataaccatttttctggcatagagaataaatttaaaaattccctgtagaatagaatggccattgctctccgcgcccctctgcccatgctgggaacatttgtatggtacaaaatttctcgcaaaaaagagataaccatttttctggcatagagaataaatttaaaaattccctgtagaatagaatggccattgctctccgcgcccctctgcccatgctgggaacatttgtatggtacaaaatttctcgcaaaaaagagataaccatttttctggcatagagaataaatttaaaaattccctgtagaatagaatggccattgctctccgcgcccctctgcccatgctgggaacgtttgtatggtacgaaaatttctcgcgaaaaagagatagccgtttttctggcgtagagagataaatttaaaaattccctgtagaatagaatggccgttgcgcaccgcgcccctctgcccatgctgggaaccatttgtatggt

SEQ ID NO: 37659 - DNA, 918 bp, Heterodera glycines
acaaaaaatttcaaaaaatttactttctcataattcaccgttttatgttaaataaaataattttagaaattttgccaaaaaaatagttgaaaatttcttctctgttcaacctgcaatggcatcgccgccggactcgcgtttctgtccaccaccgttctcgacctctgtgccgatgctgctgctggtgcgggtgatcttgacgtgatggcccgtgtcgcttcgccgccgctgccggcggacggcacggcactggccgaacgcatcaaagaggccgaagcgcgagaagaagcggcactgacagtcgacgccgatgaaacggttgcggatagacccccatttgttgttgatggcatcgacgaagtgctagcggacgacagcgaacatttgcgtgttgtcattgttgctaaagggaataaaagtgattagctgatcaatgatctcatgtaactgttttcgtctcgactaattcaagaaaaaaaattataaattgtttaaaaataattagcccctaaaactcaaatcgtaaatcaatgaaaagcattgaaaaagttgttgatggtttaaattagagtgccacgggaccgggacgggaattcccggtcatccgaggtcccggttcccggtcccgggttttgaaaagctcaggtcccggtcccggtagggcaaccgggaaccgggaaaaacaagcactggtaagaatggggtctgagtgaaaaattagtgaagaaaattggagtcaaagggaaaaataaaaaataataattaatatattcttttcaatttttttttttttttgtatactcgtgggtttcctataaagaaaatatgattcctcatagttttttttaaattgatacatattttatcattttttaaatgaaaatcctacccagtgagcttataatcgcaaaaccaacc

SEQ ID NO: 37660 - DNA, 1075 bp, Heterodera glycines
ccgattttttttaaattttcaactaattttccaaaacctccttttttgaaaatttcttataaaatttctaagattctttgtaaaaattctaaaagtttttggctttcccgtttcccccccccccccgccctcaagagaatttgtcccaaaattatgatttatgggagtctaattagtgtgcctatgaaagtctccaatttttgcccctaattaaaactcgcccaatccgttgttgcggcgcagtgtcggcacttcgtccgggaagagggcgctgaactcaaagttttgcaccaacgccgccaaaatggtgaacaattccattttggccaacgactcgcccaggcacattccttgggatttaaaattttgcaaaatttgcattttttttttggcactttttccaacgccaaacggcctcagccaggccggcggacagtaattgccctgtgcgtccaggaaacggtcgggacggaactgttccggcgccgggaaaaggtcggggtccaaatggacggcgcccagctgggccatcacttgcgtattggccggaatgcgccaacggccgcagagcaacacctggccagaggggagggggatttgtgatacctgtgattagggttgcactacgatccctcgggggggggggggcggaagagggacaaaatgtaccgtccggggaggacatgttggagctggggtcaggaataggcccaaaaatgtcggggtcggggagcaaccctagaatgaaaaacacttaaacaaacctcacgagaaaattttgacaaaaaaaattttgagaaaaatgagtaattttctaaaaaatttctagcttttttcttatttttcaagcataaatttcaagaaaaaaaaattgtatttgaaaagatccgaaattcattttatagaatttttttttctcaaaccgaggaaatttcaagttttttggggaatcttggtctcgcaatgactctcaaggacttcaatctcaccatttcgtctcaaaaatcactaaaaatctttctcccttcatccattttttccctaaaaatttggaaaaaatttttgttttgttaaa

SEQ ID NO: 37661 - DNA, 962 bp, Heterodera glycines
  misc_feature (895)..(895): n is a, c, g, or t
catgccatcgccttcatccccccggctattaaaagcatgctaatgagtgcaaatgagccgctctccaatgctcccatccggcctctcttttctttgtccaattttctttagtgtttctcctttcatcccattgtttctgtcctttcctagtcgaggagataagcaatagagttagttgttgcctttcagcagcaacggtttgtttggatgagggcaccgagtgagttcattttggccccactgtttaaacgctttcccccggggaatgggcggcactgtgccgtcgcccctccccccgccaacggccccggggggcggcattccccgtctcattatataaactcaaaaagggagggaggaagggaagggcacgaaatgctggtgatgatgatgaggggaaagggggggggaaagtgaaccaaatttacaatgagaaagggaaaggaaaaaagcgcacggaaggcaaatgaaaggacggataattaattggcataaaattgagagagagaaaggaaagagagctttatgttattatttaatgaaaaacatttttaaaatatttatggatgtttttatgctgttaaattgagttacaattgcttcctcttatcacttttatttattatttatttatttattttattgcatcgttgcccaattcattttcatttttttcaacgttatctttgaagcatttacgtgtaaagatcggctgattactaaattctgatcaatgttagtgaaagaaaggaaaaaaagtgcggaagagaagtcaaaaaaacaaaatcggaaataaaattaataaaatctttatttttgggtaatttttaaatattttcttaaatttccaaaatggcaggttcgaagggagggaaattatgccggagcatttgcncaaatatgggagacaaattcaattatgagcccatccatccgccgaatgccaaaatggcgacggactg

SEQ ID NO: 37662 - DNA, 1106 bp, Heterodera glycines
aaaataaaagtgattttgggattcgagaccagaggggtgtgaccatgattatcgagtggaaaaatctttctcacaaaaatcttccaaaaatatgtatttaggggttatttggaccgctgatcacgaatacgtaatctaatttttcttttgacatcgttaagacctcagaatccctgtgtgattggggattctgagacatcattttgaggggggggggggcgaagttcgaagccgggcggtgtacattatttttctttgtattttttgggttattttgactgtttttaattaatttgaagatttcttttaaattatttaaatttatttttttttaaattaaagaatttcatttttttttgaatttgtaaaaaaaataatttaatttcaaattaaataaatattcaattaataatttccaacgttgtttttaattaataaaagagtattttattataaaaaaatttttaaattaaaatgcattcgatttttataaaaacttttcattatttatttaattttaaaccatgttgtacctcttcttatcactgttggactcatctaatcactgttgaacctcttctaatcacaaatcctccaaaaacatgtaatttggaccattttatgacgctgataacgaatctgaaatcagattttacttttgacatcgttaatgggttatttttaatgttttaattaatttaaaatattttgttgagctaataaataaaaaattatatttaaattaatttttttttgatgaataaattttataagtttaaattaattttttttttaattcatagaatttcatgtattttttaattaaatttgttaaaaaatattttcattttaatttaatgaatttactaatcactgttgtacctcttctatttactgttgtacctcttctatttactgttacacctcttctaatcacagttgtacctcttctgatcactgttgtacctcttctaatcacttttgtacctcttctgatcactgttgtacctcttttaatcactgttgaacctcttctatcattgttgtacctcttttaatcactttagggcggattctaatcactgttgtacctcttctgatcaccg

SEQ ID NO: 37663 - DNA, 1422 bp, Heterodera glycines
  misc_feature (940)..(940): n is a, c, g, or t
tgagattattttcggttcgcccacactgagacatttgcggttcgacctagcacctgaacgagtatatctcatcaattcagaaacattaaatatcgtctcaatttcgcaaaataaattttttatacgaatcgattataaaattattcgcttgaagaatacctattaatttgcttaatgataggcgtaaaccttgcttgtgctcttgaaattatagtttattttgatttaaaatattttgcaaaattttggattaattaatattgaaatttatttatttaattatgcacgaatattatttgtttgcatttaaaatatatattccttttaaacttataatcgtagaatcgtggaccagatcccttttttcttcttttgcgcttctgttgtaattttaaaatgaaattattttacaagcaattttaaaaattcagattaattattaattttttataaggtataagatatattttaattgatcatggcatatccattatcaaataatcactattcttattaagctggttttatttaaatactgattttattttattttttacttatatatttgctcaagtagcatataaatttgtgttatttattaatttttatttgagtctgaaaaaagttaaatcattttttaatattaaaaatattcaaatttatttatttaattatccgcgaatattattttgttttacatttaaaatagatattccttgttaaactcctgccgatgtagttgcgctgctggccatccaattggaacggcacgaccttacaaatcttgcttaacattatatagatttaaatagatatatttttttataattattatcctatttgtttagcattatatacattgtaaatagacaaattttataattttaaaaactcataaaatcataatacggctaaatttattaaatcaaatatcgaacgntgtatttttatattttttataactttcctacttgctactagtgaatgtttgagtcaattattgtaaatgctattttttgctacctttttaagtgagaattattttttgctattggctaaccctttttaggggaatttcgaaaaagttacctttttagcaaattaaattggtttttaaattttttttaaaacctcgaaattaatccttccaaaaaccccggggcggtaaaaaagggggatttataaataataaaaaaaatggtaaaaaaatttttggtaaattttttaaaaaaaaaaaattttttcaaaaaccttgcgggccccggaaaaaaagggcgggggcctttttttttctttttgggccgggggagcggccccccccccggattttttatattataaaaaaaaaaaaaaatttttaaaaatttttttttttttttttttttttaaaaaaaaataaatatttttttttttttttttttt

SEQ ID NO: 37664 - DNA, 101 bp, Heterodera glycines
ttcaggaactgcgtgaggaaggcatgcgtaacgctcagtgagcggcatgcaccccacccattcgctgacagatcaaaggatgaacgccatgcgtaaacacg

SEQ ID NO: 37665 - DNA, 932 bp, Heterodera glycines
ttgtaatacatttgaaaacaatttatcatatttaagtgggatataaaatgaattcctcccaaaaaatcggcatttccattttccgatcaaaaattggacaaaatttcgctgcgtggataagctttaacaattttcacgtcattcgttggcctaaacagagaacgaattgcgccttcgcgtgttgtcggtcataacctgtcgctgttgtccgtcgtcacctgtccaattttctgcaagactttcatgcccgtcgctagtcgaccaaaaattgtatgctttccgtccaaatgctgagttgggccgagggtaatgaaaaactgagaaccattggtgttgggacccgaattcgccatggaaatctgttaacggcatgaaatatggacgaattttaacagtccactcacaatgccggcccccgtgtgtcgcaactcgtcactgatttcgtctgcaaatcgactgccgtaaatggacgtgccacctctgccttaactcggattttactttgcctcccgccgcgccataaaacgcccacccgtccgtgtcggatcaccgccctaaacaaacaaaaataaaaaacataaccacagggaacagtgacacctgaaccataaaatcagcaattatccggtggaaaattgtgttgttgtaataccctaaaaaggaatttaaatgaatacattcggactaccgtacctttcctggccaattcctggaagttcatgcaagtccgcggcgcgtgttgccaatacaactcaatggacattgcgcccatcgaagtttcgaacacaacgtgagaagactttgtggaagacattcgacgaatgaaaaagcgaaataaatggaaaaggaaaggggcgacaaaataaaagaaaaaaggcaacgaaacccatttagaaatgaattatagagaaatcttctgatagtaaatatta

SEQ ID NO: 37666 - DNA, 246 bp, Heterodera glycines
gcagggatactgaaaggaaaagaattaacctgttttatcctttagcttgtcatcagtttttataaaaaattttcaaaattctgagtctcctattattttatttatttttcaaaattttgaagggcggggggggggggggagtcagctccactccgaactcatgcgcctaacaggtacctgtgtgatgaagatatccgcgctcgaagccacacaacaataacagaaaccgatgagtaaatggtaaat

SEQ ID NO: 37667 - DNA, 1320 bp, Heterodera glycines
  misc_feature (28)..(28): n is a, c, g, or t
  misc_feature (1293)..(1293): n is a, c, g, or t
gacttcgaatgggcccttcgcgtggtcnaaccatcgcgaaaacgagagggattcgcgacggtgccggacgtgcgatgggaggacattggggcattgaacgcagtcagagaagagttgaaatggtcaatattggtgggaatttgagaaatctgttggccaatagagacacttccatttcattcagtaccccatacaaaagcccgaactgttccaacactttggcacttccgcacagccgcaaggcattttgctgagcggaccgcccggttgtgggaagactttgttggcaaaagcggtggccaatgagacgggcatgagttttatcagtgtgaaagggcccgaactgctgagcatggtcagtaaaaaggcaaattgacggcatttcccatttcttttcagtacgttggcgaaagtgaaagggccgtcaggacagtgttccaaagggcgcgtgattcggcgccgtgcgttgttttcttcgatgaaatcgacgcgctgtgcccaaaacggtcgcaaagagaggttattcttttaaaaaaataaaattttgatagatttggcaatcaaattcagaacagtggtagttcacggctggtcaatcaattgctcaccgaaatggacggattggatggacggagaaatgtttttctgatcggagccacaaaccgaccgggtgaataaaaatgggctaacaaattgtaggttttttttgtccttttcagacattgtcgaccccgccatcactcgcccgggtcgtttcgacaaaattctcttcgtcgattttccttcaccctcagaaagggcggacattttgcaaaaggctaccaaagtgagttttttaggattcatttttatggtttctcattcctcagaatggcactcatccgcgcatttctccatctgtccgtttcgatgccttcgcttcaaattcctcccttgattttttcacgtaaattccctaccgtttgctctttcctattcctattgtactattgtgtttcttcctcttaaggggtgccgatctcgtcgctttagtccacgaagcgactctttgtgccctccgagaacgcattgaccaaaatgattcgcgcattgactccgtacaatcgcaccattttgaagaagccctccgtcgaattcgtccgtcagtgagacaatccgatcgagaacattacgacaaattgagggagaagtacgcagcgggaacagaaacaaagccaatggacaacgaatgaatgaattggccgacaaattcgaattcctttctcctatttatttgtttacgccaaattgttntaatctcgggacccaagagctgggatg

SEQ ID NO: 37668 - DNA, 1270 bp, Heterodera glycines
  misc_feature (30)..(30): n is a, c, g, or t
  misc_feature (109)..(109): n is a, c, g, or t
  misc_feature (144)..(144): n is a, c, g, or t
  misc_feature (162)..(162): n is a, c, g, or t
attatcgtttttctaaaattatagtgaaanaattatattttcatttattagcaaaagcaaataatcatgattaatttcctatagaaataaatgatttaccttaaaaatntattgatcatttattactttacattttatttaatntaaaattaatcagcactntaagaaagaataccgtaaaaaaattcaataaactaaattattaaatgagttaaagcagatataattatttctatttttttgtctgcttatattaattataaattttcatctataatattaaaagactaatagaaatatttacaaaaaatataaaaaacaattatgttaaataaaaggtttaacaaactattatagtaacatgaaaccgaaataaccgaaaaccatgggtaccggttaataaccgatcatgaactacaatattaattgtaggttaaattatattttatttattcggactaacgaagaaataacaataaaaatataagggataaacaaattaaaaaattttagaaaatgcgtaattaaaattgatttcaaaaacagaatgaaagtcaacaaaattttttcttaaaataaaatgatttgaaaaaaacagttttaagatattctcttatttatttaacaataaatgttataattcttatgcataaaaatctgtccattggtcagacaaaaaatatcaagaaagaaaatatattttaaataattaaaaaacagtaaacaaaatagactccgttttaattgattaaaattcgatctaaccattaatttgataacgatttaaaaggaatttttaaaaatttaaggaagagaaattcgaaaaataagtaaatataataagaaattattaaaaagtattaagcagatacaattattttctatttttatgaaggaaatatttaagaaaagaaatgaattaactaaacgtttctgaaaataaaacaatggagaaaatggtgagtatttgaaaaacatataaaaaactaatttattatcaataataattttaaaactataacattataataaataaaaacaaatgtttatttttattgcgtttgataaataaaaatttaaaaaattaaatttttttttaaattgtataaaaagcaaaaacaaatattgcttcgccagaatacgcgccagttgtcccgaagtagaacaagattgaatagattcattgaaaaattaattatcaacgctgaatttacaaaatccttcattcaatgttcgatatgggaaagtttaaaactgtaaaatattaatt

SEQ ID NO: 37669 - DNA, 619 bp, Heterodera glycines
  misc_feature (547)..(547): n is a, c, g, or t
  misc_feature (606)..(606): n is a, c, g, or t
tcgcgtaatggcatttcttttgcatggatgaattgggtatggatgagttaggtttctcgcctccccctctttaattgtaatcaaattcaaagacccccaatttgttgcaaatagcgccaaaaatgcgtgtcactgtttttcattatctattcatcataaatttgagtcaattttagcccatttatttgcctgcacataattattgaacaaacactgttgatattgccgaaaatgacgtccgaaactgtgtcaagtgaagcgtcggcagcgggcggaggggcggacaaagagaacacgaaaacggacacaaccaccgacccgagttccagcgaaaattcggcgtccatcgaggcggaccacaacaacggccaaatgcgctgcaccgaagaaaccaccgtcccgcaagaccttgtggagcgtcattttctgcaaaacacttggtcaggttttgacatggtgggacaagggagaccccccccccccctccgaaaaatagaaaaaaattccggaatttggaatcccaaggctcggaaatccccgaaactgngaccagttccatgcatgatattggatttgtagtaggattgagggacatgagtgtctatnttttccatttcat

SEQ ID NO: 37670 - DNA, 1151 bp, Heterodera glycines
agttacggtgggagaagctacgggagtgggtcatacggtagcagcggttacggcggccgcagttatgggagtggcggttacggcagtggcagttacggtggagaatctacgggagtgggtcatacggtagtagcggttaaggcggccgcagttatgggagtggcggttacggcagtggcagttacggtgggagaagctacgggagtgggtcatacggtagcagcggttacggcggccgaaattatggaagtggcggttacggcagtagcagttacggtggtagaagctatgggagtgggtcatacggtagcagcagttacgatggtcgaagctatggctagcggaggctatggaggcaggaattttgggaacgttggtttaactgctggcagaggaaccatggctttggtagtggttacggtagtggcggatatggctaattctttgtgcaagatgaaacaaggctttcttagttttagataaaaagctaataaagtggttttctcatttaatttcattgctaaatgtcacaatcggaagaataaatcattaatttcaccgtttaattttacaattctttgtgtttagtattcattttttatagtataaacagaaagaacttatttatcaaaattaagaaaaaataatttttagttttattaggagcattaattcggttgtttgatgaataattgatgcttttttcaaaaaactactaattatctgacataatcactttctatcacttatttaaggctatttaggctatcagggattgaaaaaacttaagctgaatcagattttggacataggcgcaaatgtccgaggcgcaaatttcatgtaaccaataaatctacgagtttaaaaaaaaatgaattttcgacttttcttccaattcgggttcgaattcctgaatgggtcgaaagggatatcagaatcggtctgtccctgaaaacccataaatttaattcgtcccgaaaattaagatttttcgaaaaaggatgcctaccatcttaacgattaccaagatgacgttttagcggatactcgatctatcccaaaaacgcaaaaacaatagaatactactagcaaattttgaatacaatttcagagtattctttgattaaaaaggaatcaaattttgtcataag

SEQ ID NO: 37671 - DNA, 1093 bp, Heterodera glycines
taatctggtcccatatagcgaaatcgtaaagtcacgtgcagattgcgaaataatggaagagaaataaaagaccatcaattatctcagaaaaaattcaatttaattaatataaatgaatttgtatttattcacctattgtccaattaatattcctatatcttacaataattcgaaaaattcggttgtcattattgattaattttcgcgtcatcagcatcgccgaggagaatggggcaatgtaattatcgattaattttatcgatttttttttgcgcggcggcaacatcgatagggagggtagggcggtgtcattatcgattaatttgcgcggcgatgcatcggcggggagggatgggttgggcaaaaaaaagcacccgtgcggttttggggaaagtggattgggtgggcggcaacttcaaagtggtccaatagattttggttctgggcggtaacttcaaagggacgcacccctcccataggcatgggtccacgggcggcaccttcaaagggctgcacccctcccataggctttgggttcgtgcggggcggcaacatcaaagggctgcgcccctcccataggcatgggttcgtgcgggaaacacccaagcgcaatcgtgcgcttttggtactctatactactggcccttcgtcgtgtggccaagggggagaagtgccgcgtaacactgaaagggaatttgccacggcgccgcggcacctaccgaattcgggctagccccgccttttacactgttcttcaataaatatttatgtattgtatatgtattggagaaaaaacaatttaataatttttgtaaattggtttaaaggattaaataaaggatcttgttcgatttatgtatttttgtttcccgccctcaggctgggtttaatggtgtgtgtgtgtttttttttttaaattatggcttacactagttgcaaaatttctaagttgctgtatctccttttatttgctaaatgatttagtcaatttcctgggagggactcgaaaaagcgactcttgtcctgcgattgacccacacaaatcagtgtcttatcatctaagctgtcaggccagctcaatttcaattaaatt

SEQ ID NO: 37672 - DNA, 968 bp, Heterodera glycines
  misc_feature (564)..(564): n is a, c, g, or t
  misc_feature (587)..(587): n is a, c, g, or t
  misc_feature (605)..(605): n is a, c, g, or t
  misc_feature (632)..(632): n is a, c, g, or t
  misc_feature (643)..(643): n is a, c, g, or t
  misc_feature (654)..(654): n is a, c, g, or t
  misc_feature (657)..(657): n is a, c, g, or t
  misc_feature (664)..(664): n is a, c, g, or t
  misc_feature (684)..(684): n is a, c, g, or t
  misc_feature (690)..(690): n is a, c, g, or t
  misc_feature (697)..(699): n is a, c, g, or t
  misc_feature (709)..(709): n is a, c, g, or t
  misc_feature (711)..(711): n is a, c, g, or t
  misc_feature (732)..(732): n is a, c, g, or t
  misc_feature (746)..(746): n is a, c, g, or t
  misc_feature (750)..(750): n is a, c, g, or t
  misc_feature (759)..(759): n is a, c, g, or t
  misc_feature (762)..(763): n is a, c, g, or t
  misc_feature (766)..(767): n is a, c, g, or t
  misc_feature (769)..(770): n is a, c, g, or t
  misc_feature (772)..(772): n is a, c, g, or t
  misc_feature (776)..(776): n is a, c, g, or t
  misc_feature (786)..(788): n is a, c, g, or t
  misc_feature (792)..(793): n is a, c, g, or t
  misc_feature (795)..(795): n is a, c, g, or t
  misc_feature (798)..(798): n is a, c, g, or t
  misc_feature (801)..(801): n is a, c, g, or t
  misc_feature (806)..(807): n is a, c, g, or t
  misc_feature (817)..(817): n is a, c, g, or t
  misc_feature (825)..(825): n is a, c, g, or t
  misc_feature (827)..(827): n is a, c, g, or t
  misc_feature (829)..(829): n is a, c, g, or t
  misc_feature (831)..(833): n is a, c, g, or t
  misc_feature (837)..(837): n is a, c, g, or t
  misc_feature (844)..(844): n is a, c, g, or t
  misc_feature (846)..(846): n is a, c, g, or t
  misc_feature (848)..(850): n is a, c, g, or t
  misc_feature (856)..(857): n is a, c, g, or t
  misc_feature (859)..(861): n is a, c, g, or t
  misc_feature (868)..(870): n is a, c, g, or t
  misc_feature (875)..(875): n is a, c, g, or t
  misc_feature (878)..(878): n is a, c, g, or t
  misc_feature (911)..(912): n is a, c, g, or t
ctgatcacgaatctgtaatcagatttcagtttggatttcgataaagcctcagaatccttgcgtatagagtgatgaatcccatccccttaaacacttatggggatggtcccatccccttaaacactcttatggggatggtcccatccccctaacactcttatggggatggctcctatccccttaaacactcttatggggatggtcccatccccctaaacactcttatggggatggctcctatccccttaaacactcttatggggatagatttcaatccaataatcgagtcttatggtgttggttaccatccctccaaatagtctttatggggatgtatcttttaaaaataaaagtttttcagaatgccaattttttatctttgttttttattctaacaataacaaacaacaatatttttgatcctaaatcttccgtatttttgtgtcaagtaggtaatgaattttgtgtgttcctgttgttggtaaagcgctcccaaaagtaagaaaaaattaaaatatcgctttttggttgatttgcaataacaaaaattttttagttatttantttttctttaattcttaatacantatcattctttttaaatntttttacaaacttaaaaaaattaattntaaaatttatntccattttttncanttttatntctatatctttcactttttntccatnttttctnnnccatatttcnanattattattttttatatttanatataattattttntaantttctactnttnnctnncnntnttcnattttaaaannntttnnanttnctntatcnnccaaaaattncccccttntntncnnnttcntcccccncntnnntttttnntnnntttctcnnnttttnttnctctttgagggaaattcctcctcacaaaatttnnaaattgttccccattgatatttttcttatcatttagtgtaaacacaacagaacaaa

SEQ ID NO: 37673 - DNA, 918 bp, Heterodera glycines
gaattttctggtgtttataaaggaacaaataaattttttttaaggggtggggggaattttcatgtaaactgttccctcctaaccatcttcgtttaacctgtacattttccgtctccaccacggcgaagtgatcgccggaatggaccgtgccatgacctcaatgtgcgagggcgaacgtcgtcgcgttgtgatcccggccgcattgggtgggaattatttgtcaattagttattgcttgatacgattggtcgagactaatggtcggatggatacccactaatatttatttcgttaattaaaataatcgaaatttaaagtttgctcgtgaaatttttaaattttcgacttaaatctattaaaaagtaatataaattcaatgaaaaaattcaaattgtcacccacccctttgagaaatattaatcatgctgtttacttatgcgtttttcatttgtttttaaattgaattaatcctatttatcataattaggctatggcgacaagggccgtgacaatatccccggcggcgccactctctactttgacattgagctgcacaaactgatcaaaccgagcgcggatgagctttgaaaagtcggaacatatgacaacattggcacagagagagagtcgtcaattaattaattaatgatgagcatcattcggcaatcaaacatttccaaattaacattattacttttctatgttttttaaataccaaatattttatataatacttaaatttgatgaagttttccactctctttttaatctctttatatatttgttgtgttttatgttattcaaaatttgtgaaagcataataaatattaatttgaaattgttttacagatttttttaaaagtcttttcatttataatttaaattttgaatttaacggtaattttggaaaccaatgaa

SEQ ID NO: 37674 - DNA, 1048 bp, Heterodera glycines
attttggcaatcgttgaaatttgtgcaaatatattgagttttagttttaaactaacgaacaaacaaaaaagaaggttggcacaatacgccgatttttatagagaaattgccaaatctcgttcagagaaaacggcaagaaaaaggatacaacaggggagtggtatagccctgggagctgtcttggtcccggtactgagtgttttagctcaacatttattagaaaaaataacatcatgaaatttgcaaagaaaatgttaatgattcccgaggcggaatatttggctctacggagtgcgatgaatagtggtgattatctccaaaatgaaaaagcgagtttagacgcaaaaatttctcagaatttacaagaccccggcataagcgaggacctcaaggcgaagagacatgattggctctataaagaaagacgtacggtaaaggggatacttgaaaatagaccacagaaggtagtgattgagaatcatgtacccggtccgaacgttgcaccatatctgggcctcaataaccaatccaaactacaggagaccgatgaaccccggaaaataattattcctaagaaaagacttgaagagcaaactcctgatccggaatcggataatgatacaataaatgagttaactccggagccccaaacaacatccacattaaaaacacccattccgatcaaaactattatacacccgacccttttaaacggtctttttaggtacgtaaaggaaaacaaagatttatttaaaattacggcggccggaaaggtacagtcgaacatgaatttgccgattgaaaacagtaattatagagatgttttgttgtatctcgcagggaagaaagatgaaacgccgcgcggtgcaaaatttctcaaagatcggttactgaaggatccaacagtaaaagacatggttgataaatcaaaggtcatgtggggacgtggaaggaaaaaggcaataaaatctataaaaacacccggcatagtgcgagagaagaaacccttcaaaccactaatatgggcaagactgtagagaaaatttta

SEQ ID NO: 37675 - DNA, 184 bp, Heterodera glycines
gcatggtcaagcgatggcagaatgtccatccaaacgtcgctacaaatccagctggacatttttgctcttagtgtgcaaccatttggacaacgcttggccagcagttgcattttgcccatcgtcagcaatttcatcggggcacagatgatcgttatcgatggaattcaattgatcaagatcagtg

SEQ ID NO: 37676 - DNA, 1390 bp, Heterodera glycines
  misc_feature (1375)..(1375): n is a, c, g, or t
agtaccaacaaaccattggagttcggccaagccgatgtgctttcccgactgattgcgaaaactccaatgccagaagacgacataattttagccaaactttctacgagtgctgcaattgggagcttaaattctgttctgaagaatttccccattaaccaataagaatgtgatcgaatcgctcgaacaggacgacacactcaaaaaggtgatgaaatttgtgcgcactcaatgtcccgacaaaaagacgatgtcagaggacattgtcccttttcaccgacggagagaagcgttgccaatactggccagaaattgacaaaaaaattgaagaagttgttcgttcctgccaaatatgtgcttcggaggcaaaggcaccagtcaagactacccttcattcatggccaaaatccgatggcccatggaagcgagttcacatggactatgcgggaacattctttggaaagatgtttctcgtcattgtagacgcatattccaagtggcccgaaatattcgagatgaattccaccggttcgagccgctacgattggtaaattgcgctatctttgcgcacggcatggattgcctgaaacgttggtcacaaataacggtacccaattttcgtcgaaagaattcaaggaattcacccgactcaacggcataaaccatttgttttcggcaccttattgtccgatgtcaaactgacaagccgaacggttcgttgacacattcaagggtggttgtgtgaaaattaaacaatcgatttctgtattccaattaattccgagaaatttttggagagggccaattagtcgtttggcctctgggagctgggaaatggcttcgacggaattagaacaaaattctctaagtggcatggaagccttttcaaaaagcttaattgattttaaacatttctcgtttgcctctgatgggttgtttgacgaaaggaacacattatcaacataaatgttatttttgatttcatttgaaaggggggatggattttgagacagatggtgctgaatagtagccgcaaggaggaagggggatggacttaacccaaatgagactcgagtaaaacggaaaattttaagattagacaaggaaaggggggtttcaatgttttcatggttcacctggtcttgttcaaaagcgccacgttcgtttcgctgatgaagtggatcaaaacggtgccattgctcgagaccaacaacaaatcgccgatgtcgccgacaaacaaatcgaagttcgacgttcagaacgtcaacggcgtccaacaaagaaattggatttagacccatcaaaaccacgttatgattacatttcatgatcgttttactttcacactaccccatttttttttaaaacccaattcaanatttaaaccggggga

SEQ ID NO: 37677 - DNA, 1081 bp, Heterodera glycines
taaaactgataaattggcattggagttatctttttacatttgccaaacatttaaaaatcaaatcacagtgatcaatttcggcaataaatttgatcatttttaattaggaaaattcttacgcgcgtttgtccaccaatttaacgggcgaattctcgagattgaaattaccttaacgatcagcagaaacaatcaatttggtcatttgattggacaaagtgtccttttatcactttcaattttccatttaaagaatggaatttgttattttgcaaagattgtcagggaaataccaaagatcagtggggcagatcaaagaacacccgccgctgatcatgatcattgaattgaacaaatgtatgaacaaaaattacaaactccttttaaaatatgcgcgattgaaattttctaaagctaattttgccaaatgaaatcgtttagtagtgatctgatcaatgaattttgatcattctcgaacccaaaaataggccactgattggacgcctaaattggaacatagccaaaaattttccctataccctgatcattgatcaaacgctgatccggcattttcctatttttagagactgaatttgtcaggtaccaatttgtccattatatttttattgccttaaaatgtgaccaaaaattaaaacaaatatttgtgggggggggggggggaggtgccaaaataaaccggagcaaacatttgatgagattttgatgctggcaaaccgcatacatttggcagaccccgaaaaagtcaaagagagaattgagtctaggatgagaaacgaacaacaaaccagaccatttcagagcagatcaaattggaacagtagaactgagtggaatcctgaccgagatcgaccaccgaataccgtaaacttttgggggaaataggatgaatgaatttcgtcgagacaatcaaaatcagaattggagaatccatcaaacgaatcagttctcagggtctaatgccacgccattaaattctgtccaaccagataggcaaactgctgaaaagagctaacccgagaagcacaaactcgatttttcttaaacaaaaagaaaaacaggtaaa

SEQ ID NO: 37678 - DNA, 862 bp, Heterodera glycines
aatcacaaaaattcaaaatacatttaaaaaaagcctcgttttaaaaatttagcctattgtcctcaaaatggtttgtctaacgtataattttcgattaaaataatgatctatcttttttcaaaaatctaaccccgttatttcattaagctccgctgttctcgactgtctgaattcgtgtcttgaaagtgctgacggtgagcttgttttgccagtgcaacaacatcaacaatcggacatttttcctggtggcacacagttggaggactccaaagttcgacggcatgcaaattttcggtgaaacaaaaaaatgacatttttcaatacttttttgtcattcttcaggatattctttacaatggaccccaaaaatggccaactgtcacgcgcaatgcgaaaccgagcggtggaattggcatttggcatggacacagtttcagttactgctgctgcttctgctattaaaccgcccgtttggagtgccaatgccgtggatgttgtcagtgctgtgccattattaccacgggcggaactcctttcatcatcattgaattcaattgccactcccattgtgccggcttcgtcaaaacaattgcagcttgtttcgcagctgcaacacaaattggatgggtaaataaatctgacaaaacattgaatcattctgtcaaaattttgaataaaaaagaacaatttgagtccctgccatttgcgcactattgattatatttgttcatctattccgcaaatgggattttttatgttttgatcaagtccgattgatcttttggcaaattgcatttaaagggccatttatcatgaaaatttttattttttcgatttcgggacctggctttagccccctcac

SEQ ID NO: 37679 - DNA, 653 bp, Heterodera glycines
ggcaaacccggacattttggcggaccggatgaaattgttgctgagcacggccaaaggcgccgatgctcattttttggttggcaaatgtgacaaaagagaggcgagtggctaattaattaaaaactaattatgagaaaagatgatatttttagtctctaaaaactgacaaaataggtaggctctaggctttaaaaaccccaaaaataggctctaaaaaatggaaaataggcacttaaaaacagggctccgaactctgctgaattatcagcattttgctgatttcagggggtcaaagctgtttttttttgtcgagatgctgattttttgataattttctgttggatattcaaatttatggcgatatgctgatttttgagtctttgactttttattccttagaaattttattgcttaaattgtttattaattaattagttcctccattttcattactatgacttcaaagcgcaaatttttcaaaattttgctgatctatgctggttcttggaaaatcctcaaaaatggccatttatttccaatttttgctctggttcggtgcctaccgacaccgccgggcccccaatttaaaattttgaaaatgctgatttttgaccacaaatgttgattttttgtcggtaaaatcctgattttga

SEQ ID NO: 37680 - DNA, 1129 bp, Heterodera glycines
aaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaaactattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaataaatcgattttttcaagtgtccgtttggggtactcaaacaattatggggagcaaaaatccaacgcagaattaaagtacaggctatagtgaagctattccggaaggattcggtctccccataaatctgggcgcatcggttcagggggactgccccgaaaacccaaaaaaaaattttttggataaaaattatttaaatgaactgactagataatatttaaaataggttatttctcttcctttcagtatccctgcaaagtttggtgcgcttctgatcagtttctgaaaaaaaagttaagcctaaactttttggcctgtttaaaaaggaattaaaaatttttaaaaattttattcatctccctttttgatagaaaaagcatcagagtgcctaaactaacatgtaaataaaat

SEQ ID NO: 37681 - DNA, 796 bp, Heterodera glycines
ttttattgttttaattatgtgtatatgatcgaatgctccccacaacaattttattgttagctaaattaatcattaattaaattaactaacttgtaaactcttactataatttttttttgaaaatcataaccattgttagaggtctattttcaccacattttttttttttttttttttttttttttttttttttttttcccccaaaattttctttccccaaaattttctttccccaaaattttctttccccaaaattttaaaaggcaaaaacccccccaaaaaaaaggccaaaggcccccgtttttgaaaaaaaaggataatatcgaatttcggtttgaccaatttaaaaagtttgttcccccccccaccccgccaataacccccaaatttgttgaggggtggaatccccaaaacttatttgggaaaaattggttaaaggacaacaaaaaggagcaaccccccgggaactcaaggcctttccccacccccccccccagggtttttgggggcaacccccccccccccttcgaaagggccccccaatgggcaaaaaaggccgggtggaactcggaggaaattatccaaaaatcaaaaaaaccagggtggaaaaaagaaccaaaaaaaatcaaggccgttaaatttgggggaagggcccctcccaaaggggaattgaggaacaaggggttttttaaaaaaaccccccaacaccaaaaataacatttcccttcggaaaaaaaccaaattgccagggccccttttgggaacaaaaaaaaccaaaacttttccttaaaaattt

SEQ ID NO: 37682 - DNA, 1382 bp, Heterodera glycines
ccaattaaattaattatttttcttaatagttgacaggctacttaattaaattaattatttttctaaaaaagaaaaaaagaactggaatataaaccaattttttaaaaattaaaaaaaaattatcaaaaaatctttgattttttttttgattttttttaaagatttaaaataaaaccaaaaactcaatattaaaataatttaaatttaatgaaaaaaaaaaataaattttaccctctaccgctctctctctttttctctctcttcctctccctctatcgcactctaccgctctctctttttctctctcttcctctcccgtttcctctctctctctctttttgtctctccatctttctcttctctttctctctctacacaacctctctctctctccctctctttctttctcaatctccctctctttttttcctttcctcttttctattctctcatcacatctctctctctctccttttctctagctctcctcacctcactctctctctttttgtcctttcctcttttctattctctcctcacattactctctctcctttctttctccttttctctcgctctcctcaccttactctctcatccatccttttctctcttccctcctcacctcactctctcacttcctccttttctttcttctctattcacctaactctctctctctctcttttcctccttttctctctctctctcactctcttctacaaaactaaaacggaaaaagatgaatattttgaaacatccattgttgacaaacaaaataatttgtttggttaaaattgtgtcttacttttcctctttttctttttcaaacattgtttttatttttcttttctttttattaaaggaacgaatcgccacaaattaacgccaatttaactcgaccaaaaaaggggcggagcttcgtctcgattagtatagagtaagggataggaaaaatgcttttttcatattaaaaggatctaattgataaagttcaaacaaaaaattttatagcaaaaaagaataataactttgaaaagatacataaaaaatcggtcaaactctaattttcattgcaaataattttttcttgaaataatagcaatacgcctataccgcagtttatgattttaactattaaaaagttgtagaaaaaatttcgcttttcgcatttcgcttttcgcattttcgcatattttggcttttcgcatttcgcttttttttcatttcgcatttttcagtttcgcaaatttcgcttttcgcatttcgctttttatttttcaatttggcccatccctgatttgcggacaattcctgagaaaaaaaattaaatgaaaaaaattttttttgttataaaatctctaatggaagagtgggcctcg

SEQ ID NO: 37683 - DNA, 1016 bp, Heterodera glycines
ggtcgtatgggatttccgactcaattcggtccctcgacggccccccgcgtccttttttgaattggtcctctcctttggtggaattggtcagtatcctcgcttacattttggcactttgctttgccatgatttagtgccatgtcggatgtcttgactcggatattcccccaatggcgtctcaacaacagtcacttggcactgatcagcacccatcctcgttggcatttcgccaaggtcaactctttttccgccaaactgcccctggtaatcccttcctcgcttctgctccaatcgcttctgaactacaaatcctccgagtccgacctctctgctcacagagactttcctcccccgaggaattgctcaaatcgacgccgttcagtgcggtgatggccatagacatggccaaggagagtggaaggaggacggagcagccattgcgatttgttattcagtggagacgaaaagtgagagggactcaaacatccgtagaagcagaggaggaagagcaacagacgaaagagtccaaatggatcaccgcatcggtgggtttggccattactttttaggggatgggggagaccaaaagtggcattttatgggcaaagggatcttaaataattatctcccaacctgtatggcatgatcatcatttcagatcgagttcgaccataccttccacgttacgggcatccgtgccggtcacttccaccaattctccgtccaattggtgtcccccttggggcctgtcggcccgaccgttcgctcccattggctcaacttcgacgcgatcattgagcagttcgaaccggatggcccaatgaggcgagattcgctgcagttcttcgctcgctacaacatggacaacggcgtggccgcgttggttcggtggcggagggaccgcgacggacaaagcaaagcgaaggggacaaagtgaggggattgaacagaacatctctcaaaatcactgttttagctcaaaagcgatgcttccttctcgcttaagcgacactacc

SEQ ID NO: 37684 - DNA, 910 bp, Heterodera glycines
aaaataatgaaaaaaaaagaaaaagctggcggtgcccgattttgacactcattgagtcttaagccacgtgctaggccaagcacgggcactaccgcgtcgtctcatcacggccacggacgtagcagcaagcacaaacacaccgctagttacggcacgtaagaccgggaacgaaaccaccatccccagtcagtgtgttatgtgcctgccacaacaaccgctcaacgacgcacagacgccagcacagccgttaggtcgccccacgagcgtgcatcccacattggcgcagcgaaccagccaagcgaggcggcccgccaccgacacattgccacgcagcagccatacacaggctttcacacgtgcagcactgagcggtataccacagctccaacgtatggaagcaccccaaaagcatggctcgtgaggcagctgccccgtaatgttgggcagcgtccacaagtcatctcgaacgacctgtgcccatcagcggacgggggcatttggtggtgccaacgctagcccaacaggacagcaggtaggtggtgaataggaatcacttgggtaatgatccagcagcaggttcacctacagctaccttgttacgacttttgcccggttcaagccactgcgattaaatcggttccagtctgcataccgaccgaagccggaacactaaccgtccccgaatttctcgaaatggctcagtcccgggcagcgacgggcggtgtgtacaaagggcagggacgtattcagagcgagttgatgactcgcccctacaaggaattcctcgttcacggacaataattgcaatgtccgatcccaatcacggttaattttcaccggttttcccacccctttcggggaaggacaagcaccctgattttgccagtgtaccgcgcgtgctgccccggac

SEQ ID NO: 37685 - DNA, 876 bp, Heterodera glycines
  misc_feature (32)..(32): n is a, c, g, or t
  misc_feature (96)..(96): n is a, c, g, or t
tatatccaagaaaaatgactatctcttatttngagaaattttatacgttacagaagcgctcgagcgtgagagggagggcggtgcgcaatcgccatntaatttcacagagaatttttaaatttatcttatatccaagaaaaatgactatctcttattttgagaaattttatacgttacaaatgctctcgagcatgataggaagtgcggtgcgcaatcgccatttaatttcacagagaatttttaaatttatcttatatccaagaaaaatgactatctcttattttgagaaattttatacgttacaaaagctctcgagcgtgagagggagggcggtgcgcaatcgccatttaatttcacagagaatttttaaatttatcttatatccaagaaaaatgactatctcttattttgagaaattttatacgttacaaaagcgctcgagcgtgagagggagggcggtgcgcaatcgccatttaatttcacagagaatttttaaatttatcttatatccaagaaaaatgactatctcttattttgagaaattttatacgttacaaaagcgctcgagcgtgagagggagggcggtgcgcaatcgccatttaatttcacagagaatttttaaatttatcttatatccgaagaaaaatgactatctcttattttgagaaattttatacgttacaaatgctctcgagcatgataggaagtgaggtgcgcaatcgccgatttaatttcacggagaatttttaaatttatcttatatccgagaaaaatgactatctcttcttttgagaaattttatacgttacaaaagcgctcgagcgtgagagggagggcagtgcgcaatcgccgtttaatttcccagagaatttttaa

SEQ ID NO: 37686 - DNA, 1335 bp, Heterodera glycines
ttttgaattttttcaattttaattttttagagtcaaaaaattttggaaacaaattttttaaacgaaacagtgcacaaaaagagagggagggtagaagaggagagtaatttttaggaagggacgcaccccatctgataattccccttttctgttccataagaggccagaggcgactgtgttcgttgacaagtaattgtccaattaaggtacttggactttccacagtaaaatgtggtacaaattttggaactgtccctcctcacggtgggacttaaaagcaggatagagccaagttcaaaacttcagaggagaatttaagttttgaatttttacaatttaatttcttagagtcaaaaaatttcggaaccaattttttaaacgaaacagtgcacaaaaagagagggagggtagaagacgagagtaatttttaggaagggacgcaccccatctgataattccccttttctgttccataagaggccagaggcgactgtgttcgttgacaagtaattgtccaattaaggtacttggactttccacagtaaaatgtggtacaaattttggaactgtccctcctcacggtgggacttaaaagcaggatagagccaagttcaaaacttcagaggagaatttaagttttgaatttttacaatttaatttcttagagtcaaaaaatttcggaaccaattttttaaacgaaacagtgcacaaaaagagagggagggtagaagacgagagtaatttttaggaagggacgcaccccatctgataattccccttttctgttccataagaggccagaggcgactgtgttcgttgacaagtaattgtccaattaaggtacttggactttccacagtaaaatgtggtacaaattttggtactgtccctcctcacggtgggacttaaaagcaggatagagccaagttcaaaacttcagaggagaattttaagttttgaatttttacaatttaatttcttagagtcaaaaaatttcggaaccaattttttaaacgaaacagtgcacaaaaagagagggagggtagaagacgagagaaatttttaggaagggacgcaccccatctgatattcacccttttctgttccctaagaggccagaggcgactgtgttcgttgacaagtaattgtccaattaaggtacttgtactttccacagaaaaatgtggtaacaattttggaactgtcccgcctcacggtgggacttaaaagcaggatagagccaagttcaaaacttccgaaggagaattaaagttttggattttttaccaatttaatttttttagagtccaaaaaatttccggaacccaatttttt

SEQ ID NO: 37687 - DNA, 887 bp, Heterodera glycines
tgcaggtcgcttaaaaacatccatatatttttctaatctgcatactctttgggataaatatataatctaaatgaaaatcttgcgcaatattttgacaattatttgcaaaaaaaaaattttcaaaaatttcggcgcttcataaaagtgtgaagataatgatgatgatgatatctgatcatgaaaccgttttttcatgctgcatttttgtggaatacgcttacaattggcacgaatctgccccatccatttggacaataaattcgaattcgaattagatttcccaaattaacaccaaccacttttaaattagcgccaaaatttctaaaaaaaagatatcaaatttttctcgagcgttaatttttcccggattttttcgagtcaaaaaaaaaattttttttaacaaaattcttcttgaacaaaacagcacaatcattttatttgctgtcattgacaaaactggccattatgcccattattttcctcttgttgttgttgacccgttgtgtcagcatctttttgtgttcgccgggggggggggcggatggaatttgtggggctcaaatgggcgccgaccaaatgagcgccagcttagtttttagggtataactccttcaataattgtcctaattgaatgaatttgatgtcattcaatagccttacctattcactattttactacgaaatttcaaaaaatttggtttaagtttcaaaaaagttaggaccaaaaaggttggaaaaccagttttttgaagttttctggtactaactttttcaaaacttagccaaatttttcgagatttcataggcaagtagacaatacgtagggctatctaatggtgtaccaattaagacaactatgaaaggagttatagcccaaaaactgagct

SEQ ID NO: 37688 - DNA, 1710 bp, Heterodera glycines
  misc_feature (1698)..(1698): n is a, c, g, or t
tgctctttctattgtcgttccgttgatttcttactctgttcttccatttaccaagtagcacacttttatttttctgcccttattttatatttagcaatccttcaacgaattccgactgcttgcgatggcaatgttttgctacggtttggcattgaaataggcatgccataaatcggtcaaaggaagtgatggagcggatagcgcgctcctttcactctgtgccgctgagttgacgacactgctcagaacgaatttgcacgcggactctcagttggaggcggaaatgcacgaatgcgacaggaacatggtcgttggtgttgttttctttatttgtttatttatttgtttattcataaaaaataaaaaagtcatcagaagggcgagaaccacttactctgacgactattccggtaaatgtgtcgtagagtaagtgacaaaaatatatggatgatcacaggaattaaaaaaaagacaaaaatatgtgaaaataaataataaataaattgaggtcaaagtcaaatgaggtcgaagtaccaaatcacttagaaatttgttacattctagctttcccggtcttacatattaccctagtgaactttaagttttattttaaattgatttaaagaatttgtttttattagttctttatcgagttgattccacaattttgttaccctcccagcaaagggaatgaattttttgcccagtttgtattttgtgttaaatctataaaaggggatgttaaagcgtgctgatggattaaaaatagaaaatagtttcagatctgttcggccataaacaattttatgcgccatggaacagatcaaagagctttcgcctaatctcaagtgttggcagttgcagtattctaatcgattttggtatggaattggcggaaggctgcatttaaaaaaacccttttggtgaaatatttttgacacttttctattttttaaatattttttgaagagatggatttcaaacctccggagcgtattccaataaaggcctaatataagttttatataacgtaatccaaatcttagatgatttggatttaattattcggaacaaggaacgcatacgtaaatatgcattccttgttatatgattaacatgatcggaaaattgtaatttgttatcaatgtttactcctaaatccctaattgtctccacagcatttattgtatttccatcaaatttatatgtttcttttgggtttttggaaaccaaatataatataaaagttttttgaattgaaacttttatttgccatttatttgcccattcgaataaattatgcaatgctttacgcatactttcggtgtcggctcttgctttatagcatatatacaatttaacatcatcagcatataattttattttcactcctgatggcaaagcatcaggaagatcgttaatataaatcaaaaataataaaggtccaaggaccgaaccctgggggacgccagagccaacttttttactggaggataaagcatccccaattttaatacgaaaagtcctattactcaaaaagccctttatccacaataaaagtttgcctctgataccaattttttccaatttgtataaaagtaaattatggggcactgagtcaaaagctttctgaaaatcaatataaatacagtccacatttttcccataataatgcctcgtaccaatcttcacaactgntattagttgact

SEQ ID NO: 37689 - DNA, 883 bp, Heterodera glycines
attaaataaaactcgcctcttttttgtctccgtcccccaccaaaaagtgcacatccgcgtcctcgcccgagctcagcaaatgtttcatccgttcattcgaattcattattgaggaattcattccgaaatttaaattataattttgctaaaagatcggatcaatcagtcaaagtaaatgtgggaattagggaaggaagggttagaaaaagaaaagtgacaattcgtccagcgaatttcatcttataaactccaattttgtttaatccaactcgcttttttgcttagagccaatcccaaagtgacccacttttaggcgttgcaaattgcccaaaaatatttagtcgattaaaaataatcatagcccagtgcaaatagagagggatagagagacggagagcagagagatagagataaggagagagacaaagacggagagagagagacagacaaagacggggagagacaaagacggagagagagagagagagagagagattttatttttatttctttcatttgatatcccggttatcttcacctccggatctatctctccataaatattttttcattttaaattttatttttttcaatcctatttttcgcaggtgtcgcatttttcggtacttaccctttttctgaccctcccagaaaaattttctgataattttttctagggtgatttaatgcgctgatcatgaatctatctaagttcagttttggcgaatttcgaacctgaactcgaacaaaaaagtcgaaaattcacattttcgaaattaccttcatgttagaagctacatatatatacagaatgggcaatggtaaagaattgtggtcccggatttatttatttttaattttattttgtatttgggctcgaaac

SEQ ID NO: 37690 - DNA, 1227 bp, Heterodera glycines
aataaataaaaagagaattttaatagaaaaatcaatttaaatttatttacattttattataattatgtttaattgacttagccggcgcaaaagaggagtgcgtgcacatgctaaatgcagaaggccgatggaacgacgcgcgctgcgaaattcaaatgacaggcgcgatttgcaaaaaatcaaatttttaaatacaattgatggacgaattttaatgggcataagcaaaaaaaagacattattaattctttttaaacatatatttattactaaattgtcaataaatttgtttgggtaatgattcgaatttctcaaaaaaatggaaattgcggacatttgtctttggtcatggactaattctttgggtaattaattcatctcgtttattaaatatttatttatattttccttcaaaaatttgtctcgtgctgcgcgtgtcgagaatttgcggagacgcgccgacagacggacgggcgatgttcgcctcagacgcgacgttccgtccgctctttttccgtaattcttttgcttccgcttttcccgcgattgaccgattattttcttttcggcaattattcctttttctcctcatttttgtggcttttccattaaaattttgtgctttttaagctttgcttttcctccgcctttcgccccgtttcacttgtaattttttgttattttattcgtcggtttttgttcggcgataatattttgtcgggccaacaaaacgagtttcgcctcgacccattggtaccaaatgaatgcccataataaagaaaagtttcatcgaaactgactgattattattattatttataatagcgtgtgtcgtttttcttcgtcacggtgaccatacgcagagagttcattatctaattatatcaattttttaataggttattttttaaatgattttctttttatatgctttttccattttgcgcatttttcgactccatttgctgccaacaaattgtttttttattaaaaaatatttaaaaagtataaaattatctcgaaattgtcaatctctatttcagggttggatcccaacgatgaacttttgaaagttcaaataggggtcaattttaaaacaaagaaaagagaagtaacggcaaacaggcgcaagataattttcgagatgaaaattgttcaaaatcatacaatcataccgtatttcctagaatagagagcccccctggggctttgtttttcaactccccc

SEQ ID NO: 37691 - DNA, 885 bp, Heterodera glycines
cccccgcccccccccccccgcccttcaaaattttgaaaaaaaaataaaataataggagactcagaattttgaaaattttttataaaaactgatgacaagctaatgtgataaaacaggttaattcttttcctttcagtatccctgcaaagtttggggcgcttctgataagtttctgaaaaaaaagttaagcctaaactttttggcctgtttaaaaaggaattaaaaatttttaaaaatttattcatctccctttttgatagaaaaagcatcagagtgcctaaactagcatgtaaataaaatttggtgcgtttcagagcattttctgaaaaaaatatttatgaattaattatgcaaaaataaataaaaatttctaaaaatttgatcgtccataaataatttgtaattgatcaggggctcaccaaattttgcagggatacgtatcggaacactacaaatgcttactaattttcctagattttttaaacccggtgaaaattttttgcagacaccaccacttttgcacttaaaaaaatttcaaaaaactttaaaaattcatagaaaatttaaattcataggtactactgctaaatcaacgcagagacgcctttccttgacctttttaggcccctgcaaaatctggtgcgcttctgatcactactcgaaaaatgagtgattgaattttcactaaaaagttaagcctaaactttttggcctgtttaaaaaggaattaaaaatttttaaaaatttattcatctccctttttgatagaaaaagcatcagagtgcctaaactaacatgtaaataaaatttggtgcgtttcagaaccctttctgaaaaaatatttaccaattaattttgcaaaaaataaataaaaacgaaagactc

SEQ ID NO: 37692 - DNA, 1285 bp, Heterodera glycines
  misc_feature (1150)..(1150): n is a, c, g, or t
  misc_feature (1158)..(1158): n is a, c, g, or t
  misc_feature (1247)..(1247): n is a, c, g, or t
ttaaacactcttatggggatggatcacatccccttaaacactcttaaggggatggtcccatccccttatcacttttgtacctcttttaatcacttttgtgcctcttttagtcacagttcctaggtagcgaagctcccaaagcgcgaagcgctttaagcacccaagaaacatgtaagcacacaccggctagttactatatatgttatattgactaggggtttcgttgccaaaaacaaaatctcccggccgaaggccgggagcgccctgaaagtagtggaagggtcttacaactttttgaggtgcatccgggaaaactataggttttttgatccgacggccaactgagtcccagggagcgatttgtcacttttgcttgcagtttaggacccgtaactttttttctaaaaccctaatcaaaaagtacccgctttgagggcacccccccaaagggtcctctacatgcttgtattttttatttttttattagagccaccccttggtctgcagttgtgagcaactgaagcgtgctcaaaaagtacacttcagtaccaggtgaataacacgccgggcttttatctgagggaaatgtgcccagcagacttattgtagagcttggaaagctcgattttttgaaatttcaaaatttcgaaaattttcaaaatttttcgagttaggcctaaaagtaggttttggggtttttgaattttaggattttttaacgatttttcccgggaaaacggaggccacttccaacacatagtttttcgagctctatcgaatggtatttttttcggaaaaatttcagttttttcccggaaatagaaaaattttttggcctgagcgggacatttgagtcccgggcccataactcgttaggggttgatttaatcgaaaaaatgccttagagctaaattgtagagcttttaaaatgctatcgaatggtgtgatatatggtcggaaattttcaaaaatttccgagctaggccccctagaaattttcggaatttttttttgtgttgaaaattggggtgaaaaatatttttcaggggttaattaaggtgctgagcacgaatatgacctttgttttccgtttcaaaatttttggaattttttaaaaattcgaaaatattttccaattttttggccaagngaatttgngctaatatttgaaattcataacatatgattgagttggtcaatttaatgaaataaagctttaaaatagagaaaataaggagaatttatgngatttatttgggtttctacatgaatagaaaaaaaatat

SEQ ID NO: 37693 - DNA, 1165 bp, Heterodera glycines
gctcgagcgcatgtgtatcgtataaatttctcaatatgagagatagtcatttctctaggatatgagataatataaaaaattctctgtgaaattatatggcgatcgcgcagcgcacttcctatcatgctcgagagcatgtgtaacgtataaaatctctcaatataagagatagtcatttctcttggatataagataaatataaaaattctctgtgaaattaaatggcgattgcgcaccgcacttcctatcatgctcgagagcatttgtaacgtataaaatttctcaaaataagagatagtcatttttcttggatataagataaatttaaaaattctgagaaattaaatggcgattgcgcaccgccctccctctcacgctcgagcgcttttgtaacgtataaaatttctcaaaataagagatagtcatttttcttggatataagataaatttaaaaattctctgtgaaattaaatggcgattgcgcaccgcacttcctatcatgctcgagagcatttgtaacgtataaaatttctcaaaagaagagatagtcatttttcttggatataagataaatttaaaaattctctgtgaaattaaatggcgattgcgcaccgcacttcctatcatgctcgagagcatttgtaacgtataaaatttctcaaaataagagatagtcatttttcttggatataagataaatttaaaaattctctgagaaattaaatggcgattgcgcaccgcactccctatcacgctcgagagcatttgtaacgtataaaatttctcaaaataagagatagtcatttttcttggatataagataaatttaaaaattctctgtgaaattaaatggcgattgcgcaccgcactccctctcacgctcgagcgcttttgtaacgtataaaatttctcaaaataagagatagtcatttttcttggatctaagataaatttaaaaattctctgtgaaattaaatggcgattgcgcaccgcacttcctatcatgctcgagagcatttgtaacgtataaaatttctcaaaagaagagatagtcatttttcttggatataagataaattttaaaaattctctgtgaaattatatggcgattgcgcaccgcacttcctatcatgctcgagagcatttgtaacgtataaaatttctc

SEQ ID NO: 37694 - DNA, 1680 bp, Heterodera glycines
gaagaggaagacggaagagagtgaaattgaggatgaagaagaggaagacggaagagagtgctgctggtccgaggcttatcacggggagaagggggggggggggtgacatacggacgggggaattgcattcccgtgtccacacagttctacaaggtttccccaatttgcgttactccccccccccaaaccctgttttattcccaaaaccttattgatatgtcacactgtttgatatttttgcattttaaaattattcaattttcatttgaatgaattaaactaggggttcacccaaaatgatattattaacatatttgtcttctttgtcaactcctttgctcccttcgttcttttggtgtttttggcactcggaaaggggcatttatgtacggaggaggggccgaagaagccaatggaaaggcgggcagtcgaagtgcattttcataggaagggggaggggacgcatcgacggaaggtcccactggggacgaaggacagacaaaaggcagcgaatctgtgcggaggaggacacttttagcactcaatcgtttccaactttgctgattgtgtcttttgttgttgtaatgtctgcagcctaaactaatcaggaaaaccacgaggaaaaggatcaaagtgaggccggcggcgatccccgaattggtcgctgcccggcgttgctcttccgcggccgagtggccgtagtaatgggcccacgacgcgggtctgagaattgggcgaatttgtgctctttctcaccattcagacagaaaggtgtcattgaatcgtgttttggtccaatttggacccgcgtttagtgttaattacctgttctgtgaatgataggcccacatttattggacaaattgaatcagaaaaaaatagtcggatcaaaaaacatttttaaagcttctcatttgacaattggaggataaaaaaattacaaaacttggtaagtcaataattacgaacttataaatatggggaacgaatgaacggaaaaaaaggaattgagaaaagggggggggagagactgccgctgctaattgaatttgaggcaatttgtcgttttaaattttatttttgaaaaatgcgcggcgcgagtaatggcagagaaagaacacagtgaagggcccttcgcttatcgacgacttcgatcactgacgcccccccccccccatcaacccaattttgaacaataggaaggcgggagggacaatgggaggcggggccatgcgtatgaattgaatggacgcgagggtatttgggacacaattggaaatgaatgaaaaaggggaccaaagaggggggggggggacagaagacatccattgattgtgctctgatcatttctcgtcgaaattcaattcgttcagtgccgagtaaggcgacccaacgcatggcaatgccaaagggtctctgcacgccttccgtcggcctgaataattattttattttacgtttccttgtttgttgggcttctcactcggataacgccgcatcagatagtcattggccacgttggccatttggactaaaattgaaaaacgacgaaatatcgccacaacggacaattggcacaaaccttccctcagctgactctccaatttgctcttttgctgggcaactgcaaagttctcgaccaccattgaaatgggaaaagccaggatgatgatgccaaaa

SEQ ID NO: 37695 - DNA, 971 bp, Heterodera glycines
  misc_feature (925)..(925): n is a, c, g, or t
  misc_feature (947)..(947): n is a, c, g, or t
ggtattattactattttatttattaaaataattttttgacataaatgttcaaaatgtttttaccattaaattagtaaaaaaaattaataaaattaaaagctattttataagttaaataagaaaaaatatttgattaacaggaggataattaattctataaaattatacacacttttttaaatagtattaaatgttaaaaatttttttctcatcaacaattttatgcccataatttttgccaattccaaaaattcaatttgaataaattgttactgcccaaaaaatttgcataaattttcagcttaaacgtttcaacaaatatttttctgtcacaatttttgctcaaattctgccaaatacaaacaagcgctttcatgaattcgattatggtaaacgattcgctattattgaacaacttcatttgggacaaaattagtcaacaaaatgagaccaaaataatgacaccatacactgaggtaattaaaaaataattactttttctcaatattattttatttaaaatgaaagaaataaaaattaaggtttttcctattttaatattatattccatgtttaattcacaaataccatttatttcgaaagaagggcccccgggggctttatttttaagcccccctcaaaggggatgctttatttctgggcaggttctaatttggggggggggctgtattttagaaaaaaggtaataggaaaattatttgaaattttattcaaaaattatgagcgagttcagatgaacttaaaattttaagctattccattcttaataatataaaagaaattaaatataaaataaactttaatattataatttatattttattttctcagtttttattcgacttggattctaaccgtttcaacggctttttaattgttataacaaacaaaatgcatatcactnggcgagtcgtgccacctgtttnggcatctattctcacttgagctga

SEQ ID NO: 37696 - DNA, 591 bp, Heterodera glycines
ggggcggagtcgttacttaaaaaaccatcattatgatttgatgaaaaattatttataaccagggttcccagatcaaaaatttcaaaagcctcatttggcaggcgaaaaagcctcattttgtgtcaaaaagcctcatttttataaagtttattaaaacacgcttaaaattttcaaatgatttatttttgattgtccatgatcaatttgagcaattttttgttcgaaataaacattttgtgaaattctaagcatgaaaaaccgaagttgattttttgcggcgcttttttcaaaaaacttttggggaaccgggggccggcggtgccgataggcgccgccgggaaaaattttgtgatttttaatacgatttgttaacagatttgtcgacaaatatggacaaaaacattatgccaatttatcaaaattaatcaaaatttaaaaaatctgacgaattttccccaaaaatcttcaaaatttctcaaaaaaccaaaaaaagcctcaaaatttctcaaaaaaccacaaaaagcctcaaagcctcattttgaaaatttagcctcattgacctatcaaaaaaccacaaaatgaggctaaagc

SEQ ID NO: 37697 - DNA, 1101 bp, Heterodera glycines
ataaaaaaaaaactaaaaatgtttaagtcgaaaacaatcagcagttgttttagaacattaatttatattattttcaaaaattatttaggttcgggccgatggtcagactgctgatcctttctctcttgttttctcctgcgcagcagctgagcaaaaagggctcaattctaacacttcaagcacagtgcctcgtgctcaaaatgctgctgctgcatcacggccgaccgatccacggccaaatgcaatccaaactgtacatgctgcatctgctgctgctgttggaggtggcgactttttaattcctctttatattcttcttaaaataaaataaaaaataacccaaaaaaatggaaaaaaataacctttttaacaatgggatttttgttcgactttcggttgggaactcaaagaaggagtcaaggcttttcagtttatttatttccaaattaaataaaagagaaaaaaaggacacaaacaattttttgagaagacgacatcataaaattaatacaattaaattcgaatgaatgaaaaggtgggaaaaaacagtcacaaataaatgaacataatgccaaacaaatatagaaataaaaataagggtcaaaaagtccaacataacatcaaaaaaaatatatattaaaaataaaaacaaaaaaataaaaaaatcccatcacagttggcgcaaacggtggtcgtggtgttgtgattaaaaacgttggcaaaaatggcacagatcttcctttgtctgtatgttttttttcggatttttgtcactataacacccaaaaatgtaacatagttaattttaggcttgattaatttttcatccctttctcaaaaactgaattattacaaaatattcgggttcaaatgatgttttgctttaggctattccctcaattctcaagtgttcgcggctaccacctccgccaagcctccagtgccttcgtggcggtggcctgacgcaacatcaaaaaaggaggtacctgtcagatgacactttgtcatctgacagtgacgttcatgcttcaacggggacaagaacgtattttgtcttctgaagatgaaaaaggaagaataagggaaaaaaagcaaaaaaaa

SEQ ID NO: 37698 - DNA, 1255 bp, Heterodera glycines
  misc_feature (1156)..(1156): n is a, c, g, or t
  misc_feature (1208)..(1208): n is a, c, g, or t
  misc_feature (1226)..(1226): n is a, c, g, or t
acacttcaaaaaacaaatttttttttaaataaaaaaatttgactagaccaatcgaaagctaacggtcgacctaatggaaaaaaatccccgaaggagagaatttaattaattccattccttcgggggtccgtgccgggtgccgcggggtaagcagtgctggtttcgtttcatcacggcccccatccttttgactagtcagccagcgttgcttaacttgtcagatcggacgggtacgcatgattccaattttccaagcaccccaccgaaagtagaacgaaataaccaaaatataaggaaaatattttaaaaagatgttattcatctcccttttgatagaaaaagcatcagagagccttatttaacttttaattaacatttggtgcgtttcagagcacgttctaaaaaatatttatgaattaattttgcaaaataataaataattaatgaaaaagtcagaatttcgaaaaattttaaaaacaacaagcgttggcattttttcaggttaagttagtcctttacaatggagaaggcctgcaaaatttggagagattatatcgattttagtgcgctaagttcgatgaaactttttaaaatataagcctaaactttttggcttatttaaaaagcaattaaaatttttaaaaattttattcatatcccttttgatagaaaaagcatcagagagccttatttatcttttaattaacatttggtgcgtttcagagcacgttctaaaaaatatttatgaattaattttgcaaaataataaataattaatgaaaaagtcagaatttcgaaaaattttaaaaacaacaagcgttggcattttttcaggttaagttagtcctttacaatggagaaggcctgcaaaatttggagagattatatcgattttagtgcgctaggttcgatgaaacttttaaaatatacgcctaaactttttggcctgtttaaaaaggaattaaaaatttttaaaaattttattcatctcccttttgatagaaaaagcatcagagtgccttaattaattttttttaaataaaaaaatttgactagaccaatcgaaagctaacggtcgacctaatggaaaaaaatccccgaaggagagaatttaattaattccattcctttcggaggtccgtgccgggtgccgcgnggtaagcagtgctggtttcgttcatcacggccccatccttttgactagtcangcagcgttgcttaacttngtcagatcgacgggtacgcatgattccaa

SEQ ID NO: 37699 - DNA, 1449 bp, Heterodera glycines
  misc_feature (153)..(153): n is a, c, g, or t
  misc_feature (1319)..(1319): n is a, c, g, or t
taaaaagaaatgtgcgaaaacatcgtggcaaccgaaaggaaccagaaatgggcacggtctggttcatcttttgctgctgttgttcaaagttgaaaatagcagccgagttcccgatatattcatttggctaacaataaaaataaataattgttntaataaatggtttgccgtatttgcatttacctgacgaaaatcctgtccacatccggcacatacgccgcgcatcacaaccgaatggacacagggagtggtcttaaaaaatgttccttttccctcttttactgaagaattatgtaccaccttctccgatttttctgactttccatctttttcggtggtcaaatccacaatttgtgccacataaacctcggcagccggttcttgtccaacttccttcacgaattcgtctgcctttttcggttctacaaataaatacagcaatcaaaatgaagcatttgagggaaataaaacactaattgtaaatggttttgtcatgtagaaagttcgagcatattcggctaaaattgtgaatatcttttaagttttaaacaagagactcaattattggactaataaatttattataaaccgtaaattcagttattttagtagaccaaattgaacttttcataatcccccaatttttaaaaatttcctaacttagaagttaaaaaatcttcgaaaattatccccctcccccaactcaccactctccgccgtcaatttctcatccacgcgttcatcggtgcggttgttgctgttgttgtcagccatcgttgcctcgcgaaattcgcgttccaattgttccgcgaatgggtcagcggcgacggtgccaccgccgcactccacgcgacgacgcttctcgtagaagtcgcacaacttcttgaacgactccttcttcaccaccatccaaccgtcgtcacccgcgttggtgccactgtcctcctcgtcctcaacggaagacatagtagtcgtggaggagcgggacgagaacgaagagacgtatgatactaaaaaataatatctattgaattatgagtggatggcaaagggaacaattcatcatcgactcccaagcaacgcgaagaaacggaaaacgatttgcaaccaattaagactaggtatatagctaatgttgtttttaagtgaattataccatttccattgtcaactggttcctccgagttgtgcgtgctcaacttcataaggtcttcttcgccgttgtctttgttcactccgtctcccaatttgcgcttgttgcccaattggatgggtgccgttggctgcttttctttgtccaacgaattggcattggtctngaagtgaatcgaaaaatatttaaattcataaaaaatgtttccatttatacgataacgattagttaaactttaaaaaagtataaattagtagtactaggcactggatcaatctgtattttatcacaaaaat

SEQ ID NO: 37700 - DNA, 1412 bp, Heterodera glycines
  misc_feature (1368)..(1368): n is a, c, g, or t
ttttttttttgcttttcataagtgaccaaatgccgtaaatacaggggtaggtgtttaaaaaaatccctagtgcaagatgagtatcacagacaaaaaaagtataaaatttgttacaatggtttgggtaatagttctataatgcttctccgctgacaaaggaaggtccccgggtgtccgtgggatttccgaatgaaatttggtgggtggatagagcacccatgggttcttaagaaaagtggttatattttttgcggaatgagcccgagcgccgagttatgactgcaaactctttttttttttgcctttttaaacaaagtaaattacaaaaataatttctaagaataaaattttttttaccattttaacaaaaagatattcaataaaaatattagataaaaattatatttttttaacagaaaggtaagtatcctttttaaatattgcatctttatcttaatgcctttttttggttttaatgaaataaaattaaaaataaaattttacttcataaacaaatatttttaataatttttttccttaagaacccatgtgtgctctatccatttggattactgtacttttcggaattattgatttttgacctttcttttctctatgggaggattcgtagagacatgagattttttatatattgtagcaaattttaggctctttttgctgtcatatttgtctttcacgaaaaaacttttcagccctcctagggattttttaaaatcatagtcccccaggggtgttaaaattctgatcactcgatcacactgaaggaatgatatggtcactgtggtgcaattgactttttcgaccaacattgaaagcttcaatttttaagggaaaagtttgtttggtaaaaatttcagcccgattggccaattggaagtaggtatgtgaaatatcaaaagaaactccttaagctataatcttggtaatactgtatgcaaattcgaaaactggtgaatcgactttttgttcgaattcggatccggattcgaacttcgccgaaatggatgacagatttgtgatattctctaaaacccgtgaaaattcgtctttatgaattttcaaaaaaagggggggggattaattacagtattacatatagtaacctttatgtacatatgtatatgttagttcacaattatggatttttgttcatttttcgtctatgtatgtatgtcccccgttgcttggcagagataatcccctgcgattaattttcacactctgaagccatccaattggcattttgtcggcctaacagaaggagcgataatagcacagacacagcagcagcagatctgggcactgttttctgctgttggcttccgttcattcggccttaaacaaccnaaagacagagtcttctgcccattttgttgttaagctctttctac

SEQ ID NO: 37701 - DNA, 944 bp, Heterodera glycines
cgtccatttgctataggacagcgatcatcgaactatacatttgccaaattcaaaaatgcagattataatttattacccgccccatggccaaactgatcatgtccgcttccaccggttccgtcataatttgccaaatcgttggcaattaattgcaaaattcactctttgagttaggcaattccgtgttttactaaaatcgatttgtgtcaggcaatttttgagtgaaggaaaagattaatggccaattctgccgcggtttgcgtgcgaaatgccttctcttttcctttttttcatctctataaaagccattcattgccaaatggtccatcattttattaattgctttccctttgctttttctttgcctttttgacaccaaatgaattttgggcttttattttaaaattattctcgacaacaaatcactcgcggctttttgcataaaaagctttatgcatattaatgagttcaaattgaattgagggcattaaaagtgaaaggaataaatggaggggggggagggaaaggtcggatgtaatttatcgaccggataagcggaggaggaggagtaacggcgggggaagtgcctccccggggtgcttctccctccccctccctccccccgggggctttttctcttccgtcacggggaatttcccgccccttttgctttgctttgctttgctttgttgctgtttgtgtgttctttatgtgtacaatgtgtgaagaggaagaaaggaaggctaaagagtgttgggatggggggaagaagcaaaaaatgaagcgaagtgaaaacggcgacagttggcaaaggcaaaggcattggcatggaaaagtcaaaaaaaggaggggggagggaacggtgaaggggagggggacgagggaatgtgagcggtggaagcaagcaatttgatcagtcagtcgatcagatcagtccatcaatt

SEQ ID NO: 37702 - DNA, 869 bp, Heterodera glycines
gcatcggttcggggggactgccccgaaaacaaaaaaatcgattttttcaagtgtccgtttggggtactcaaacaattatggggagcaaaaatccaacgcagaattaaagtacagactatagggaagctattcccgaaggattcggtctccccataaatctgggcgcatcggttcggggggactgccccgaaaacaaaaaaatcgattttttcaggtgtccgtttggggtactcaaacaattatggggagcaaaaatccaacgcagaattaaagtacaggctatagggaagctactcccgaaggattcggtctccccataaatctgggcgcatcggttcggggggactgccccgaaaacaaaaataaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcagggggactgccccgaaaacaaaaaaatcaatttttt

SEQ ID NO: 37703 - DNA, 1029 bp, Heterodera glycines
gaagcggcggaaatggggttttttgagaggggaggcggggcaaatgggagcgagaatacaattgttccaaagaatcagtttccgttgtgcattttgatgggcaacggaacactgcgcgagaacgacgaattgggcaatatttatagaaggtttcggcagagagacggactttctgagtctcataaacgaaaaggcgagcgaagctttgccataatcccattgaattacggttgggaatgggtacggtaccgagatgatcagtgaattgtttggtcaaatctttttcatagagataagatcagattagtaatgtaaaaatatgatcatttatttagttaattctcaaatcatattaaggtaaccgcctgtaagttgaaatatgatagatctgagcttgaatagactcaatgctttttaatgataccaaaaagatagggtttgttcacacatgaacaaagttattgtataaaatcaggtattgtcagttgattggactcataaaaatacatttggactcataaaactcgattggactcataaagtgcattagagccgaaaagcgatcacggaatgatcacctgaaaaggaaatggtttatcgttaatcaatgcttttgaatctgaactaccgaatctggttgcttaaagcgaattttgttgggcagcggacggtctggccaaggaaaatgcacagatttgcgaccaatccgtacagataattctatttttgttccattcttgtcaattttgattgttctcaaaattggaaattctgattggccatcgaaatgtttgtccaccaacgcatcaaaatgtggcgaaagaagtgccattttgaggccgagttgtggacggtcaaagaacaggagagtgtccatccaaatgtcgttgcaaacccatggaaacatgttttcatgatttatgaaaacgaaaaaaaatttcgaaaaggggggggggggggaccaaccaaagtattacctagaattcaatgctacgtgaaatcttgatctcctttttcattttgactttt

SEQ ID NO: 37704 - DNA, 940 bp, Heterodera glycines
ctatcatgctcgagagcatttgtaacgtataaaattctcaaaataagagatagtcatttttcttggatataagataaatttaaaaattctctgagaaattaaatggcgattgcgcaccgccctccctctcacgctcgagcgcttttgtaacgtataaaatttctcaaaataagagatagtcatttttcttggatataagataaatttaaaaattctctgagaaattaaatggcgattgcgcaccgccctccctctcacgctcgagcgcttttgtaacgtataaaatttctcaaaataagagatagtcatttttcttggatataagataaatttaaaaattctctgtgaaattaaatggcgattgcgcaccgcacttcctatcatgctcgagagcatttgtaacgtataaaatttctcaaaataagagatagtcatttttcttggatataagataaatttaaaaattctctgtgaaattaaatggcgattgcgcaccgccctccctctcacgctcgagcgcttctgtaacgtataaaatttctcaaaataagagatagtcatttttcttggatataagataaatttaaaaattctctgtgaaattaaatggcgattgcgcgccgcacttcctatcatgctcgagagcatttgtaacgtataaaatttctcaaaataagagatagtcatttttcttggatataagataaatttaaaaattctctgagaaattaaatggcgattgcgcaccgccctccctctcacgctcgagcgcttttgtaacgtataaaatttctcaaaagaagagatagtcatttttcttggatataagataaatttaaaaattctctgtgaaattaaatggcgatttcacaccgcacttcctatcatgctcgagagcaaggaatcgtacaaaatttctctacaataagagatagtcatt

SEQ ID NO: 37705 - DNA, 867 bp, Heterodera glycines
ctgctgctgttgttgaagcatttgctgctgattttcccccgctgctgctgctgctgtcgacgaatgagtgaataaaaatttcaatttttcacgcatcgaatactttaaaagggtaattaaaaactaaattagttattgaggaaattcaccactttctcaccggaaaatttagaatgaaaatctcggtttgttctttgagcgtgtagccgacaaacatatatttgaactggtaaagcaagtcgcaaatgctgtcctcgtagtgagtcggccgaccttctgcaccaaatcggcaagaacgttgtaaatggaaatgatctgaagaaacccaaacaatcaaacgcaaggaaaaggacgagcaaactcgaatcaattaaatctaatagctgaaatttgcagctgccctaatcgaacattgtgcccatgggacacctcgggcatgtgtttgttccgctccttttcgtgaattctctgcaaatacggcaccacaatgcgaaggaaatacaccagctgtgcctcattgtccactttgtgagcaagtcggttgatcacgaaatcgggaataatcgaaagcgaattctaaaatgatttgatttcaaaacattttgtttgtttccgaacattgccgccatgttgacaaaatgaatggattagggccagcatcgagagaatgcgactgtccgagtggaggtaaacttcgtggctaagcgactcgaacaattgcgaagggtcagcgtcggcagaggcgatttgggaccattcgaaggactcctcaattcgatccaagaagaaggcttggaaggaggaaggaagcccagtcaacaacaaacccaacgcattcagagtgtcctggaaaatagtccttattta

SEQ ID NO: 37706 - DNA, 966 bp, Heterodera glycines
ttttattctttttgagtatatctgatcaacgccatactcaacagggtctgggatttttaggtgctaaaatgacaaaatggttgatagggcttgcaattatatggaaagtcatatttatttcctgggattgtgggcctgaaacgcacaaaaagcatgttagctttattttttcatatttaccctatttttagggttttgtcttacatttagagaatttgaagatatatcgagaatctaccatttggaaaatgttctccatattttagcaattttatggccatatttcgcaattttatatccatattttttccccatcctacttattaacaaaatgcaggtcaaaaaattatccagtttgaagcctcgaagtttttgtgacaaatgatatttaaataatttttattgcttaaataaaaaaagccatttcttttttggtccgacttttggcttttcattatcgtataaatttaatcacaacccaaccacagttcactgggtgcgcccggacaatccacaaagcggacaatctgtctgttgacaatccgtcaataaagataatccttgcgtgagccgcacacacacgcctttccccgttttgaataactttaaaattggatgtattagcttggtaatgtccagaagaggtgccactgctcggatatatgccgcttggaacaatgtttagtggaattagtcaagaaattttttttttattaaactaccgtacttggtggcactccgtcacaacaaactcaccgacaggcggcacatttttccattttgagaattataattataagaacacaaacccatagccccccgccccacccataacataacacacaaattatttattctgcacacaaacacacacccaaataaaggacggacggattgtcgggttgggttgggttgggtattgggtgttgttgttcaacaccgtcaccaccacccaggacataacat

SEQ ID NO: 37707 - DNA, 709 bp, Heterodera glycines
  misc_feature (634)..(634): n is a, c, g, or t
ttgagtcacattgtttggaatgccggagatttgagtcccagagattgaaatgctggtgggttgagtcccagcgattggaaagtctgataattgagtctcagagattgaaatgctggtgggttgagtcccagagattggaatgtcattaaaagttggtgggttgagtcccagcgattggaaagtctgataattgagtctcagagattgaaatgctggtgggttgagtcccagagattggaatgtcattgaaagttggtgggttgagttccagtgtttagaatgccggagatttgagtccattgtttggaatgccggagatttgagtcccagagattggagaaaaagccaagaaaatgatgcgaggccgcgaagcggccgagccagtcgattttatcattcttaattctataacacaatcgtactgcctagcgggggatgcgccgaaggcgctgaccccgctagtaattgacaaagaaaaaagcaaacgtactttttattatttttcatgaatttggtttgaagcttgaaactaattaagagattttttgacattattcgatattttgctcacattgtacatttttcaaggacagttcttgaaaacgacacctcttgaccctatttttggaaatanaaaaacaaaaagacacaaaaattaaaaaaaaaagttggattgtctaatccgcacaataagtgaattactttatat

SEQ ID NO: 37708 - DNA, 1420 bp, Heterodera glycines
  misc_feature (1029)..(1029): n is a, c, g, or t
tgcaaatgccccattcgccgctgaacagaagggacagcaaaccccagtttggaggctagcaggccaacgtacagcaacaaacgggtgaatgcagtccagatacgccagctctgtccgtttccacctcatcggtttcacgtcctctttaactctctcttcaaagtgctttgcaactttccctcacggtacttgttcgctatcggactcgtccccccgaaacccaaaaaattttcagtaaatttttcggcgtcatgacccccctgccccccccccccttgcacagagctatgactcaaaaatacattaatgagacttataccacatataacaagttattttaaaacaaactttactgtcgagatcaccactgtcaaaaactaacagcaccaaatttcaaaaaattcaacatgtttaaaaaaagttatggcatttcgtgttttgaagtggtgaaacccagttttttaaattactttgttggcaataacgattagagaccgacttttgaggatatgtcttttttgtgcactagttccgatatattaagcataaaaacgcattttccacttggtttgaagcttttacgttgacttttattatgccctttttgccgttttggtgccttttttggcgatttttccaaaaaagttccattaaaaatacaataaatcgggaaaatacacccctaaggaaggtgtaccggggacccagagcggttccccatgggccccccgggcgaaattccccccaaaaacggaacgggaaaaaggggccggggcccccttcacaatttttgggaaaattttgtggggggggggaaaagaaaaaaaaccccccccccaaagaaaaaaataattttttttccgggggtgtgtggcggcggaggaggggtgtgtgggggggaaaaaaaaaaaaaatattatttttccctccccctctccctgggagggaagaaaaatattttattttaaatattgtgttttttctcttccccgccccccctcctttgtgtgggggggcgccccccccccntgttttttttttttttttttataaaaaaaaaaaaaaaaaggagggggaataatatttttttccccccccaccccaaaaaaaaaaattttttttttttttcccccccccccccccccccttttttttggggggagaaaaaaaaaaaaaacccccccccccgggggggggggggggggggccccccccctccccttaaaaaaaaaaaaaaaaaaaaaaaaaaaaaaaagggggggggggggtgtttttttttttttttaaaaaaaaaaaaaaaagaagaaggggggggggggggggggggggggggaaaaaaaaaaaaaaaaaaaaaaaaccccacccccccccccccccccccccccccatatatttttttttttttttttttttttttttt

SEQ ID NO: 37709 - DNA, 1466 bp, Heterodera glycines
  misc_feature (1327)..(1327): n is a, c, g, or t
  misc_feature (1396)..(1396): n is a, c, g, or t
  misc_feature (1414)..(1414): n is a, c, g, or t
tcatcgcctgcaactgcatcggtgatgccttcctacccctcaatgccgcggcggcagcggcagtcgcggcggtgacccctccgtacgccaatttcggcggagcaaccgcgtgagtgaatggacgcatttccatcagcagaggaatcggcattggcacctcattcaccctattttacctccttcagaggctttccttttgctggaattggcggagtgtcctcaatgatcgccccgtacgcgctgaattcgatggccggcggatgggcagggatcgacctgaattcgacacaccagggaaacttggacggatgaccgaccgttgggggaagggaaatgtcggaaaaagcgaaggacaaaaggacgacgtatccctcgccattctcacaaaacaactcattcattctgctgaatacgtgtatcatctgtcccctgtcccccctcccttttttgacttttccattcgtcgctttgtctttttttcgttttttaattttgacttttccgctttttgttttccttacttttcgcccatttttcagcttcgcattttctcgaattcgttcgcaaattttgtttgttttttcaccaatctgcatgcactttctgtcaatctcttgccggaagcaaataaataataaaatttgtcgataaatatttgaaaatcaactcattagccgtcctttgataatgagttaagtatatattagtggcatttgcttagaagtcgaatttaacgaactcaaaaaacaattatttccaaacaaatgttaattgtaggccagctacggaattatcacttatttttggtccctttcttgggaatggcattttttgttaattttctctttctgaaaattcccctatttgcctcccttttttggcatttcgttgcccgtggaaacggaggggaaaagagagagagagcaatgactttccaactaaaagtcagccgtcacaaaagttgctgcttttccgggctaataaaaaaagatcagcagacgcgcaaagtggtcaaaaagtaatggccgaagtgcaaagtgcggggcaaaagggcggagggggtaatggcagattggcactatttgccattggccgcttccactccatggcacggcacttttaccattcattcattccgtgtggtcattccccgccatttgggcttttttctttccattttaaatttttgtgaaaattccaaagtcagcagcgaaaactgaccaaataaatggtcgctttaaattcaaaagtcaatgccggcgaattgcttttcacggcattggacagcggcgacatggaaaagaccaatgaaataatggacaaacancccggagagtgtggacgccagggatgaggaaaagcgggtagggagggggaagtgatcagaaaatgccanaagagggcgcgagggaanagaagatcaaatagaaatggcagggataaatcatgagaagggataaatgatc

SEQ ID NO: 37710 - DNA, 1137 bp, Heterodera glycines
ggtgccactcaaaaaacaaaaaaattaaccggggttttcggggcttatgaccttctcattggctaataaatagtgctgctcatatatatatggttgcgcttcactcgaaaaagggtgcaacatttgaccatattgatcataattatgattttcaatatcaataatagaatcaatgatttttgcaaatctgtggtaaaactgaaaaataccgccatttcgattttgtatacaaaagatatatcattcgattcctcacgatgatcgaatggtaccatttttagagcgcggcgataagtctgagccgagttacagacccgggactgaagtgtccttacaggacagattctacattcattttcagatgcctataaatgtgtttcagaaattaatgaaaataagtgttaatgggttctcgaggtcgctgattatgaatccgggctcagatcagcgctaccgttcatgccaatgagaatatcatccatacaaatttattaattttattattcttctagttcgggtcaggggttcggaattagcaaaatgggtgctatattcgtgatcagttgcgccttacttttagaatcaaaaaatccaattttcaatttattaaagctcagaatataataaataacaaaaggattggtacaataaaacagaggaggaaaaaacattccaaagaaaagaaagagaatgcacaaagaaagaccaaaagggaaaagtatcaatgctaaacaaaccgaaaacgaaatattaaacaaaaagaaaaacaatcaatcaaaatccatccatcactaacttatcaggcgttgatgcgcagctccctcaggtaggtggtgttgaggaaaagaaaggactttggtcatgtccgcataagtgcgcagcggccattccacccctttgttctttgcgaagagctgcaaatttttgctgttgtcaataccgttcttggcgtagtgtgagtagatgtttcgaccgcgtttcgcctaaatgatttcgattctcggtctatatttttattgttatttgaattgactcacatattcatcggcgatatacaccggcgagggcaatgaggtcggcttcctgacaatttgatagaagagcagaggtaatggaccattgtttgaagtgtgtcca

SEQ ID NO: 37711 - DNA, 1290 bp, Heterodera glycines
  misc_feature (135)..(135): n is a, c, g, or t
atgggttttcctataaatggattgacagtaaaagtctaaattaaccgctgcaaaaaagtttttttcatatagccgctataattgggaacatactgtagcctttactaggaacggaaattacaaattggcagatcncaatctgggattggattttgcgggcgcgggactaatctcgctaatcactcattcttctcaaaaaaagttcaggataacggaccgggaatcccgtcccgcgtctgcctctagtttttactattttcctgaaaagcatctcatttgccactttataatttggccttgatgctcattcagtttttttctgactaaaaattcactggcttcctcaaacatgccccccttattaaattttttttacctttcttatcatcagcagggctcgaaattttatggtttgcatatatttttttgcgcatatgctatgaagaaaggggcttggatttggtgaaggtttttagtccatataaatccatattttgggggttttcgggaataaactcatattccaccatttttgccttttttagtccatattttcaggcttttttagtccaataatttcgagccctattatcatttgattatccaagaagtgtttgcccctttttgaaggtcttgttggcggctttgttctgtctctgcttgcccagtggaccgctccgacaatgggcagcacatcgatcggactgcttttcagtctctcgaggtggattctctatcggtttttccgtccgaatcccgagagtcccgacattttttaacgtccgagtctaaaccccaagagtcatgaatggatggacatttttaacattttcaaacaatttttgttttagaaaaaaataaagcaattttattgtctgtttttgaatgccttgcggatttcagctaaataccattttcggcttcttaattttcagtaatttctttctcttccatttacgtccctttttccgagggcatttccttgaaaattttatattacatggaataagtataacccttttttattgtcttcataaagtatctttttttagtttcataattttttcctttgtccttgaaagtcattttatctgtccttgaaaaccagttttctgatgctcatgttcctccccccatgttcaaacaacaattctgccttttttactgaccacttgtctcctattcttttcagttttccgtgccactttttagtgcaatttcgcacaatatgccaatctcagaaatctgtaaacaaaattttctcggcacttttagccacgccgccgtttt

SEQ ID NO: 37712 - DNA, 929 bp, Heterodera glycines
gattttaagcccgaatgttgaattttcttgtgattcacctataattttcagttaataagttgtcagttttattctttaattctataggtaaatcccgaaaacattgcaccaattgacttttctccggattataagcccgaatgttgaattttcttgtgatgcacctataattttaagttaataagttctcagttttattctttaattctattggtaaatcccgaaaacattgcaccaattgacttttctccggattttaagcccgaatgttgaattttcttgtgattcacctataattttcagttaataagttctcagttttattctttaattctataggtaaatcccgaaaacattgcaccaattgacttttctccggattttaagcccgaatgttgaattttcttgtgattcacctataattttcagttaataagttgtcagttttattctttaattctataggtaaatcccgaaaacattgcaccaattgacttttctccggattttaagcccgaatgttgaattttcttgtgatgcacctataattttaagttaataagttctcagttttattctttaattctataggtaaatcccgaaaacattgcaccaattgacttttctccggattttaagcccgaatgttgaattttcttgtgattcacctataattttcagttaataagttgtcagttttattctttaattctataggtaaatcccgaaaacattgcaccaattgacttttctccggattttaagcccgaatgttgaattttcttgtgattcacctataattttcagttaataagttctcagttttattctttaattctataggtaaatcccgaaaacattgcaccaattgacttttctccggatttaagcccgaatgttgaatttcttgtgttcacctatattttcag

SEQ ID NO: 37713 - DNA, 146 bp, Heterodera glycines
aaaaggttcataaagttggaatctcctttctcgttttcgttgttgtctttcttctgctttctatttaatattctcaatactctatatactctatatgaaataatgacaaactgtcccaagaacaatttttaaggttccacttaaag

SEQ ID NO: 37714 - DNA, 961 bp, Heterodera glycines
gtgtgccttctgcgcaattctgatggccgtcttttggacctgtgaagtgatgcccatcggcatcaccgctctgctgcccaccgtactgttccccgccctgggcatactgtcggcccgtgccgttgcccatgagtttttaaatgtatgtgcgtgcgttagttactgtaaacccctcacagaaccagaggcactagagacggatcgggggaccccgagatagggtctcttccaaatcccgatcgatcatgaagattttggaaaacgatcgggacggatctcgagtcgaggtctgtcaaaatttcccggtcaatcctgaaaattttgaaaaaaatcgggacgggtcccgagtcggtatccgtccaaacccccatcccgagcaatcccaatgaattaaaaaaaggctcgggacggatcccgaggtaggcaaatcctgcaggataaagcagatcccgtccggtctctatcaggcacacacattaaagtacattttgggtgtgggtctttttggtcattaaaatgcttttcaggacaccaactttctgttcatcggcggcctcgttgttgcggccgctgtggagaagtgcgggttgcatgaacgcgtggcactcagtgagtgcgaagatttgcacactttcttaattagattaattactttattttatttaattacttaaataaatttttaatataattaattttattggtataatattaatttaacacatttaaattaaagcaaattaagcattaattaatttaataatagataatatttttaaaattcatttattcaaatcatcaaagttaaatttaactttactgatttagtttgtaattaaaatctattcttctaacgctttaagttaaatatttattttaattaatttaatttaatccaatttcaatttaatttttcaaaattaattgaaatacttatttcattttcacttacactttattt

SEQ ID NO: 37715 - DNA, 65 bp, Heterodera glycines
ccaggatctcgcaggccgccgccggcgggtgcgccgccagggcgcgcaggcaggccagggtgtgg

SEQ ID NO: 37716 - DNA, 1068 bp, Heterodera glycines
  misc_feature (7)..(8): n is a, c, g, or t
  misc_feature (1021)..(1021): n is a, c, g, or t
aatacanntttttgaaaaagattcggcaatggtcaaatattgtcgatgtaaatacaaaaggagataaatgttaatatttttgaagccttttatgattattaaggaaaaactattaaagaactgtaataaatctctaaatatttttttaaataccaaataaatatttgagaatttaattatgtcatattttattcgttatatattaactttgttagcaaaagcttatatttattattaataattttttcttttaagcgtgtgcaatttataaaataaatttaaaaaatgaattcatatttatttaacattaacgcttgagtggcattaaaaatatgttttgtttttttcattttataaaaatatttgtttttaattttaagtatcctcttgtagagatttcattcaaccaatcaaaaaaaatattaactttttgaatttatatgtttttcataataaattcatttatttttattaatttaaataggtttgcaataaagtggtgttattgcctccccaaaatgcattaataaggtggaaatgatatgcttgatttaaaggtttgaaatatataagagtagtttacataaatattcatcaattcatcaaaagatttatttaaaaagtgtttttgtgatatgatattttttatttgaatttctacaaaaaaaagctttaacaaataagttattattttattattaaacaattatactaaatatacaatgtttttatttttaagtttggtttaaatttgcatatttttgaattcatttttccatctcgttttctcattcactaatacatacataaataatagatacgattaaaattatattcgttttatttatatattataataaaattcttttttgacttttgaatactcaaaaacacgaattttttgacaaaaacctgcccattttgtgtgaataaaccagtaaggagtcacttttctgactttcagttgttaaaagcaaatataataattatgttgctagatattatgtttggggtgattcgntaggaattcttatatatcaaactcctatatttctggggcaatttttt

SEQ ID NO: 37717 - DNA, 1099 bp, Heterodera glycines
gtgacaaaatcctcgctgaaccagaccatgccacaacgcgaaactgttgccatcgtggcaaatttgagatcagcaacttcgaaaatgatccgaacctaatataaaaaaataagtttgaaattaatattgcctcacatttggtggaatagacagccgttccccgtttggaagagtaagcaatttgtagtcatcaagtacggaattcagattttcaacccattccggatcaacatctccatcaaagatgatccattgccgcttatccaactctccacgaacattgccaatgattctaaacaatgtgtcattgtcaacatattaaaaattaatagtaaattgactttcgaataatatgcgtaaataatccatcagtccattcgcgtgtgttcgggtcgagagtgccgtagagagtgtctttgctgatcgatttggcatcaatgacatgagacacgccttcaacgcgctcatgattttccaacgccttcaaaagtgtcttccacgcagtggttttgaccgatccactcgcaccgacaagcattaggccatgattgcgattggtgatttggtaaacctgaagaactttctccagccaaagatttcccttctccccagtgataggtgaacatgagaagtgttcggttttgcagatgtcaaaacttcgttcttgaggctgaaaataaaacaaacaatttttttttctaaaaacccagaaatctgcacctttccacttgttttgggctgttgtcagggaaaaattgatgcaaaggtgatttaaaaagagatatcctcagagacaagcttcggtgtcaaagtgtcgtacacggattggaagagcatttgttgttcagacatttggcttgccactgcctgttctccagctccatccccgctttggcttggttcatcgtaagaacgttgaatcgcatcgcgtttgatattcccggccgaaacaagcacatatttcaaagcacgcaatccaaagtcgtaatgacattggttcgaaagctgttccttgcagagactaaagcaaccatggaatttaatttgaaaaatgaatattacgtaaataataggacaattttgtttgcgagtctctcgg

SEQ ID NO: 37718 - DNA, 912 bp, Heterodera glycines
  misc_feature (883)..(883): n is a, c, g, or t
atagcctgtacttaattgtgcgttggattttcgctccacataattgtgtgagtaccacacacgcacactagaaaatatcgatttttttgttttcggggcagtccccccgaaccgatgcgcccagatttatggggagaccgaatccttcgggaatagcttccctatagcctgtactttaattgtgcgttggatttttgctccccataaatgtttgagtaccccaaacgcacacttgaaaaaatcgatttttttgttttcggggcagtccccccgaaccgatgcgcccagatttatggggagaccgaatccttcgggaatagcttccctatagcctgtactttaattctgcgttggatttttgctccccataaatgtttgagtaccccaaacggacacttgaaaaaatcgatttttttgttttcggggcagtccccccgaaccgatgcgcccagatttatggggagaccgaatccttcgggagtagcttccctatagcctgtactttaattctgcgttggatttttgctccccataaatgtttgagtaccccaaacggacacttgaaaaaatcgatttttttgttttaggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctcccccataattgtttgagtaccccaaancggacacttgaaaaaatcgatttttttgt

SEQ ID NO: 37719 - DNA, 1090 bp, Heterodera glycines
  misc_feature (8)..(9): n is a, c, g, or t
gcctgcannggtcttgaaaaattaaaaaaaaattaaaagtatttaatttaacttgaatattaattaagttgacgcgacgatgaaaaagtgaacagctgaaaagatatgaatttcctgatcatgattttgttaaaatttggagatgatgacattgtgattgattgtattattgttggtttttatttttcataatttatttaattgccatttcctcccagaaatcttttgttttaatttctaattgtaagttcgaaatttaaaaaaaaatcttaaaaattttgtttctaagaagagaatatagcgttttttttaaagttttataaagaaccaagaactaactttattcaaaaaaatttgccaaaaaaaatatatttttaggaaacttttcttacattttcaagctaaggctcgatcaaatttaataaaaaaaaaactatgaacttgattaatttagattagaaagtccggagactttctgtttcatagcaaattttcagtctcgaagccaattcccgaatccgaatttaaaaagttaaaatcccgagaaaactacacaaaatactgaccaacaaatccgacgcgtcttcaattggtgccgccagcgtctcctcatgcgtgtcgtcaaccattgcgcgcagcgtttgtgcgtcgcgatgcagcgccacgtggtgccagccggacgccaactgttggccaagttcagcacggacagcgccagccgagtcagtgccctcggcaccgtttggcttgatcaccagtgttgtgccattctcgatcagcacacgcacaatctcttccttgaattttaatttgtatataaaacgttttccaatcttcatactgtatgtaaattactgtacttggtcattgttggcgaatacggtaagcaggtggacaatacggtcgggcacataggcggcaggacggaaacggaaggacactgcagctgattgttgctggacagtttgagtcccggtgaattgggcatacgcacgctcggacagcaaagtgccaatgcgaaccttcaattggaaaggatttaaaaaatgtataatggttaattgaaaatataaaaataaaacgaattttt

SEQ ID NO: 37720 - DNA, 1809 bp, Heterodera glycines
  misc_feature (97)..(97): n is a, c, g, or t
ttcgtcgagaaattctgctgacattcgtcgctcaacaaatggaaaatgcctgcggatgagaaaaataaaatgaaatagccgaactaaaagaaaagcncaactcaaaacattcatccatcactcgaaactctcgacaagaacataagttggaaaaaataattacccgtggtgtgacaaaaaccaatgggtaattaacggacaattatcaaggaacaaatacagagcaaataaatctccaagttaagaatgagcctggtaaaagtcgcaacaccttcagccggttcaacgacggcaaatttggccaattcttcacgcaattgctgctcactgatctgcacttggtcgagcagttcattcagtttgattctgaccgattattttaaatgaaaatttgcgaatgaatgcctcggcacttaaattcatttcaaaatgggccaaaaacatttatcattttcgaatttcgtcctctcattccttccattgtttcaccgtcttttaccctttcgattcctccgccgccggtgcattttcattgtaaaaatcgagcaaattttgctccaaaagcgccttcagacggaacgtttggtcgggaagaaaagcttcggaaagctccacaaagcgatttgtgatggagacgatatgttgctgctgttccgtaaatgaattaatagccacgtgtaattaattaattaattgaaaaatgatagccccgagggttggaccacccgtcgtaaagcaaaagcattggtggaccattcaaaggtaatagtgccgatggtagccccccttttttgcattgtcggtgagtttcaaaggatttttccccaatatattccaaaatcgccccacatttgctccggcgctgtttggcgtcccgtcgagcaacagcaaagtgttggacacttcgacgtcctttgcgccgaatgttcgggacgaagtgcacacgaccaaagggtcagagcaatggccacggattgtaagcgaaagactgaaaatggaagtgcttttcaaaatccaaattatagaccaaacaagggctccgatcgatctaatacagaaacgaaaaagaccaatcgtatcacaaaatggacctttcgtgattaaattgatcagtgatcatattggacgaagaaaaagcatcagccaccgacttttccacctccaaaagcacaaaattatttgggaaaaacggccgggcaaaattcaaagtttggcatttgggcgaatccatcggaaattgcaaataaaaaaactaaagaaaaacgaaaagaaacaaataaagtgaacgggggaaaaacaaccaaatggaaaagatggaatgcggaaatcatttaaaagatatttaaatcgacaaatgttcgtttgtgttttctttggctatgtgatggacatcagtttggcattcagttccacgttgtaaaagtcggaagatgccaattcgtccaaatggttctcaaagtcggacaaactccgatgcaatttgttctgcaccgcgacggaggccaaaaggacggcgtcgtcagatttttccaccgaataatccgcgggacgccatttggcagcacttaaaaatgattcagaaattaggtcagatgaaagtcagaaatgccggcatcccgaaattcgcaaatcaaatttggtcctttgggtttacctttccaattcaaacgcctgcaaacacggcgaagtcgcgttcagtgacaatttcgcgttttcgatttgcaaaagaatgggctgtccaattttatctgccgcaatccgtgcccataaatcatccaaactgaacgcataaaaaaattaataaactaa

SEQ ID NO: 37721 - DNA, 1001 bp, Heterodera glycines
taatataagaaaaaagtttacaaaagcctaagcttaggcctagtctaaccataagccattgttcgagttgcctgtgtataagttgtcatgataaccttaggtttaacaacgaaatttatagttaaaaactttactgaatacctgacaaaaaaaatagtttttctcttagttattaggacaactataataccatgagaccagggatggcacggaattccgatttccgaaaatttttggggcctcggaatgccatccccgccatggacacaaaatgtcatgggacgcgtaaagtgttgttgggacgcgtaaaatgtgatgggacgcgtaaagtgttgttgggactcgtaaaatgtgatgggacgcgtaaagtgttgttgggactcgtaaaatgtgatgggacgcgtaaaatgtcatgggacgcgtaaaatgtcatgggacgcgtaaaatgccatgggacgcgtaaaaccgactagaaccaaaaattttattaacgctttttaggtagcaaaacataaaaaaaggcgaaatgaatgtttttggcttagtaggcgaaatgaatgtttttggcttagtaggcgaaatgaatgttttttggttagtaggcgaaatgtcggtaggcgagatgtcgagtaggcgaaatgtccgtacaccgttaaaagtaccccgtaaaccaaaaaagtacccgtattttgtgaaatacggcctgaaatgtgatagccagctgattctcgcatgtcagctggttggattcttaaaattccattaagtcaaacgttaacacaccatcccagaaatgagctcctgtaccagaaaagatttgcatgtgtggctcagtggtttttgtaagatagtaaagggacaaagggtggtggttcgagtccgttgtgcaacatgaatattttcatttatttttgtccaaaatattaaaaaatgacgatatttgggaattatttttgaagctttttcccaaccaaattggacaatcttagtatcattcgaaa

SEQ ID NO: 37722 - DNA, 648 bp, Heterodera glycines
tcaaatgtggtctagtggctaaacctactcttgaccttcattatttgttgcttgggttcaattccccaagggaaagaaaattttttatattttctttacaattatttcaattgaaattaattaataaaaaacatttcaacttaaaattatctttttcttttttttaaacagcctaaaaccgcaaatttaaagcaccgccaaaaaaagtggtttccagcttcgattgttttgaacaagcccaattttcgaaaatgaattactagattgaaagtccggcttaaatcgcgaatttttagtggcggatgatcacggattttaagtgggggatggatgatctcggatttttaggtgcagatactggcggataatcgcggctttttagaggcgggtatcgcggatttttaggggcggatactcccattaaaacaggactaataaataggggcaaaaaatgtaaattgaggtgtaaaatattccttttttttcatttttatggttccttcccaatcctcgatgagagaaaaatcggggatcggtgggaaattccccgacaaaatctgttgggaatgattggagaaaaggtaaaaaatgtccacatgcataaccctcagcagggagtaaattttccaaaaatcgtaaaattactaa

SEQ ID NO: 37723 - DNA, 1152 bp, Heterodera glycines
gtagttggacatttacggtgctttggctgccaattatggtaaaaaaacttattagtggaatatcgtactgagtgttttgtaaatccgcataaatacagtagttggacatttacggtgctttggctgccaattatggtaaaaaacttattagtggaatatcgtactgagtgttttgtaaatccgcataaatacagtagttgggcatttacggcgctttggctgccaattatggtaaaaaaaattattagtggaatatcgtactgagtgttttgtaaatccgcataaatacagtagttggacatttacggtgctttggctgccaattatggtaaaaaacttattagtggaatatcgtactgagtgttttgtaaatccgcataaatacagtagttgggcatttacggcactttggctgtcaattactgtaaaaaacttattagtggaatatcgtactgagtgttttgtaaatccgcataaatacagtagttgggcatttacggcgctttggctgtcaattacggtaaaaaacttattagtggaatatcgtactgagtgttttgtaaatccgcataaatacagtagttgggcatttacggcgatttggctgtcaattacggtaaaaaacttattagtggaatattctactgagtgttttataaatccgcataaatacagtagttgggcatttacggcgctttggctgtcaattacggtaaaatctgtttcttcattttcatttatttattactgtggtattattttctcatcaaagtttttcgctaataaaaaaaattatctatgaaggaaaatgaattcctaattaattaattaattattaatttaattaattaattattatccgtatttaaagatcatcctttgtttgggattaacaatttatcatttgcttgttttggatttatcgtttgcattaacaaatatttttgtgggtctgtacatcggagcaatgatcgccagtttaatcgaaatttttgtaagttaaaaatttaatttattatttatatatatatattttttagattttttctttggtcagaaaatctaatcagaaattgtttgatttgcgccctggaaattataaaaatcaaccattaaggttcggtaccaggtaaaataaaacgaaaaatatat

SEQ ID NO: 37724 - DNA, 369 bp, Heterodera glycines
cggtgtcatctatgttactagatcggggatcgatccccgggcggacgctcgagcaggacctgcagaagctagcttgatggggatcagattgtcgtttcccgccttcagtttaaactatcaagagaggaaaggtcagtgtctttgaaggagcggaggagtagcgtcctcttaggcccatttcctcgccctattcgtcggcacagagaggagcacgaaggggaggggagcggcgcgtagcgggggaggtgggtggcggaagaagaaaagggtggggggagtatgagtatgatggtcaatatggagaaaaagaaagagtaattaccaattttttttcaattcaaaaatgtagatgtccgcagcgttattata

SEQ ID NO: 37725 - DNA, 1013 bp, Heterodera glycines
ttttctgctcaacagtaataggaattccaaccgcattctcagaataattacgccgatactaattgttctggaatttgtttctctgcgcgtttgtttgggaaaaaatttggaaaattggctatctctttttctgctcaacagtaataggaatcccaaccgcattctcagaataattacgccgatactaattgttctggaatttgtttctctgcgcgtttgtttgggaaaaatttggaaaattggctatctctttttctgctcaacagtaataggaattccaaccgcattctcagaataattacgccgatactaattgttctggaatttgtttctcggcgcgtttgtttgggaaaaatttggaaaattggctatctctttttctgctcaacagtaataggaattccaaccgcattctcagaataattacgccgatactaattgttctggaatttgtttctctgcgcgtttgtttgggaaaaatttggaaaattggctatctctttttctgctcaacagtaataggaattccaaccgcattctcagaataattacgccgatactaattgttctggaatttgtttctcggcgcgtttgtttgggaaaaatttggaaaattggctatctctttttctgctcaacagtaataggaattccaaccgcattctcagaataattacgccgatactaattgttctggaatttgtttctctgcgcgtttgtttgggaaaaatttggaaaattggctatctctttttctgctcaacagtaataggaattccaactgcattctcagaataattacgccgatactaattgttctggaatttgtttctcggcgcgtttgtttgggaaaaatttggaaaattggctatctctttttctgctcaacagtaataggaattccaaccgcattctcagaataattacgccgatactaattgttctggaatttgtttctctgcgcgtttgttgggaaaaattggaaaattggctattctctttttctgctcaac

SEQ ID NO: 37726 - DNA, 1592 bp, Heterodera glycines
  misc_feature (690)..(690): n is a, c, g, or t
cttgaaagtggtctccgttttccccggaaaaatcgttaaaaaatcctaaaattcaaaaacccgaaaacagttttttaggcctagctcgaaaaattttgaaaattttcgaaatttttaaatttggaaaaatcgagcttttcaagctctacaatagtcccgctggcgaccccccgctcagatcaaaccataatgagttattcacccgggactgaactggacaaagttggtactgaaaaagtctacgcacctacagccttccctattataggtagaggcctggaattttttttaaattttagtcaacacttcaacttaggtccctaccagcggaaactttttgattcgggttttaggaaaaaagttatgggccctaaaatgagcgaaaaagtgacaaatcacttcccgggactcagtcgtccgcgctgaatttttttctatagttttcccggattctcctcaaaaagttgtaagacccttccaccactttcagggcgctcccggccttcggccgggagaaaatggttttagcaacgaaactccttgtcaatataacgtatatagtaattaattaaagtcatccatctgtttttaccaactcctggttataaaatatgctttttattaaatttcctttaaaatgttcaatcttgaatgaaccaggtgtcgttggattaacaacaacgatcttanataattcttcggtaaagaagtttgggagatacccctttgcaaattttcccttttccttgctaatacaaacgatatcgccaattttaaatttgttctttttcgaaattttaatttccttctccttatataatttttcccagaacgcccgggcattttcaaaattaattgaagacggtttgacccccaatgtcctattcacactgttgttaatgtttgagactattttatctattacgtcgacccatcgtagagtttccatctttgtaaaatatcagtataaccgttactttattgtacgattttgccctttaagctactccggtgtggaggtcgggactatacatgacatttttgataataaattttccctcaaaatactttttcatttttccagcctggaattcgattccgctatcactatatattttcattgggataattttcgactttttgaacacccgatcaaatacctcgatcatgtcctcactcttctttgacttggccggtgcactgaaaatcattcgactcagcacgtcgatgcagaccaataaatatctgtaaccatcgttatgctttttcaattgatcaaatatgcacaaatcacactgccaatcggtgtggaagccactcggtactgtatttaatctcgcgaatttttttttaaattttttgaattcctgccggagatttgaattttctctatagtcttgcccatattaatggtttgaattcttccccgcgagatacaacagaacatctctataattactgttttcaatcggtaaattcatgttcgactgtacttttccagccgccgtaattttaaataaatctttgttttcctattatgtatctaaaaagggggagtaaaagagtcggatgaataatagttttggtcggaa

SEQ ID NO: 37727 - DNA, 1654 bp, Heterodera glycines
  misc_feature (1637)..(1638): n is a, c, g, or t
cctgggaattcccccgtggcgaagataatttcacttcggaacagtgcacgtctcatcagcagattttttgtttatctcatggctttttcgttttcatttttttgcatatgtccctgttcttttttcataattcttttttttcttcggcatttgtgccattgagtccctcccctccgtctttttcagtcccttttcgtctgtccgtttcagcgctgcgcctccgtttccgcgccttctgttcgcgttttggccaaagtgcgcgccgtcggcacagtcaaatgcgcgcgtcgaagcgcaccgagcgccacatccgccgtttggtgccatttctgctcgttctctccgttttcgtctacgttttgctgggcgcacgctgcctttctgttcttcgagcactcaaaccatgagcagagcgtgcgcaattggttcttcactctgatcacgaataggtgaaaagcgaaaaaaaacattgcggggatttaaaatggaaaatttttgactgaaattggctaccgtattctcccattattttgcttcccgtattctgtgcactttttagacacaaatttgcgcgccaactttcctcacgccatatttaatggcacgtgcaacatggtgataattgtcgactacgacagttccgaacgcattcaagtcggtgggggtagggaggaaggccaattagccaatgggtgagaagataaatgacaaaattcaaaaaaaattgaccattaatttggcgcccggaaaatgagtcagtggaaaatgcgtcagtagaaaatgcgtcagtgaaaattttattgtcataaaaacaagttccttgcgttttcgggggcactgaccacgaatccggtatctatttcggccaattctgaaccccggaccagaattcaaacaaaaagtctaaagtctaagttttcgaatttagcatttttggttcgaaaaacggcataaatgatcacttattgaaggattgttggcttttagtttgtttccgtgtatttaaagcgatttttaagaaaaaacctaatttcgaaaattttgatttttcgactttttgttaaagttcgggtacggggttcggcatgcagaacgatgttcctatagagtttacttctatattacaatattaatgccatagaaaactttattttaaaatatttgtatcaatgacgtctactgacgcattttcaactgaccgattttccggtcacgctcccggcacgtttatatgtgttacttttttgttttccttcgcttggcggaatttaaaaaacgactacatagcaatttttttctcagcacatttctccttttttaggatggtgtgcaaacaaagggcagtaaatgtgctgggacgaaacccgaatattattttaaataaaaataatatttaagaattttaatttttatattttcaagcatttggtcataccgcacaaaaccatgaaatttcgactatttttatttataattccatcaatcatttgaattaattcattcgggataaattgagctctttaatttaaaatatttttgttaaatgaaattatttactaatgtttaaagtttgaggcagaaggaaaatagttattacagaaaatttttcaattatatttttaaaccaataagttctnngtgtagtgaaacatta

SEQ ID NO: 37728 - DNA, 973 bp, Heterodera glycines
ttgctccagggaaacttttttttaaatcactccgtcgatgttttcttcgattccccccccccccccctcctcttctttttttcaatggttcacattctttttatccgccggttctgctgccctttgtttacccaatgaaattgagactttcccccgttcgtttcactgaccatttgagaaatgaatggcgccatcgctcgtcacttctgtcgtcaaaatgcctttcttcagaaatatgtccaataatttgaaaagtggaattattctgaaactctttaaattcattaatgggatgggattgtttaaccaaaacagaaaaagcattcttttgggttagccgggggtggggggctaaaaatgctcaaaagaaaagcgacggattggcggcgaaatgcctttgggttgtaaagtgattcaccaattttttgcgcacatcaaagcacgagaaacgagaagcagcgatcggactgatgagaaggacaaataaaaaggaaaacgcggagaagcgaattatgcgaagtgaccgaaagtttagccgagcgtcggtcgactatcggcgggaaaaagcctttcccaatgttttactacaaatgagaaaattcatccattgcgaatttttctgtttgattcgcccgccctttccccgcgatcggtgatttctcatttctttttaacagttttaattgctttttacaattcgtgatggttttgttgaataaaaatgagaaagaaatttcggaggagagacatcggtgaggggaaaagcaaagggagggggggggggggggcaattgccttcattgggaaacgaaaaaaagaaaatcatatttttatggatattcaattttaaaaaaatcttaaatcttattgaagataagttcaaaagaaggagatgggattggcttttacccttttttcctttgaaattgcatgtgaaaataggcgcctttttcaaaagaaaagggcctgataa

SEQ ID NO: 37729 - DNA, 964 bp, Heterodera glycines
  misc_feature (95)..(95): n is a, c, g, or t
aaaaatttctcactccaaaggtgcaatgtgcgatatgctttggtctgatcccgaagtacggcatttttgtaccaagattttatgttattcttatntaattttttgaattattggtaaggagtgcgtcggcttcgctatcagtcctcgtggtgccggctatctgttcggttctgatgttgtgaaattgttttgtgaaaagaatggcgtagaaatgattgcccgtgcccaccaattggtcatggaaggatacaaatggcactttgacaacaccgtaagtaaaacgcaatgtttaacagagaaacagcgaaagatatttcccatctttcataggttctcaccatttggtcggcacccaattattgttaccgttgtggcaatgtggcggccattctcgagatggacgatgtactgaaaaaggaatttttgattttcgaggcggcaccgcaagtggttggaacaatatttaaaaaagaatattttgaatgttttggtttttcaagggacgaaacacaccaatgaaggggcctatgcctgaatatttcctttgattcagagttaaaatgatgaccatttcgatgtttgcaacattcatttctaatttgtttattttttgcatttatgtggggatttgttgccattgttttcttttatattttaaaataaaaagtgctggagacagagattttcaaatcattcgactcgagaagaaaaaattaaaccgactgacaatgaggcacaaaagccaaattttggttatagcgctaattcttggtatcaatcgaaggcaaaggtaaagaacattggtcccgaaaaaaaaacttttaaattttttaaaatgatttttaggggtaatcctaggcgctgagcacgaatctgaccttctttttgctcaatttcgaaccccggacccgggttcgaacattaaaaaaaaatcaatttttttttttttgcaaattttgctaaa

SEQ ID NO: 37730 - DNA, 618 bp, Heterodera glycines
cgttaccgttccgctcgcctaccaacacttccaacaagtgggcacccaaatgcaaaacgaaatggacttttgcaaattgcgttccggtaacatttggagagaggtgagaaacgaatagaaagcattgggcattggcactgatcgatggaaaatgttttacaggtgacgcgcacccaagtgttgtcacagttcactggtggcgttcgccaaccgcgtgccgtaaataccggcaaaagccgtcgtattcgccaatatgagggtgcagcaggcagtggtgcgactggcgtcgccgcaagtggcgcggcgggaggtagctcggctggcagtggcgcaggaggcgcggcgggcggcgcaacaagtggcgcggcgggcggcgcagcaagtggcacgggaggcggtggcgcgggaagcgcaagtggaggagggcagtatggtaccgcgggagcagttagcggtggtggaggaggaggcggctgctgcggctgtggcgtatctcagcccggtccacccggtcctcccgggccctccggaccgcccgggaggagatgggcagccccggagggtcgggacagcccgggtctgacggtttgaaaactcaaaacaaagctgaattgaatt

SEQ ID NO: 37731 - DNA, 1090 bp, Heterodera glycines
tgatagcttacactcatacacttgaacaatgtaatcagatcctgaaaaattgcatttttgaaaattttataaaccctcaatcctcagtttttttacatttatatgaatttcatgatggtaatagaatttagacttttcttaaatatgtacaaaaatttaaataaacttaaaaacttgaaaaattctaaaataatactaatttattttaatgatatttttttggcaaaactattatttttatttttttaattagtgcattgtgtacaattggtcatgactagggctgggaatttaagtcacgaaaaattctccaaaaagtctactaaaaaaatcataaaaaaaccgccaaaaagtcacaaaaaatgccaaaaaaaagcacgaaagaaatgggaaaaagttttcaaaaataattaaaagtggaaaaaaaatcttatttttatcaatttattgaataaatttttataaatagagatcggatttttaggaactttattttataaataggagcttaaactattattttttgcctgaaagaatctgataaaattcgactcactatatctttgtactaaataagcaaaaatttctgcaggatttcaattgccttttcatcgaacggattatttttcgaaattttcttcactaaaattcgaattttgccttaaaaagtgtaaaaagtcatgaaaaaattcacaaaaacgcaaaaaagtcataaaaatcccaaaaagtggaaaaaagtcaaaaaaaagtgacaaaaagtgcatgttagaagcttcaaacaaattattatgtctttttttttttttttgcctttttcgggattttagtgccttaaatgccttttttggcattttgccgttttggtgcctttttggcgtttttttccgaaaagttccattataaatgcaataaaattgggaaaatacatcccataacccaaaaaaaattccagcaaatacgcccataagaattgaaaaattttctcaataaattgatctccacatcttttttttcaagataaatttaaatataaaaattttctttattagaggcaaattattaattgtttatttaataatcatttaaatga

SEQ ID NO: 37732 - DNA, 1123 bp, Heterodera glycines
ttttgcctgagagaatgccaatgggattcggcaccctggccaaatgagaatgccatttccggcaattccccccggggatgagtgccgctgtttttggccaatgccatcgttccaaaatttctccgcctgcggcggctttgttcgtgcactcaccttgtccgagggggatgaatgtggctaaatggatgatcaattcgtttgtcttctgatcagtccccccccccacctaccgccgttccccgccggaattgcgagtccgccgccgttgaggccaaggccgaggccctgcagggcctgcaattgttgcagtgcctgcagctgttggcccagctgagcggcgccgaggccaatgcccggaatccctgcagggagatttgttttgccataggcacatgaaatgggaacggtcggcaattaaagcagcacagcacaaaattggcatattcaaactgtggcccactcgcgcataaacacaaaactcatcagtcagtaccagtgagtccgttcagtgtcggcagaccgacaaagccggccgaggacgaagccgcttgggatgcgagtggggcgacgccggacagagcggcgagcgacggggccgcgggttgttgggcgagaatggaggcggccttggacggaaattgtgaggggcgggcaaattcagattttgttcattgttctaccgcttggttcagcggcaacgcagagaaagcagaggcgggttgaaattgtggggtcaaattgagattattaggcggaaattgggcacgagaaacggcgaaaaaagagagaacgaacaaagggcggaggatggccaaatgcggcaacattaagacagaatttttattgatgaagtaaaattgccaaaatcgttgaaaaagcggcgacagggcgcgactgtaatggatgccctttaaacaactgaaaaatgcgtttaattgtccatgctccgttaaattcgtaaattttaatgaaaagcgatagaaaatttaaaaaatgaaaatacaaaggggagaaggaaaagcatcaaaaaatgagtgatggtaaaggggtgaggaaatgaatgatcaccgactaagaaaagcgaacaaaatgccccaataaagaccagcaatgaatgaatgaa

SEQ ID NO: 37733 - DNA, 504 bp, Heterodera glycines
tggcaccggagtggcaccccttttcattcaccctcgagacaattgcgaaatcgctggccacgtgtcttttttaggccggcattgaatgtttcgtttcatatttgactaagaattttgtaatcagtaattaatgttttttttcaccaactaaatattgattaattagttttgaaaccgaaagttgtgaaaatgttttaaatttttggtcactttttcaattttaattttttaatttggtcagacatttttcatttttatttggctatttttacttatcattcaaattttaatacaatgattgtttttttcatatttgtaaatttgttttgaatcacttttctttgtcttcattcagcccttctatggaagttaagcaatttttgatcagaaaatagttcattgcagacgggtgatgcataggagaggcgtgcgtgcgtcgcttcgcgaccgtcagttgtgttggggttgatggggatgttcaggctgtaggtgggggcggaaatg

SEQ ID NO: 37734 - DNA, 1774 bp, Heterodera glycines
  misc_feature (58)..(59): n is a, c, g, or t
  misc_feature (150)..(150): n is a, c, g, or t
taaaaaatttctgcaattatatgaaattctttgttttcccattattttgacttttaannttcacttcaataaaaaaaaattttaatattatttgtggtgtaaagccattttttgactaatccattttttagtccgtaaaacttaaaactntacatataaatcaaatcaaattaatctttgattaaaatttatttttatgatgacctttaaaatttagttcgtggtaatgtttagctaattttttctacatattttgttaattgatgataatgttcatttgtttcgtcagttgggtttgtttgtgtttagcaaaagccgcaggataatggacactccgttcccatttgtgcttgttgactccgacacaaacccaattcgacctttgtcggacagttcggctggccagagcccaacgggggaatctcgtcgccacaaccttcaaaattataaatttttaaaatatttattcgatatatttcttttttaacggatgcacaatatcaggagactgtaaatttttacaaatttaactaatgcgtaaatttatattgaaattggggtgtattaaggggttaatttgaatttaaatgcccacattttcccgccatttttattgccctaccctaaatatggaacctaatatctacaaaaatgaatgcatattttccattgaagtaaggctttaaacgcatgaaaaaaagttctaggcttgatttggaaatttaggatcgacttttgtatctagagaccggacaagagggtcggtcggtcggtttcggttaaaaaccgaaaaaaaccgaaaaactcaaaaatttgtcggtcgggtttcggttaaaaaaccgaaaaaacccgaagaaaaattttcggtataccgtttcggtttcggtttttatttgaatttttttatcttttcccaaaaaaaacaataaaccatttttatcaatagaaaaagcgaaagatcacctctgagtaacagcaaaatttagttttttggttagtttttacgtgttttgctccctaaaaatcattaataaaaaaatttaaatgccttttttcatgccttttcgggatttttgtgccttttttcagtgccattttgcgctttttggtgccttaattgtgagctctagccataactttagggccggcggtgctgataagcgccgccaggaaatttttttttgtaattttaatgctatttgtgagcagattttgtctaaaaataccaaattttgagattttgggctaattttttaagaaaagatagatttctgtggggtcgggatcaaaccatatgtgaattcttttgttaggaaaccatcccggaatactatcagtatgcaaattttaacgaggaaagtagaaaccaatttcttcagaattgtcataaatagtgtgattcgacctttcctgacttgaagagacgtcggatcaggtacaaaaagtcgtctcagttcgagcgtgccttcatccggtttaatgacaaatcagctttcgttcttttcgtgtgttgcatcctcctgatcggcttcttcctgattgcttcgagtatattctttgctctagaagtttattaaaacaaatgaaagactagcatagattactttacggctgatttctttacgcttttcctttttgcatggttgtccgtcccaaaggccttcaactttttcaacggttttttgcccaaaaattctccccgggctccacgtggcatcacttgttcttaacccacccagcgcactttccaataatcttttcctccgcttacttt

SEQ ID NO: 37735 - DNA, 472 bp, Heterodera glycines
atttatttatttatttcatgaataaaaaagttatcagaagggcaaaaaccacttactctgacgactgttcagataatatgtcgtagagtaagtgataaatatatggatgaccaaaaataaaatcaaaatatattaataaaatgaggtcaaagtcaatgaggtcaaagtcaattgagatcgacagcataaatgccaaatcactagggctgcaaaaaatacagtcatggtcataagtgttgtcccatcatgctttgaaaaaaaaaattgcgtataaaattgtcattttccaatttcaacagataagtaacataccattggatatcattttttatgggctttccaatgataccatatttgcatttgtgacataaacatttatttgatttattttaccatattcacaatttgatcaaaatataggagcacaaaagtgatgtcccatttcatttttaacatattgcttctctggatc

SEQ ID NO: 37736 - DNA, 931 bp, Heterodera glycines
aaagtttaaggtgttgctgtatctttttaaaattaccctaaaacaataataaaaatttattaaattttaaatgtatattgagtagattcaatttttttttaatttccattctcggaatcatgcttttagttatcatatttttttatgtattcttccgactcaaatgtcgattggatattttttcgttgttatactatatcagttttttattaatttacattcatttcggatattaatgatttggtgctttgttttcatatttaatgaatcaactaaattttatattttttctttcaatatattttaataatataatgatcatatttattttatttagcatttctcttcaaaaattcatattattctgaaaagtacgaaacgaacaggaatttaaaataattctcaaaaatacacattttgaatttgtgttatacaattgtaatataatttccggaaaagtatgcctttctggtgcaatttgaactggaatatgcattttcagtagttccttttttacaattataatctaatttcagcaaaaaatttaatttgcagaaatgtatgcattttatgtgttttatatttgtaatttaaaacagaaaaatatcaatcaaaattggactaaacatttaacttaatatttaaataaaatgcatatttgtctattatttgaaatatcactttatataaagtaaagattgaaaatgatctttcctttttaacagagctcacaactgaaaatattcaaaatcagctgacttattttcatttgggataaaaaattttaaatttgaatgtaacatgttaacagattttcactaaaaaacgaccaatttttgtgaatttaagccaatttattaatgaaaaaataattttagaggcacggcggtgccaatagagcgccgctgggggaatttttttagaaaatttt

SEQ ID NO: 37737 - DNA, 100 bp, Heterodera glycines
tgcagtacatctcacaagttcacatactctttttaaataggagtggaagtggcaaatgccgcaaacagcgaatcgaaggcgatcagccaattacaaactt

SEQ ID NO: 37738 - DNA, 963 bp, Heterodera glycines
tttaacccgtcacatttacacgggcacaggctgcttgtgcatcgacacgggttacgggctaaaaacccgtgtgcccgtgaaacccgtgtcagccgaaaaaaacgggttacgggctcgtgaaaagccgtgcaagggtccggcccgtatccgatctctaattctgagtatattttcacgaaacaaaacacacaatgataagcaccaaatgtatgtaaaaatatttggttgagatcaatttgaccaaaaatgaaaaaaagaacaaatggatgaataggatatttgaagagcaattgctgggttatcgttttttaaattttgaaaagcaaaattcaaaatttaatcaaatgccaaaaaaattgatttgtgtgtaaaagtacgatcacacgacaaacggacccagccaaagcccaataaaaattataatgacaaaactcaatggtggataaataaaaagtataaaaattcaaaaataaataaataaaatcgaatatttgatctctcgttttcctgtccctcaaatgtcgtcctcgaaattgtatttgaaatttggcccaaagttggcctcaattttgtccccaggatggtacagcgtaacgcaggcaaacaaatcaaccgaatcggcaaacaaattcgacgcatctgaatatgtaaataataatttcaaaaatataaaaaactaaattcaaaaaaatttggaaatttttgtgaaaattttgaaattattaattttgttttccgacaacagaccaaccaattcgctccccatttttggtgtacaccaactggcgtgtggacaaattgacgccacatccgacgacgtcgccggccccccacaacggcacccttttgcccacaaatgcccgactgctgctgccgctggcacattcgctgctgtgccggttgcgatgtttcagccggcggcacccgttcagccaaatgtcccattgctgtcatacgcatagg

SEQ ID NO: 37739 - DNA, 942 bp, Heterodera glycines
  misc_feature (8)..(8): n is a, c, g, or t
  misc_feature (918)..(918): n is a, c, g, or t
taattctntgaggaatttcccaaagccatgcgcagctttgttagaccgatgccgaaatggcaatataattggaaaaggacagacaacaatgcttttctttatatcagctgatggtttatttacaaaaatcgaaatacttcctgattactttccaagaaccatgagaataaatatcgcactagcgccaaaatcgaacaagaacgctaatcatcagaatcatcttaattttccccagtgatttgtgagtgataagaaaatagaagaaattcagggattaattcctgaggaatttccaaggaccacgtccatcattgctacaacggtgccttaatggcattttaatgtcaaaatgcccgacactagcgcatttctttagacaacgaaaattaattcctgaggaatttcccaatgcattcgcagctttgttagaccgatgccgaaatggcaatataattggaaaaggacagacaacaatgcttttctttatatcagctgatggtttacaaaaatcgaaatacttcctgagtactttccaagaaccatgagaataaatatcgcactagcgccaaaatcgaacaagaacgctaatcatcagaatcatcttaattttccccagtgatttgtgagtgataagaaaatagaagaaattcagggattaattcctgaggaatttccaaggaccacgtccatcattgctacaacggtgccttaatggcattttaatgtcaaaatgcccgacactagcgcatttctttagacaacgaaaattaattcctgaggaatttcccaaagccatgcgagctttgttagaccgatgccgaaatggcaatataattggaaaaggacagacaagaatgcttttctttatatcagctgatggtttatttacaaaaatcgaaatacttcctgagtactttncaagaaccatgagaataaatatcg

SEQ ID NO: 37740 - DNA, 1237 bp, Heterodera glycines
acactcccggaaaaatcctctcaacggagagcatgggaagcgtggtccaacgcgagaacagagcaaacagtgtgctttgcatgaacttaagtgccgcgacggacgatcatatggcttctcgcattcaaaacaatagttttggccaaacagcccatactccttctgcaccccatcgaaatggtcgttgttgaagtacagcacaattggggtgtcatagcggtcgtttatgtatttgtagagaggcttgtattgtccagaagagccgaaaataaacacagcaaatcgctgttgttgttgttgttgttgttggtcattgttgttattccaatagtcaaccactcttggaacaaaaacttcggcttcgtaggcattaagaccaggccgagcaccagtttgctgcattaagtccaaaacatctctctgaagacagccctgttgaccatatctgctatgcatgtagttgtaaaattgccacttaggccatccacgcgtttttgccaccatcgttgcttgtaaggcgtaaaaaagacaatatccatcctggtttcgaatcttaattttttctcgtcaaaattgacattctttggagcgaactttgatcaaacaccgatcattgatacggtgatgtacagatgccagactgcgccgggcgccacctttcagacttcttttgtcgggaagtccagttcggtcaacggtggtcacagtaactgtgaacggctcgccccatagggtcacattttgctgttgtttgctttgcgcaactttattgaattgattaaggatggtgtccacggtgttgtcagtgatttggcgaattgggatgggtatgtcaccgccagtcaatagtgggctgctgatcaaacacccaagatgagttggttttactccgcgctgttcgctttccacgacggcctcatcaatgcaaaattggaaaatgccggcaagcagcccttcgggattcgctgggacgtcctcgatgctgaacttcgatttggccttgacgtattggaaccgtggcacatgctcgatactgctttccaattttttgacgaaatcctttgctgacttagccgatgaagttccagctcccgcttgaatgccatgacgtggctttttcgcaggaatggacaaaatgtaatcaattgaaaattttgaggggcactgaaggttgcgattttccatttttaaatctagaagaaatccataaatattttttaaatattattttaatgat

SEQ ID NO: 37741 - DNA, 909 bp, Heterodera glycines
  misc_feature (814)..(814): n is a, c, g, or t
cacgttcgggattatggaagtttttgcagaggttgcagtagcgttcgccacacacgtgtccttttcttccatttctgttgttgtcattgacgtcccaaacaacgccacagtccttacactttttggacctcttgcagaaaccggactggagatggtgccggaagcagtcattgttgttaaagtttttgttgcacccagcgcaatgcataaagaatcccgcatgtgattgacatggaaatagaggccccgtccgtgaacataatatgcagcgagctttgcacgatttattgtgtaacaatgccctcgaatatggtcgttcacactccaaacagtaaggccttccgaaaaggccaccctgcttctgcaccccatcaaaatggtggttgttgaaataaaggagaagtggtgtgttgtaggtgttgtccacatatttgtagatgggcttgtagtgccctgtggtgccaaagatgaaaacagagaatcgatgttgctgttggttgttgttgttccaaaagtcgataacgcgcggtacatatgtgtcagcatcgtacgcgttcaaattcaaaggtgcaccaatctgattcataagctgcatcgcatcgtgctgaagctctccccgttgaccatgtcggttttgcagataatcgtaaaacttccatcggggccaccctctggtcttggcaaccattgtcgcctgcagtgcatagaagagacagaaattgtgcctgtccgggttcctgatcttaaactatcacattgatatatgtcaagaggcttccaattgaggtaaaaccttgatcaaacagttatcatngtatttgatgtcgcactggagccaattgacgagcggcacctcccttcacttgtcgttttggcggggagcgcagaccgatcgactgctgtcacaac

SEQ ID NO: 37742 - DNA, 1124 bp, Heterodera glycines
attgagccgtacacttcaaatgtgtacagccgtcgtgtcctttcgggagactttcaagtaaaattgccaaaattttatggatgaccaaagaattcttaaacatgtaagattagtttctctatgtgttttaagattgtcaatccgcatttgatgaaggatttaattgaactcaatctttgggatgatcaaatgaagaacagactaatcgcggagaacggatcggtgcagaacatcaagcagttgccgcaagaaatcaaagacctgtacaagaccgtgtgggaaataccgcagaaggacattttgaaaatggccgccgatcgcgccgctttcattgaccaaagccaatcccttaacattcacatagcgcagccgaactatgctaaactgagctccatgcacttttacgcctggtcattggtcggttatcgactaattgttaataaataaatggttgtatattagttttatgccttttattccttttttataaaattgcgtaaaaaagaacacctatacgtttaggacgataataaaaataccatgaaaaaataaattcaaaaaataatgcaaattcgaccaaacagggggaggggtcactatgtatgttacgactcattaatgggtaccatcgtttagggacttaaaaccgggatgtattacctgcgcactcgtccggctgtcgatgctgttcagttcactgtggacaaaatggcccttcggggaacaattgccaaggacgaatctgtcgaaatcgacgttttgaaagacaaggaaaacatttctgccaattcggagttgcgcttgccgtccaaacgcaaatacaatgaacaattggaggagagcgatgggtgtttgatgtgttccggttgatggattgtttttccatttatttgattgtatttttgggcattttttttatttggctttaaccattggttttcgttaacatatgataaattgatattttgcttgtttaaaacattcccttctcttttggtgtatattgttaatacataaacatatttttaaaaattaccctttctttttcaaagtttataaatgaataagtaattgtaacatctcggcacctttttgatttattccgcctactaggaagggaacag

SEQ ID NO: 37743 - DNA, 960 bp, Heterodera glycines
attttggaacttttcgcattttttcgtacatattttgcaatttttgagaatttttaaggaattttttattaaatgcccaaaaaaaaatccaaaattacacaatttttttcaaaaattttgagaatttatagaaatttcttgtgaaaatttaaaattttttcttgaaaatgttcccaaaaaatagtttttttttttttcaaaaaactgataccaaaaattaatcatttttgctaaataactaattagctaattgaccattgccatatgccccgaaaggcaaaaacatttaagaaaacattaggaggaggacagtcaaagtcagcagaagcacataatagggggaggctaacaaatacaggggggtgatgcgaatttgcggcgctgacatttgcggcgttacatttgctgcgcccagtcaacgacatttgcggcgcagaatttaatggctccaaaccagaatttttattttattttatccattcattgctgtcctgccataaaaatttatgaattcggcataactcaagagattcttaaaaaccctctgaaaatattttaaaaatgaactaattcagcgggttcgtttttgctttggaaaaaaaatttcttataacaaaaaggaaaatagaagggcaataataaaagagatttaattttgcacattaattatgggccgccacaaaatgtcggggaaaagtcgcgtgctcgcagggatttgtcgccaactcggctttacgttttgcggttggcaaagttaaatcttaaattttgtgatcaataaattttccttcttttagtgggcatataaagcgaataaaattcaattagtgaaagttgtgaagtcgggggaaaagggaatcttttgaggatgagatgacaacacatgggaaatgaggcgaagggaagcgaaggacagcttcttcccaccagcatatacatttctcacagagaacggtcgat

SEQ ID NO: 37744 - DNA, 1050 bp, Heterodera glycines
  misc_feature (6)..(7): n is a, c, g, or t
ctgcannggtctgaaaaaaatattttatgaaacaaaaaaatcgattttttcaagtgtccgttttggggtactcaaacatttatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctactcccgaaggattcggtctccccataaatctgggcgcatcggttcggggggactgccccgaaaacaaaaaaaatcgattttttcaagtgtccgtttggggtactcaaacaattatggggagcaaaaatccaacgcagaattaaagtacaggctatagggaagctactcccgaaggattcggtctccccataaatctgggcgcatcggttcggggggactgccccgaaaacaaaaaaattgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcgggggggactgccccgaaaacaaaaaaatcgattttttcaagtgtccgtttggggtactcaaacaattatggggagcaaaaatccaacgcagaaataaaagtacaggcttatagggaaagctattcccgaaaggattcgggtctcccccataaatctggggcgcatcgggtttcgggggggactgccccgaaaaacaaaaaaaaatcgatttttt

SEQ ID NO: 37745 - DNA, 986 bp, Heterodera glycines
  misc_feature (47)..(48): n is a, c, g, or t
ttggttagatctgttaacagattttgtccaaaatatgctaaatgtgnnaaattcaattaattactaaaattcgatcagaattaaatgcaaattattgattgtttttgatcagggctggccgactaaatttgcaattaacaggcttaattaagtcttttcatttgttcttttggcgctgtgttgtaaaatgctattcgattaatgatcattgaccatattcaaaatgatcagagcaacaacaaattattgataagccgccaaaaaataacaattaattttataaaaaatcaaattaaatttttaattgttttctccaccatttcgatctttgtcccttttatttatttattttttatttatgtcttttatcattttgtcctctcttttttttaatcattcaatgattaaaaaggggaaaattttttgcagtttttctttgttttatatatatgaatagataatttcgaaagaaagtgttctcattgtgtcaatttattaatgcaaacttcagaaaattcacaatttttcgaaaataattttcaattaaattaaaaatttaaatttaaattaagggaatattttaattatttggcatgactttgttgacttcatcaagttcatctttggaagatttggctgcccttgacggctgctcaaacacatcagacattttggtaaaatcatagaattaattaacaaatcaataaaaaatatatttaaaatcttttggaaatgggatcccttagtttgagttaattaaaattcgaatttaaaataggtaccatttaaaattttatttgtttttagcttgccgactctttgctcagtgacattgaacattttgccacacattgtctggcacttcgcaatttattggccacaacagcagcagcaacagcacacaaaaacggagcaacagcaggtaaaatgtgataaataaaaaatggtgagaaaaaaaatgaaaggctatcattaaatggtaatta

SEQ ID NO: 37746 - DNA, 778 bp, Heterodera glycines
ttttttttggctcaccgcaataaaggagcttatgaccaagacgcagcacttgttccatatagtcataaaggtgtagacgagcatatgaagtgacaaaaattgcaattggtaagcagttggttgacggtgcttttgcaaattcagcctttttcctcactaccactctgtccatatggtgagagacgtgatgaaagtcaataatgtcgatgttgcgattctcgagcagtgcatgaaactcagctggagttcgggtataacgaacttccgttccaccgactcgttgcgcaagttttccccagagggagtttgcaagaattttctgtgtgtgtgtgtttttttttaagtttaaaaattgtaattctgtattttttttttaccgcaaccatccgaagtccagggttgtttgaaattttgttgtggtccaactgaatgccttcaacccgcctaaattcatctacataggctctgcgctgttcatcggtatcacaaccggatggccaaccgcttgcttgaactttaagacccacaaaggtgttcatatagtcacgaaacagttggttatcccattcttcataatgccatacctttttttttaaagtttagtctaataaacgatacgttatttttacctcaaataaatcaataactttatagccaagctccagtgctttgttcaatcaacatgggtgtatctaaacaccggggacaaaaaaagtaaattgacatgggattaatttcacaaaaattacgcggaaaacccatgccccttgacgcatca

SEQ ID NO: 37747 - DNA, 953 bp, Heterodera glycines
aaaaccaactgaccggatgtggatggcacactcgcgcaatgtcctcacaggaggcaccgtactccagcgcaagcgtcgcttcggcaatcatttcacccgcattctgtgagcaaaaaaaaaaaacattggggtgatggacaaaatgcaaaataattttttgaatgaaattttaaaaccaaccggtcccatgatatgcacacccaacagccgatcagtgtccttgtcgccgatcaccttcacaaagccttccacgtcgttgttggttttggcacgcgaattggcgacgaaagggaatttgcccactttgtagttgacaccctgagtgggaaaaacacaaattgtaaggcattttgaaaaccttattaaaagcatgaaaaaatgaaatttcctgggacggtctcacgaagttcattaaagattaaaaatagaattcgtcacaaactattcaaaaaagcaggaggttgggatcctctctgaattggaaatgagcaaatttcggccgggcattctttgccggtttccaaaagtctgaaaaaactgtttaaaaattatatttaattaaaaataatttatatattttttaatttatttttacagtcacctaacaatgcctgttgggccatgaggaatgactaaggtgaccgaaaccgcatcatgtgccttttcggcattcattgcagcaacaatgccaagcatttcacctgtgagttaaatggggtgaacagaggaggggggacatatttttctaattgattattttggggatattttggcatctctgaatcagtgacggtttcagtacgggatatcggcttggagaggcttaggagtacccgaatatgaccattttttttcttttgctcttcagaacgccaaattttcctctctatttttaaacttttttggggagtgaggtcagtgcattttgtacctcatcgcccatttttgaattt

SEQ ID NO: 37748 - DNA, 1329 bp, Heterodera glycines
  misc_feature (61)..(61): n is a, c, g, or t
  misc_feature (96)..(96): n is a, c, g, or t
  misc_feature (1322)..(1322): n is a, c, g, or t
agaggccgagtgagtaccttcggtgcaggaaaattataaattttaaaattttttaattgcnttttaaatatgccaaaaaatgtaggctaacttttntagtgaaattcgatcactcatattttttgctaattgagcagaagcgtaccaaactttgcagggatactccccggtaaaggactaacttacactgaaatgagcgccgagctagctggctcaaaaaaatttttcgaaaatctgagtctttcgtttttatttatttgcaaaattaattcataaatattttttcagaaagggttctgaaacgcaccaaattttatttacatgttagtttaggcactctgatgctttttctatcaataatggaggtgaataaaattttaattgctttttaactttgggaaaaagtttaggcttaactttttagtgaaagtttgatcactcatatttttttagtctaatctactcaaaacggttcagaattcaataaaaataacattcacggtgcgaaaaatggggtttgacaagtttattggggaaaaaaagactttacaaaataatacccctgggagaagggagtgggaaacatgatttcaaaattttcaattttttctagtctaatctactcaaaccggttcagaattcaataaaaataacattcacggtgcgaaaaatggggtttgaaaagtttattttgaaaaaaagactttacaaaataatacccctgggagaagggagtgggaaacatgatttcaaaattttcaattttttctagtctaatctactcaaaacggttcagaattcaataaaaataacattcacggtgcgaaaaatggggtttgaaaagtttattggggaaaaaaagactttacaaaataatacccctgggagaagggagtgggaaacatgatttcaaaattttcaattttttctagtctaatctactcaaaacggctcagaattcaataaaaataacattcacggtgcgaaaaatggggtttgacaagtttattggggaaaaaagactttacaaaataatacccctgggagaagggagtgggaaacatgatttcaaaattttcaattttttctagtctaatctactcaaaacggttcagaattcaataaaaataacattcacggtgcgaaaaatggggtttgacaagtttattggggaaaaaagactttacaaaataatacccctgggagaagggagtgggaaacatgatttcaaaattttcaattttttctagtctaatctactcaaaccggttcagaattcaataaaaataacgttcacggtgcgaaaaatggggtttgacaangtttatt

SEQ ID NO: 37749 - DNA, 976 bp, Heterodera glycines
  misc_feature (938)..(938): n is a, c, g, or t
cttgttaggccgcttcacggcctcagtcgagcgcttcttccggtttttcaatttttgttggccttggacgggcgcttcttgcccgttttttaaattcgttgaactcatacgggcattaaccggccgatgacagtgccgcggcatcggatgacaagtggtggccaaatggcttttcatccacttcaaaacaatgtgccaaaggtgttcaaatgcgaattggacaaggatgatgggaatttggcatcgaacattgaagacttcaaagaggtgatttcggattgatttagttgacacttttacgctttttgggttcgcttacaaaatcattattattcgcctaaaaagatattttcgaaccaaaaacgtctcgtccatctgttggcattttattattaaatggccaagtgccgtgcccatctttggctttttgtgccgctccccaaccgtaaaagttttatcaatttcccatcttttaggcttttgctggtgcttcttccgccgtcaatttcatttttgtcattcgatttccgccgtcttttgctaactccgttgtgccatttacgctgaccaatgaattgacccgtgaacaattggcattgaaaaggattaacaaacgttttttgctgattcgtttcgttgtccaattgcgcgagacgaaagcaaatcgacaaaatgggaaaaggaattgatttattggcgaattgagaagtgaatgaattgtgaagaaatatgatcaccaatttgaattatggaaattttgacgtgctcataatttgggcttccaattatatggaaatccatattttttcctggactgtgggaggtctgaaacgcacgaaaaacatctttttaacttggtttaagcttctaggatgggtttccatatccattttcccatattttccatatttcgcgatttatgtccctaacaaaatttnaataggcaaacttaaaaaaatatccatatttaaaaagc

SEQ ID NO: 37750 - DNA, 1290 bp, Heterodera glycines
gctgagcggcgcaagtgtcgcggcgcaaaagtccgctaaccaacgcaaattaaattaaattaatatattcgaatcattgtgactattaattaattttatattaatatttttgttattctataatttttatttttacttcaatataattattttaatctatttccacttgagcttgtaataatttttttggtctccattgaattattatttaaactgatcagatttgattgcatttagtgttcacttcaactctagctaaaagcaagatgaaacaattatgtcaaagttcttttttgcttcaaaacgaatttttttttttgcattttgcaataattttagcaattttatattttgaaaacttttttaaatatttgtaattatactgtgcgttaattttgggtgttattcacataaactgttacttttatcttaattaaatttaaagaatataatggaagatttggtgagaaaattgtatttattatagtaaacaagcaaagaatttaaagaacgtatattaatagttaaatagttataaacgaaattcttctttaaaataaatttgattatgtttaatttatgttgcgcatattttattatttaatgccttttgtttttattattaagaaatttatcattattcaataaatatataaaacggaaagtgtgataatgaattatttcgaattctattatttttaaatgaattattactaacttgatattattcatttaatttcttattgtcagaatgaatttttaaattctattttggttttattttaatacccatgcaaattttaaaagataaatttaagaaaaatcttttgctaaacttattaagaattttaaatatgtgttattatttatgcccatgtattccttttttcaaatcatttgatttttatcaattaaaatgaaattctgttgatgattatgttttgtatttattttattgattttttaataggaaaatgcttcgccccttaagtaacagattttttgtattaaaactaagggaaacttaatttttgattttattatcatttgaataatttatgcctgattagaaaatttcattttcttaatattttttatgtattaatgagaatgtatgagaggttggacaaaattagcccagatcagtcatttttgtgcgcagaaaatgactgtttctgtaaatcattttttaaatgaaaattttgcctttaattatagatttttaaattctttaatttataagtattttagcatgtaaaataaaggtgtttcaggctcggaaatttgatc

SEQ ID NO: 37751 - DNA, 960 bp, Heterodera glycines
  misc_feature (903)..(903): n is a, c, g, or t
  misc_feature (916)..(916): n is a, c, g, or t
cttcttcttaattgcctgatcattctccaattttttttattttggacagtcaaaaagtccgcgcgtaggtccaatttcaaatgatcttagtctgttttgttggtattattcttcattttcatttcttagatgaacctatctatttaggttaaagctatgtcaactgagatttagaattatttaatttttaacctttttatttgccctcaatcccgttgtttgtgcgttattcttcaagcaacaccaaattatgttaaattaaaaatgtaaaactttactttttcattaatttcattttcaaataatcatttatttttgcaattaattatatttgttttactggatctatgaaaatgtgcaattagtaattcagaatatcttagaatttttattttgctaacatttatttttaaattcaaaatattttttagatttgacaaatataataattcagcttttcaccaaaaataccaatagaatagcttctctattcatgtcataaaagttagatattatacattaattattttcaaaaatttccccggcggcgcctatcggccgggaaatttttgatcccggacagcactagtatttatcttgcttacctattctttaaattccacttgattagcatagaattgattattcctttcttatttattttagtttccacatcagcgaattaatattgcttttgttagaatttcgaattcgttttatcttaatttttattttactcttctttattatcttttacaaataaatataactttttcacataaaaaatatttttggataatctataccttctcatttacataaattattaattttttgaaaaaaatcttgaatcggtaggtaatcccgtcaaaaaataatggtagggattcaggtccgtttttncatgatttgattntctatttcccttaaaaaatcatactctaatatttcagtaaacta

SEQ ID NO: 37752 - DNA, 719 bp, Heterodera glycines
ctcttcctttcagtatccctgcaaagtttggtgcgcttctgatcagtttctgaaaaaaaagttaagcctaaactttttggcctgtttaaaaaggaattaaaaatttttaaaaattttattcatctccctttttgatagaaaaagcatcagagtgcctaaactaacatgtaaataaaatttggtgcgtttcagaaccctttctgaaaaaatatttaagaattaattttgcaaaaaataaataaaaacgaaagactcagattttcgaaaatttttttgagccagctagctcggcgctcatttcagtgtaagttagtcctttaccggggagtatccctgcaaagtttggtacgcttctgctcaattagcaaaaaatatgagtgatcgaattttcactaaaaaagttaagcctacattttttggcatatttaaaaagcaattaaaaaatttttaaaatttaataattttcctgcaccgaaggtactcactcggcctcttcgcggcctcgtggtgggccttcgcccccccccctcccacgcccttcagagcacgacaaatatttcaacacaaattttgaaatcatgttgtcccactcccttctcccaggggtattattttgtaaagtctttttttccccaataaacttgtcaaaccccatttttcgcaccgtgaatgatatttttatagaattctgaaccgtattgagcacaatagactataaa

SEQ ID NO: 37753 - DNA, 964 bp, Heterodera glycines
tctacagtaatcgcttacctaaggcaattgaaattagcaaatgctcccttcggaaattgggtgcaatttcggacgtcactttgctaatattcatcggtttgaccgccaaaatgatgacgtcattctctcgcgcgactgttttttttggtaaattaaaaatccctttgttgaactgctccacttctcgtgttgtcactcgtcgttccaatccccaatttctgcaaaaataaattttgaccatggccattccttcgatcgttcttctgtttttgctcactttgcattgctccaatagtgactcatctgtctatcaaaaaattatttattaaataattttttttttgcttttgcttggttttacgtacctttggacaactcgccatcaaattctctgatggataacgccctaattatcacaaatttatccgacttttctttttgcccaattcctacccgaattgataagtcctctcgctaaacaattgtttttttcaaattaaattatgaattttctcaattttcttttgctccgcttacccaatgcctgtgccattttcccggctccgataaatccgattttcacggtttctgtcatcaatatttatttttttaatttaatttattttttaaatttttattttcctaatttccttaccgcttaacatcgtttggtcaaattgttgcaccaaatgttgtgatttaaatgggaagtgataatcgactaatgaattgggctgagaatcggcggaggcggcggtgatcgattcgtgcggtgataaaatgcgaagagtgagtgactagtgacttcatttattattattatttgctgatttggcgttgggtttgccccgcggagtgtccgccgtgggaatgcccacgcccacacaccgaccaatgaatgctgctaatggtaactaattattacccattaattagcatgtgtttgtcgtttcatgcaaatgac

SEQ ID NO: 37754 - DNA, 982 bp, Heterodera glycines
aagctcaacggtcaaacaacagcattttggatctcgtatgatcgacaaaaggcactgaccttcaccgagacacatgccgtgcaagcatgcgacgggagacaaatcgtcttatcagagcagaacttcggcattccaaaagagcaattcgacatcatcatgagcgaccacacaagagcgaaacgcaacgtgcaacccgaacaactcgcttcacagctttccgctgctcaacttgccacaacaatggcactctcgcagctctacttgaaggaatgccagcgcaacgtgcgcgtcagcaacccaacgcttcaggcacgaaaactcctcaagcgcgaaaatctgcaagcccgatggatcagcgaaacaacaatcgaagtgtttccctgcgttccaatctccctatccaacatcagctaccgaacaacaaaggactgctacaagttcattcctgtcacaatccatctgctaaacacaacacaagacgcattcctcgacccggagatgcgcatcctctcactcatctcaaagatcgcaagttgctctcaatttcgctaccatcatctgcaagtgcaacaaaaacccaacttgtgggtgcgaatcgactcaaaaaatggaaacgtccaacgattggcacaaacagccatccacgagctctacgaaacaatcctcaacaaaacggacaacgatttggatctccacccactgatcttccatcagtggcagctcgacaacgacaccaactttgctaactttccgcacatcgacgaattcgaagactcggaagacttcaaaaacaagctggaacaacacacgacccaacgagccgaagcactcggagctttacccggcggaatcgaaggatggactatcagatggctccaagaacggctacaggaagcaatccaatggtggatacgtctcgcctcggcatattccacattcctactttgccgtgacgtcatcctaccctgcctaatcgcttact

SEQ ID NO: 37755 - DNA, 914 bp, Heterodera glycines
tcccctttctctctctctgccacctcgtcgtaattggctcttcgacccctccggggagtccgtaatacgaagaagaacaatcactgcccaaggtggagaaacgcatggcggaagcccggccagcgggcaaaatgcgcgagttggtcagttgagggagccgatcggtccccgaggggaaagcgcaggaagggatgaggacgggatcagagtcgtagggagaagcagtcgagcaaggatcatccggatcagagggaccacgagggatcagctaacaaacgaaaatgggggaggaaatgccaatgggtggggggaggaaatgccattaaatttcaaaatttggcggcgttcattagattcaacttcccataaataaaaacgcccatcaatcattggttagcttacaattagcatttcttctcaatttccattcgttccccgcttttcctccaaaacctgttgtgcttgcgaatgtgtccgctgatgaccatgaaaaaaactggacattttatgtggccgatctgctgactgttgccacgagtcttttttagtaatttattttattcgccatttaagcttaatctgccaatcgattgtttatttccctttttctgtagtacaaacaattaaacattagtaattgatgttgggcgaaaacggaataggtatgtattaaaaattaattgataattatgtagttaaattgggcaattaaaataaattaaaaattatttcaaatttctaaagttcatagaccaaactcaataatataacgatagtaattaaagcccatttgttggattcaattttgggtccaaaaatcgaaagtcggtttttaaattaggattacagcattgtacgtgccatagatagcccctctctcgctctctctccctctcactcttgcttattgctga

SEQ ID NO: 37756 - DNA, 936 bp, Heterodera glycines
gagaatagatattataagtttttcctttataattgacaaaaaaaacatttgtaacagttatgttcaaaaacagcttgtcgttctaatcagaccctcgtactaatccgatcgtactaaaccgaccttcgtactaaaacggccgtactaaaacagcgtactaaaccggccgtactaaaccggacccgaccggaaaaaaatatgttagtaaatacactgtgttgcattagaataaggacaccctattttttgggagtttgaccacttcccatgaaccaatcgatctgaaattttaactgtacgtagcaattctgaaatattaagattctaacaataagaatacgaaaggatgtcggaaaaaattttacgaatttttttccaaaattggggtgttgcattagaataaggacactttggaaaactaagaaaaatctcaacaactactaaaaagaaactgataaaacaagctataagaaagaacaaatcttttttcacatttctgtttattttgcgtacagaaatatgtcttttggggagagttatgttgaattttctaagttttcaggagaaattaagggccaaaaggcttaaatcgcctctaacattcgcccaacgaatcaaactgacagcaatcaacgctaagataacgtacagacatcctttaagcattttgtattcattttatgccataaaaaaggcattaaacacaaaatttttgcgggtgaaaaaatacgaaaatctgagtaaattcgaaaaaaaaattctagggggttggaaaaaattttccgtagaagatgattatgacgaacagaaagagcacaaaattctctacaaaatggcctttgaatgattgctctataggaagtattcgctgaggggtgccttgttgaataccgactatccctaaaaagacgcgattccagggatttttcctcattt

SEQ ID NO: 37757 - DNA, 1597 bp, Heterodera glycines
cacatattgggcacatccaacatttttctgcccaggggaagtgtacggtgccaaaatgcaatagactttgtgtcctacatcttttacaaatttcataatgacatggacagtaatgacaacattttacttgatgaatacaaattttgttcatttttaataatttgtaacaaattgaaaaaaacagaattgtttaaatagtgtaaatatgtaggggcagttattcgggtttcatgatgtattcgagccattgtgttaaatctgccgaactgccagataattctactgtttccttctgcgaccactctgttgtcaatttggctgttttaaaaagagtttgcgggtcggcctcggatattatggcaagtggtggaaatttatcgcaagacaaatggttgacaaacatccacgggagtaaggagaaacgagcatttgtctgatggcatgggcccttggtaacagtcgtcgatcgtttggggcgtcagagcccttccccttttgattatccattgatcacccccctactcccttctctttaccattgtgccgtcaccattggcgtgccattgtactgccgtgccgttttctcctgctgttcctccctctccgccactcgcacttccccgtccacttggcccccgctcggcgccgctgttgcgcttccatttggccctccctctccgtccccgttcttttccatcaatgcgttcacaatctcggatagcgaagttgctgccgtgtcggtggcatttgccgagggctgtgctggccatggtctgtgcccgctcctttcatttccattcagacccttttgttcttcgttccaattttaccttgaaaggatcgtccaattgtgtgccgatttcatctattattttgttcagtcctgccatgaagctctttgcgctgaacagtttgtactcgtggaacacccgctgcatcaaatccgccggcattcgaaagtcttttcccgtcttaacaaacggaggaaccgacaaatgagaacaccgcgagggccgcctttaccaaccctcacataagcgagttttgctgcttcaattccaatcagaagaaggaatgttttgcatgacaaatcattaaggccgtaccgatgggccaattcatcgccaaaatttgtctaaaaaagtcaacaattaatgaattggcgttattaaatctgttctttcgtcacctaccaaatcgtttccagggatacttttgttatttggtgtccaaatttgtttggccagcagcacataaatagtgatcctctcgctttgattttggcattctgccggcgccttttccgctaacgttacattggcatttgtcagttctttggttttccgctttttcccgttaaccaatcccctcttctacttgtcatttgacttcggatgttctcgttgatctgtgccctccattggtccgtcagaatgtggtcggggtcgcacagcgtggagttttcccacgtgttgcagcccgtgtgattccgccgtgggttcggatagatttgtgacgtccatcgttcggtgtcagccttaagcactgtgccggaagcgagcagtaaggagagcaaggaaagcattgaaaagctatt

SEQ ID NO: 37758 - DNA, 1259 bp, Heterodera glycines
acggacacttgaaaaaatcgatttttttgtttcataaatatttttttcagaaagtgctctaaagcgcaccaaattttatttacaacttaattttagcactctgatgctttagtatcaaaaaggaagatggagaaaaaattttttaaaaaatttttccttatattttggttatatcgttttgcttttggtggggtgcttggaacagtggaatcatgcgcacccgtccgatctggcaagttaagcaacgattgctgactagccaaaaggttcggtgccgtgatgaaacgaaccagcactgcttaccccgcggcacccggcacggtcccccgaaggaatggatttaattaaattctctccttcggggatttttttccattaggtcgtccgttagcgttcgattgctctagtcaatttttaaaaatttttgttgaaatatttgtcgtgctctgaagggcgggggggggggcgcgttgtgtgttacgaacgaaaatttaaggtgttttggcacaaaatattactttttgctggacattgaaacgaaaaatgggttaattaagggaagaaaaaagttggaaaatgattgatgctactgctttttctgctgatctgattatagtgtggtcgatcatcagccaagtccgttgtcttcaaacaatccttgcgttgtctcctcctgaaaattgagccaatcattaaaaaggttcaaaaatttagccttactattttttaaagaataattaaattggaaaacttaataaaatccataacaaaagtaagaaattagaaaagtaagacaaatgttaatcggtgcaatttgagttgagaatggtgagagtcaactggaccacacattctttcactgttccttactgtttattattcaatatttaactttatcgataaaaaacaaaatttcaaaaagtcacttttataaaaattggatgaaatttcaaaaatattttttttttgtgatttattcaattttcagcaacattttctcaacttaatcaattttgagggcattaaatttgtttagtgaaagtggcacagatttgccggttcgatttgagcatcagcgatatataccagggatgtgcctaggtttcgcttttcgcatttcgtcttattcgcattttggcgcgaaaagcgacttttacacccctaagaattggattagattctcataaaatttttcaaaattttacctataaattgcctaatttcagtgaaaaccagtttataaatgatcacaatttcca

SEQ ID NO: 37759 - DNA, 905 bp, Heterodera glycines
tcgattcgtgaaaacgaattgaaaagggtgcgcaaaatggggaggaggcgcagggaattggtgctccttccgctcggtgtgtcctcgaggctgcttttcctccggatgcttttcctgcgggtgcttttccgccgccactttccgttgcgactgttggcgggcggtggacgctctgctcgactgggcactgcgcaactcgtcgctgtcctcctaaaagcgaaaattgcaaataaaaagaaaataatttcgaaagaaaaagggggagagaatggcaaatcaaagcaaaagtaaaattaaacttttgcaatgaccgaaaggcattcatcggacggacggcggcgataagaaatgtcggttttgggaaaggtcactcactcagtgagcgaaccgaaaagtgaccattccgagggtcagcaaacactcccccggggggaaagtgcgccctttttatggtgggcaatgtgcggggaaggaacggcgggggacgaaggcaaatggacgggggaggggtcattcattcatcgtccattgattggggacggacgaaaggggagagggggggggggcggggacagaccaaactaatctttggcgatggatgagaagagaatgaggcggggatgctaatgatgggttgcgaaaagataaaggattcaaactgcgaaggtttcctcccattatgctaattgattatacaggctactaattgggcaatgcttttccaattgaattttcattccaattcgatgctttcccttccctcctccggttggaatttctcacttccgaaatggcgtccaatcggccaaaaagtgtcattctctgctgaaagtcgtcctcctcctcttccccttcttcttcttcctcttcttctcctccttctctgatgacaaatgccattcctt

SEQ ID NO: 37760 - DNA, 1041 bp, Heterodera glycines
catcattttccatttccgaatcgggcgactaaatttgttaattttgaatttttaaattatttttcaataatttttgaacaccgtttcggggctcgaaattctttttatgaatggtcgagtttcgaccaattgtccgtattcatccaaacattcttcaacaattttcagcgcgagttcactgacaatcggtgaaaaattcaaatgggctgaaaatttcaaatatttttaaaattattattttaaaaatttttttcaatttttgcttttaaaaataaaaatttaacttgttgctttcaatgcacagaaactttctatgaaaagaaaaaagaagaaaattgagcagcaaaacatttttatgagcaaagaaatgaaaaaaaattaaaacatcaaataaaataaatgttttaaatttatctatggaaaaatataataaaacaatcaattctaattgattgccaaataattcatccgccctgctgaagctgaagaatgcctacgcttccgttcgtatgttgaaaaacaaatttccataaaaaatatattttaattatcctttttcatcaattatggtaattattagggctataagttttaaggactaaaaaactcctaaatgacaaaaaatatagacgaaaaaagcccgaagtccggactaataacccaattatgagcaaacatagactaaaaaataatcataaattgttttaaatcctcaaaaaatgccaaattgacttaaaaatcaaaatgaccggcactttcgatgggacgatgaaacccaaaggggggaccaattcaataattttgaatttgtattttttctgagtcgtgatcaaagacatttatttattttgacccattaatgatttaagggggcctcctttgtgatgaaaaattttggctctattgcatttcacatgaccataaaaaagacaagatcaaaaaagtaatggtcaaaaatgtgaaaaattatagaagtttgcccgctaaaaaaccgtccaaaatgagttccaatcggcataggtctagatcattagtcccgaa

SEQ ID NO: 37761 - DNA, 1227 bp, Heterodera glycines
caaccaggtgcaaagtggcattactgactgacattcttttggctttttggcactttcagttggccgagttcaaagacagacgggcgaacgccagcgaaaaagtcattaaaatggaaacaattcgggagagcatcggcgacaaggcggagcaggtcaaacagttggagcagctgattgccgccaccggttgcgagttgtccgagacggaacgtcaattgcgcaccatggaacgctcgaagcaggcaaaaattgatgttcaaaaatcaattttgctatggttttcaaggagttggaaacgactgtgcagcaaaacttgcgcaaaatggcactcgacgtggacagcatcaacggcacgctggacaaaatcacggagattggcgaggtaaatgtcaattgatatttttagcattttccttctctttgttaatgtatagtaatcatttatggcctataggtgttcctgctccttttgacggctattgtcatttgcgagtgcggcgcaggaagaaaaaatggtcaggcgggatgtgagcgacacaccgttggacggggcggcggaggcgcaaccggccgaaacggagcaggatcgaagcggggaggaggacgtggcggcggtcgcggtggtggaaaaggcaatggccgcggcggtggaagaggcggcggcgggaagggaggagggagggcgcagcagccggaagctgaggaggacgaggtgggagggggggggaaaagcaatatgtgcacgagtgttagttaacacacatttcaattttggcctcccagttccaaaaatatttgtatgtgtggcgaagtggttttttgtaagatagtaaggaacaaagggaggagattcgagtccattgtgcaagctttttttaagcaaatgttaatcaatttgatgaattcgagaaaagatatggttttctaaatttttttttttgaataaatttcctatttaatccattttaatatagacctgacatgttttttctttacactctctctttattggttcatctctcgtttttttgaaacgttgtagtactataagttaacatttagatgtagattaaaaaatgcaatggtttttgatcatagatcttttgggcatttgtttttatagttaagcgtatacagtaacccaccccaccgcatcaatcattcattcccctcctccacagtcgcattgtgttgtggccttgtcgcacactttgtggccaaataaca

SEQ ID NO: 37762 - DNA, 993 bp, Heterodera glycines
aaacaaacaatgccggagccaatggagttggatcaagagcccgggacgtcaacgtcaacaagttcagcccggcccggaccatcaacaaatcaacaagtgatcagctcgctaatgctgatcagcattctttgcctactcttcaccggcacggcacaaggacaatcaagtcgacaaaagcgattcgccgaaatcaaaacatggcatggcggccatgtttccaacttcttcaacatctttacggagcgcgaccgacgagcatcaacgaaatacagcccttacgttcaacgatacataaacaaggttctcgcattaaaccgaagtttgagccaatcaacaaatccgctgacaccgacaactccgacatggacaacgacacaacccacaacaaccacaagtcaaccacgcacaacgacaacaactgcgactacaacgaccacacgcacaacaaattggccaacaaagtcaaacacacggccaaccgcacgaataacaacgacaacgccaatgccatggtaaatagatcatcgaacaacaacagtgtcaaaatcacgtccacaacaacgatcacgaccaggaatcaagttgattcgttggcccaagagcccaatcacaaacgagcaaggacgcgacgtcttctggtgctcgaatcatggcagcacactctgggaactgaaaggcccggaaaactcaccattttgccgtccaccacctgcactcactgcgcaatggacaccgctaaccatcacgttgtataccaaaatacatcgaccggaaccaatcgcaacagcatggcattgctccataaaaacgacaacggaaaattattacacaaacatcgtcggcgataagttcgtcgaaatcaacaaagaatttccgttggtctccaaacgactctgccaacgaatggcacatcagcaagaatgcccactcgccaaaacagaaatgcaccacgatgacaacaatcgcatttgggcaacaaacaaccaactccaa

SEQ ID NO: 37763 - DNA, 1475 bp, Heterodera glycines
aaaaaaatttaaggtgtcccttggcgattgcctggaatgagcgcctcgtgggttggagtggcagcaaaaatcaggtgggcattttttttgaattttctggattaaccccccttcccccttcgtctgcctgtttttttttgatcggcctgctcatttttagcagcaattttcaaaaaaattcccgttgactatttttttttaaattctttaacaaaaatgaacaaacgttctgaggtcggtcggcccggcggtcttcctttccatcagcaggtcacagagctgaattaggagcatcattaattagcattaattttttttgtatttttttggcacttacccgcaaaacatccggccattcggcgtccaactccttccgggccgttctcatggcccatccctctaaccgccggacctcccgcttgacaaacgccctcttctcctcctccccttcaatctctgcccatcttgtcgacgtcatggcaagcttaaattataagtttatttatttttgtttcacttttttaagtcttgaggctgcaattaaacggcaacaatgtgttttactggtcccagaaatttttttttttttttgtaatttctaaaaacacgtttcgagaattcggcatccctctcgaccaattctaatccgaattcgaacaaaagctctaacaaatttccatttttaatccaaaaatagttgaaattatattttattgaaacagtgatgactttcgctttgtttccatgtatttttaaacaaagttttgagtcagaaaatttacaaaaaatttttttttgagaccgaaacgcatggttttgccaatttgaactggtcattttcaattcatttttcagttacctttctggcgacgcggcaccaatccttctcgtcctcttcccagccggacgaatgcccgaccgccttcacctcggcaaccttccccgctaccgccagcaccataaggcgcttcatttccctccgcgtgtaagtctcggggtctggcccgctatgcatcgtccagccttctctcgagctcaaaattttcatcttaatcaaaaagggattttttcaagaaccccaaatattttatatgagaaaataacggaaaatgcatttaaattttccatttgttcaaaatttagatgaattgcttagtttttcaaaaattttctaaaaaattgttcaaccaacatttttttaaatttttggggaatgaaaacgaaacggggggggggggggtgatgaagtgcacccggacatccatgcttgaacaaacctttaaaaatttccttgggctgttgcgccacgttattttggcgtggcccgcctcatgggagacggtgccggcgatgttttggcggcccgtcgtccgggatctcttggcaagttggccaaacttattttccctattgttgaagtgccttttgctgccttctttttattttttcttcggccggcataatattttgccatt

SEQ ID NO: 37764 - DNA, 1198 bp, Heterodera glycines
  misc_feature (150)..(150): n is a, c, g, or t
  misc_feature (1044)..(1044): n is a, c, g, or t
tgaatcagtgttcggaatgaccgagctgataatcgtcaataatattcgattacattttcttggtcaccttttggaattccaccatttcaactccttatcctctaaatataaactgaatcagtgtttgcggaggaccgagctgataagtcncaataatctccaatttacaattttcatgatcacttttgtgatattctcaatatttcaatttcttatatccaaatgtaaactgtataagtttacagtaggaaattgtaatttgggggttattggcgatttcaaatcgatccttccggaacactgatgctgtttatatttagagcgtaatgagctgaaaatgtcagaattcaaaaagtggggtcgcgaaaatagtaaatctgaggttattggcgcttatcaacctgatccgtctgcaacacttaaacagtttatatttaaagcctaattagcagaatgtgaaattctctcatttgttactttatgatcatttttgtctaattcgcaaaattacagctcattctccgcgaaatataaactgaatcagtgtttgcggaatgaccgagctgataatcgccaataatcttcgattacaattttcttggtcacctttttggaattccaccatttcaactccttatcctctaaatataaactgaatcagtgtttgcggaggaccgagctgataagtcccaataatctccaatttacaattttcatgatcacttttgtgatattctcaatatttcaatttcttatatccaaatgtaaactgtataagtttacagtaggaaattgtaatttgggggttattggcgatttcaaatcgatccttccggaacactgatgctgtttatatttagagcgtaatgagctgaaaatgtcagaattcaaaaagtggggtcgcgaaaatagtaaatctgaggttattggcgcttatcaacctgatccgtctgcaacacttaaacagtttatatttaaagcctaattagcagaatgtgaaattctctcatttgttactttatgatcatttttgtctaattcgcnaaattacagctcattcttcgcgaaatataaactgaatcagtgttttcggaatgaccgagctgataatcgtcaataatattcgattacaattttcttggtcacctttttggaattccaccatttcaactcccttatcctctaaatataaactgaa

SEQ ID NO: 37765 - DNA, 575 bp, Heterodera glycines
aataaagctttaaaaatagagaaaaataaggagaattttatgggatttatttgggatttctatcctcaaaagaaaaaaagttattccagaatttctggaaattttcgatttttcagaaaaaaattcgtagctaccttctgaaaagctattcaggaaaagtaaaatactacaaaaatccgcaatttttttctctataatataaattttattttacatttttatcacatttttaaaaaaagatacaaaaataaaagtgattttggggttcgggaccaaaggggggtgacaggatttttgattgaaaattttttttcacccaaaattttcctaaaacatgtcattaggggttatttgggccgctgatcacgaatacgtgatcagattttacttttgacatcgtcaagacctcagaatccctgtgtgattggggattctgaggcatcattttgagggggggggggggcaggttcgaatccggacagtgtacattatttgatctatttattttttgggtaattttcactgcatttaataaattaaaatagtttggttctaaattatttaaattaattttt

SEQ ID NO: 37766 - DNA, 607 bp, Heterodera glycines
agcacttgtaagacctcaaaagagactttaaatgtttgtttagtgactgggagccctgggttattgaaaataaaaagttcgaacaaaaggtcgaacattgttcgaactctaccaaaatgatcaggaagacatttccagacagggggttgctccaaggggggtcgaaatgttgttatttttgctccaaaacgacgtttagacccactttttggagttcgaacaaatttcatttgttattttcgctcacagagcacttgtaagacctcaaaagagactttaaatgtttgtacagtgactgggagccctgggttattgaaaataaaaagttcgaacaaaaggtcgaacattgttcgaactctaccaaaatgatcaggaagacatttccagacagggggttgctccaaggggggtcgaaatgttgttatttttgctccaaaacgacgtttagacccactttttggagttcgaacaaatttcatttgttattttcgctcacagagcacttgtaagacctcaaaagagactttaaatggttgtacagtgactgggagccctgggttattgaaaataataagttcgatcaaaaggtcgaacattgttcgaactc

SEQ ID NO: 37767 - DNA, 1594 bp, Heterodera glycines
  misc_feature (37)..(37): n is a, c, g, or t
  misc_feature (58)..(58): n is a, c, g, or t
  misc_feature (97)..(97): n is a, c, g, or t
  misc_feature (102)..(102): n is a, c, g, or t
  misc_feature (240)..(240): n is a, c, g, or t
  misc_feature (278)..(278): n is a, c, g, or t
  misc_feature (327)..(327): n is a, c, g, or t
atcatagaaattaaataatcatgctataggtagatgnagatttaagatattctatgcncaaaattaaaaaatcattgtttcaaaaattatatttttntatcnccaggctaatagagagagaccatagggctattgaaaaatttttatttttaaagaaaactcaccagcacgaatttaaatattggtgacaaatttccaaatctccaactatttgctaattaatgcgtgtaattaagtttntaatttgagctgcgataaaatcaaatatttgtttatcnttaattattcattttatttgttagtgagcagtccaactgagttcagttngcgcaaattgttgtcggatggcatccgcgcggccgaaacgtacaacgccgagaaattggtggtccgcccaaaagcagtccgtggcttttggattcacaatgcacagaaattgggagccaaatacgaatggcgtccggttgttaaccaactattcattgattttccatttggccaatgatttggtaagcgataagcgttgctttttctatgttatagtgggtttggaatgaaatttcggcgttataacgttagttaaacaaatttttacacagatgttaccaatttttaagaaatttgggaaatttgaatttaacaatatttcgagaaaattaaaaaaaatgattttttttcggaaaatttccggtatttagagttcaaaaaggccaatttagctgatggggaatctcgaatagaggtttttttgataaatgccaaaataaaaaatgtggaaatatggacataaatcgcgaaatatggataaaggactccattctagaagaatcaaaaagctgaaattatttatttaacaaataacttaacaaatagaaaattaacaacatcgattttgggttatttatgaatttaaaaaaattcttataaatttccgagtccgaaagaagtaatttttttaaaattttctcaagttcaaaatctgaaattcatcataagttaattatcccacaatatttttccaccctattttaggcaaaataaattcccgacaaatcttcagggttcttgaataagttttttctaattttttccaacttctctatatagttcgatagagctttcagagcgcttaatttatattttatttaactctgatcggataagatcctgactagtggttcgccagaaaatgaattgaaattggtacttacttaattcttgatatattttccatccttcctattatatatagaggcctgaaatttttttagatgtaatcaatattcagacttaggttatacaaattatgttttttttttgattcgggttttacaaaagtttttgactaaaaactgtaaacttgccattaaaagatttattttatggaaaaaatgccagaaaattgatttttaatggacaaaaggtcagggtttttgtttttcactgtaattcactctttgaacagcaaattaatttttagtccgaaactgctttaaaaacacagtatgatcacacataatttcattatctgctgatcattaataaacatttttaaaaagagaagttgatccggaagagtttcgcaatccattta

SEQ ID NO: 37768 - DNA, 678 bp, Heterodera glycines
aactcctgccgagactgagacaacaccggccgagactgagagttcaccagccgagaccgagacgactccagccgagactgagacaactccagccgagactgagacaactccggccgagactgaaacaactcctgctgagactgagacttctccagccgagactgagacaaccccggccgagactgagacaaccccggccgaaactgagacaactgcagccaagactgagacaacttcagccgagactgatacaactccagccgagactgagacaactccggccgagactgaaacaactcctgccgagacagatacaactccagccgagactgagacaactccagccgagactgaaacaactcctgccgagactgatacaactccagccgagactgagacaactccagccgagactgagacaactccggccgagactgaaacaactcctgccgagactgagacaactccggccgagactgagacaactccagccgaaactgagacaactaaagccgagactgaaacaactcctgccgagactgagacaacaccggccgagactgagagttcaccagccgagaccgagacgactccagccgagactgagacaactccagccgagactgagacaactccggccgagactgaaacaactcctgctgagactgagacttctcc

SEQ ID NO: 37769 - DNA, 890 bp, Heterodera glycines
tgacgggattgaaatttaatgaaaaggaattttcactttcaggttaacgaacaagaaagacatttgtcgtttattacgtaaatggagctgaattgtatgtcataaatggacgggggggggggtcagaaattgcctttaccaaataagaaatatcccccatcagaggccaaaattgaaaaaaaggctcaacattttttttaaccttttttttttgcgtggcgcgctttttccaaaaaatttgcggaagggggcgggggggggggtccggcggtgctaatagaccccgccggaaaaatgctgcaatttattaacagatttattttcactaaataatccaaattccataaatgattgaagaggataatatgtgggcaaacagaattgcagattttcaggccgctccagcggatggcataagaggtccacacgaccgacggaaggcaaaatacatacggcaagacaacaacctgcaagctttagtcgctgatttgaccagcgtgatccgcttgaataccttcgcgcatgtgcctaccacttacacttttaaaaaattaagaaaatcattcaaaatatatcacaatttaaactatgtaattattttaacaaaggtattccaaatatttgtgcgataaataaactcatgaaattaagtggaattcggttagaatacatatgctataatgttagaaaattaaagatagaaatccaattttatatagtattaatttgcccatgggttgatttggtccgatctggcgaaaacaatcaccggcgaattcacttactggcgaaatcaaatacagacgccgaaaaaaaaagaaatagttcactggcgaaatcactcactggcgaaatcaatcactggcgaaatcactcactggggaaatcac

SEQ ID NO: 37770 - DNA, 1007 bp, Heterodera glycines
gatttaaagccatccatttcctgcccggttctcggcaccagcaaagcactaatagggtggtttgactcacttcaaaaaaataattccttacacaaaagttttttacaaccacttattgccaatctaatttcttgcagatttaaagccatccattgcctgccggttctcggcacagcaaagcactaatagggtgtttcactcacttcaaaaaataattccttactcaaaagttttttacaaccacatattgccaatctaatttcttgcagatttaaagccatccattgcctgccggttctcggcacagcaaagcactaatagggtgtttgattcacttcaaaaaataattccttacacaaaagttttttacaaccacttattgccaatctaatttcttgcagattgaaagccatccattgcctgccggttctcggcacagcaaagcactaatacggtgtttgactcacttcaaaaaataattcgttacccaaaagttttttacaaccacttattgccaatctaatttcttgcagatttaaagccatccattgcctgccggttctcggcacagcaaagcactaatagggtgtttgactcacttccaaaaataattcaatacccaaaagttttttacaaccacatattgccaatctaatttcttgcagatttaaagccatccattgcctgccggttctcggcacagcaaagcactaatagggtgtttgactcacttcaaaaaataattccttacacaaaagttttttacaaccacttattgccaatttaatttcttgcagatttaaagccatccattgcctgccggttctcggcacagcaaagcactaatagggtgtttgactcacttcaaaaaataattccttacacaaaagttttttacaaccacttattgccaatctaatttcttgcagagttaaagccatccattgcctgccggttctcggcactagaagacactaatagggtgtttcactcacttcaaaaaataa

SEQ ID NO: 37771 - DNA, 1125 bp, Heterodera glycines
  misc_feature (1090)..(1090): n is a, c, g, or t
taaaacgtggaaagcgggcttgataatccataaaagaaagggcggatgtgcctcggtagctcaatggtagagcttgcccatggaaagggtgcacgagtgggttcgattcccatccgaggcctaacatttgcccaattcttattattctaagagttttcttttaatctaagtgattgaaaaaaaagattcaaatgaaacttttgaaaatttattggctaatagcgaactcttagagctatcggatgatcattaatttagatgcctctgttggaaaaagttatgaagcgttaaagttgtctgttactttatgtcgtggatcattaaattttctatgataatgcaaagtgcaacagagccaattaatcatcctaattacgtgttaatgagttattaattataaattggcaattggcaccaatgagaatgggaaggtcgagcatttgtgcttggactgcgaaacgaaagccggacatcacagtgagtgaggagccgagcacaagcagaccagaacactcgttgatctgaataaagacgaaaattaattattggcgaaaaactcgatgaaacaaataaaaattcccctcattaaagaaactaaaattttacgataaaatttggcgaaatttaatcaaaaaaaaatacggaattttactaaacaaaatccacaaagttaggtatataatttttgtccggagccgtaatccagaattttttaaaaagtataaatttttggtacccattagtttcactccagaaattttttttgaaaaattgaaattttcaatctttcttataattatatagaggttttttctaataaaaatagtcagaaaaaaacatgaaaaaaaattctcatttttcgaagcttcaaaaattatgaaaaaaattctacaaaaatcactaaaaagttgtttctgtcacatcgccaaacccaccttagcactgcagtgcttaaccgactcggccgacacagtgtcgccgaagaacacgacgtccgtcttcagcacggagccggggccacatcgaggacagtgcggcacaacgaaggagtgcaggtactgttccggcacgtcgacgtcaccgtcccggnacgagttcgagctgttcggccaacgcattaccatc

SEQ ID NO: 37772 - DNA, 962 bp, Heterodera glycines
tagatattgggagggaaaaaaagttttttgtgactatttacaataaaaatttatgcagcatttctaaaaaggatgtaaaaataatttcttgcgtaatattttttacattatgttgtgaagaatttgaggctgcttctgatgcgattgaaaatttttcagcttttcttgaaaagtttttttcccagaatttatacagctttcccgacaaattgtttagataattattctagacgatttttttatatctcagtgcttaactattgcctttttgtatgataactggtagatattgggagtgaaaaaaagtttgtttgtgactatttacaataaaaatttatgcagcatttctaaaaaggatgtaaaaattatttcttgcgtaatattttttacattatgttgttgaagaatttgagtctgcttctgatgcaattggaaaatttttcagcttttctcgaaaagttttttcccagaaaacggatgggtcaaataaaaaactaaacatctcacatgaccaatttaaattcccttacattttgggtttactttattatgctggcccataaaaaaatggagtttttccggtgccaaatttttgtgaattttctttcggcccgtcataagcggattgtttgggggcaaatgaaaacaaattttgtgttattcgaatgcgctagccgagctctacattttcaaatgtatcaacaaagggtctatctccactctctggcgagttatgtccagccaaagcagagtgggccataaacacgaattttttaatctttggtatttcctctattttgagcctgctcaacatttatgtattgtgccaatatgcctattgcaactgaaatttattcaactttcccgacaaattgttgagataattattctagacgatttttttatatctcaaagctgtgtgattgcctttttgtatgataactggtagatattgggagtaa

SEQ ID NO: 37773 - DNA, 997 bp, Heterodera glycines
atcgattccttacttaatcggtaaaacgggagtgcgctcgcaagggtgtccattttggtgttaagtcgggccacccggtggcccggcgacccgcaccgatgacagtgtcaggcggggagtttgactggggcggtacatctgtcaaagcgtaacgcaggtgtcctaaggcgagctcagagaggacggaaacctctcgtagagcaaaaaggcaaatgcttacttgatcctgattttcagtacgaatacggaccgcgaaagcgtggcttatcgatccttttgaatgtgtaaagtttccagcaagaggtgtcagaaaagttaccacagggataactggcttgtggcggccaagcgtccatagcgacgtcgctttttgatccttcgatgtcggctcttcctatcattgcgaagcagaattcgccaagcgttggattgttcacccaccaatagggaacgtgagctgggtttagaccgtcgtgagacaggttagttttaccctactaaagacctgttgctatgatagtaatcctgcttagtacgagaggatccggattttaagctcgaatgttgaattttcttgtgattcacctataattttcagttaataagttgtcagttttattctttaattctataggtaaatcccgaaaacattgcaccaattgacttttctccggattttaagcccgaatgttgaattttcttgtgattcacctataattttcagttaataagttttcagttttattctttaattctataggtaaatcccgaaaacattgcaccaattgacttttctccggattttaagctcgaatgttgaattttcttgtgattcacctataattttcagttaataagatgtcagttttattctttaattctataggtaaatcccgaaaacattgcaccaattgactttactccgtattttagcccgaatgtagaattttcatgagattcacctattcttttcagttaataagttgtcagttttatt

SEQ ID NO: 37774 - DNA, 1067 bp, Heterodera glycines
ttttttacacccccatttcccaatttatttttttgcagataaaaagacatacatttcctcccgggttctcggcacagcaaaacactaatagagtgtttgtctcacttcaaaaaataattccatacacaagagttttctacacacacatatcaactatataatctctcacagatagaaacatacacatcctctcgcgtctctccgcacagcaacactaatatagtgtgtgtgtcactctacaaaatatatcactacccacaagttttttacacacacatatatccaatataatttcttgcagagataaagacatacatttcctctcggttctcggcacagcaaagcactaatagggtgtttgactcacttcaaaaaataattgcatacccaaaagttttttacaaccacatattgccaatctaatttcttgcagattgaaagccatccattgcctgccggttctcggcacagcaaagcactaatagggtgtttgactcacttcaaaaaataattccatacccaaaagttttttacaaccacatattgccaatctaatttcttgcagattgaaagccatccattgcctgccggttctcggcacagcaaagcactaatagggtgtttgactcacttcaaaaaataattccttacacaagttttttacaaccacatattgccaatttaatttcttgcagatttaaagccatccattgcctgccggttctcggcacagcaagcactaatagggtgtttgattcacttcaaaaaataattccttacacaagttttttacaaccacttattgccaatttaatttcttgcagatttaaagccatccattgcctgccggctctcggcacagcaaagcactaatagggtgtttgactcacttcaaaaaataattgcatacccaaaagttttttacaaccacatattgccaatctaatttcttgcagattgaaagccatccattgcctgccggttctcggcacagcaaagcactaatagggtgtttgactcacttcaaaaaataattccatacacaaaagttttttacaaccacatat

SEQ ID NO: 37775 - DNA, 358 bp, Heterodera glycines
atggaagtccgacttttagggtccgacatttggggatcgaacgtcatttggagatccgacacttagggaccccgacttcgagcccggtggattcaaacccgtcccgggttcccggaattccagatgtcaggaatcttatcgtgattccggaatttttccgggtccaccgggtttttacctagggtggaaaacagagtttgcataaaaatggtcaacttgtgggtttttggttaagtttgaaattttaaaatttggggccgggtcggtaaggctctcggaaaattagacaccaaacggaaacagaaaattggacaccagggttgtagcgaatcgaaaaataaaatgtcaattaaattta

SEQ ID NO: 37776 - DNA, 1236 bp, Heterodera glycines
ttttagaaatagcgtagaaaacagcttcgatatcaagaaaccaagtcaagtccagaaaggaatattttaaaacgatttcgttttgttttggcattatgataccgaataactttcggaaattatggaaacaaaattggagaaattcgaataattttttgactgcaaatttttttccttttttgaattgggttcaaaaaaattttaagagaatttttgattattaatttgaagtcttgaatttatttgacaaatccaagacttaaaactgggagaagcaaggggctgtggctgggggcctaaaatttgggccacattggagaattaattctgatttctgaaaaagtcccagaaataactattttttctttccataccttcttgtagagctcgagctgctctttccaatggtcttatcccggtctcgatccgtgccgaactcacaaagttatggagtgaaatgtgaaatattgttttcaccacaaggcattttttctgaaaaccggattcaaaaatctggggtttggtataaccgttttagaaatagcgtagaaaacagcttcgatatcaagaaaccaagtcaagtccagaaaggaatattttaaaacgatttcgttttgttttggcattatgataccgaataactttcggaaattatggaaacaaaattggagaaattcgaataattttttgactgcaaatttttttccttttttgaattgggttcaaaaaaattttaagagaatttttgattattaatttgaagtcttgaatttatttgacaaatccaagacttaaaactgggagaagcaaggggctgtggctgggggcctaaaatttgggccacattggagaattaattctgatttctgaaaaagtcccagaaataactattttttctttccataccttcttgtagagctcgagctgctctttccaatggtcttatcccggtctcgatccgtgccgaactcacaaagttatggagtgaaatgtgaaatattgttttcaccacaaggcattttttctgaaaaccggattcaaaaatctgggggtttggtacaaccgttttagaaatagcgtagaaaacagcttcgatatcaagaaaccaagtcaagtccagaaaggaatattttaaaacgatttcgttttgttttggcattatgataccgaataactttcggaaatatggaaacaaaattggagaaatcgaataatttttgactgcaaatttttttc

SEQ ID NO: 37777 - DNA, 843 bp, Heterodera glycines
agtagattagactacaaaaaattgaaaatttcgaaatcatgtctctctctcctttctcacaggggtattattttgtaaagtcttttttcccccaataaacttttaataccccatttttcgcaccgtgaatgttatttttattgaattctgaaccggtttgagtagattagagtacaaaaaatttaaaatttcgaaatcatgtttcccactcccttctcccaggggtatcattttgtaaaaagtctttttttccccaataaacttttcataccccatttttcgcaccgtgaatgttatttttattgaattctgaaccggtttgagtagcttagactacaaaaaatttaaaatttcgaaatcatgtttcccactcccttctcccaggggtattattttgtaaaaagtctttttttccccaataaacttttcataccccatttttcgcaccgtgaatgttatttttattgaattctgaaccggtttgagtagcttagagtacaaaaaattgaaaatttcgaaatcatgtttcccactcccttctcccaggggtattattttgtaaagtctttttccccccaataaacttgtcaaaccccatttttcgcaccgtgaatgttatttttattgaattctgaaccggtttgagtagattagactacaaaaaattgaaaatttcgaaatcatgtttcccactcccttctcccaggggtattattttgtaaaatcttttttcccccaataaacttttcataccccatttttcgcaccgtgaatgttatttttattgaattctgaaccggtttgagtagattagactacaaaaaattgaaaatttcgaaatca

SEQ ID NO: 37778 - DNA, 983 bp, Heterodera glycines
gctgttaaacactggacatatctcacaatcatcaccatcatcatcagcagcagcaaaagcagaggacaacaaaacgcatggaccaaaagtgataaaactagaaaattttttgaaaaatcacaattttctttgtttttttcagccgactcagcgacttcgcttggatggaaacattggcgtggctcggtcgtgcagaagtgggcatgaagctggcgctggtcaacacccggttcaacatgctggtggacaagcaattcatgctacggcagtggcgctttggcgagtttcacatctgcgagcgggaaggagcacaacgaggcggcgcagaaatcatgacatcggaagacggcaccaacttcatcacgttgccactgcccaccacgccgatgccgagcagtgtcgtcggcttccaatcactctccatttggttgaaaaaattcaatcaattttcacaatttccccccatttttgcaggttcatcaacgcggacgtcatcaaatttctgcgccggattcgccgtctgttcgccgaggacatcgcactggaattctccactcggcacacggagtttcgcagttggcaagtgattgcgcgacatgtttggccactgttacgggacgggatcagcacattggtgtgcctgaggaagtgcgatttggccatgctgcgcaaacacgtgtcgccgaccgtgctgttcgactgccctgacctgcaccaaattcgcacggatatggtgcccgagtgtccgtccgatgctgctgaaaatactgacccaacatgccgtgagctgtacacgtggattcactcgccgcgcgactatcgacaagcgccgatctccgtgaaactcatcaaatggaggcagaccaaatgggacgagtttatgaacaatttgtgcagggtgagtgagtgagtgctgcttgaattctctgggaacttccatgttttgctaccgcccttgaaaaatttaaaaattcttattttgg

SEQ ID NO: 37779 - DNA, 536 bp, Heterodera glycines
tgtggcccgaaacagaacccactaatttaccaactttttccaacctcggttcgcctaaactttgccaaaccgaaagctgtatgatcaacaaatgtgaacacgaatcggctgcaagcttgatctggtggtcattgacttgtaatggaatccaaatccattctttggtcgcaccattgatactgaacgtcgaaaccacgacgtgtgattgaacacgtggatgagctgaattgggcccataacttctctcaatttcatttttgtacaaaaattctttcttgtcctaaatttacatgccaagaggaatcgattgatgtctattttggggactaggttgtttcggcgcagtcgtttcggcgcaagggtcgtttaggcgccgccgtttcggcgcaagggtcgtttcggcaccaaaaaatgtaagccgggtccgggtccaagatttcaaccggatccgggtacccggtaaaaccgggtcttgaaaaaatccaaaaaataattatttttttcaaatcaggtaatttttttctttaaaataaaag

SEQ ID NO: 37780 - DNA, 1518 bp, Heterodera glycines
ttattggaggaaaccaagtgcatgtcggctgacgcacataccctaacagactaaaacgcgcctaggtagcgaagctcaagaagcgcgcagcgctttcccaagcgccaccctcgcatgcacacacttcagcgcggacgactgagtcccggggaccgatttctcactttttcttgcagtttagggcccctaactttttttctaaaacccgaatcaaaaagtgcccgctgagagggcactccccacaactgtcctctacatgctggtattttttatttttttattagagccaccccctggcctgcacgcttggctaattgaagtgtgctcaaaatgtacacttcagtaccaggcgaataactcgccaggggttgctttgaccgaaaaattgtttctgagcaaaaatgtgtagtatttgaaaggctatccaaccaagttttaaaatttcgaaaattttgaaaatttttcgagctaggcctaaaaaacggttttcgggtttttgaattttaggattttttaacgatttttcccagagaaacggagaccacttccaaaacatagtttttcgagctctatcgactggtatttttttcggaaaaatttcgattttttcccggaaatagaaaaaatttttggcctgagcgggacatttgagtcccgggtccataactcgtcaggggttgattttagcgaaaaattgtcttagaacatttttgtagagcattttaaatgctatcgaatggtgtactacatgatgtaaaattttcaaaaattttcgagctaggccccctagaaattttcaaaaatttttttggggtcgaaaaagggtgtgaaaaatatttttctggggtaaaataaggtgctgagtacgaatatgatgtctattttaagtttcagaattttgggaattttttaaaaattctttattttttggcaattttttggccctcgggattttggcctaatatttgaaaattcataactaacctcagggtaagtcaattttcatacaacaaagctctaaaaatagagaaaaataaggagtattttatgtgatttatttggcatttctatctttaaaagaaaaaaagttattccagaatttctggaaattttcgaattttcagaaaaaaattcgtagctgccttctgaaaagctattcgggaaaaataaaatactaaaaaaatccgcaatttttttctctataatataaattttattttaaatttttatcacatttttaaaaaaagatataaaaataaaagtgattttgtgattcgggtccaaagggggtgcacatggtttttgagtggaaaaattttttcacccaaaatcttccaaaaacatgtcattaggggttatttgggccgctgatcacgaatacgtgatcagattttacttttgacattgttaagccctcagaatccccgtgtgattggggattctgaggcatcatttgaggggggagggggggggaagttcgaatccgggcggtaacacattatttttctaagtattttt

SEQ ID NO: 37781 - DNA, 842 bp, Heterodera glycines
atcacttttgtaccacttcatccatttgtacctcttctaatctctgttgtacctcttctgatcactgttgtacctcttttaatcacagttgtacctcttctaatcactgttgtacctcttctaatcactgttgtacctcttccatttacttttgtacctcttctgatcactgttgtacctcttctaatcactgttgtacctctctaataactgttgtacctcttctaatcactgttgtacctcttctaatcactgttgtacctcttctaatcacagttttacctcttctaatcactgttgtacctcttctaacaattttgtacctcttctaatgactgttgtaccacttctaatcactgttgtacctcttctaatcacttttctaatcgctgttgtacctcaaaatttaaaaaacgggcgcgaaacgcccgtatgagttcaacgaatttaaaaaacgggcgcgaagcgcccgttcaaggctaacaaaaattgaaaaaccgggcgaagcgcccgactgaggccgcgaagcggcctaacaagctaaaaaactggcgcaaagcgcccgtatgagttcaacggatttaaaaaacgggcgcgaagcgcccgttcaaggccaacaaaaattgaaaaaccggcgcaaagcgcccgactgaggccgctaagcggccttaatagcccaacaaatttataaacgggcgcgaagcgcccgtctgaggccgcgaagcggccttaatagcccaacaaatttataaacgggcgcgaagcgcccgtctgaggtctcgaagctgcgttaatagcccaacaattgagaaacgggcgcgaagcgcccgtataagcccaac

SEQ ID NO: 37782 - DNA, 1061 bp, Heterodera glycines
  misc_feature (1051)..(1051): n is a, c, g, or t
ttgctcattttttggcatttacagtgcccaaaacagcctaattgggaaccatgtgtgccgaaagagatcgctaatcaagttggaaaaaggctttatttttaaattttttgtttttcaaaatagacatatttaaagaaacatataggtagttttaagtgaaattattcggcttttgcttttaacttcaaaatttaattttcatgctttatttaaatatttttaagcaaatggccgtttttcaaatattttaattaacctatttatgttttttttgtaatgttcgaaatgttattaaaatttttgctagctctttaaaattctaacgaaaataaaattcactaaattagatgaccgtatttactgaaaccaagccccctgggctttatttctcaaccccatcaggggagggcggctttagttcaaatatggtaattacaaaagcgtctttttctaagcgatttcgtaattgttgtgcccgactcggcgacgggtgccaacaactgtgcagctatgatcagaacttgggcacggtaaattttttgttaattaggattagcgtaaaatattatcccatattttgattttaaaatttttatctattcttgaaaatctataaaatctcttaccattttcattttgcctttttcagatacaattggccgtgctgaccggaagtaagaaaaacaaagcgtatacagtatccactgacactaatccaacccccctccctcctactgtaagggtgtccggtgagtcgcgtcggtgaaatgatggtgagaaaatgaggcaaaaatgaacaaattatgaccaagtttaaatttaggtatgcgctagtggaaatgaggtaaaaaaaagggggaccaattaaaaaaatcacttctgaaaaagtaaaaaattaacggaaacaaaacattgtttagtgattttttaaattgttatttttagcgctaattggcataatgacttttttatacccgcctctttttcgcatgaaattgaaaaaagattttcaattttttcaggacgccaccgcctgttgccaagcatttgncgtttttgag

SEQ ID NO: 37783 - DNA, 69 bp, Heterodera glycines
tgaggccaaaaagattgacccggaaattacgacccgatgaggttaataaattcctagaaaagcagaaaa

SEQ ID NO: 37784 - DNA, 316 bp, Heterodera glycines
ctctcatcaggggaattgggtctgccctatcaattgcccgaaattgtgagtgtgcgcctcagtagctaaatggtagtttctcaagtaatgggtggacgacgagtgggttcgcttcccacccgaggcctaacattttgcctatttctcattatagtaaactccaccaactaattattatgatatagtaaattcaccatcgcctacaaatgcaatttgcagcttctactcaaaaaataggcgtataaaacggagaaaaacctcaaacttggattaaaaataatttttcgataattgttttcatcaaaatagataagaa

SEQ ID NO: 37785 - DNA, 931 bp, Heterodera glycines
gccaatttttcatttaatattgccacaaaaaaattaccctttgaaactaagttgcgcctccgctgcgatgagtgcagtttggagaacaaatgccaacaaagcatcagccattttgaatattctattattgattgcttttttagttgggcttggagaattatttgaggctcaatcatctattattttccgaaaaaaacctagggaatttcccgttctttatttttcgcaataaaaaccaactgtgtcaattttttacttactttagccccaaaaacttactgctcaagttaagatgtacgcctgacaaaaccacgggttgatcatgggtgccactacagccttgattaaaacttggatgaaaatttgttggatggaagacattttgacatactgtattacttaattagaggagcccaccctgaattagaacacctccccctgaaataaagtcccaattccgaggtgggttgtgaaatagactcccgggggcttgaagtcagtaaatatgagatgttagtttggctttgatgattttggttttgttttttgagatttgaaacagatgattttctggggccatcaacggctatttatgcagctcattttggtcggagtttcggctaaaagccgaccgatccgtcgatggtcgcccgtccgcttcgggggccccgccccaatttcccagcgacttgttcgccgtttttaaacagaaattggctttttgaattccattaatgatgaatcacttttttgcccattttgccctttcccaactgatgctcaattctgtccaattcgcccacataagcacagattagcatcggaattttctgattttcccgttgagtggcggtgattcatcaattttttgcccatttgtaaataatttatcaactaaaacagtgatcagaaaaataatttctctgctgat

SEQ ID NO: 37786 - DNA, 681 bp, Heterodera glycines
tggtgggttgagtcccagtgattgaaatgctggtgggttgagtcccagtgattgaaatgctggtgggttgagtcccagtgattgaaatgttggtgggttgagtcccagtgattgaaatgctgttgggttgagtcccatgggttgagtgattgaaatgctgttgggttgagtcccagtgattgaaatgttggtgggttgagtcccagtgattgaaatgctggtgggttgagtcccagtgattgaaatgtgtgttgggttgagtcccagtgattgaaatgctggtgggttgagtcccagtgattgaaatgctgatgggttgagtcccagtgattgaaatgctggtgggttgagtcccagtgattgaaatgctggtgggttgagtcccagtgattgaaatgctggtgggttgagtcccagtgattgaaatgttggtgggttgagtcccagtgattgaaatgctgttgggttgagtcccaatgattgaaatgctggtgggttgagtcccagtgattgaaatgctggtgggttgagtcccagtgattgaaatgctggtgggttgagtcccagtgattgaaatgctggtgggttgagtcccagtgattggaatgctggtgggttgagtcccgagtgattgcaataatggtgggttgagtccccagtgattgaaatgctggtgggttg

SEQ ID NO: 37787 - DNA, 798 bp, Heterodera glycines
agagttgcggaaattgtgaattaattctcagaaaaaatggctatctctttttaggacaattttctatctcgtaacccccgatgctaatccgttccacagagactcttcaaaatttttccattaccgcaagagctgcggaaattgtgaattaattctcagaaaaatggctatctctttttaggacaattttctatctcgtaaccccgatgctaatccgttccgcagagcctcttcaaaattttttccattaccccaagagttgcggaaattgtgaattaattctcagaaaaatggctatctctttttaggacaattttctatctcgtaaccccgatgctaatccgttccgcagagcctcttcaaaattttttccattaccgcaagagttgcggaaattgtgaattaattctcagaaaaatgctatctctttttaggacaattttctatctcgtaaccccgatgctaatccgttccgcagagcctcttcaaaattttttccattaccgcaagagctgcggaaattgtgaattaattctcagaaaaatggctatctctttttaggacaattttctatctcgtaaccccgatgctaatccgttccgcagagcctcttcaaaattttttccattaccgcaagagttgcggaaattgtgaattaattctcagaaaaatggctatctctttttaggacaattttctatctcgtaaccccgatgctaatccggtccgcagagactcttcaaaatttttttcctttaccccagaagtgcggaaaatgtgaattaattttctgaaaaa

SEQ ID NO: 37788 - DNA, 1101 bp, Heterodera glycines
ccaaacaaaagttgtgctgctctgcaaaagaagacttagccaactgtaaacagcaagccatccaaatgcttcaatgtaaaaaaaattacatttggatgcaacctttatttttcctcgcctctcttttcgaaaagaaaagctattagcaagcgtgtttggaccaattctaaaacaaatcggggtaattaatttaatctgactttataagataaatgggaatttaagcgaaggattcatgcagaataataatctatagaaattatcaaaaaagtagttcctcgcagattcggggaccgtttctataaagctagagacatatgcgctaaccataaaaaagatgaatcattttttgaaaaatttatatagttcgactaaatttgaaaatcgatttatggtgtacaggatgtttgtcgaaacataactcttcaggcctttaagatagacctgccattgctattcctgcaaatattgagtctagtcagcccaatcgattgctattcgaatggtttggggtcgttggcccaaacaaaagttgtgctgcttcttgcaaagaagacttagccaactgtaaacagcaagccatccaaatgcttcaatgtaaaaaaaaattacatttggatgcaacctttatttttcctcgcctctcttttcgaaaagaaaagctattagcaagcgtgtttggaccaattctaaaacaaatcggagtaattaatttaatctgactttataagataaatgggaatttaagcgaaggattcatgcaaaataataatctatagaaattctcaaaaaagtagttcatcgcagattcggggaccgtttctataaagctagagacatatgcgctaaccataaaaaagatgaatcattttttgaaaaatttatatagttcgactaaatttgcaaatcgatttatggtgtacaggatgtttgtcgaaacataactcgtcaggcctttaagatagacctgccattgctattcctgcaaatatgcagtctagtcagcccaatcgattgctattcgaatggtttggggtcgttggcccaaacaaaagttgtgatgcttcttgcaaagaagaattagccaactgtaaacagcaa

SEQ ID NO: 37789 - DNA, 804 bp, Heterodera glycines
  misc_feature (49)..(49): n is a, c, g, or t
tcagcaatttggccgttccgatgacaccgctcccttttgctgagtcggnccaccgcacgccgaagcagcaccaccagccgcactccgccgcggcacagccgcccccgtctaacatgccagcgtttgtgccagcaacgcctttctcaaacgcatccgtggaaatcccatcgccgacgctgcaaaatattgtgtcgactgtcaatttgggtgattttccgtgctgtacaacaacaaaaatgccttctttcactttaggcgttcaattggacctcaaacaaatcgccctcagagcgcgtaatgccgaatacaacccaaagtcggcgtttggcggtgtttaattaccgatcccctttttaaggcgttttgcagctgttattatgcgtattagggaaccaagaacaacggcactgattttctcttctggcaagatggtgtgcaccggggcaaagtaagtgccaaagtttaatttattaacacgtaaattgcttgcttgccgccgcttatcattccgatcaaaattaagatccgaagagacgagtcgactggcggctcggaaatatgcacgaattgtgcaaaaaattggattcaatgccaagttcacggagttcaaagtgcagaacatggtcggctcttgcgatgtaaaatttcccatccaattggaaggtacggattgggcaaagcgacgtttaaattgttttgattgactaattaaatctaaatttcaggcctttgcataacgcatgcccaattcagcacttatgagccggaactgttccccgggttaatctatcggatggtcaaggt

SEQ ID NO: 37790 - DNA, 900 bp, Heterodera glycines
aaaaaagagatagccatttttctgggatagagtataaatttaaaaatccctcaaaaataaaaggtctattgcgcaccgccctcccctatcatgctcgagagcatttgtatgtgtataaaatttatcaaaaaaagagatagccatttttctgggatagagtataaatttaaaaattccctcaaaaataaaaggtctattgcgcaccgccctccctatcatgctcgagagcatttgtatgtgtataaaatttatcaaaaaaagagatagacatttttctgggatagagtataaatttaaaaattccctcaaaaataaaaggtctattgcgcaccgccctccctatcatgctcgagagcatttgtatgtgtataaaatttatcaaaaaaagagatagccatttttctgggataacctctaaatataaaaatcctctgtgaaataaaatggcgattgtgcacagccctccgtctcatacgcaagcgcttttgtgaggtataaaatttctcaaaaaaagagatagccatttttctgggatagagtataaatttaaaaattccctcaaaaataaaaggtctattgcgcaccgccctccctatcatgctcgagagcatttgtatgtgtataaaatttatcaaaaaaagagatagccatttttctgggataacctctaaatataaaaatcctctgtgaaataaaatggcgattgtgcacagccctccgtctcatacgcaagcgcttttgtgaggtataaaatttctcaaaaaaagagatagccatttttctgggatagagtataaatttaaaaattccctcaaaaataaaaggtctattgcgcaccgccctccctatcatgctcgagaaacgtttgtatgtgtataaaatttatcaaaaaaagagata

SEQ ID NO: 37791 - DNA, 1070 bp, Heterodera glycines
caggtcgcctcgtttcaatggaccatttccgcgacccgcacaaaggcaaccaattgcattactacgcaagttttgggtcctttatgaaataaaattccctaaaaagtgtttaccaattctcttttttggcattttcttccatttcggcacttctttttggattttgcccccccccccccccctttaggccataatgcatcgtttttcgggctccgtttttcttaagcccgagccgatgagtttttcagagcttctgaaaactgcgcagttaagccaatgggaagggggagagaataactgggaattgcaaatattctcaaagagagaacgaagaggtggacatggcattgacacagctttgcgggcacgacgaatacggggacggccgagttcagttcagcacttactgggaaagagtgcccggggccgactcaagggtactgtagtagcatacggtagaccaaattccaacggacatttgattaaaaggagtgaatattccttgttggaattgcattccattcaaattgctgcagatttggttcgctggttcccccgaatcggacgtgcaaaaatcactgttcgaaaaagacggtttccgactgatcagtctgtgcgggtacagtataagaaaggtgagcgacagaaacagtatgaaaacatgggacgaaaagaaaaataatcagccgaacagattaccaattcaaacaatttttgtatttgatcagaaaactgcgcgatttgttggcgtctggcaaaagccggcactgcgcacggttccgtacgaaggtaaaaattgaaaattatgagaatttaaaaacgtaaaaaaataagcggaatatttggtgagctttctttcgtcccattagttagctcattttgttccattaattagctcattacggcgtcacactttccgaatgcattgagttgaatgacagactcgcggcaaggcgagagaacaaagaaagtgttcgtcaattaacgaatgcttcagagatttcgtcgcggtgcaattccgcgtctttcgcaaaaggacgaagtaagcggcgaatcggtgccaccggcgt

SEQ ID NO: 37792 - DNA, 1764 bp, Heterodera glycines
ctgtcttggggcacaacggttaattgtgaatttgccacaaaataaataataatttccaaaaaaataattctgacagttaaagttccccacacttttacataatttaaaacaatgctttttcagctctttccaaaattggtggcgatgagttggctgacagtgtgcaaatgcgtcttcttcgtgatgaaaatgcgcgtcttctctcagcgctcggcagtgttaaggcggacaaagccgtgctgaagaaacagttggaccaactgcagcagaacgacgcattggcggagcaccaacagaccaatgttttgaagcaggtatttattggcacaagacgaattttaaacactaatttttctcaattcgcttttctctcattaattgaaaaaattttaagaaattcgaagccgtaattaacgaatgacagaaaattaaagatttttttgaataatcgacaaagcctccattcctggtttttacatttttttcaatcaaaaattcatagtttggtttttcagataaattattaaccgattacaacaaaaattgtcggaacaggtcgttctcccctgcgtcgtttcccccttaaaattaaaaaaaagtttggcaaattttctaaaaatcgttgaaaactttttcgaaatttttttaaattttccgatggggaaacgacagagggggttgaatgaactgcacctaaaaaagccttcaatggttaaatgtttttttttcagtcgaaactctcaccgacgagaacggaaaagtcgcagcaacggcatgtgttcactttgcacgacaacaacaacggattcactgggtgcacgtcggcgcacaaccaacaacataaatcaccgcaaaacatcagcaacagaaacagccgccgctgttccccccgctgcccacacaaccggcactgtcctcctccccctcctcgtgttcatcaccagcatcatcatcatccgccgcactgtcatcatcgcccgcaattcctccatcgtcttcgtcgttgtcccatgtatcgtcttcgtcttcctcattttccacaattccgccacgtccgcccgccatccgcgcgtccgccagctttccgctccatctcggctcttccccctcctcgcctcctgtttcattgtccttccatcaacaccaccattcgtcctcccctccatcggccagtggtgctgttgttgttgttggcggtggtgttgacaacaagaaacggcccaccaccgcgccggagggcagcagcagcaaccgaaggacggtggtggcaaacaacgggggacgaacaacgatgctcggggcaaaaggcattagcagcagtaacagccaacggcacatgaacatgagccaattcccggtgagttttgtccgcagaatggttaaagcgggtgccgatgcacttcatttcgaaagcaggacaaaacgtcgccacaaaaaaataataaaaaatttttaatttcatgaaaagttttaagaagaattgtttaagattttttacaaacctggaaacaaaatttgctagacttcccaaaaaaaaatatataaaccaaatttttttttgtttcttgaatttcttagttaaattttttcgaactaggctaaaaaattttacataggtcactaaaatttttgatatttttctaaaaaaattttctaattaaaagaaaattgcggtgactttatgtcccggcgatgttttggggtgtacccctttatttcccccttatcgtcgcctttgaatgattgggtttgatcactcacttt

SEQ ID NO: 37793 - DNA, 941 bp, Heterodera glycines
  misc_feature (900)..(900): n is a, c, g, or t
cgccacggttcagcacaaagtgttggagttctgaaattagtattcaaaactgttccatgggaacgccaaaacgccattttcagaaatctgattgtgagtggtttataaatttataaaaataaatgttacaatacctgtagccataaaaaaatttttttttggaggggtgaattcaaagacctttttttcttaggccaaaaattaagaaaaacagaaaattgtagcgccaaaaatgactaatttttgccattttgggatttgacaactaatccggcattgtgtcaactttgtttaaaaaagtatagaaaattaaaaatgaggttgaaaatagggaatattaatttggtgtccactattacctttttgcaagaagtcacgccacacgccctccaccacttcggcatcgtaacggccggcacagtgcagcacactcagcttcacctcctccagtccgtacgcgttcgccacccggtacaggtcggtcagtgagcacagctggaagctgagcgtgtccagcacctcacgaccacggggtgtcatctccacatcaatgccggcgtccgactcgagcagcgctctgaaatgagaatttatgcatccgtatttactgtgaaataaacccagctgggggcctcgaaccggagtttttcaaaaaaatcgtaaccaataaaaaaagctttaaagatgaagtgctacattttccagaaaatagctgaaaattttgaaatttttaaagtttttttggttcccagaaattttgtccaaaaagggggcagttagggaatgactcacttggtcctcagttgaatttgtgcaacgtcaagtttgtcctggacagcctgacgtaattcggtgtttgcgcgtgtttcgggtgccgattggacacacatcaaagcgtgngacaggtggtcaatacgtttggtgatgttcaatcgacttaa

SEQ ID NO: 37794 - DNA, 1262 bp, Heterodera glycines
  misc_feature (1227)..(1227): n is a, c, g, or t
attttttatctctgttttttctttgatttcatatttgtccgaaagtttgtaacgttccaacagccacgcaaatgaacagtcgaattttttgccaagaattgaacaagattcattcatcttcagggtgtaaaccatctaaaaagcggagattttattgaaacaattgaaaaagaaaaataataaaaaaatgcattcgtcgattaaaacggaaattctcaaaaaatcggtcatttttaattgattttgccgaatttcaagtgtcatttacgttttcaccgcaacattcatcattgtccaattgtgctccgttcaatctgtggaatcattaaaatttaatataatatattaaatttgtttcaaattacgtgtgggaggaaaagcaatggccattagcgaagttaaagagaagggcaaaaatgagaaaattaataataattaaaaaatgatgcataacaaacttaaaataacagaataattagttaattaatataataaaaaaataaaatttactaaaagtgatttatgcatattttccttttttataaacattcgttatttatgttaattaattaaagatgaattacaaatgatttttctttaaatagagaaagaactatgtttgtcatcaattgtttgttcattaattaaaaaatttaaacgatttcaaagcgatgaataagcaaagaaaaagaaaaagaaagaaatatgtttatttattttttacaaagagacgacaaaaaagatgaataagcacaaaaaatagaaaatttaaatgaaaaatttaaagaaaatgctaagaatgaatgtgactcaaaatagcagaaaacaaaaaatcattccattttaaaaataatgtgtaaataaaaaattattaggaaaaatggttgaatttcttaacctaattaaaaagattatcacatgcctatgggcattcgccaggattttcggcaattatttcggcacttattttcgacattaattaaaattctcccggataaaaaataaaagtaaaaaaattaaaagatttatgacaagatcaatttccattcttgaattaatcgagagtcattgtgccgtcgatcagtttaatcggaacccattcaggcaaaaaatgttgtcgatgatgaagagctaaattgaaaagcaaataaaacattcattgcattatattatatattcacactttttaatgaagaaaaaatacaattttttaaagcccatggccanaaactttggcaaatttggttaaaataattttaaat

SEQ ID NO: 37795 - DNA, 936 bp, Heterodera glycines
ccaccaccttaaagctgcactgagatacgatgtgcccgttgcgcgatagtccgcgggtcctttcgtaaaaatgtggccggaaagcggcgcttcgcccttcgctttgaactctttgatcagcttcgtctcccatggctgtggcctgataatggaagcatttaaacaaattttattgtgttaattatttttgtgaaattaaaaataaaattaaatttacggtgttggtaaatattttccttctggtctacggtaccttaaaattggacgtattttgtcaataaaataaaaataatttctaaaatcatttacatgtcgacggaatgttgcaagtcaaagtcaaaatagtccttgtccaatctgttgggtcggctgtaatacggtcgtggcatatatggctaaaaataattagaaaccaatttaaaacacaaattattttttaataaaaataacacttttctcaccataagctcatcatcggccgccaattcgtctgtaatttttggcgcttcacgaaactctttccgcgtaaatgttttcatgtgctcgggaagaatggacgtctttaaaaggcgtgcttaatcacaatggaatggcataattaacactcattaaatgctatataaatcattaattaatttggacctctgatttttcttagttggccccacaaaatcacagaaaaattcagtacggaaattgcgcatcgcaaaatagaacagaatttttgggtcataaatccttttttgtttgactaaattcaacaaacatatggcattccctgaaattttcaacacaccactcacccgttacgtcgtcgaccattttggtgtagcgattcatttcgggccgctcaatgccctgcgacctgtcgacatgcggcgcgcaatacgggcctgaatttaaaaaatcttatttataaaatctattgaaattttt

SEQ ID NO: 37796 - DNA, 1386 bp, Heterodera glycines
aataccgtatatactctttttatatgccatggtatattatttttcaacctcttcagaaaggggtatataattggaggccggcagattaatggagactgggagattatttttcagctgatttatttagtggaaaatttttgaaatttttttgaacatgtcgccaaaaatgtcatcgcgtcaaaaaaaaaagatttctattgcatttctgttaaacaacttctgagaattgaccccaaaatggcaaaaatgtgtcattttcttgcttccaatatggataaaaattgaaatttttaatggtgaaagatggacgaaacgatcacgaagaagccttttttatttttgttcacagattttgttcgtaaaatgagtcaaaaaattagagccataaaaaattggtctcgagtctcgggaaattttcggtctcgatagtgaaaatttactatttcgacatttttagaaattccttaacaaaaatgcaataaaatcaaaaaatacacccctaagaaacgacctaaacattttggtaatactttggcttgttcgacccatttcgaacccggacccaaattcgaacaaaaatcgaaaatttatttttcaccaaaattcacactgcagcgactcgtggtcacaaaagacgttcaaaatgaaagagcgatggacaacggccaatagattttgaatggagaatcgcacgactgccaacgaacgaccatttcgtgcatttaaaaaaagagtatatacggtatgcgaaagttctagtaaattttctgacagcttaccgtatgtagaacaaatttttttttattgtattttaaacatgacaaaaagtccgaaaaatgattttttatttttttgaccataaattttaaaataggaaaattcttcaaattttatagtagaatgttttcattcatcttgagctttcacaattatataaagaatgtttgtgattggtttttcaatgaaaagttaggaagcgttagtgttcccaaactgatcgacctcatccgtcgacagtgtccaccagcgatggcatttcgaggcccaaattttttgaaattcctaaatctgtaattccgacccctaaaatgtaggaaaatcggaattccatgccgtccctggtgtccaccctttttggctatttctgtttttctttccatgtgcgcctcttttaccacgacattattgtcattctttccacatttttcaattggttttttaattactttttcgactgatgtgtgagaatgagcaaagtgataggataggggggatttgatcagcagagtgattggaaaataggttatcaggatgagcggagagagatgatcagatcggatagacgatagagggtgaaagccttttccattttgtgcagcaccgttt

SEQ ID NO: 37797 - DNA, 825 bp, Heterodera glycines
  misc_feature (25)..(25): n is a, c, g, or t
ccaacaccaaaaacctatctaaatntggagcttatttacatttaaaggcataaattcgtaagccggcccggaattggggccaaaaagcgacaaatagcagcaatttatggaaaaaaaaattgagaggccaaaaacctgtcgatgaaggtcaaaagcgataaattcaattgaaatttggagccgaaaaagacaatccctggaaatttttaaaattttagtttggctcacggatgaaattcaaaattcaaaatttggttgctttcgacaaaaggatttgatttaatttttgtttttttctgacacttggtggaattcacgaagttacctaacttgaaataattattttttaattaaatataaatattttttcccaaattttaattatttaaaatgtgatttccagactcgcagttttgaggagcgacccagcgcctctcagccgagaatggcctggcggcatgcgcgaagcaaccaatttgttgccgacgaatgggctgagatggggcagcagccgtacagtaattacccacagaacattggcattcgaactgctgggatacggtaaagcgtttttcgttaccctaagtttggcttgagagtcggaaactctgccgcccagcagcagaatgggttttttcggaatgccaaatcgaattccacccaatcagtgaatttattaataattatgaaatatgcgaccggccaggaccctgcggggaggaggagagagagagggggatttgtcttggccaatccctctacaggagctgggcgtggacagaaaaatgccgcggtcgcgcatcgcggactcaaattgccgcggtt

SEQ ID NO: 37798 - DNA, 1002 bp, Heterodera glycines
  misc_feature (873)..(873): n is a, c, g, or t
agctcagttggttagagcacggcacggattgctgggcttttgggttcgagtcccaccgggcgagttacctttaatgttctacaaggcgcccctggggaatcccctccacagtgtcgggaccactggaccaaggagaggtccaagtccgtcggtgaaaggccaaggagatcccgagggaacggtcttccgagagaggcggaatgtgatgccagaaggaacggagtgtgggaaggagaaagtgggataacggagatgggaaagcttccgaatttgaacaggaggcattactcacaagtgccgacgtgtgcgtaataattttctaatttttgtctcagtttttattttgtgttttcttcgcaataatcccttttcctttagcttttctttaattgcatcaaatttatgaataatttcacttttttgttgatcatttgggtcagtccccatttcatcaaccatttgataaactgatgctaagttatcgttttgctctttttggccaatttgttcagtttttattaatttttttttctctttcatttttgtcccattcgttgccaaatatttcatcaaattttgtcgaattttgccggattcaattttagaagcaaaaaatatataaaaaatattaaataaaataaattcatttttgatattcgaaaatatatttaatgaaaaggacttttatgtgtatttattggaaatcaaatttcgtagtttgtgccaattattaaaattgaaagcaaataaatttatatatatttcccatctgttgccaaatattttctattaatttggtcgaattttgcctgattcaaattttaaaggaattaaaatattaaataccacaaaacacattttacaataaattanaaataaaatgagaatttatttgaatgaatttgctcatatttttaagttcaattatttaaatatttagctgaaaagctaaatgacatagaatttaaacaaatttaatttgatgaaacaacaaaaaaaatt

SEQ ID NO: 37799 - DNA, 798 bp, Heterodera glycines
  misc_feature (619)..(619): n is a, c, g, or t
  misc_feature (656)..(656): n is a, c, g, or t
  misc_feature (698)..(698): n is a, c, g, or t
cactcaaaagggcaagcaccaaatggaggggggggggcgtggagcgtataggctttgggtccatggcgatcggttcccattggtcagaatcggttgcagcaatccaatccgcagcaaaactgggcatacttttggcatctgtgttccgttcaatatccattctttttgcaaatctcttgtcaaattgcacacaactactcactggtaaacaatgtccagcaccggttcgtccgcattctcttcgtattccaatccgtcccgctcttcctccctcattcgataggcgcatgtttcgcgagtgtcaagaaaaaagttgttgtccaaagcgtaatatctcgtcccgaaccaataactccgtctgtagcgtgacagaaacacgcggtcgttgaacattttgatgcgtctcacggcgtacccttccaaaagtccgaccttcatcaacttgagcactgttgcgacggtttcgttgcttcctttggtcgcataacttccggtcaaacttctgttatccagagaacattttatcagggcaaagtcttacgtaaatagaaaaagagaaatgccttgtcattcccgggtcgtaccaattacacaaaatgcacagaatacagaatgacangccaacaatgacaaaaggttgacggattatggattgngccattgtccacaaaatgcaattatattacgattgcttaaantggataaacattcagagattgggggtcacacaattaagcaatgatggggtgggaggccattggttaaagcaaagaatgatggtgcggagggggggggggg

SEQ ID NO: 37800 - DNA, 892 bp, Heterodera glycines
gttgaggttcctttcttcggattgcttttttatctccttttttgaagatcattcggtccgagcctatcttcggcttcatccctaggattcgcttcagtgacaagggttcctacgtcgaatcggccaccaaagactacgaccatgtgagtcctccttttcaattatttactcctttttctcgcttaagatggccttcaaatatttgtcatgggcactctttccgcttttgggcagttacgccgtctattcgctggtgtacgatgagcagaagggctggtacagctgggttctgtgagtttgtcggcgcattttccctttgtcattatttccttcttcaagtggcatgttgtacggctttctgttgacattcggctttattatggtacggatattcaaaattcccattcaattagcaaaaacgccgttcagatgactccgcaattgttcatcaattacaaattgaaatcggtggcccatttgccgtggcgaatgctcacttataaattcatcaacacttttattgtgaggccactcaaacgatactcatttagtcccctcttctattaaaaggatgacctcttcgcctttgtcattcgaatgcccacactttaccggctcggctgttttcgcgacgacatcattttcctggtccattaaatggctttgtagtgcgatatttgggaacctgcatgcgcagattgaccgtcataaaatttaaaatatctaaatctgcaaaaatctgtccgcaaacttttttcagtactcgaaaccccttttttaagatttacatttaccaacgatggatttaccgagtggacccgaaacgtgtcaacgaattcggcaccactggcgatgatcagacgggcacggaggaatttcgggcatcgaggcg

SEQ ID NO: 37801 - DNA, 1333 bp, Heterodera glycines
atatttggcattctgtcctttaaaatttcaaaaaaattcaatgaaagtccccgcagaatccatcacaaaaaaatcaattttgcgggtcccgctgcgggattcgagccaaaattttgcaggacgagttccctcatgtaaatcccgcaattccgcaaatcccgaattttccaaaaatgcggtttgcgggttgggaccccgcaaaatcccgcgcaggatcccgttccgctccgccaaaattacatatgcatttacttcggggaatatctaaattaaaaaatgtcattttttatgtttatccgatgatagtttcactgcactgaactaagcatctgttatacagagaattgcaacttttaaaattaaaatatcattagaaaaggatccaaaatgctaaagtcttcaataataaataattttattcattgttcaatttgtcaaaatgcacgatgcttttgtccctagtgatgggcagaaaatggatttaattattataattttagttgaccaagaaaaagcaaaaaccaaaaaggaggattaaggaagtgaagaaggaataaggaaggggagaaggatgaagaggaggagaaggataataaagaagaaagattaattaggtcaattctctttaaaattaatttgttttcttggcatttctctacagtcttgtgattttaatgatttttattatgaagaagtataaattggcatgcaactaatcaacttgagaagcgcgcaaaaaaacttacaaaaaggatgaagctgcgagcgacagcgatttattgggggtctaatagattctttgcttccaactagacaatttctaaggttttcagtcactctcattctctcttgttctcaaattacaaattacggtttttggtgttttggttttggtattaatcacgattttttgtcatttctttgtctccattctcgggagcaattcttgctcttaatcccgatagaaatcatttctcaaatttcaatgaatattacaaatttgtatgcattttacaaaaaccaatactctattttaattaaaaaaatttataaaaaggaataataattataatttatttttacattgaaaaaaattggttgaacattgccaagtatggggcggagaggagtccccgggaaaaattaatgagagaacggtgtgacgatgggaatgatgctggcggtcggcgtgggctcggcgttcgaattcgatgtagcacgagtggacaaacggtcaaagcggtgatggagcgagggttgtcgccttccctcctcctcggaggaggagtctttaaagggactgcggctgcgcgtggcagaaaaagaggctctg

SEQ ID NO: 37802 - DNA, 1058 bp, Heterodera glycines
  misc_feature (40)..(40): n is a, c, g, or t
  misc_feature (145)..(146): n is a, c, g, or t
catcactcatcgacccaaccgccagatcaccatgctagcntcatccccttttctccaacccgccaacggatgcccgatttcaccccgaagctgaccactcttctcgaagcgtcgtttgggcggaggatggtggctccatcccganngggacgccgattggctgagagttttctgcgagaaaattggcttcgccactccatccaatggccaactcgtcaattgggaccgcttggactccgtcccggcccaagaacgtcgcgttcagccgcacttgtccgtcgctgaccattggagaacggtccgagaaactcctctccatcgtcctgagctcccggcggtgattcaagaacgaggagtgagaggaacgtccaggcgaagcattgctagacggcgccgcaccggaataccgacgtggctccgaggggctccccattttgatttcttccccttagaggctttggaggtggaacccccggacccgatctaccgggccccccactctcgcaccccctcggattacccatcttcggatgaggacgatcgaccaattcaactccaccgccgattcgaacgactcgccatatcttcacaggccaattggaacccgccgcaaaccatcgctccgccatcgccaacctcaggatggtcagaggcggagtcgccctcgggaggaaatggcagagagagaattgaaaattcggatccgagagcggtcccggtggtgaacaacccgtcgcatttcgtcttccagccctccccttcccacctcttcctttgcgggaccccccttcacccaatgttcgtccctgtgacttatgtgtttcccgcctctattgctccaattcattcatcaacgagaatggccgccggggatggacttcgggccctcccccctagactcgcgcgggatgaaacgcaaaccggtgcctcccctgcgcctaccacctctgccagtgtgaccgccgctcccccctcgaattccccccacccgtctcattatcgctcgtcatcggccccacgttttcagattaaaacggatatgaataagcgggccttag

SEQ ID NO: 37803 - DNA, 787 bp, Heterodera glycines
ccccccccccctttgttcgtcgtaagggggcggctgtaaaaaagggagggggtcgtcgtggaggttggtcgtaacgaaggggaaaattttaaaatttgcatgcgaaatcaataccaaaataaaaaaattttcccggcggcgcatatcggcaccgccggaccgaccgcccgccacccccttccccccaaaaaaggtcgttgctggagaaaaatttggaccttcgtatgaaaaatcggttccgaaacacaacagaaagacgaaaaactgacaagccaacggagcgaaaatcgctgtccgccccctccaccgaacacaacttgaaggttcttccaggaggaactcctcgaagagtgcagtgactcctcgtcgtccgtcctcttcccataatggtgctcttcttgtagtgcctcttaaaaatattttaaagagtaagagactgattagaggattgttgactttagttttgttccatatataatatgcaattttaagataaaaattgggggggctaccatccaaactatgaccataaaaaatattgtaattttaaaagttttgtgaattttccacataatggacaatagtaaaaatattaataacaaagggaatggcaaaacaatttatttttatgaacgaaccgaaatgaattcatggttattattattttttttgtttttatcgtaataaatcaaagagtaaaattaccgattccagtttgatcggtgcaaattgaggatatttgcgtgccgaacataaccgctgtgaatatttgaaacaaaactgcctc

SEQ ID NO: 37804 - DNA, 618 bp, Heterodera glycines
gaaggggaagaggaacagaataggaagagcaataaaaggtgaagagtatgaggaagaggaaaaggaagagaaggcgaagaggaagaagaagagaaaggggaagaggatcaggaggagaagtgaacagatggcgaagaggaagaagaagagaaaggggaagaggatcaggaggagaagaggaacaaaaggtaaagagaaagagaacaggaggtgaatagaaggtaaaaagaggaaggggcagagaagaggaacaggaggagaagagggaaagaaaagggaagagaaagggggagaggaacaggagggaggagaagagaaacagaagacgaagaggaatagaaggcgaagaggaagagaaaggggacgacggacaggataagaagaggaagagaattgaagagaagcagaagtggaacaaaaggcaaagagaaaaagaacatgaggggggtagaagggaaaaagaggaaggggaagagaagatgaacagaagaggaagagaaaggggaagagaaagggggagaggaacagaaggagaagacagaagacgaagaggaatagaaggcaaagaggaagagaaagggaaagaggaacaggaggagaagataggaggaagggagg

SEQ ID NO: 37805 - DNA, 968 bp, Heterodera glycines
  misc_feature (883)..(883): n is a, c, g, or t
  misc_feature (904)..(904): n is a, c, g, or t
atggcacataaaataaaccattaaaattaaatgcatccctttaaatcatttttgtggcttttaccgcggcacgtgtccattgcattcgcattcgccacgctctttggactgctcgccgctgccggggcgccacggcaaatcgttgtacaaatccttcaaattggcattattttgaaaggacatttgaaacaaatgtatgtacgttaattcacttggcactgttcacaattcaacccttttgtgttgtgtttgcattcgtaaatgtcatggacaacctcataagaacggctttaaatcaacaaaataataataattaatcaaattgaaaattgtggcacattgccgcgcctggcatggtggccgtactcatattttgtgtatcatcgtgctgaattaagatttaatttgaaaaatattcaaaataggaaactctcgcacattttggcgcactgcaactgcacacaatgcaaaaaaaacgtccaaaattgtgtataaaagtcgctgttgtgatgcatttttctcatattttactaaaggggcgtaacacaacgagaagatggcgcacccagccggagatgtggtgagcgattggtgcttttcattttcttctatgtcatttcattttttcaatttttcagaccgacgcccaagtgctggagatgtcttccgaccaaattgacgaacgcgtacgacagctcgacgaagaaattcgcgtcatgagggacgaaatgcgcaaaattgcgtacaacatcaaaacaatgggaacgaagacgaaggagaacaacaaacagatgcagaaagtgagcaaacaaacaaaaggaggaacgacaaatttatgacgaaaagcattttcagtacatgaaaatggcccgtggctggtggncaatggtcgtgggaaatctgngacctcgcggatgaccaaagcggaagggagaaagaaggctcgagcagcgacttggacgcgcgtc

SEQ ID NO: 37806 - DNA, 1128 bp, Heterodera glycines
agtactattttttttttacagagattctcaaattataataaaaaaaatgaacaacgagaatggaactcttccgagtgtcagtaccattaaaaagaaagccaatgccacggggggaggttatggcgtcgtaattcattccttcgattcgcaaaacaaaaacagtgcacaaagcattgtctacgtggaccacagtctgtccattcattcagactgactctcggtttgctcattcgctgctttttgttcagatcgacctctttatgttgtgccacgctatctcttcgacgtcacttatctgaccaaccaaggcttctccaagtcgcaagtgaacaaacggtccatcgaactcggattcggagctaacatccaatttgaatcccgaggcaaccaaattgtctatttcgaccgatgttccaagggacaggactggatcaagattggtgaacaactgctcttacaggacaaggacaggcgatttttttttgaagacaaggcaaagaattacgtgaatataaaatcaaaagcccattcttggtcctcttaataatcgtttcaaatttagttcattgatgcaaaaaatgcgaatattttggtgggttttgcctttgcccttttgtggactctgtcccaattcgcttgactccgtctctttgtcagcttcgtgcccacgggtgtgtgtcggatgaagaagtgcgtcgctttttctgccattccttccattccgttgattcgtttcgcgtgccttacgctgaactacaaaaagtgattccgaatgttctgtacgatttgtttgtgaacatcgacttggacatgcacggctacgaaccaaacatggaaagcgcccattgtcagcccactttctcactctctttcaaccgttggcacaaagctctgagatgggagttcgagaaaatcagagcggcggtaactgttaaatgttcacacgttaaacattcgcaattcagccttggcacaacattccggtcccaaggatcacttctatcaatcttcggtacattatccgtgcaattaatccaccacctgttagtcttgtacaatgtgaaggcaagaagccatgttcggctttaggctgtttattccttgtgcggtgtgttgatcagtgagaag

SEQ ID NO: 37807 - DNA, 882 bp, Heterodera glycines
tatcgattagtgatgtttttagaaaattttcgattttttccaggaaatagaaaaattttttggcctaagcgggacatttgagtcccgggcccataactcgtcgggggttggttctagccaaaaattgccttagagcaaaattgtagagcttttaaaatgctatcgaatggtgtactacatgttcgaaaattttcaaaaattttcgagctaggccccctagaaatttttgaaaattttttttgggttgaaaatgggggtgaaaaatttttttctgtggtattttgaaatgctgattacgaatatgacctttgtttttcgtttcataatttttagaattttttaaaaattcgaaatttttttcattttttttgaccctcgggattttggggtaaattttgaaaattcataactaacctcagggtaagtcaattttcatacaacaaagctttaaaaatagcaaaaaatcaggagaattttatgggttttatttagattttctatcatgaaactaaaaaaagttattccagaagttctggaaaaattcgaattttcagtaaaaaattcataactcggttctgaaaagatattttggaaaagtaaaataatataaaaatccgcaattttttgctctattttataaaatttatttggtatttttatcacttctttaaaaaaagatataaaaataaaagtgattttgtgcttcgggtccaaaggggggtgaccaggatttttgagtgaaaaatttttttaaccaaaaatctttcaaaaacatgtcattagggctattttatgacgctgatcacgaatacgtgatcagattttacttttgacatcgttaaggtctcagaatccctgtgtgattggggattctgaggcatc

SEQ ID NO: 37808 - DNA, 287 bp, Heterodera glycines
gggtctcattttttatcccatctagcagtcccgccgtatcgtgcgcgatgtgggtcagatcgatgatctacaggcaatgccattcccctccccctcccctcccctcatcccatcctcttattcagcccgaccgaccaacactacgataaggaaaggaaagggaagaaatatgtgaagaggaatggaaaagagaatgagtggggacgatggagtggggaaaaagaggaggaaaaaaggaaaacagacagacaaagaaacaatgaaaatggggggggggcaaaggaggg

SEQ ID NO: 37809 - DNA, 488 bp, Heterodera glycines
tcactcgttgatccgtcctttttgctggcaaatgagtgggaatatcgttttcgcattttaatttgctgctttttccctaatggatttcctccaactaaaaatagccattcctttttttgttgccttcggggcattaataattgggcaattaacggctgaatgaatggctaatgagttgggctatcagtgtaatgagaaaagaatggacaaatttggtcaatcgtcggagaatgtgaaaaattctttgatcgattgggcgggaatgaatccttttttatcgccccgcttttttgttgttgttgtgcccataaaacattgtgtgtaaaacaagtgtagtaacacacaagcaaagcatgaaaagcgcaaaagaaaaagcaattagaaaatgggggggggggattaattataggcaattaggtgggcggggggacaaagggacaaagtcccgtcaacgccccgggcgatgaacggtgggaggtgccttttta

SEQ ID NO: 37810 - DNA, 876 bp, Heterodera glycines
cattcataacaaaaaaccccaaggcatatacatacattccccccggccagagagaataacattaacatatcccttatgagctgtatttgcatgattcatggctaacagttttataattgatcgatcagagtaatcaactgatcatgacactttatggcactcactcaacaaatttgtgatgtaaaatacattatccaaaccagattagcatggatcaaatattgctccactccatgggcactaatcacattttggtctgcagttatttttgcggtttttcccttctctgtacataattaatatccaaaaacaaattgtctaacctgtaaaaatactccctatcattaattcaaaaattaaattatcaattcttgggcgttttttttcgtttttcatggtgatggtctcgttggtgatggtggtagttaatgtgttgatccatttgcttatttattctcttttactgctcattttgtcctgttgttgatgttgttgttgttggcttattattttttgtttctaattaatttgctttttcttttggtgatggtacgcccttttattttccatatttctctctggcctagtaatgtgcaaatttcaaatcggcatttctgatgacgagactttgataatcggaacggattttccaattcaagccaattctttttaataattttatgagaagtccattccggtaggcttcttcccatcgcacaccagggatataactgagttctgattttccaaaactttttgaggcgtcgtaattcggtccctatcgcattactttaggactggtggtcaactgagccccgaacaactgtgcccttttggggtataactcatttcataattgttcaaattgaatgaatt

SEQ ID NO: 37811 - DNA, 873 bp, Heterodera glycines
ttagtcccacaaatcccgcaaatcccgcactttccccttttgcgggattgcggactgggatcctgcaaaatcccgcgcgggatcccgtcccgcgccggtctctagtaaattgtactaataatggtactagtcggggttgggtcccccctttgggtcgaaattttttataattttattttgctttaaaagatcctggaaacaaatatccgggggttttcgatgaaacccaggattttcagaattctcactattgctctaaaagtgattagactaggtaaaagttgatacaaatcctgagaaagcatctaaaaagatatcatacttgggtcgctttcctaacataaagagtcaaatttctaatagaattcttattgatgtattatttgagctagacattgaatgcatattgtcaagaattgttagattgtaatgtaacatttaagatcaacaaagacgtatttccagtatttagggtagttcttttcatacaaagaatttgggtccaaatgtgtaaaaccatgtaaaattttataagtagataggaggtcaaaattttttcatctgttttcaagagtagctaatctattaaacagaagtcgttaatttttattggataaatgcgtttattgagctcctttcttaaaatcaatcgcgcttaaaaaaaatgtgttttcactagaaatcgcgtcccttataatacatctaatcataatattattttggaattttttataatattctatttattgaaagaaatttttataggtaggattcttttttttgaaattttgaaaagtgaagatgagctcattttaaattgactaaaacctaaaaccctcagttctgttcagaacatttttctaaaaaaataaa

SEQ ID NO: 37812 - DNA, 852 bp, Heterodera glycines
  misc_feature (805)..(805): n is a, c, g, or t
atcctatgaaaatcccgctcccgttaaaatcccgcaccttttctaggcatctctctctttctcccccctccctctttatctttcttctttctcccacatctctcttcctctctctctctctctatttctctctctctctctcttttatctctgaattttgcattttttttatttatccttctctcatagaaacaatcgcgtcaaaaaaaaagattcaaattctttgtttactttgtgacatgaaaggcaaaaattatttctcccgttctttctctcttcctctctctctcttcccccctctctctctctctttctcccccctcccactttatctctctctctttcttctttctcccccatctctcttcctctctcccacttctctctctccgccccactctccctcactttctctctctcttttcattctctttccctctcctctctttctttctctctttctcttttctttctttttatctcctctctctttttctccctctctctctctccccctctcgttctctctatttttttctctctcccccatttccctcttttcctctctctctctctatttctctctctctctctctcttatctctgaatttttcatttttttttaatttatccttctctcataaaaacaatcgcgtcaccgaaaaaaaccgactggcgatttgaagcgacataacccgttaataacaatttttggcataatatactgtttgaaattcgatgggtttttgatagagcccgggtaaaaaaatttttccgggaaacgggaaaacgaaaatgaacgggngcggattcccgaacgggattcccgcctttttccccgttcccgtaaaa

SEQ ID NO: 37813 - DNA, 945 bp, Heterodera glycines
  misc_feature (830)..(830): n is a, c, g, or t
ttcggaatatgcgagttcggccatttttcaccgcccattttttcccaaaagaattttcctccgtttttaggaccgtgtcgaatacagtcgcacttggcagggcatttattttaacatcgccggccattttttctccgtttattgcatatggaagctgatcatttgcacggcaagttcattttttataaattttgtttgaaatttaccttttttcaggttaatattgtgttcgaccgcgtcggaaaggtcgacccaatcaccaaaggcattgaaatcattgtcaaacactttggctaccaaattgacgtaagtcaattgcctttgtttttgctaatcatttgctggcaaatgccttttttcatcgaatttcccaatttggccctttttaggtccctttttggtcccagcagtgctcctttttggtgatcggtctgatcgccgtcacatccatccgcggccttttgctgaccatcgccaaattcttcaacgccatttccaatcgccagtcctccaacctcattgtgctggtccttgcccatgtcatggtctgttgtgccgatttgaggactgttcagtgccaaaaattggcatttttttaatttcagggaatgtatttcgtgtccagcgtccttctgattcggatgaatatgccgcccgaatatcggtaaacctatcaaattactggcaaaatatgctattttaatcaaaaaaaaaagtttttcctggacaatttattaacttacggtctttcaaatcgactattaaaaaatgtcagacatttgctttctctctctctctctgttcagaacgatcatcaccgaagtgcttgnggaactccagttcaatttctaccaccgatggttcgatgtgattttctcctttccgcactctcttccattctctttttgtacttggcgcacaaaagacaccaaatcaataggcaaa

SEQ ID NO: 37814 - DNA, 1706 bp, Heterodera glycines
  misc_feature (57)..(57): n is a, c, g, or t
  misc_feature (934)..(934): n is a, c, g, or t
gacctgtgcccatcagcggacggggcattggtggtgccaacgctagcccacaggacnagcaggtaggtggtgaataggaatcacttgggtaatgatccagcagcaggttcacctacagctaccttgttacgacttttgcccggttcaagccactgcgattaaatcggttccagtctgcataccgaccgaagccggaacactaaccgtccccgaatttctcgaaatggctcagtcccgggcagcgacgggcggtgtgtacaaagggcagggacgtattcagagcgagttgatgactcgcccctacaaggaattcctcgttcacggacaataattgcaatgtccgatcccaatcacggcaaattttcaccggtttaccaacccctttcggggaaggacaagcacgctgattttgccagtgtagcgcgcgtgcagccccggacatctaagggcatcacagacctgttattgctcaatttcgtgcggctgaacaccgaaaatccctctaagaagttgtgcccacagaagcaatgagccaactatttagtaggctagagtctcgctcgttatcggaataaaccagacaaatcgctccacgaactaagaacggccatgcaccaccatccaccgaatcatgaaaaagctatcaatctgtcaatccttacggtgtccgggccgggtgagtttccccgtgttgagtcaaattaagccgcaggctccactcctggtggtgcccttccgtcaattcctttaagtttcagctttgcaaccatacttcccccggaaccggaagactttcgtttccgggaagctccccaccagggcgaataaatccgccggcggatcgctagttggcatcgtttacggtcagaactagggcggtatctgatcgccttcgaacctctgactttcgttcttgattaatagaagacattcnttgccaaatgctttcgctgtagtccgtcttgctacggtccaagaatttcacctctcacgtagcaatacgaatggccccgtttgtctctgttaaccattatctcggtcagcaaaaccaataaaatcggaccgaaatcctcttctattattccatgcacgaacattcaagcgaaacgcctgtttgaagcactctgatttgttcaaagtaaactcgccagcccaccgacgccgaccggtaaaggccaacgccggggagagaccggcagaaaagccaaccgaaccagtaacacacaaagtgtgcaccggacggctagcacagatccaactacgagctttttaaccgcagcaataattctatgcattttgagagctggaattaccgcggctgctggcaccagacttgccctctcatagatactcgttaaagggtttaaattgtacccattccgatgaccggcctcataagagatcggtctcgttatttctcgtcactacctcctcgcgttgagagtgggtaatttgcgcgcctgctgccatccttagacgtagtggccatttctcaggccccttctccggagtcgaacccttatcctccgttacccgtcatcaccatggtagtcagatacactaccatcgaaagttgataaggcagacacttgaaagacacgtcgccggtacaagaccgtgcgatcagcttagttgttctgagtcaacactggacgcccggagggcgcttggttttgtggcgaaaaatgcgctccgctctggggaga

SEQ ID NO: 37815 - DNA, 1110 bp, Heterodera glycines
ataatacggaaagacgggaaggcctaaaaataatgtttaaaacaacaaaaactgtgaattgttacgttttacatctctaaattttttccgcttttcgcattttatttttcaattttatgttaaaagaacaaaacacagctgaaattttgaaaattgtgttgagctaaaggcatgtttttgaggaatgaaaatgtgcccaaaaaacaaacctccgatgtcgccgaccaccaaaaaattcagttgcgaggtgtcagacaaaacgcatcccgcctcagtgacacaggacaatcggccgacggttgtcagcggaatttggcggttggcatctgttaaattaacggttttatatacaaagaaattcgaaattaaattcaatttgccaatcgacgccttgctctgaaggtgtgctgctgaaagagtgaatgtccggcgggagaaggaacagcccggagatgaggcaaagcattgagaccattgcgctagcgaggagcagaaagaggaggacgaatttggtgttgcggggaagtgagacgaagggatgcaaaaagtgggagggatgagacatggcgaacgaagaaaacgaagaagtgagggggggggcgaatgacaaaatgagaaatatgacggaagaagcgacggggatggacggagaagggtcgatgattcacctaacgccaatgaaggcggtcgctcaacgaaatgaatgcgttgtagttctctttctttaggaatgcatcaaatgcaaaaacagttaacgcaacccctcttttttatcagcaaatcaaacaatcgcatgttttcgttgatgattattaaggtttgtaattatatggatataaaaacgcgaaatatggccataaaatatggacaacaaatagtgaaatatggacataaatttttccaaattaaggtgtaaattttcaaaatttcttcaaattcgctcaatgtaaggcaaaacgctcaaaaatggctaaatactatattaaaaattattttagaagaaaaaacacgatataccttaaaatttactcattttagcgaaaaatcaacctgaaaagcgaaattttcgctttttgtttatttttacataaattaacaatttttaagaaa

SEQ ID NO: 37816 - DNA, 810 bp, Heterodera glycines
aatatttattaattttaattggggtgaatattaattaccttccttaagttctatgattttaaatgtatattatataagaatctaatagggttcgagccccgctcccgcccccgtccccgggacgggacaggtttttggggctcacccccgtcgccgccctcgtgactctgatcccagcatcccccgcccccgcgacctttttttaaaatatttgtggtttagtggttagtgttctggttttggggtacttactaccttattttcatctaaaaaagggaaatttctaaaaaatttggctaatttctaacaaaattcaaataaagtcttaaaaattttccgcttgcggcgcaaatcggcaccactggacctctcccctcgcacattcaccaagttttttggaaatgtgccgcaaaaaatgttaaaaatctgatttagtgatcccgaatgcactgaaatttatgaaaaatataataatagaatacattttggatcgaataaaatgtaaaaatatttgaagcaattttgcaaaatgttcttatttttgaccctaaaatttttagacaatatctgtgcaattatacctaaaaagaattgaatcgaggcgatacatcgaataaaggaatgtggagccaaacacatcattaaaaaaaattaatttttttttgtgagattttcaggagctaattaaaaacaaacccccgcccccgtccccggtggcgagaaatttctcacccccgcccccgcgactctgacccccgccaacccccgccgcccccgcgaaaagccacccccgcccacggggctcgaacc

SEQ ID NO: 37817 - DNA, 1232 bp, Heterodera glycines
  misc_feature (13)..(13): n is a, c, g, or t
  misc_feature (28)..(28): n is a, c, g, or t
ttaatgatactantagcaaacaaatganggtgtttttcaatgcaaatattatctattttttggcctaccatcaaaaatgtgagtcaaatttgctgaattcatttaaaaacttatttttctattaaaatttttaggacaattttatgtttaaaactgcaatgcaactgtcaattattgaaaatggaatttgttacacaattattatcatttgtggattcaaaattgccaaatttgtcaataaaaatgcatacagaaatgcaacatgtggacaacaggttcacaaacagttgacaatcaatttgataattaaggtctattttaattaaaaagaacgatttttaaaataatgaaatttttagaaatatattttaaaaattatatgataaaaattctcaatttgaaaaacttcttaagaaaattggtagaaatttttaataatttattgataaaattgctaaaatctattaaaaaaaaatcaaatgcatttttaaacaaggagttatcattctaaaagcggggcttaatgatgcccaaaacaaatgagatttcaaaaagaaatctgataccgtacactcaattacaaaatttggccatttaattttttttttaattttgcaatttgcttttaggccctgctaccgttagcgatgaacatcctcaacttttccgtcgccatacaactgctattcttccagacggaaatgtcgccaaattttttgtttcttcaaatgtgtgcgtccgttcccgcctattggctgcccgtgctcaacccgttggttacgatatgtacagtcagcgactaccgtagtgctgtgaccatactcattcggtccacaacgagaagccgaagtcgggattccggtgtttttgctgctgctgatctgccccaaattcgtgtaatccgcccaacgaattatgccaatccgatcatcaacaattatgtttaatgaaggagttatttgtaccaaaattgcatttttttttcccctcttgaagcaaaatttctttaataaatacaattgggaatgttagcctccgttttcaagggttttaaatattttaactataagtttattttggtgcttctacgccatgttattttaacaattatgagtagggatgcgatttaggcacaaaaaatcgcgaaataggcacaaaaatccttgaataggcacgaaaataagcaaaaaaatttttttattaacgctttttaggtagaaaacacataaaaa

SEQ ID NO: 37818 - DNA, 692 bp, Heterodera glycines
agattcggattctccgatccttaaaacctcttatatgatcattccaataagggacctgtgattttggaaaagaaaaaattgcaaaaaaacacaccttaaaagatgaaattgtgagaggtcggcaaaagattaatttgttcatacaaaaataaaaacaggaacatccctggaaaatgcactcgccagttgaaaatacctaccttaatttgaatttagaaaatttttttacattaaaactgcacgaaaaaaaattttgaagttttttaagcgatttttaaaatttatgggcaaccagcgagaatggggaaacgcagtgcacccattcggatcagtggtttttaaagtgatttggacggcgcaacagctcggaatgttcccgtgtgaatgggtgccatccatcggagtcccaatttgatcggtgtgccgtgccattcattcatttgttcctcccacctgatcagattggccacccgcactgcgttcagcaggtccctctgctgcacaaagtgccggcagcgggccaacagctcgtacgggtcgtatctgttcaggtcgagccggtcgtcggcggagtacgcgtagggcagctcgaaggtgaacagcgactggagccaggaggtgacgtagcgccacagagtgccgccctcgtcgcctatctgtgccgtgcatcggtgcaatttgtacacctggca

SEQ ID NO: 37819 - DNA, 901 bp, Heterodera glycines
taggcttagatcacatgcgattttcgccactctgataattttagcgctcataatgggatgtataaaggcgattgtagaaggaattggaagcgctaaaattgtttgaggagctttttgagcgtaattacgattttacttacaccatttttttctaggcttagatcacatgcgattttcggcactctgataattttagcgctcataatgggatgtataaaggcgattgtagaaggaattggaagcgctaaaattgtttgaaaagctttttgagcgtaattacgattttacttacaccatttttttctaggcttagatcacatgcgattttcggcactctgataagtttagcgctcataatgggatgtataaaggcgattgtagaaggaattggaagcgctaaaattgtttgaaaagctttttgagcgtaattacgattttacttacaccatttttttctaggcttagatcacatgcgattttcggcactctgataattttagcgctcataatgggatgtataaaggcgattgtagaaggaattggaagcgctaaaattgtttgaggagctttttgagcgtaattactatttttacttacaccattttttgctaggcttagatcacatgcgattttcggcactctgataattttagcgctcataatgggatgtataaaggcgattgtagaaggaattggaagcgctaaaattgtttgaggagctttttgagcgtaattacgattttacttacaccattttttgctaggcttagatcacatgcgattttcggcactctgataattttagcgctcataatgggatgtataaaggcgattgtagaaggaattggaagcgcataaaattgtttgaaaagctttttgagcgtaattacgattttactta

SEQ ID NO: 37820 - DNA, 188 bp, Heterodera glycines
tgaaaagttgcaaaatccaacgcaacgaaccagcgtaaagccaacgaacaattgaccgtatcaacacacacaagcaggagaattcactccatagaaaagaggggggggggggggattggatttgtaaagtggcagcagtggtgacggattactttgttggactttgctggagcaggaaaagtgagggg

SEQ ID NO: 37821 - DNA, 1661 bp, Heterodera glycines
  misc_feature (52)..(52): n is a, c, g, or t
ttacctgataacgaatggatagattagcgagccaaggttttgcatcattttntgataaatttttgaattgtatcggcataactggtagaaaatgcctaactcaatgcttccgatcagcgattggacggcggttgtgatcagatttgttctcggttggttttgatcagattgtgtggaggtggagaaagcgaatgtaaatgggaaatgatcaactgaataccaaataaaatgcacttaattagtatttcgatctattagagtctgtcgtgcccaatatttgtgtttttattataattgattgtaactggctaataaattgtaattatcccaccgcaaaaggcgtccacagaatggtgaacaggtggccacgattcttttcatatgtttggacaaataaagtggccaagatgcgttcaacaatcagaacgtggggtacaaaattacgggagtaaatgccgatcaaatacatttttataagtgccggaaaaaactgcacgatattcggcaccaaattggtcccaaaagataaatttgaatagacaaatgataaaacgacaggaaccacgcttaatttgcaaaaaatgatcgatgatttttaagtacggtaagcttatgattggaaaatataaggacataacgtgaatttttccaattaaaattttttgatttattcaatatttaccaagagaataaagaaactctggaagatgagaatggctttcgatgttcgggtggatgaccgatgtgcgagccaccgaaaatcagattggcaatggacaacggaatgccaacaaatgtggtcaataattcaacggcatcgccgcagaacaaaagaaatagttcataattatttggtgccgtggtgttcaaagatgtcatgttagcaattagttgcttaatttgtttaactaaaaatattaaaaaattaaaatttccattaaattttattcgttgcttattttaattgcaattaaatttgaattatttcgcaataaattttgattgaatttgtcaaacacttatcctttgctttccaactttaatgaataggaacaattttttttggtaatagaaattattaaatgaagcggcgattaatattgttcagaatcacttttgttaattgccaggtgtaaaatgaaataattgttcttgacatgcgattaatgtttacagacaaatgggacaaacagatgcaaaattctctcaacaagtaaagcttttaatgaaataattggcttttcaaaatgcaattattaaatttcaataaatgatgaaatataatgacatttaattagagttgagcgggacctggaattttgggcaaaactgggaccgggactttttggctgggaaaaccgggaaaaaacccgggaatttcccggtcccggtcaaaaccgggaccttggtactcagttgtactcagttggccgtgtccaggtcccggtcccgctcaactctacatttaattaattgctatgaataaaataaaaagataattcattcagtttcatattaataaaataatttcatatattttatattcattattatttatatttgttccatcatttatgaataaattttagggttgggcggtgcgcttttttgagtttgttaaaggaaaaatgaaacttcaattaagaaatcagtcagactct

SEQ ID NO: 37822 - DNA, 863 bp, Heterodera glycines
aatggtttgagtaccccaaacggacacttgaaaaaatccttttttttgttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagtctgtactttaattctgcgttggatttttgctccccataaatgtttgagtaccccaaacggacacttgaaaaaatcgatttttttgttttcggggcagtccccccgaaccgatgcgccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgaaccgatgcgcccagatttatgaggagaccgaatccttcggggatagcttccctatagcctgtactttaatctgcgttggatttttgctccccataaatgtttgagtaccccaacggacacttgaaaaaatcgatttttt

SEQ ID NO: 37823 - DNA, 942 bp, Heterodera glycines
aggtcaaaaccggaaaagtaccaaaacaacaaaagacgggcagaattgcaaaaatatttattccaattgaataaattaacgaaagggcatttgcttcccacttcactattctaattttataacccttttccaaaaaggatctctaataaatttcgaatatgccaaaaaatgtagcgcagatccatttgaagaaatcttagcataaattgtggcatttatgcccccaatgtaattttggcggtgctaggttattgcgcgaagtgcaaaaatgatgacgtcacaaaaagggcgtttcgcgaaaagtgcaattttaacaaaagagaccgaccacatcagtaaggtgaactttgtgttaaaataatttttaattatttaaatttttaattatttcaaatgtgtatttcgaaaggcaaagcaaaccagattataataaagtttattatttattaatacattaatttttaagaaattcatttaacattattttaattactcgtaattttaccgtactcattgtcaactaacaaacgattaagttttcatttatgtaattagataaatgtataagctggttggagcctttagcaagctcgaatataaaaattatttaagctttctttgctaaaaaaattaaaaataataagcttaattaaaatttggtttactttgcttgtcgaaatacacatttggaataattaaaaattattttaacataaaagtcgacaccatactgatgtggccggtctcttttgttaaaattgcatttttcgtagaacgcccttttagcatttttcgcgcaatgacctagcactatttggtgactatgataaatacatgcaatgcttgaagttgttgagcgatcgtattgacacaaaatagttttttttttaaaaaaagctcaaaatttaaattgaaaacgttacttgagagagaaatacttta

SEQ ID NO: 37824 - DNA, 925 bp, Heterodera glycines
  misc_feature (891)..(891): n is a, c, g, or t
tttttaaaatgtttcttgctccgtcccacgctgtcattcgatcagaaccgtagccaaaaaactttcggaggtaggagggaatccgaagagctttatttttatctccgtgattcaaaatattttgtccagtgatatgtgttctttttcacaatttctgtgccgggcgaaaaagcggtggcaatggtaaagaattgtggtccctaatttacatcaaaataaagttgttaaatgaattagaatcttttaccccagaaaaatgcatccttggaaaaaaatttcacctttttgttcgagttcgggtaaatccgagttaagattcgtaatcagcaccctcgaaatgatattttttggaagcttctcttgaaacttattgtatataaggatataattgtgagaacacctgcaaactctgcaaatacgcgtcccatcggttgccgatcacttttccgcacgtaaagcagcgaattgggatgatcatttgtgaagggaaattggaagacttttaaaagctaaaatcatttctcaaaaaagtgaaaaaagcaaacactggttttttaggagtcaattaaatgcaaaaatgacattttcaaatccaataaaaccaaaaatgagatgaataaaaatgaaatgaaatatttccgttggtcgacggatgaaaaaaatgggaaaaaaatgagaatataatttattaggccaacaaaaaacagctaaataaaatataaaaagcacaaaacgttctctctcggccgtccctcagcatcgaatgccttgcgcaacggtcataaaaacgccgaaggaaccgcccatttgcgccgcgattttgcccgtctgtctgagcaactcgcgcccacggaggcccatcctgggaaagaattagcaaaataaaattgngaaatatgtacaaattcagggaaaatattttcat

SEQ ID NO: 37825 - DNA, 1290 bp, Heterodera glycines
attgcgcccttctcgaaagcccacctctgcatccgcttctcggacatcggcagagtccgatccgtccggcagcccaaccaatttgtgtttttcaattccgtgtcaaccattttgcgggtttcatgctcttcgtcatcatcatcgtctgtctcttcgtcgtctttgcccgcttctgtccgttcgtcgtacgtttccccgtccactttagaccattgtcaacgcggttgctgcctttgtcggtgccatcgtttgtgctatcgtttttggcttttcgctgttggcggtaaaccattggcaccgggtcaatgttggccaccagaagtgccatcatttgctgtaattgtctcgcttcttcctgctcctcctcctcttcttgttgcttttcgttgcctctgtttgctgctgtactgcttgtcaatgttgccttctccgcctcctcctcttctgctcgtacggcatcgtagtaatcctccctctctcttaaagtgattaatgccattggtgccgtcggaaaatttaaaaatttaattattatattgtgaataacatattccagggatggcatggaattccgatttcgaaaatttttgaccctcggaattccgatttgcaaaaatttttggggccttggaatggtatccctgacacatacaaatatttggtgtcaaaactcaaaatggcataatatttaaaaacccactctgatttatgccgaggtgtttttggatgcaaaatgtaaggccaaaaggcggcaggcggcacacttttctcttcaacagatttcatctttgggtcaccattgcaattagcaatgattgttccgaccaacagaaggaatagagagagtgccatatcttttttaattaaatgtgaatatttgacctacaattaaagagagataatttataaaaggtgctaattaatgtctatgtaaatacgttcttttctcgggccaattacaatagaacgatttgatatggatgtgactaatttaacacgtacaaaatgccaactaaaaatattttcttcctccgactgactcacactgattcgttagtcggtcgtgaaatcttaggcttaagttcacatagtcttgcttacatagacacatagttaccttcattattctttgttcatgataaggtctaaaatggtcaatcaaattcttctgcttaaccaaaaatcttttgcatcgcttctcaactgggacgtcattccaatgctttcaagggtttggttctcacagtgcaaactttgtttatggcgagtgacctacatcttcctcctccc

SEQ ID NO: 37826 - DNA, 913 bp, Heterodera glycines
tttttaaagttggactttgttttttaaaatccataattttaccaatacgtttcgaaaatttctgcattgaacaaattaataaaattcataaaatttaaaaacaaaattttcccgtcgaccctaaaaatccttattttctctcagctcaaaatcgcaaaatttgggtcatttgttggtgcaaatctgttaacaaatcctcttcggtcctcatgtagctttttctcatggagcgggttgacctcctctactatttaatgtattaaagttgtgcccaaaatgtttaaataagcatgtatttgtgctcttttgacaaaaatttttttcaaacttaagaaaaaattttcaaaattttgcaggctaacagaggaaccttaaatgattaaaaattttgaatttcgccattcatacctcaatggtactagttgggtttgagtcccccttttgggtcaaatttttcaaaagcgtaaccagacagtcagacagtgcactatttccttctttatttttctcacttcttcccttttcccacacacaatgctgctgcacagcgagcacacggctgtttactgtctaccagggatgggccaaattgaaaaataaaaagcgaaatgcgaaaagcgaaatttgcgaaactgaaaaatgcgaaatgaaaaaaaaagcgaaatgcgaaaagccaaaatatgcgaaaatgcgaaaagcgaaatgcgaaaagcgaaattttttctacaactttttaatagttaaaatcataaagcaaaaatcatttttttaaattttattccacatttaaaaatcaataaaacgcttttttgaggcgcgctttttccaaaaaaactttttgggaagagggggcaggcggcgccgggaaatttttgaaaatttgattaaaatttgttgacagattttcaccaaa

SEQ ID NO: 37827 - DNA, 601 bp, Heterodera glycines
gccaagatgggactcatattgttgcatcaaatcctctttcactttttcaaaattttcatatcctttaattaacttattaaacttctcaaaatttgttgcatgtcctttcacaaattctgaaaataaagcatcttcaacctaaatttgaatttatttgaaatttttttttaaataaagctaacccaattatctaagtccttgaagttcggacacaaaattataaaatgcgtattatttcttgtgccatttctttcacttttttatgcatttcttccaaatttttgtcgaaattttgtcgaattattccgtctaaactttcatttgtttaccaatcattcgctatgtcaattgtcaattgcaaaatgatttcgttaatggtcttttctttttcattttctaatttaataacataattcaatctctcatcattcaacttccaatatgattgaacattttgtttaatttattttcatatttttgtcccaacgattttataaaataaaatgtccaaatatttacgatgtttttggcattctgtccgttaaaattcgtcaaattcatctgcaattttatcacattgccaattctttctcataaaata

SEQ ID NO: 37828 - DNA, 951 bp, Heterodera glycines
  misc_feature (5)..(5): n is a, c, g, or t
tttcnggggtactgtatttaaaaaaaattttttaaaccgttcgggtgtgggggtggaattttaccacattttttcctcattattctgtaattttaataaaattttttcctatttaaactgtaattttctaataaaaatttatacatttcgacggcatcgatattacataaattttaattcgataaagtttggcgtcgttggctgctgctggtcagtgaacgttggcgggcggggggattagtgaagggggggggggcattttttttgcgctcaatattattgagtggacggtgtgtgtgggggggtcatttttctctttttctctcccccacatttatgttgttatctcttcttctctctctttctctatcttttttctctcttccttttcattctctatcgcacacagcgcaatgtgccgtagagtggactcatacagccaaaaactcaacaacaatttttagcgtctcaaattgattttttgtaattaaactttactaacatattttcccaacaaccctttttttaatttattttaattcttttcaattgccagccgtttttaaaaaacttttacattcccagcttattaatattttaaattcttttcaattcccagccgatttatatttttatgtaatcctttcatagcttattttttaatctctttttcttgcactttaatttttgaaatttttactcaacattaataaaaaaattaacagatgatttttgatcgatttcaaaaacatttttttttgaaaattcccccttttcaaaaatggcgcatttctttccccgttcaccctccccgccccatgctcgttccctgtccatcacgcccgcgcctcggtcggcttggtttaggcgtctcctgcatttcatccctctcctcctcctccagccctctaagcttcttcgcctctctcgctttatctcgctgtctttttc

SEQ ID NO: 37829 - DNA, 932 bp, Heterodera glycines
ctcatagtaaaaaattatttcgttagaatacgagaaataatttgaaacgaaacactggttactaatttgcatatatctctgcgaaaattccagatccaaaaaaatcagctataccattcgaaagctgctttcaggcgctctcagaaaacagtaaaaacgctcctattcatgcactaggcgctgagatatatgcacttgactttctgcatataattgccattctccgcagcaaacttcgcgttctcaagcgtgaatagttaatttttttgtgctgaactgtgtttgggttctccttgcagtgcgctcaactaagtctcttggagttagagcatttttcatggtattttcaagaaaattgtgcaatgtgggcgacccggaacattttagacagtttccaaaccaaacactcatagtaaaaaattatttcgttagaatacgagaaataatttgaaacgaaacactggttactaatttgcatatatctctgcgaaaattccagatccaaaaaaatcagctataccattcgaaagctgctttcaggcgctctcagaaaacagtaaaaacgctcctattcatgcactaggcgctgagatatatgcacttgactttctgcatataattgccattctccgcagcaaacttcgcgttctcaagcgtgaatagttaatttttttgtgctgaactgtgttagggttctccttgcagtgcgctcaactaagtctcttggagttagagcatttttcatggtattttcaagaaaattgtgcaatgtgggcgacccggaacattttagacagtttccaaaccaaacactcatagtaaaaaattatttcgttagaatacgagaaataatttgaaacgaaacactggttactaatttgcatatatctctgcgaaaaattccagatccaaaaaaatcagctataccattc

SEQ ID NO: 37830 - DNA, 788 bp, Heterodera glycines
aaaatgataattgaatttgattgggtttttttattcgatttttttgcatttccatcaattgtttgttattgttgaaaatccacattttgacgaaaattgtaatattttgttatttgttccgccaataattaatttgttaatgctatttaaatgatattttgagttaattaaagaaatgaatgcaacaaataaataaataaaaatgtgacaataataaacaaaatggcggtgaaattggacacacaattcgacgagaggggggggggggggggaaagcccataattatgggccactctccgccgtgccatgccgtcttctcacgaagtctctctcatcaattcaatgtgtttctactggtggtggtggtggttgtttggtgttgttcggcagtgaagggacactttcaatgaatggatgagaaaaagagggagcaaaaggaaagaggaaaagggagaggggaaacgggggagaagagagagaagagaaagagagagagagagggagagagagagagagagagagagagaggttggaggggggggggaaagaaaacgatagaaaagggaaactgaggagggagtgaaggatgtagggggaaaagaaaaaagaaatgggcaaaaggaaaaataaataaataattaattaattaattgccatgcgagtgatctgctgtaagctttaattgcttattattattattctttaagtaaagtgtttatgcctgctgctgaacgataaaatttgcatttgaattgtttctttggtttggaattgagccttatctccc

SEQ ID NO: 37831 - DNA, 967 bp, Heterodera glycines
tgcctttgtcatttctactaacaataagttttgcttcttttttaattcacattgaattaaatttaatggctataaatgcttaatgacttcaccatttaaaaagttgctttcctgattcaaattcaatatatcccttctggcaaagggaaacaaaagctttctaccaaaagtttcaatttcattaaacttccattaaaataggcttacaatcagaagtgtttttgggccatgtatagtttgtttgttctcagtttgtacagaaattttaactataacaaaacaacaatgatatcacgataaacaattagatattttcttcggtcccatgtgagaacactttcaccgtcgagtccaccgaaccgctgcaaatacggctcggcactgtccaatcaacgcacagcacgcggtccgaatggcccatcaaatcatatagagccgccctggggctgctgaaattggacacaaaaaacattagagcaacagaaaaaaagaatttcttaaaattcaaatcctcgaaatacacccccccccttcacagtcaaaaatttatgaagacaatatttagtactaataatgacattctaaatataaatttgttttaatcattcgctaaatacctactcgacgcttgtgccagaaactcaccggacgtcccacattttaactgtgttgtcaaagctggccgaaacaaacaaatgctggtcggttgagtgccaacagacatcggacacaacgccaacatgaccatggaacgatgccttgaccattgagccatctaatggcgaaattaattagaaaaaaggggaggggcatttagttgggtcaccaacccctggaacgaaaatcccaaagccgaaccaacgaatcgacagaggcggtcagcacaaggccattggccggacagaccgaaagtgctaaaggctttgttcgaagtgagcgtggagatgggccctgaaaaggcagaaaa

SEQ ID NO: 37832 - DNA, 1335 bp, Heterodera glycines
cagataatgctgttcaattctgcagaatttcgtccttatggtattgtttcaccgccttgaatctaaagatccaactttgccgtaaaattgtaaacaaattaaaataccgagataaaatgcgatttgcacttgatgacaatcttgatgaatgtgtcacaggccatgtcctggacaccttcgtgcgactcgtgcatgaattcaaacagtttgttgatcacagttttcaggaacttccaatgacagcgaaggaaacgcgggtattggcccacgacgtacattatgttggaggcaatcaccgctttgttgtctttgccacgcttttgttcacacaaaccaagcaaatctacaaaaaaatatatatttatttggtgcccgaccctttcactcaccgcgaatgactgtgaccaaaaatcgcttctcgtcgtcttcatgcatcgcaccgctaattgagccgattgcccagcacagcttaaatcacttttgaaagacagggaagaaactccaacaaaccgtgttcaaattcttccaggaccactcactgccattaacttgattttgaagtttttccgtcattttcaactcagtgtctcggtagtccaaatgggtcagcaacactaaaatcacaaactgtgaaatttgcctaaataaatcgccaagaaaccaagtgtttcccgcatcgttttgtagagcacaacggagtccgtgtccttcacaagttccctgactgcctcattgttctcgttgacaacgacaatgacttcttcgggtttggccattctgctaatcatcagcaggcgaagttctgagagcacttcgatgtacagcttccgcttgggcgattcttgccggttatagcgcttcagagcgtcgatgatcgaatgttcagattgttcaaatggagattctcgaaacagttccatgcaaagccaattccaataatccaaacaaatctgagtaattggagagagtgtaataagggttccgtaaagaaaagagactttgaacacttcgatgtcttcgacttcgctgctgatcttcaacaaatacttcaacgccatcaaatgtgcttgcttgacagctttttgttcttcgtccggatgaggaaaggttatttcgaccaatgcagaatgttctttgaagaaagtgctaagcaattgggcgaaatttgacacaaatttttggtcttcgttagttccatttgcgtaggaagtggcaatgtcaaaggaaagtggaagttgttccgatataatttcgatgaccttcctgagcaaaaagaccaatttgccgccgtattgcggattgtcatcgatgctgatggacgacacctcaaccaaa

SEQ ID NO: 37833 - DNA, 974 bp, Heterodera glycines
  misc_feature (918)..(918): n is a, c, g, or t
atatcacaaaagtgatcatgaaaattgtaaattgggagattattggggacttatcagctcggtcctccgcaaacactgattcagtttatatttagaggataaggagttgaaatggtggaattccaaaaaggtgaccaagaaaattgtaatcgaatattattgacgattatcagctcggtcattccgaaaacactgattcagtttatatttcgcgaagaatgagctgtaattttgcgaattagacaaaaatgatcataaagtaacaaatgagagaatttcacattctgctaattaggctttaaatataaactgtttaagtgttgcagacggatcaggttgataagcgccaataacctcagatttactattttcgcgaccccactttttgaattctgacattttcagctcattacgctctaaatataaacagcatcagtgttccggaaggatcgatttgaaatcgccaataacccccaaattacaatttcctactgtaaacttatacagattacatttggatataagaaattgaaatattgagaatatcacaaaagtgatcatgaaaattgtaaattggagattattgggacttatcagctcggtcctccgcaaacactgattcagtttatatttagaggataaggagttgaaatggtggaattccaaaaaggtgaccaagaaaattgtaatcgaagattattggcgattatcagctcggtcattccgcaaacactgattcagtttatatttcgcgaagaatgagctgtaattttgcgaattagacaaaaatgatcataaagtaacaaatgagagaatttcacattctgctaattaggctttaaatataaactgtttaagtgttgcagacggatcaggttgataagcgccaataacctcagatttactattttcgcgacnccactttttgaattctgacattttcagctcattacgctctaaatataaacagcatc

SEQ ID NO: 37834 - DNA, 895 bp, Heterodera glycines
  misc_feature (877)..(877): n is a, c, g, or t
taaaaaacgggcgcgaagcgcccgtatgagttcaacaaaaattgaaaaaccggcgcaaagcgcccgtctgaggccgcgaagcggcattaatagcccaacaaatttagaaacgggcgcaagcgcccgtctgaggccgcgaagcggccttaatagcccaacaaatttagaaacgggcgcgaagcgcccgtctgaggcctcgaagctgccttaatagcccaacaaatttagaaacgggcgcgaagcgcccgtataagcccaacaaaatttaaaaaacgggcgcaaagcgcccgttcgaggccgcgaagcggcctaaaagtcccagataattttttaaaaattccaaatctccacaaccagagctaatctaggtagcgaagctcccaaagcgcgaagcgctttttcccagcccagagccgactgttcacgcacccgctagttatatatatgttagaatgataaggggtttcgtttcaaaaactaatttgagaagaacgggaatagctagggggctgaaattttgcaccaaggggtaactcgtgacggcgcatctgggaaaactataggtttttttctccgagggccaactgagtaccagcggcttattttccatttttgcttgcgtttgaaggcccataactttttttctaaaacataagtcaaaaagtttccgctggtaggaaactaagttgaagtgttttctaaaaaacaaaaaaaattccaggcctctacctataataggaagggctgcagaaaaatggagaaattcagtaccaactttgtccagttcagtccccgttgaataactcattagggtttgacctgagcgcagggtggccagcagacttatttaagaatgtaatgagctcgatttttccanaattttaaaatttcaaaa

SEQ ID NO: 37835 - DNA, 928 bp, Heterodera glycines
  misc_feature (869)..(869): n is a, c, g, or t
  misc_feature (897)..(897): n is a, c, g, or t
atatgcaaaaaaatcggaaaatatttgaagaaaaatggcaaaatatgcaaaaaatcggaaaatatttgaagaaaaatgtcaaaatatgcaaaaaatcggaaaatatttgaagaaaaatgtcaaaatatgcaaaaaatcggaaaatatttgaagaaaactggcaaaatatgcaaaaaatcggaaaatattttacgaaaaatggcaaaatatgcaaaaaatcggaaaatatttgaagaaaactggcaaaatatgcaaaaaatcggaaaatatttgaagaaaaatggcaaaatatgcaaaaaatcggaaaatcggaaaatatttgaagaaaaatgtcaaaatatgcaaaaaatcggaaaatatttgaagaaaaatggcaaaatatgcaaaaaatcggaaaatatttgaagaaaactggcaaaatatgcaaaaaatcggaaaatatttgaagaaaaatggcaaaatatgcaaaaaatcggaaaatatttgaagaaaaatggcaaaatatgcaaaaaatcggaaaatcggaaaatatttgaagaaaaatgtcaaaatatgcaaaaaatcggaaaatatttgaagaaaaatggcaaaatatgcaaaaaatcggaaaatatttgaagaaaaatggcaaaatattcaaaaaatcggaaaatatttgaagaaaaatggcaaaatatgcaaaaaatcggaaaatatttgaagaaaaatgtcaaaatatgcaaaaaatcggaaaatatttgaagaaaacgggcaaaatatgtaaaaaatcggaaaatattttacgaaaaatggcaaaatatgcaaaaaatcggaaaatatttgaagaaaaatggcaaaatatgcaaaaaatcggaaaatatttgaagaanactgggcaaatatgcaaaaaatcggaanatattttgactaaaaatgggcaaaatatgca

SEQ ID NO: 37836 - DNA, 601 bp, Heterodera glycines
attttgaattttaccaaaagttaaaacaacaggggggaccctttggtttgcaaaaatttttaatgtatattcatgaaagtttattccctggggttattggggtccatgacctcatattagatgtcagattcgtgatcagcgacctctaaaaccccggataacaaattttcatggttttttatcacaaaaaaagttttgcaaaacaaaagggtcaccccttttgtttttgataaaattcaaaatgcgggacttttaatatagtgcccaattttttcttactttttcgagtaccctcacactctttttttttaataaaaaatcgcataatttcccgggtgttttcccattttcagcttcattatgctgccctggtgtccacccaaatgttggagacactgcttgaacaagaggcgggcaaggcgttgatcaattcgcggaacaatgcgggcgaaacgccgtcaatggtcgcgctgcgggcggtcaatccgttgtgcatgaaaacgctgttcaaccacgggggcgacctgttgaataaatcgacggacaaaaacccactcatcgaactcatccagtccagcaagggcaacacgccggagaatgt

SEQ ID NO: 37837 - DNA, 1017 bp, Heterodera glycines
cccccccccccagcccccctcagtaattagccaattcgtccaaaattggctgaaccataatggcacattttaaatttaaattttaatatttacattatccttatcatttttttctccttttttcttccttcacactctcgtgccctctctaacatttttttaaatttttgttcccaaaataaaaaaatcacttggcttatttgctcattattttcaatccctttcaaacacagtcaactttggcacgggccaattccggttgtttgttggcaaactcactcacaaataacggggcatggcacattttaatttctatttgtactccggttttgcaccccacaaaaagcaaatatatttatttgtaatttcattacagtttttcattattctttacttcttttcaactgtgccgacatttggcacttccccccccccccgcccccaacagctgtaccattggttgaaatgccgaaatgccaaaacaatgaatgccacctttatttccattaaacgtaggttttgcactccaaaaattctatttatattttcaattatttatttatctctcgtgcctctctaatatattttttgatttttaaaaatttttgtttccaaaatataaaaatcgcttggcctttttttgctcattatttttcaatccctttcaaatagtgcccacaaaacgcttttcgtgcattatataagaagaaattattttttttggtactgaagtgtccattttcactgggactcagttgtccaagtgcttagatggcgttggtttgatttttaccgcttttttctttaatctttcgacttaactcgtcaagagctttcgaatgatactaaatttgtatgggtttgacccttttaaaaggctataattgcccaattttgtccatttttcgataaaaaaaaattgcatttcgccaagaaatcgtcggttttacgccaaaaaatgatcatacctattaattatatgacgtttaagaatcattaaacatatttttgctttac

SEQ ID NO: 37838 - DNA, 1051 bp, Heterodera glycines
aattgtagaggctgttccggaaacaaatacttttttagcaacggatcctctcttgccttttcagcaaattccttatagcccacaggcggccctttgaattcgcttcgcttgtccctgttcaacaaatggctgacaattgcctccacgttgctcgttttaaactcggacccatctgcgcgcaaaacctttccctgatcactgactcccagactgtgccccttttttcgaatgtgtgtgatcagtgcatttttggtcatctggtagttgtgttttggttgaaggcgatcagccgtttctcctcctcctcctcctccttttcctgcttccccatctcttgctctgagcactctttttgctgcggcaccacctgttgacgccgtggacgatgatgattgtgcgtcgtcccactgttccccatcatcttcatcaccctcttctttttccgtttctccatttccactgctgtttggtgtttctgctgctgctgctgcttttctttgttgtttttgggcaggtctgcgatttgataatgcccccgccttttgtgtgtagtggtgtctttgcctcctcaacccaaacgctgatggtacaatgtttttctccaatctttttggcgttgaatgatcgatcgtttgcggcggcggcggcggcggcggcggcggcggcggcggcggcggcggcggcgttgctgcatttttttctctctccttttcgtgctgaagtcgaacattgatcggctgctcctcctgctcgcgcaccagtttgttgagccgtttgaattcctgatggtattgcgcggccttctgctcttcgttcagctccctgctgcgctcaatttgttggatgcgcgagcgcaaaagcccaattggtgtgccgtcggcaccgtctgctgctgctgctgctgctgcttggggttgaacaaataccgactgaaagacgtcctccgggacgagaaacattcgcattgcgtgacgcattttttttgcgctctcctcaaatatatgagtgttcctgttgtttcgcttttatatatttatttattaatttcccc

SEQ ID NO: 37839 - DNA, 1039 bp, Heterodera glycines
  misc_feature (1008)..(1009): n is a, c, g, or t
atgtgattttggcatttgtcgtgtgaattgatgaattgtcgttcatcacaattgatccgagaccggttttatgtttttttattgaaaatgaaatttaaaaaaataaacatctatatattcccttaaaaatttcacgattagggatgcaaaaaatatgcatataaatcgtaaaatatgcatacaaatcgaaaatatgcacataaaaaatagaaaatatgcatataaatttttccaacgattagataatgtaaaatttgttaaaatttcattgaattcattaaatttaagcttaaaaatatagaatatggtgagaaaatagattttcgaaaaacaatacaaataaaactatattaattttgaagaaaatagacgagaaaattttccattttgaaacttatttttggcttaaatttcttatttttaaaaaaatattttttaaattaatattttcgagtaaatacgcaaaaaagaaatttttttgaaaattttccagtccatcctagaagcaagctttaaaacaagctaaaaacatgtttttcgtccgtttcaggcattccacagatcaagaaaaaatatgcatgtgtgcatactaggtagagacatgaaaatagtacgccaaaaagagggaaaaacaaatgcattttcatgtttctttttatttgtaacttttgaattaaacgtataaaaaaaatgaaaatgtattaatcgaataaaaaaaaatttcactctcgatatgcaaaatttggtgtggatttaacaagcagaaaaaaagttgaacaggatgaagtaaatgttgttttttcattaaaaattggagagagatagtacgccaaagtgagagaaattacaaagaaaaagagcaacaacgagatagatgtactaggcctttctctgcaccgtggagttgatcaaataatgcccctctgtcttttgcataaataccctcccctttcctcccctcagtgttttttctccgttcattcattcatttgtttcccttttttcccnnagcgatatcgtcgccctttgtccttttctg

SEQ ID NO: 37840 - DNA, 702 bp, Heterodera glycines
atttgttggcggcggtgcccttcctccgttggcatttccgtctccgccaccgccaaaattgccaacacttgcggatgggccgaacccggcttgccttttgccgtaccatccgccgtagggataggcatatgcgtagccaccccacttaacgaaatacaaatttaaaatttaaattattttaaaatttctcacataagcttgggactgttcaatggccaagccaatgcaaaggacaagaagaaaaagggaaaagcttaaaaattaaatttaaaattggaaaatgattgacaaattacattttgatggttgaagaagaagccatttccaatgataagcagcgaatgattgactttttgcagaatgaatattttatgaatgtgcgaaaacattttggagccctttaaatactttcactttttggcaaaacaaatatttgctttttatgtgccataacaattgtcaaaatcagtcccaaattacgtcctattttcgagatttcttgacaataaaaggcaaataaagcgaacggatcactgggatttttagtggtgatgaatgtcatccattccaccattctcagcacattttgcccaaaatatcagaacaatgaaacgaaaagagttgtcgcgcggtgaaaagggaactcaaacaaaaaaataaaaataaaaacattcactcgcgtataaaaaagacagaaaataa

SEQ ID NO: 37841 - DNA, 1086 bp, Heterodera glycines
  misc_feature (741)..(741): n is a, c, g, or t
aatctacacgggaacgggcgtggaacggagcccgcacaatttcataaacatttaaaggcgtagttcatttgccttctccctctcccctctgtcgtttctttcccaccccctcttcaccccgaaaattttaaatttcatgcgattttctagagaaatttttgaaaaaaagccaaaaaaatttcaaacagatttttttctaaaaaattattgtttttttcaaggtgggaatgacttaaatgaatgcgcaacttttcttaattttccccccatttttttgccaggaccgttgaggagcttcgcctgaagagcaactccgacctgcacaagctgtggtacgtgctgctgaaggagcgcaacatgctgttgaccatggaccacgcgtacaaagtgcgccttcgcaacatgccgaaccccgagcgaattgaccgggtggccgaggtgtgcggtgtgctgcttgctgatcataggatcatagctgtgcaaagggggtgggggggttgtgaagccgaacgcaaagggtcggcaggcatcgatcacatgagaacggggagggtggtcgagatgaatgaaggagaaagggaaaaaagcgagaaagggagcgtcgagatcaaggagagggtcgcgcattgcgttcgactaacccttaatgagggatttatcgaacgcaaaagaggagggagaaaactcaaattaagacaaattttctcgctttaaactcccgcatttttatgcacacatacncgtattttttgattattacaaaatcgaaaaatacggttggcttttcacacacattttctactgataatgacaattagtaataattgtcaatttgattccattccaagagcatggaacgccttgaggcggtggtgcacgaacggaacgacgcctttttgcagttggagacgggcgacagcgcgtcgcccccgaaaaggacggtcacttccttcatgggattcacctacgagtgagaaaatgttaaaaaacaaattaatattatggcattttttcctcaaaaacctttaaatttgttaaatattatattttggaggtttcctgtttttgaaggcgtgcaactgcatt

SEQ ID NO: 37842 - DNA, 1394 bp, Heterodera glycines
  misc_feature (989)..(991): n is a, c, g, or t
  misc_feature (998)..(998): n is a, c, g, or t
  misc_feature (1013)..(1015): n is a, c, g, or t
  misc_feature (1020)..(1020): n is a, c, g, or t
  misc_feature (1024)..(1026): n is a, c, g, or t
  misc_feature (1031)..(1031): n is a, c, g, or t
  misc_feature (1035)..(1035): n is a, c, g, or t
  misc_feature (1045)..(1045): n is a, c, g, or t
  misc_feature (1050)..(1050): n is a, c, g, or t
  misc_feature (1055)..(1055): n is a, c, g, or t
  misc_feature (1073)..(1073): n is a, c, g, or t
  misc_feature (1089)..(1089): n is a, c, g, or t
  misc_feature (1096)..(1097): n is a, c, g, or t
  misc_feature (1099)..(1099): n is a, c, g, or t
  misc_feature (1106)..(1106): n is a, c, g, or t
  misc_feature (1119)..(1119): n is a, c, g, or t
  misc_feature (1124)..(1124): n is a, c, g, or t
  misc_feature (1136)..(1136): n is a, c, g, or t
  misc_feature (1142)..(1142): n is a, c, g, or t
  misc_feature (1148)..(1148): n is a, c, g, or t
  misc_feature (1151)..(1151): n is a, c, g, or t
  misc_feature (1154)..(1154): n is a, c, g, or t
  misc_feature (1157)..(1157): n is a, c, g, or t
  misc_feature (1173)..(1173): n is a, c, g, or t
  misc_feature (1180)..(1181): n is a, c, g, or t
  misc_feature (1184)..(1184): n is a, c, g, or t
  misc_feature (1186)..(1187): n is a, c, g, or t
  misc_feature (1192)..(1193): n is a, c, g, or t
  misc_feature (1195)..(1196): n is a, c, g, or t
  misc_feature (1212)..(1212): n is a, c, g, or t
  misc_feature (1226)..(1226): n is a, c, g, or t
  misc_feature (1236)..(1236): n is a, c, g, or t
  misc_feature (1245)..(1246): n is a, c, g, or t
  misc_feature (1252)..(1252): n is a, c, g, or t
  misc_feature (1255)..(1255): n is a, c, g, or t
  misc_feature (1257)..(1257): n is a, c, g, or t
  misc_feature (1262)..(1262): n is a, c, g, or t
  misc_feature (1276)..(1276): n is a, c, g, or t
  misc_feature (1278)..(1279): n is a, c, g, or t
  misc_feature (1293)..(1293): n is a, c, g, or t
  misc_feature (1296)..(1298): n is a, c, g, or t
  misc_feature (1318)..(1318): n is a, c, g, or t
  misc_feature (1324)..(1330): n is a, c, g, or t
atttcctttttttttggtttgccaaatattgacataatttaaatatgaaatctaattggtcaatttataattaaaatactttaaggctgctatcccaaactcggcatcgtttgactcaacattaaatggacccaccatgccgaacacgtaccagcaggacaacatcagcaattccattgataaaccaccacaacgcgctacaaaaattgttcaacaacgtcccaccactttggcacccattggtggcacattcattggcacttcacaacaacaatgccatcaacggcaaacaccacaatgtatagaaaatattgcttttattttaagtatcgagacaataattatttaacatagaagcgatatttcctctgtaaattttggtctggatctaatcattttcggatgagttatgagtattaatttgctaaaaaagagttaatagaattgtaatttttttgtaaataattatttttgagaaattaaacaaaatttaattttttcgaaaagatctggcataattttgcttaaagtaacgaaattttagattcttttactttattcgatagccatgattttctctattagccttcaaaattccaaaaaatttggtcaccttaagaaaaagttgtatgaaaataagtattttttgccataacttatatgatttaataattttaattgaaaattttgcaggctaatagagaaaaacctgggctaccgacaagccaaaacaatgtaaaattttgttacttttaagcaaaattatgccataagcaaccaaaaattatcgggacttggcattatggctgaaaatgtgaaaaatggtaaagcattcatatttagcatttgatccaagccatcagctgccaccccatcagcttacttcaccaatatcatgttcatccacacagggcacaatttggcggttgtgccgtcggcaacgaattatttgagcaaaattcgtctggctggccttgtatgctttttcnnntggtggnttttggcctttggcnnnttttntttnnngtttngttntgccggttgnttcgncccgntcgcccgcgtcggcgcgntgccgttctcggcctntgccccnncnttgtcgnccgtctcttttgntggcnccgccgccgctnttttcngctggnggnggnccntcgtctgccggttgtngctgtcnncgncnncctcnncnncctctgccggtgctgntgctcggccggcgntttttgcttnttcggcgcnncttttncgntnttggntttcctccgccgtntnnttgctggtcgtgcnttnnnttctcgtgcccgctaaaacngccttnnnnnnnctcgtggcccgatgaggtccattagggcactaattgatattggagaacttagatttgcttggtg

SEQ ID NO: 37843 - DNA, 1667 bp, Heterodera glycines
tggcggagggtggaggaatgaagcgcacttcacatacaactctaatccgtttaaatttgaatgacaacagacaaatagcggcgtccctaagctaaaaaagcgtcgttttgtgacgccacgacccaaacgggtcggggtcaattcggcgcggaccatttcggcgccgcaaattttgaaatgctataacttttttatttgtcagttagctttagccaatctggcatcatttgaaagctctatgtgtgctctatatttacatgtaaaaatagaaatgaatgattcaaaaataaaaaagttatgccacgcggcgccgaaaaagccaagaaaaagtcaatttttgaggttttttggccataacttttttgtaaactgacgaaattttttgaaattttacaggctaatagagaatctgaagagctatcgaatgataacaaaaatttttaatttggttgatcaggaaaaaagttgttagcaacggcgccgaaaaggccggcgccgaagtgggcggttccccccccccccaaacataatccatccaatcagtgggcattgccactccccccgccacccttgacaacagtgtgcgggggtacacaacgttttccctccctccgaaaatggtttaaaactgaaattccatattttaaatatttttgtgaaacattttgaggaatgtttttgcttcggctaatttcgaacacctgacccggattcgacaaaattcaatattttgaatttttcgaattcgaaggattttttgggttgttggcaaagggccaactgaagcggctgttcaattttgtaattattttggcaattttttcctctgtgtttactgtgttatttatttatttttcttgtgccttaaagggtaattatcgggcggaattagcgaccggcggcgcattttgttgacgacgacggcctattggagaaattgttggcatacggtagagtgttttgtttttttcacatgactcgtggatggatcttagttcataaaaacggctttttgggtcgtaaaattcgtttctgacatctgtttcgtctaatttcgaactgctgactcggactcggaacaaaaatggaaaatcctattttcgaaagaattcaaaatattgaatttttgttcgaatccgggtcaggtgttcgaaatgagccgaaacaaaaacattcccaaaaatatttcataaaaaaatgcaaatatggaatttcagtttcaaaacatttttcggagggagggggaacgttgtgtacccccgcacactgttgtcaagggtggcgggggaagtggcaatgcccactgattggatggattatgtttgggggcgtggcgtcacaaaacgacgcttttttagcttagggactccgctatttgtctgttgtcattcaaatttaaacggattagagttgtatgtgaggtgcgcttcattcctccaccctccgccaaaaaaaaataaatttaaaaatcgaggtttggaaaaaaaacgaaaatttttaccacccctctcacattcttctccatctttcagtgagtacgacttgcccttcgacatgtgcgtgtgcattgaccggcagcagttctttttcggccgatgtcacaccgttttgggccgtaatccgtccaccaaattgccatcaatctgtcgcaaagaggcattggtgga

SEQ ID NO: 37844 - DNA, 948 bp, Heterodera glycines
tttccgtacaatcggaaaatttctgtctctcaaataattaccgatcagatcagtccatcagccacactcacttacccgattccaatttgccctgaatacaagcgagaaaaagcagcttctgcgcgtcaattccctcatcatctgcagtttccatcgcttgcgcttctgctgataaaattggtagcaacgccaaaatgccaattgaaaaagctgctaatttggtaaaatttgctgacaatggcattccaaagcgataaatttccacgttcccgaatattaaaaaaatacaattttttgatttaaaaaaaaagtgaaatgagtgctttcgttttgtgtaaaaagtccgttcaagttcatgtgtcaaaaggaggagctctcggaaaatacttaacaaacaacataagcaataaaatctcgaaggaataaaaagtcacacacaaaaaaaaccaacatatcgccataaatttgaaaatttgagagtttttggtagcagttttagcaatttttgaagattttttcttaaaattagaacaaatcagcatcttaaaaaaaaattcaattttgacccctttaaaactgctgataatcagcagtgctgctggaagtcctggttttaatgtacaaaaatatttgtaggtgcttaaaagaattttttttttataaaaaggaaaattttggataaattttttggaaattaaaaaggaaaatttttggataaaatttgttggaaattaaaaataaaataattttataacttttttggcgaaaattggtaaatattaagcataggctcccaaactcaaaactggacagtcttttgggatcgatttaaaaaagtagattcagggtgcttagtatcctaatttgcattttttttgtttccatcgttttatatcgtcttaaatccattccgaccgtgtttaagcagtttttaagttttggagctac

SEQ ID NO: 37845 - DNA, 832 bp, Heterodera glycines
agaaaaatggctatctctttttttgagaaattttatacctatacaaatgcgcttgcgtatgagacggagggcggtgcacaatagacattttatttcacagaggatttttatatttagaggttatcccagaaaaatggctatctctttttttgataaattttatacacatacaaatgctctcgagcatgatagggagggcggtgcgcaatagaccttttatttttgagggaatttttaaatttatactctatcccagaaaaatggctatctctttttttgagaaattttatacctcacaaaagcgcttgcgtatgagacggagggctgtgcacaatcgccattttatttcacagaggatttttatatttagaggttatcccagaaaaatggctatctctttttttgataaattttatacacatacaaatgctctcgagcatgatagggagggcggtgcgcaatagaccttttatttttgagggaatttttaaatttatactctatcccagaaaaatggctatctctttttttgataaattttatacacatacaaatgctctcgagcatgatagggagggcggtgcgcaatagaccttttatttttgagggaatttttaaatttatactctatcccagaaaaatggctatctctttttttgataaattttatacacatacaaatgctctcgagtatgatagggagggcggtgcgcaatagaccttttatttttgagggaatttttaaatttatactctatcccagaaaaatggctatctctttttttgagaaattttatactcacaaaagcgcttgcgtatgagacggagggct

SEQ ID NO: 37846 - DNA, 952 bp, Heterodera glycines
ttatatacctcgccgttagagcactgccgagatcggccattacttcggttggcaatttgccagaatttgggccaaattttgcgttttgcccaagacttaatggcctcgcaaagagaattaaacaaattttgtaaaaaaatttttttgaacaatttgaattaatcacatttttgcaattatcaaattaaaatttgtagatataaaaatacgaggaagaaaaaattataatgaaaataaatagttaaactctaataatttagaaatctatctgttttttcttagctagcaaaattgggccttttacaactaattaggtaattatataattgccttcccaccgccttcgctccttttctgctgaaaaggaagaacacacgcacgcaatttcgtaaaagagaattaataattagataattaaaatgttttatcatcaaagaaaggcacattttgcaatttttttttttcgtttttcatcaagcatcgattgagaaaatttttgggcaaatttggggcgtaaatttttggattgtgagaaacagaggggcagagagagagagagagagaaacactttagtgatacgagagaaacagagggacagcgagagagacaattcatttttgagagagcatcaacataaccggttggggtcaagagcagcacagcggaacaacggcacaatgtgaggacaaagatttaaagaaaattaacaaatcattctttcggacggtaaaagagtgattttttctggacaaaattagaatatagagacatcctttcggacgggaaaaggatgtgttttttttgttgatatttttggcaaagcaccccctaattaaaaaaaaaaattaatgacacgaaaacacccttttggacggtaaaaggtgtttttgtttttaggaattttcatgtttttcaattcgagtgcttaatgccaaacctaaaatgtaatga

SEQ ID NO: 37847 - DNA, 977 bp, Heterodera glycines
  misc_feature (54)..(54): n is a, c, g, or t
ttgtgcctgttgatcatttcgcacaggcacgccactgggttagtgacgcggtgnccaggcacagttccgcagccaattcaccctcgtccacggtggcaatccgagttctgcatggaaaagagctgacaatgaatgctaattgactaaccatcggacggacgaaatcaaatagctgagctgatttcccttcccctccccgataaatttatattttcgaagtttccagtttttttaatattaatttttgatttttttttgaaaatggtaataaaaaaaatgatgaatttgaggacaaactggttgagcatttggccaagccaacagtgcagccaaatgtccattcccagcgacacattgcaacggttcacatgcgcaacagcgttcggactggcccagccctgttggttggcgcacagaaagacctggaattttttaaaaataacctaatatttgaaatttatttttattaaaaccgctatttttttttttgcatgccaaagaaaatgccgaaatttcccgtacacaattcactgtcccccgcccgaaaaattttaaaaaataaagtttttttcatacaaatgtgccaacaaaatgtttattttcatcgctttattgttgttgctgttgttttttttgccgtccattctcacctccttcagccgctgcttctcctccttcagctcgtccttgtccgtcctcaacatgctcagtttgcgcaccggcagcgcaggcaacggacgctgggcaaagcctaggagaaaacaaaaccatacaaaaatataaagatatctcaatttaatttaaaccttccaagacattaattagtgattgatggaaggatgggtgattaagtcgagaaaaatgtagaaaataattaaaattttaattggtattaacaatgtgtccaaaaggccatgtagtatgcggggtattgcttattttaaaatgttgaatatcatatcaaaaattttaacaat

SEQ ID NO: 37848 - DNA, 1009 bp, Heterodera glycines
  misc_feature (858)..(858): n is a, c, g, or t
agtcatcgcccgaaaatgacaaaaaaaaattgggaggaaaagcaaacaaaaagcacaaaatgttatcaccaattggttaattatcatcaatcagcacaaacaatgaaagaagaagaagaagaagaagaagttgttcaattgtattttgaggcaaagcaatcgaaaaaaagaagaattcaatggccaaagaacacagtgaaaaggcaacacaatttgagaaaagatcaaacaaatacaacgacacactcattaagcaattaattaattatgtcattaaaatttaacaaaaatcttttccttttgagattaaaaatgaaaaaataaatacaataaatacatttaacaattttatttctatagaaaatgttgcaaattgtcgctagtctttttcataatgtccttatcagcttatcactttacaatatgaaaaaagtgagcaaaaaatcgcatgtgacaggattcgaacctgcgcgggtcaaaccctttgcgtcttaagcgcaacgccttaaccactcggccacacatgcagtggacaacggacccaaattatcattttctgtgtgaaagggcataaataaataatcagtgattggtatttgaccacccgaatgtcacgccaaaataagcacaaaataatcaaaaaataaaacaatttattaaaaaaatcaccgaaatagtaaaaatatcaagcacaattattctgagatcagaacaaataaacatattttcaattgatgcgtccttttcacagttgagttgcgcgactgatctgaaccggatggatgccgcggcttcgcagcaactgaacgaaaaggcgcacattttatacgaaatataattaatttaaaatctcattanaattttccaagaattacttagataattattatgacatgccattgttcgaatgcaatttgttttttattttatcccggagaaacagtacacttctggcacttccaccgtacctcttcgaaactttcgtcagctttgtcaaatgactgtgccg

SEQ ID NO: 37849 - DNA, 1432 bp, Heterodera glycines
aatcaataactggttctgatcagctaggataaaaaaaaattgcaattgtttgggtgagaaaattctcggtttttttttggcatattgccattaattaaaaaatattattctattgttgctattacatacatcgacaatacggtcggcgaactctttgccggtccgttggagatcagctaagggatgggaaatggcaatttgttggcattttgcacacaggaaaagtgccatcaccaaaaggcaaagacacacccacccggtacctaaacccgactttttgaaaagtccactacacgaaatctgacacggatctaatcataactcagccctcgaatattgtaacccccggcattctcaccgtcgccacgtgagtccaattcgggcaatggcacaattcgcttgctgagtacttcttgccgttcttgctccttcatcatctgctgcttcttcagatcttccgctgctttcaacatcaacaatttctggaaacggaattttcactcattttatggctccaattttatccatttatcttttatttaatcaattgtcagttgtcagttgtccgtctccatttttaatgtcttaattacttaataatgtctcacattccttttgctttttgtccatctaattacataatgttcaatgactatttactaattatctccacccatttgtctctcattatccgcttatcacttaatcacattcaaattaccgtctcccatcctttttgctgtcattatccgcttatccaattaattaacatttgctaattaccaaatcccatccttttttctctctttatccgcttatcacttaatcacattcaaattaccgtctcccatcctttttgctgtcattatccgcttatccaattaattaacatttgctaattaccaaatcccatccttttttctctcattatccgcttatcacttaatcacattcaaattaccgtctcccatcctttttgctgtcattatccgcttatccaattaattaacatttgctaattaccaaatcccatccttttttctctcattatccgcttatcacttaatcacattcaaattaccgtctcccatcctttttgctgtcattatccgcttatccaattaattaacatttgctaattaccaaatcccatccttttttctctctttatccgcttatcacttaatcacattcaaattaccgtctcccatcctttttgctgtcattatccgcttatccaattaattaacatttgctaattaccaaatcccatccttttttctctcattatccgcttatcacttaatcacattcaaattaccgtctcccatcctttttgctgtcattatccgcttatccaattaattaacatttgctaattaccaaatcccatccttttttctctcattatccgcttatcacttaatcacat

SEQ ID NO: 37850 - DNA, 421 bp, Heterodera glycines
ctgacaatgaggcaaaggcactgcatcggtgcgtcttctggtcggccaaggtaggtagttcggccttgtcccagaccaataactctaaaaaaaataatcagcttatcagtcatttttcgggaggggtggggagtacgggggaagttgtgtgaagcgcgcacacgaaaagggtggcaggaggggccttttacccctcccgaaccgctgacaaaaaaaaattttttttttttttgaaaaatttctttttgaaatttctttacactttttcgctggggggggggggggaaggacgggggaagttgtgtgaagcgcgcacacgaaaagggtggagggaggggccttttacccctcccgaaccgctgtcaaaaaaaattttttttttttttggacaaatttctttttgaaattgctttactctttt

SEQ ID NO: 37851 - DNA, 1586 bp, Heterodera glycines
  misc_feature (14)..(14): n is a, c, g, or t
  misc_feature (60)..(60): n is a, c, g, or t
aaaaatgcaaaganagttctcgaaaaacaaccaaaagttacaaaaccaacccttattttntaaacaatttttttgaataataagcaatttaaaaacggttaattttaacgaaaaaagaatcatttcactttatcagagacggatttttagacaccaaatttttttaaataggcacctaaaatagacacgaaaaaggcttaaaaatgtagaaaagaataaaaagcacaaaagattgaaaaaagcagtaaaaaattgatattcttggattaatatgttgctacttgtttatgtagagtagggccgaaaaccaaccgcgggggaccctttttttacattattaaaaaaaatctcttggcaagtcaaaagccttcgcaaaaaaaagtaccaaaaaattaaagctagaggtttcaaaccaagttaaaaactcgttcttcgtgcgcattaggccgtagcaagttagcacaaaaggcatatgcctcaaaatacaggttttgtatcattcgaaagcaaaaagtctcaaaaaccacaaatttttaaatttttttttacaaaatttgttagcaaattacatttttttctaaaatttttcccggtggcgcctatcggcatcgcccgacctcctgtttctcaagtttttggaaaaagcgcgctgtacaaatcattttcattgattttttcatttggtaaaaaatttcccaaaatgctgattttggatcataatgttaatttttggttggccaatgctgattttgaaaatcctgtgttttatcggtttaagatgctctttcatgtttttagagttttcttagtgttacaatttgttttgcaaaaatctaatttttcgggtctagatctgtgaaatggagggaattgggtgacaatttgccaccgacacttagaaatactgaattaacgcaatttttaggcgctcacaagaagcaccagccaaaaattcaaatgaacgaaaatgactgaagctgtgcgcatgcactgaattgagatgtatattttaatagttcttttgtatgggatgcatttggtagaagagaaatgaaaaatagtgtgggaaaagaagagaaaaagacaatgctcagagttttcccctccatcttttccccttttctttttcaatgctattttccactttttctgttaatttaaactaggggttggatcgaatatttttatttttaaaataagaacattgcaaaattgcttttaatcgcttatgtaacaatttattaattaatatagcatcaaaaatcatatttttcatgggtccagccagtaatgtaaaacgacgatctttttttcaaatcaccttttttcggcgcgctttttcaaaaaacaatttcgtggttgatgggggtccggcagtgccgataggcgccgccggaagttttttttgaaattttgtctagatttataacagattttgttcaaaaatgaccaaatttttcttaaaattaaaaaattctaaacaaggtatacattacgtcataaaatgtcaaatatttttatgtatttctgtattttctatgcagaataagaacatttctttataacaagaacaaatccaaaccctg

SEQ ID NO: 37852 - DNA, 1236 bp, Heterodera glycines
attaatggacacaatacttggtatgagaactttttaaaataaatctaagggatttgaatttaatagtaaacgcgttttttattcgtacacagtaaatacaacaacacaaaaattaaaaataataaaaaacgtttattttcccattatttttcttccatcgacgcgcggagcgtcgcttcgtcccacgggccacggattggtgctgaaaataaaatttgtgtacaatgattttccaatcacttcagagaaggtcagtgaccacctttttaggctttgcattcgaatgaaaagcaacggacagaaaagggcgacgaacaaatggagaaacgagaaacataaaggcgaattggagaccaaccaaaagggagagggcgaggagagaaaggacggagaaacggcacgaaacagaggggcgacagaaggggccaacgcgcaaaaagggctgatcgaatggtcaaagtaattaggaaaatgactaatgaattgaattaaatcaagatgcaatggcctgtttggcattgtgtttcttttttatttcaccgtttctcagtcgaggccaaaaacagaagagacaaagcgaaagtgcgagcagaagaaaggccacaaagtcggattggagacgagaaatcaaaaaaacggaagcggcgaggcaaagatttgccgacaaaggcaaactgacgctaaaacgggaaatgccatcgttaaaaagaaaataaaacattggcacgaacgaacaccggcacatttatgccgtagtcgtggacaaaaagactggcgaaaaagagcagaatggcacaggcgtaaatggtgtcagtgctaattgaagtggtcaatgtcctaaaattgcaattaaacaattattggtcatttatccccctttctcaccttatcaccggagtaaaagcgtaaccaaacgcgagaattgtgacaaaagttcggcaatattcaacaaaatcggaagacgaaatttggaacagatccgacgatcggagaagcgcaaaatgagccaaaagagtggcggaagaagcgaaggaacaaaagcaaaacaaagcgaagggaccgaagacatcggaatggacaagttcaaagcagcaaaggaacagaacgacgaggtcaaaatgagccatgacagtgcacgcggcacaaacggcggaagaaaaagtgaaagggacgaagccaactgaaaacggacagtcaaaaacaaaacaaaaaagtaaggcaaaagccaaagagact

SEQ ID NO: 37853 - DNA, 756 bp, Heterodera glycines
tcgaatctcagtatttttgtccccggtttcctagtcttttcgggctaacgaattccgattttttgggtttttatttttgataggccgggttccgggtttcagaatttttaagaggcctggcttccgctttccatgaatttttataggacatggattttggaatttcataaattttcaggggaagggaagggggaggggggcctccgattaagccactgttggtgggtgggctcttatttttgccaaaatatttaccgcaaaaagcggttcgccgttgaagaattcggcaaaaatgcagccaagtgcccacaggtccaccgccggactgtattgggtggcgccgaacagcaactccggcgcgcggtaccaacgggtggccacctgagcgcgagaaaacgaagaactgagtgattttctggtcactgatcagttgtgtatgtatgtaaataaaaattaattgtctgatctatgactaatcaagattctctgtatgtggtacattcatggaaatttgaaaaaataatctgaaaatttgattaaaaattttttactgaaataaaagagacctagatgttttttaacccccgcccctcaaagtggggggggggggggggggggagtatttcaggggttctaattcagggaggcttaagaaatacgatagatttacgcttcgatggactatttggtacctcctccaagacatcactcaccacaattgccaaaaaatttcgccaaatttttcaacaatacatc

SEQ ID NO: 37854 - DNA, 923 bp, Heterodera glycines
attttcggaatagtagcgacgaccctaatttttctggattttctttctgggcgagtttggctctgaaaattttgtaaaaacgtctatctctttttctgctcaacactcacatgaattccaaccacattttcggaataatagcgacgaccctaatttttctggattttctttctgggcgagtttggctctgaaaattttgaaaaaacgtctatctctttttctgctcaacactcacatgaactccaaccacattttcggaataatagcgacgaccctaatttttctggattttctttctgggcgagtttggctctgaaaattttgaaaaaacgtctatctctttttctgctcaacactcaaatgaattccaaccacattttcggaataatagcgacgaccctaatttttctggattttctttctgggcgagtttggctctgaaaattttgaaaaaacgtctatctctttttctgctcaacactcaaatgaattccaaccacattttcggaatagtagcgacgaccctaatttttctggattttctttctgggcgagtttggctctgaaaattttgaaaaaacgtctatctctttttctgctcaacactcaaatgaattccaaccacattttcggaataatagcgacgaccctaatttttctggattttctttctgggcgagtttggctctgaaaattttgaaaaaacgtctatctctttttctgctcaacactcaaatgaattccaaccacattttcggaatagtagcgacgaccctaatttttctggatttctttctgggcgagtttggctctgaagatttgaaaaaacgtctatctctttttctgctcaacactcacatgaattccaaccacattttcggaataatagcgacgaccctaatttttctggattttctttctgg

SEQ ID NO: 37855 - DNA, 515 bp, Heterodera glycines
tttaaagtagggttcgagccccgtggggcgggggtggcttttcgcgggggcgggggttggcgggggtcatagtcgcgggggcgggggcacgataattcggccaccgcgggggcgggggtttgctttgaattagctccaaaaaaaactattttttatgaatgatttctttggctccacattcctttattcgttgatcgccttgattctatttattttgacataaattgcacagattttgactaaaaataaccaaatttagggatttttaggtaattttttaagaaaaaaaggtttttttttggggccggcgtgccgatagggcgaccaaaaaaattaagatttttctataaattttcgttttttaactttattaaaattatcatgatttactcaaggaaattaaaactcagacttttaaaaattttccgccacatttttccaaaaaacttgatgaatgtgcgagggaagaggtccggcggtgacgataggcgccgccgggaaaattttaagaattt

SEQ ID NO: 37856 - DNA, 949 bp, Heterodera glycines
  misc_feature (842)..(842): n is a, c, g, or t
ggggacctctagagcaatttttgggaaaaagaaaaaaactggtagagggagaatttgttcaattttttcaacaatttcatacatatcagattccaaaaacttgacaaaaataagacaattagttcaaaaaattcgtttcaatttcataaaaatttgattttcgaggtggaatggatgggtgttatttagaaaattgtgaccccacccttgtccatccatgtgtgctcgagagtctcggcaaatgatgccatggtaagcaattaacagacccaatccaagctctccatcttgacacatcaacgaaaatggtgaacggagcccgtcgttcccaaatcattcgcactggcaccgtgatccagcaaacaacggacaatgttcacatgagtatcctcctccagaacggcatgatacaacgcggaaaaccctaaaatttcaaaagactacgaaaagccaaccgagataaattggaaagttcccgagaaattatgacacaattttctgatggagtgccgtcccagttcaccccaagaggtcgccaccaaaaaatataatcaattttagaaaaccataagaatttaaaaaaaaattattttgatgagtaccatagaaacagtcaatttttgatcattttcacttgaaatacggtagaaatcagtatttttgagatttccaattttgacaccctatagcgctctgcgggtataggtcatagacgaaccatccgaaaggcaattcggtagagaaaaatacgacctttttaaaatcattcatttctgagaaataggattttttttaaatttgagtctgccaacacatggccagtttaatcaatgtgttattanaatagttaggtatttgataatccggaggtaaaaattcaaaaattttgtcaaatattcgaaaataagggcatttgaaagtaatggttaagctgccgccgcccccccct

SEQ ID NO: 37857 - DNA, 958 bp, Heterodera glycines
  misc_feature (944)..(944): n is a, c, g, or t
cagctttcttctggctcctcctcgtccgcgtcgggtgcagcagcgggacgcgacgtgcacgtgcggacgccactgaacgacccgcggtcaccgtttaagccattggcttacacatcttttgagccggagaaacaggcaaatggaaaaatttatcaaaaaatgatgtgttttaattaaaactcttcatatttcatttaaatgatgtctttagtggagttcttccatatttaacatttcgagatttcttaaatatctcagtattttggcattatgttcatgtttcgcacccatttctgctggcatttaaaaaaccaaaaccacttttcgattagatttttaactgaatttttatgcattttaagagattttgagaatgaattttatatccatataatccaaacctctgtcatatctgtctaaagctaggcggtccatgataagtgtattttaatttgcattatacaatttaagatttaaaaataaacgtacctaaggcttgaattaaattttcttgtcgcattttttcaattaattcaaataataacaataggtgacaaattttccaagtttcaattttctcaggcacaaattcgtcttgaaattggctcaaacggcccctccggcatccgacgaatggtcgaccgctttcagaagggtcaatgtgcagcagttgaacaacagcaaaaacagaatgaactgaacaacacgaacaacgatgaggatgcagacgaacacgatgagttggtgcagcagcgccagcagagaacgccaattgcgccaataatgcgccaaaattcgctccatacgctcccagtgagttgaaagagcatgggtttttggtacggcattttcttgttgttatctgagagtcgagaagaaaactccaaaaaaccgagaaattttttcactctttgtaaaaatttatttggctattttcctgctgnggactcatctgcat

SEQ ID NO: 37858 - DNA, 1198 bp, Heterodera glycines
  misc_feature (1131)..(1131): n is a, c, g, or t
  misc_feature (1137)..(1137): n is a, c, g, or t
ctttgactcagtcgaaaagtgactaagaagagaacaactgtattttttagctgacgcttattttaaattttgagtcaagtctcggcgatttttcggcggcaaaattttgaggtgcacccctcaaaatagggccccttttcctctaaaagtgggacaacgccgcaaatcaatcggaagtataaattaaaaaataacaaatgtgaatagaagaagatggcacatacttttttaagtcactcgataatttaatttagtgagatcgtaatctcaatatttgattgagaatttttaaaaattacaatttattataaaaaagatgacacggagccgttctctgtggaaatttaaactttatgggtgattggaggtgtgaatagggcaattgtgaatgagttgagaaaaaaccaggaggagaattagagaaagcgtaaatagcacagcgcagaaaaagggcgagaatgaaaacaatccctttgtcagagagggggattttgatcaaagaaaaggaatggcatttacaaagaaattgcattttattatttgagaagcgggagtagggtcgagaaatacatttaggggggggggggggtaagcccaaagtgaatgatttgccacctctccttcccttattcacctgttgacttttttgaattggcactaatatccaatcccatacgcttctcaggtgccgctaccacaaaccgcccatctactgtcggtttaagcttttgcatgtgcctgccaagaacgtgctttaccatcgcatgtcccacaaccatccgatgccgttgagcactgagttggcgatgcgttttagacaaaaacagagaataatgtataagaaaaaagtgaaaatggtggcaaaagcaaacgaccgcacaaccaatggaaaggaaaagcgtgggcagcagaggaaaaaacagaaagtcaagcggagaagcagcagcatcggaatttctgacggagctggtggatatttttggatttgcctctaattagtcgggataatgacaatctaaagaaaatgacacaattaaactacattttaggggggtcttacctgatttcattttggaatatgtttttgatttgggatatccactacgctttgttaggccaaggttcagcacnccattnccattcgttgattaaaaaaattgagcaaggatcggtcgcctatgccttttggggggggggg

SEQ ID NO: 37859 - DNA, 1020 bp, Heterodera glycines
  misc_feature (926)..(926): n is a, c, g, or t
  misc_feature (939)..(939): n is a, c, g, or t
  misc_feature (946)..(946): n is a, c, g, or t
  misc_feature (948)..(949): n is a, c, g, or t
ttgtccatcggagcctcgtgcgaattgtgaaagtccttctaatgacgaacaatcgtctcacgcgaaaagtgaccctaaaagacaacataaatgtgaacacagtgggagaccaagtgaattccacaataccaagttgcactgttggcacttgaacaggtcgcacccctccaagtgagagtaagcgtgatcagacagacgattgatgacgagtttgccacatttctgaaaaaggggaaataaatacgaaaaacaatgaggaaaggcgacaagggagcatagtgatttttattgtatattttagctgtcatatgataaatggggtaaaagacagcctccgatcagtaaatcatttcgtattgcccagcaattaccaccacattttacctcacaagaaatggcttcgttgctgcgcttcttgaaatactgagcaccgccaagtcgcatgctgacctcgcgcagtttgatcatcacatcccgcgccttacgcgacattggcttcctacccctggaataaggtgaagccgagcgatcccataatgacctacgataagtgttgtgtccaacaccagattagtttttcccggttttaaagcaagaaaagcaaaactcttatttgttaaagaccaaaagtttattaagcaaaaataagaaagcttcaggcagggaacctgaggtttaagaaatggtaaaggaaagtcctgaatgtgagggcaaaggcatcgcttaaatactgacatgagtaaaggggaggagacgaacagatggacaacaaaacattacataaattgttgagttgtggaaaataggtcatcattgggggatctttaggatggacagaaacagagggacttaaggcaaaaacaaataaataaagcaaaagaatgattatatataataagaaaattattattatttcaaattgtggnatgcacattcttnccccttncnngcaagtcctggaccgtttcatgcttcccatgcagcctcagtgtccacggtgcgatgggcccgcgtgctgct

SEQ ID NO: 37860 - DNA, 822 bp, Heterodera glycines
ttttcttgcataaaaaatgccaaatacttgctatactttgctggcttttgcattaattaatgtccatagaatatttggcgattttgccgaccaaatccgtcatggaaagcgatagagccgaatcatttgctgatgaatgcgcacgagatgatggacttgttgcggggcgagtttaaaaaaatgggaaacagacaaaagcaaaagacatttgtggcacggattaaaaaatgccaacaaaattaaaagaaaaaacgcggcgatttaattcatttgttataaaaaatatactttttcaaaaatcaaaaatattaattagttttttaaatatagaaatcggacaaaaattctttctccttcatttattgggcacttatatgataagcaaagtgtgcagttacgacactttattagcaggtgccgtaatggcgcattttatgcaaattgaaaattctgccgaattgtacagtaattctgccaatattcgcaatgcatcaaaactgtgcccaatgcgtttgtttgtaggtgccatgttcagcagattaagggacgatttcgccaaaatcgaaggtagcgaaaagtggcatttcgatgtggtacgaggtctggcatatttggatttggaattttccgatgtcgcattgaagaaacgcagaatcagcgaagaacaatgcactaaaatgtgaggtttttgtgttcttaaatttaagtcaattttcgattcattaaattaattaaggaataatgacaacaacgcgaacaacccaaggcaattagcgaagttaattagcattaattggaatggccataaaaaaatatccctga

SEQ ID NO: 37861 - DNA, 946 bp, Heterodera glycines
atttgtagagcccggacaggaacatgagccgtgcaggattttccaggaatcccggtcctattcccgcatttttgaggggaatttgcagaaaataaatccagtaaaaacatctttttccgctggttactattcggcactattttcaaccctgttcctgttcggcattttcaaatttccgtgctttcgctttgtccacctgccgaattgcatgcctcctgtcctaactcagtctcttcctgttggccgttcgctgttgccactttcactacacattgcctgtgtcttttgcgtgtctcaaaaacactgcaagacgcacaattggtccattgggaccaatttgaccactgaaaataaaagggttttgtgtgtgtgtgtgtgtgtgtcgtttgtgtgaactgcctgcgggcatgggccaagaacgcatcgcttttgctctctcaaagcttccccgggaggacaaagtccgttcaagcatcgtcgaaagcgttgctgaatgccttggccacaggtccgggaacaaacgctccacagggaccacccactccacacgggcatgccgaggacgcgggaacagtcctaagaggcaagtggccaaggctttggctttggaattcacctgaacgttgcatgtcctcgcctgcttcccgctgttggcacatggtccgtctgcgcaaagtctttctctgaactgaaatccgatgccgcaactcactgagcacggttgccactgtaaattggcaaatgattttgcggtttttatcccccgggggtcggtaactcacttcgccccattgccctccgtcgttcactggtgacaattcgcactttgtgtcgttacatctctctctttgaactgattgtcccccacagcccaactcggcatcgcccgccccttctaacaaatgggtcattttcattaattaccttaatgtgcataattgcccct

SEQ ID NO: 37862 - DNA, 900 bp, Heterodera glycines
  misc_feature (12)..(12): n is a, c, g, or t
tgcccgcctccnccaattagaaggcactcttcctcatcattccttccctttccatttgtatcccttctttttttcctttattttcaccataatattacatttgctcgaaaagccaaaaaaggacggaccagcagcagcaaattggaatgagtggagaaaaaaccaaaaggaggccaaattcggcacgaatgggccaaactttggctcaaaaatttaaagtgaaattttaaatatttattttatacttttgatcaaataaaaataaaatatgccaccgtactaatattataagtttttttttgttaattataaattcacgcatcacaacatttggcaaattatcattggcttctgcctaattcctaaatggcatttggcatcattcatcaatcatttttagccaaaaactgacgcatgaaaataatgggagaaaaatgacagggaaaagagaaaaggaaaaaggcggaggggtgcaaagagagctttggaatatcattttaaagtttgaattaagttttaataagtggccaaaattgtgaaacttttcttttctttttcggaatgcgtcactttctctcccccccccccttttcccttcgcaacttgaaccaaaaatgggatgtgaaataaaatgatgaattttgcattgaaaattagagaaaaagctcaaattcccacaattttacgaaaatacaacaaatggaaagattggtatataagcaaaaaagagaagccatttcaaccaaaatgacttttttacatttattttaaatgccaagaaatgcaatattaatttattaatcaaaaattatgaattccgtcaatgtcaaaaagcaattgtgataattcttcttccgtttgtttattcattttcgttgttctacccctcccttactttta

SEQ ID NO: 37863 - DNA, 931 bp, Heterodera glycines
  misc_feature (898)..(898): n is a, c, g, or t
atttcgaaaaatttcgttaaggttcaaaaaaagttatggccagaagaattcaaaaagccagattttccaacttttttgggctcgaactttttttaaactcgaacaattttttttggaattttgtaggctaatagagtatcttaagggctctcgaatgataccaagatcgttggatttggttggaaaataaaaaagttatagtcaaaaaacatgtgctcgtacgaaaacggcccggccccttaattttgtgctttaataatttggaataattaaatgacttcattcttcactttgtccagctatcattagccactctataaaatagaaggcagaaatgataagacgagaaaattttgtttgcacaaatacatgcaagctttcaattttcatacccaatgggtatgttaattaatgagtagggctgtgaattttagtgacgaaaaatcccaaaatagttaactaaaatagtgagtaaaaatgtagtgaagaaatagtgacaaaaagtccgaaatagtgacgaatagtgacataattttcagacaaaaattaagcaaaaataatttttattcactgattgcagttgcaaatgagtaggactgggatttttaagggcaaaaaaacaaaataggtacataaaaaaataatttttaaaattaaaattcttgccacgaaaatacctttttgagaaaattttttcatttcttaggagtgctttttgaaattttttttgtcgattcttaggggtgtattttttgaaaaaaatttttaggtcgattcttaggggtgtattttttggttttattgcatttttgttaaagaattttccaaaaaatgtcgaaatagtgacaaaacgccaaaaatagtgatttttaactatttaagttgacgaagtcgccanaatagtgatttctagtgaccgataatgacatca

SEQ ID NO: 37864 - DNA, 935 bp, Heterodera glycines
agccggccaccaaaattggcattgcaaacgcaaaagcaccgtaaaatttgttggcgaactgtgcaatggcgaaaaattttaaatttgaatttgtgattgaacaaaataaaattaacaaaaaataattaaatataaattcccactgtaacagcgatggcctttgattcgagcagttcgtctggcgatgtgccagcatagaatgccacatttgcgagcacgtaaaacagggtgcacaatgtgcaggaaatgaaaatggcacggggcaagtcgcgcaccgggttgaccatttcctaattgaccaataagaaattaattatgggaatcaattcctaattggttacaactatcataaggttatgaaatgttttattgagttaaaaggtagttaaaagaacaaaaatcttaattttgcgagttttttgaaaaataaagtttgattaagtatggaaataataataataataataattttaactaaattattatcatttaaatagatatccgagtcaatttaaaatattaaaaaaaataaagaatataaatttaaataaaattctcttcaaggcgcacctccgtgatgaagttcaaatagttccacccgttgtatgcccaaagtcccgagtaaaatgcgatggcaatttgtcccgtgccaacactctccggcaccgtaaaagcatcgacgaacgagtctcgataggcttaaaaataaatattttcattataatattcctatttatttcattattttttttataaaatagtgtttttcatgttatgcggaatttaaaataaggacaaattttggcgtaatgaatcgcagggacagttccgatttgaaatgtttaccatttttaatagaattcactaaaacggtgtccttggaaatcagaaaagcacgcttatcatcaaaataactaattccgatgtccttgaat

SEQ ID NO: 37865 - DNA, 1429 bp, Heterodera glycines
  misc_feature (1383)..(1383): n is a, c, g, or t
aatttctcttttttccaggagaagaacgtgcgtcgccttctccgaaacgttggacgaagtgcgtgtacagcatcggacaacaaatcgacaagacgaatttacgttttaacatctttttttctttaaattcgccttataaattttcccaacactttttaggaccaaatacagcgtcttacagcagccttagaagcggagaaacagaaaacgaaactcgaaaataagtttttttttaattcggaaactaaaagccaattaaaattaatcgacaaattttaagacgaggagttggcgcgtgaacgggtggcccgtgcgcaagaaaatctaaaacataaaataagttttttacaattttttattatttttttttaatttttatcaatttttcaggaggaaattcgtcatttgtattcccaaattcactaatctgaagtcagaaaatggggcgactcgaaggagaccatcgagcgtgaacgagtcttacatcaaatgggaaattgaggacctgaagataagttaataagccgctttttaagaaaaaataatttaaattaataattttattttttacacttattaataagtttttagtgcttttttacgaaaaaataaaaatttattaatgctctttgaagaaatgataatttaaagaaataatttattatttactattattaataaatttacagtaattatttaattcatctataatatactattaattaacttttcacaagcaaatcgggctgctggttgacagcttggaaacagctcaaaaaaaaatcattgagctcagtgacagtttggaagccgctgatcagaaaattgctcggctcagtgacagtttgaaaggcgctgatcagaaaattgctcagctcagtgacagtttgaaaggcgctgatcagaaaattgttgaactcactgtaaatcattgaattgaaataatatcttttaaatcaatttgaaaatataataattaaataatattttgattaaatttccgtcaaaatcaggcggaggtgaaggatttacgagctgcggctgaactccaagtgcaaaatggtgctgtgccgccggtgccgaacttggttgcagaacggtatgatgaatagtaaacgcatttttctttacttttggggcttttttcataattacgcattttataatgactttttaagaaaaaaattttaatgcccaaaaaattcaaatctcgaattttttttttttttacttattttgagatgttgtggagaattgaattaaatttttctagttttttttttttttgaaaaaatttccgaaaaagggatatcaaaaattaatattaaaatagctaaaactttagtacaaatctaatttggtgattttatgtccttttcccanaaaaatactaaaaacacaagttttttttataatatgtatatattgt

SEQ ID NO: 37866 - DNA, 283 bp, Heterodera glycines
ccccgcctcccctccgtccatccgacgcctttttgcttcccctttgaggtcaatgaaaagctggacaaatgatcagcttttgtcgctgtatatgctatgaaatcaatataataatagtataaatcggaacaaaaaaaaaataaatttcgattattttaaaaatattcccgacaaaaaccaattgcaccgacgttttgcgttttgttcacctgctgctgttccaattgcgcaaggtcgccgcatttccgaacgcctcgagcaacgggttggacttcaaaatggt

SEQ ID NO: 37867 - DNA, 1002 bp, Heterodera glycines
tcacggacaataattgcaatgtccgatcccaatcacggcaaattttcaccggtttaccaacccctttcggggaaggacaagcacgctgattttgccagtgtagcgcgcgtgcagccccggacatctaagggcatcacagacctgttattgctcaatttcgtgcggctgaacaccgaaaatccctctaagaagttgtgcccacagaagcaatgagccaactatttagtaggctagagtctcgctcgttatcggaataaaccagacaaatcgctccacgaactaagaacggccatgcaccaccatccaccgaatcatgaaaaagctatcaatctgtcaatccttacggtgtccgggccgggtgagtttccccgtgttgagtcaaattaagccgcaggctccactcctggtggtgcccttccgtcaattcctttaagtttcagctttgcaaccatacttcccccggaaccggaagactttcgtttccgggaagctccccaccagggcgaataaatccgccggcggatcgctagttggcatcgtttacggtcagaactagggcggtatctgatcgccttcgaacctctgactttcgttcttgattaatgaagacattcttgccaaatgctttcgctgtagtccgtcttgctacggtccaagaatttcacctctcacgtagcaatacgaatggccccgtttgtctctgttaaccattatctcggtcagcaaaaccaataaaatcggaccgaaatcctcttctattattccatgcacgaacattcaagcgaaacgcctgtttgaagcactctgatttgttcaaagtaaactcgccagcccaccgacgccgaccggtaaaggccaacgcccggggaaagaccggcagaaaagccaaccgaaccagtaacacacaaagtgtgcaccggacggctagcacagatccaactacgagctttttaccgcagcaatattctatgcattttgagagctggaattaccgcggctgct

SEQ ID NO: 37868 - DNA, 1012 bp, Heterodera glycines
  misc_feature (951)..(952): n is a, c, g, or t
  misc_feature (1002)..(1002): n is a, c, g, or t
gagaagacatcacgcgaatgatgacgacaaaggaaagtgagaaggaaaagtgaggaggaccggcggggaggagggggcgggggaggttaaagaacgaaacataagacaaaatgggactttcgaaaacgaacacaagactaaaagaaagggaccaaccatacaaaagcgaaactaaaacataattcaataaatattgggaattcgtacgtatacatacctattcaaagttttgacgattaaaacagtgaatttgtctcttaaaaattggaccaaacaccaactgcgtatgaaatggcagggttaatttgtaaatggcaatgcgttaataaattgtgggtcaacggaagttttcacggtttgagcttttctctgttgactgcttttaaaactacaaaacatggcttaaatactaataatgtgtcaacaaatctgcatcaaagtgaatactgaatgtacacaccgtttcaaaaaacgagagatgaaccaataaagagagagtgcagagaaaaaaacatctctctttttggcgtactatttctttatctgtgttaatagagaaaaactgaatttacttcgctacgtttaattttttttctatacgttagatccactccaaattttgcataccgattgagaaaaaaattctgcatagaacgtatcaaatacttttttgagttaaacatcccgtttttgcatgaaaccattatgaaaatttgaaactctcactactcttttctgagatgtcaaattgcttagcatttgcttagaaaaagcttctccccatcaagggctttcgaatgataccaagatttaccaatttggttggcaaaaagcttcaaaaataattcccaaaattcgtcattttttaatattttggacaaaaataaatgaaaatattcatgttgcacaacggactcgaacttccccccccccctttgtccctttactatnnctacaaaaaccactaagccacacatgcaaatctttttggaactgggaggncaaattgaaa

SEQ ID NO: 37869 - DNA, 861 bp, Heterodera glycines
aattttatttacattattattttggcatttctttagcatggattggtagatttattagtgctgacaattatattaagtagaaatcactcaggctgtcttttaaaatttttgacagccattcaaaatttttttataattttttgttctataattgaactcattgaaaatttagactgctttgcctctaaaaaggctcttgagagatttattttagaatgtgaaaattttatttacattattattttggcatttctttagcatgaattggtagatttattagtgctgacaattatattaagtagaaatcactcaggctgtcttttaaaatttttgacagccattcaaaatctttttataattttttgttctataattgaactcattgaaaatttagactgctttgcctctaaaaaggctcttgagagatttattttagaatgtgaaaattttattttcattattattttggcatttctttagcatgaattggtagatttattagtgctgacagttatattaagtagaaatcactcaggctgtctttttaaatttttgacagccattcaaaatttttttataattttttgttctataattgaactcattgaaaatttagactgctttgcctctaaaaaggctcttgagagatttattttagaatgtgaaaattttattttgattattattttggcatttctttagcatgaattggtagatttattagtgctgacaattatattaagtagaaatcactcaggctgtcttttaaaatttttgacagccattcaaaatttttttataattttttgttctataattgaactcattgaaaatttagactgctttgcctctaaaaaggct

SEQ ID NO: 37870 - DNA, 887 bp, Heterodera glycines
  misc_feature (787)..(787): n is a, c, g, or t
  misc_feature (806)..(806): n is a, c, g, or t
tgccacacgttatctcaccaatgaatttgctggtttggtgttaatggtggacaattacagctcggacaattgtttgaaggtcgtgttttggattatgaattaattcgttttgtttatcttttttgctcaaagaatccatttcttcctatttgcgcattatttttcgaattaattcccatatttctcatttaaggtccattccgattgtcaaaactcaacaaatgttctttccactcgttcttctttgcttgcgttcgattccatccctccgctgcatcgacaggtccttctttatcgcctgtgacttcaataattgtttatggacaatgattaaaattgcgtgtcatatgaacattttgccgttttgcaatcttttagtgattttaaatgaaaagcaaaatgagtccattttaaatgggaattgctttccctgattttttctgtaaaaaagtcccctccccactttcttcaggttgtcactcttttgacgcacttcgaaccctcccaatcttttatggtcactcatcgatgggtttaccaccaaacaaaattcccacaactgcgcgactttgtgccctgcactgaatttgcttccgctcagaattttccaccgttacaaacggaaacaatcggttatttgcatggcccttttccggtctataaatgatttgttcacatcttctaatttcgtcaaacatatcttttctatttcttttgtggatttattttttcccatcttcagcatctcatacatatcacttccattgtatattttcctcctttcatncatgaatttattgacttanagaatttttacgactttataaccgtcattcctcccgacaacccattcctaatggaagcgtagcaaaaaaaaaaaatttatg

SEQ ID NO: 37871 - DNA, 908 bp, Heterodera glycines
tagggaacaacgatatatcttgccaaagcggcgtacgtaatcaatacaattgtttacactgctgaaaactcaaagatcaatccatagtttcttatcgtaacacacaatagaaatcctttcttcattatcgattattcacaaaaatcattcattgtctatttcatcatcagcaaaaacactgtaaaatttgctatacatcatcggcatgtacacgcatcaattgttcaacttgctcaacattatagttctccctaattcttgatttgcttcatctttcctttcttctccttcatgttcggtgagaagcaatgtatcttcaacatcaccaatttgaatcaataattcttcttgttgttctccagtttgtttcaacagttcggcttgttgtggttcaggtagtggccgctgttccagttcttgggcatctggcgacatattaaaaaccttatcgtttgcgggcattggcataatttaaagtttttagaagcgcgaggtgagccaattttatagacagtaccatcccgaggggagtcgatatagagagccaagaaaatcctgaaaaaattattatcaaatcaacgaacggtctcaaaaaaataattcaccttacagggggcggagtcagttgattgcgtcatcataaaggggggggggtcagttgactgcgttatgctaagggggcggagtcagttgattgcatcatgataaagggggcggagtcagttgattgcatcatgataaagggggcggagtcagttgattacgtcatgctaaagggggcggagtcagttgattgcgtcatcataataaggggcggagtcagttgattacgtcatgctaaagggggcggagtcagttgattgcgtcatcataataagggggcggagtcagttgatgacgtccatgag

SEQ ID NO: 37872 - DNA, 1186 bp, Heterodera glycines
ggacaactcagccgaggagacaatttggcagatggacaactcagccgtacaataaaaaattacaaaataaagcctaagcctatgcctcgcctaaagcttaggcctaagcctagcctaagccattgtatgagttacgttttgtaaattctcgtaaagctgagttgtccatgagccgaattgtcccatcagctgagttgtcctcggctgaattgtcctaggctgagttgtcctcggctgaattgtcctaggctgagttgtccccagctgactgtgacgcgatttttgggcaattttttaataaaataaatgaatttatatattcagtgatttatgcttttgaggtatgcgttaattgagaaaggataggaatatattagaacatatgaacagttattttttgtactcgggaaacaattagctaaagcccagaaaaaaaggttcagaggaaacatctcgaggattaataacagcaaaataacaaaacaataaaaaataaagctctaaaatgataaattcgcaaaatgtacaaaaatagggaattttataatgcatttattttcgaatatcaatcacaacagcacatttgtgaggctgggcggcgaggtcgacgagtgttggctgatgctgccattgctcggcggattgaccatgccgaccaatgggttctgctgcttttgaagcagcgagggggaggacgaagaaatgtcggtggattggtggtggtaatggtggtgaagcgcggaggtggtgattgcagtttcgtgctgtaattttgttttgtttaatggcaaattaagtgatcaatgaaagtgccaaattaaagagaaaaaaaaagtgtcaaccgccaaattccctgaaaaaggtcggaaaacaaaaacaaaaggacagagtgcggaaaggagatgtgagagagaaagggagaggggggagagtagggaaaaggagagagagaggagggagagagagggggagaggagagaaacagtggagagagagagagagtgaaagaggagagagaaagatagagagaggagagagtatgtgagagaaagactaatagagtacatacattaagagcagtgctgtgccgtgctgatttgtgaatgacaaacccgcactctgacctcaattggttgcaatgcttcgacaggtaaatgcgtctgtaatgagttgaatgatgtcatgc

SEQ ID NO: 37873 - DNA, 1097 bp, Heterodera glycines
  misc_feature (13)..(13): n is a, c, g, or t
caaaaaaaaacantttttcgccattaattgtttgctttctggatggattgttagtttgttgttatgtatttgcatggcttttttttggctttttgggaattttctctaaaaaggtgccgacgatgtaaaaaataaaaataaataaaaatccaaaaatggcttggcgcctcactaaattgaaattctaaaaaatgttttactccactaatttaaatttttttaaaaagtactttgccccatttaaaaaaatcttggccctattaaattgaaattcttttaaataatgcttatcccttttaaattgaaattttttttaaatgcttgactccaataaattgaaattcttttaaaaaaaatgttaggccccattcttaaaaatgcttggccctattttgaaattaaaaaaaaaagtttttttaaaaagcttggctcctctaaattgaaaattttttttaatgcttgactaaattgaaattcttttaaaaaaatgttaggccccattcttaaaaaatgcttggccctattttgaaattaaaaaaaaaagtttttttaaaaagcttggctcctctaaattgaaagttttttaaaaatgcttggccctattaaattgaaattctttttaaaaaatgcttgacagtttgcgagccatttatttattgactgttcccatttcaataatttgctgcgagtgttaacaaatgatgatgatggattgggatggttggttcttcgatggtttcactgataaaatgtgtgtaataattagtgacaaatcatcacacaaattttctcgtcccctttcttttacctccgtttgctctccaaatttatacttttataaagttattatattttaaatttactaattttgtaaaggacaaaattcgtcttatgactcagagaccgccacaaagttttaaactatgatctttatttacctttttaattgacatcatttttaattagccaaatatccaccaaaaaattaaataccgtactcagagaatgataaacaattaaacgggccaccgtaccaccacatttcattaaataggcaattttactaaccgttatgaaatatattcatattttcaact

SEQ ID NO: 37874 - DNA, 1098 bp, Heterodera glycines
aattgccctccccccagaaaatttgtctgaagtggtcaattcactgcagtttgacacctgttgggcgaaaactcgggtttcctttgcctttgactattttgtattggaaaggcaacgaatttgggttcgaaaccaaaaatgggtggaagaatagtattattagtattaaagacgaattattttcttttagaaagcccagcgcgacttggcccaggcgaaggatctcctcgggaacgtggcacaacatttggcacccattccacgtggacaacttcgcaattgtaagttcattaagtgtatcttaaattaacatttaccgaattaaattccttttagtgatcgcgtctttttttgaggtcgggtacacctttggaatgactccgccccacgaagccaatcatgccccgactcaagaaaattttaaagtgcagtttgacagaatcaccgaactgcttcaaaatgcagatgccacccgaattaacaaggcatcacagtgttagtcgtaaacactgcatgttaattataatatataacataataaataaaataatttgaagatgtcattactcattaagttctgttcacgctgtacgaacactttggttcctttcatcagttggcaattgataacaacgcaactcagactcgaaaccacgcctttcgggccgagaatgtcgcccttcgggctgagaatgttggacttcgggctaaaattaccagtctcgagggaactcttgagtcaatgctttgaaagactgacgataaatgttttttgttgactattgttgttataaaaaaatcacctgcacattttttggataaaggtcatcaaatcaatgaaaagcttagtcagtgggacaaaggcgaaaaggcgcgccgaaaaaataactttttgaattttcttttttctcggataaatttcaaattttcagttaaaagtggggaattactttgggtttgtcccccccccccccccttttcgaaaattttttagttttcaaaagtcatgaaaacatgtgtatccatgggttttcggggtcgcgtgaacacgaatccggcatccaactgaaagccctggagacatgcttttatgactta

SEQ ID NO: 37875 - DNA, 999 bp, Heterodera glycines
tcgagcatgatagggagggcggtgcgcaatagaccttttatttttgaggaatttttaaatttatactctatcccagaaaaatggctatctctttttttgataaattttatacacatacaaatgctctcgagcatgatagggagggcggtgcgcaatagaccttttatttttgagggaatttttaaatttatactctatcccagaaaaatggctatctctttttttgagaaattttatacctcacaaaagcgcttgcgtatgagacggagggctgtgcacaatcgccattttatttcacagaggatttttatatttagaggttatcccagaaaaatggctatctctttttttgataaattttatacacatacaaatgctctcgagcatgatagggagggcggtgcgcaatagaccttttatttttgagggaatttttaaatttatactctatcccagaaaaatggctatctctttttttgagaaattttatacctcacaaaagcgcttgcgtatgagacggagggctgtgcacaatcgccattttatttcacagaggatttttatatttagaggttatcccagaaaaatggatatctctttttttgataaattttatacacatacaaatgctctcgagcatgatagggagggcggtgcgcaatagaccttttatttttgagggaatttttaaatttatactctttcccagaaaaatggctatctctttttttgataaattttatacacatacaaatgctctcgagcatgatagggagggcggtgcgcaatagaccttttatttttgagggaatttttaaatttatactctatcccagaaaaatggctatctctttttttgagaaattttatacctcacaaaagcgcttgcgtatgagacggagggctgtgcacaatcgccattttatttcacagaggatttttatatttagaggttaaccgagaaaaatggctatctctttttttgataaattttataca

SEQ ID NO: 37876 - DNA, 995 bp, Heterodera glycines
ataattggggattgtttttttatgtaataaaaaagcgcgaaatatgtaaataaatatgtataaaaaatgctaaaatatgtaagaaatatgtacaaaaatgctaaaatatgtaccaaatatgtaaataaaattttttttaatgtttatttttttggaaaaaaattcctagtaaatggtgaaacaggcacaaaatgctttaaaaattacctaaattggcttagaatcattttattattttaaaaattatttttgatatctcattttttgaaaaaaaaaatagattttttagggataccttttcaaaaaattttttaaatttttcacaaaaaattttctataaattagagaccggacaagagggtcggtcgaacggtttcggttaaaaaccgaaatcgaaaaaaccgaagaaaaattttcggcttatttcgattttttttttttgaatttgtttatttttttcccaaaaaagcaataactatttctattaatagaaaaaacgaaaaatctcctccgagtaaaattgtagggctattgcaacccttttgaacggtgtactataggttgtgagaatgatttaaaaaggcagccaaaaaacatgtgtttgctccttgattctaaaaaccccaagattagttttggcgaactggtgcctttttggcgttttttccgaaaaattccattaaaaattcaattaaatcgggaaaataaacccctaagaaatgctctaaaaaaattttagaaaatataccattaagaattgaaaaattttctcaaaaattgttcgccaaaatttcatttttttttcttgataaaaattttaggtttataaacttccttattgaaaaacattataaaatattaatattcatttaaatgatcaagattccggcggtgccgataggcgccgccgtgggaaattttaagaatttttaatgaattttgttaaaaaatggccaactgatttttcataaaagtcggttgattgtttcggtttt

SEQ ID NO: 37877 - DNA, 1336 bp, Heterodera glycines
caaaataataacataacaaataaaaatttacataaataaatctaatactaagacagtttaccaacacacaaatgatgctaatcgaatttcgaaagatgtaaaggaaggatttttaggaataaagaaaaaaaagcatgaaaatgattatctcaataaaaattcttttaatatattcagggttcgcagatgaaaattttcaaaagcctcatttggcaagcaaaaaagcctcattttgggtcaaaaagcctcattgcattaatttgcttacgagcctgtacagactgggaaaatcagcgctgaaaattctttgccatttttgctctgttgtcagtcgcatgaattctgcttcgtcgatgctgatcaaaatgtggttaacctgactaacttcatcgaacaaagtatcggacaaatcagggggaaaagttgaggccaattcaatgacattctcatggactagttgccgatctgtaagcgaaagccattgaatatgatccggataacgttcggtgcgaaaccatttggcgacataatccaaagttgttttgtatgactgaaaatttgtaatatttaaaaacattttagctcaatctaccgtgaaagcatttttggcacgtttaattcctttgaactcagaataacaatcaagaaattttcttttcaatgatattgaacctagcaaaaaaatagttacacttacaggtcatttgtggaatatagatataggtacatatacaggcttttttcgaaaatgtcgaagctctattaaacccaaagtactaaacaattgccaaacattatgccaatttatcaaaatccagtcttacgaattatcagcatcatttgcatcccatgaaaaagaaaagtggtaaaacagaaaacacagtgctaatcaaatgatcaacaattttctatctaagctgttctttctgatcagctgatcaccatttggctgatcattggtccactttctttggtcgtcctcatatttgccgatcacttcgaaccattttggtctgatcttagaagacacccttcacaccaaagttctgcaaatccttaatccgttgatcaattcaaagattaagttttctcatgtttttttcatgtacaataaaattcaaaaatttcgttggcggtttgaaaatctctaaataaatattattattaaaaatttttaaaataaaaaaacattcctccatttttaaggaataaaaattaattgttaaaataaaaatgtgacaaaattaattaaaataataaacggtttgccctctgctcaataatttaaaatagagagtattacatgtagtttcgtttttattttaaatatgctttt

SEQ ID NO: 37878 - DNA, 1142 bp, Heterodera glycines
  misc_feature (158)..(158): n is a, c, g, or t
tttctttttcccatattaacgcccccttcagcagtccctccatttgtccctcggacagtacaagtctccctcgaacaaatacggaatttgtccgccctttgagtcggcgctttgccaccgcatcctcaaaatgttccgcggcgcatcgttcgtccccngcggcacattcctccgccactttcagccccttacaaatcatcatttgtttcccaccggtgggtactgcaaattacaccggacaaaaaattgtgaagtgttcgctgaatttgttcatgttttccatgtagcgatccagcgaagatattgtggggaagagatcggggtgatcagtcataaattgtttacggaaattggatttgaagtggtggaaggatggaaaagcggacttaaagaagacaaaagggggagggaggggggggggcaggaaaaaaacatcgccacaaaggcaattatttagttttaatttaccaccaagggagtccaacaaaagcaccgcaaaatcagagcccaaattgaagcaatttttacaacaatttttttcatggaattttcacataaattaattattaaaaataaaaataacaaacatgtgctttagagcgggaggaaagaaaagtgggcattcacaaatcacaagctgaactttcaaacttttaaataacaccggaattagtcacaaaatttccgagtaaatgacaaacagtgaatttatagagaaaagcaaaaaaaaacgcgaacaaattaatttttacatcaccgaaaaaggacccatttaaaaatgcaaaggcaaaaagtaccaaaatgggaagaaagctcaacaaaacaaatgatggaatatgaaaataaagaaaaagaaggcagacattccgtacaagcttctgaaacattcaaattccctatttgtttggcggaacatccgactcggtggcctccgtttgttctctcctgtaaatgtgccttttctgtttggcaaatggcaattccatcgccgccacttgcagaggccatccattgaccacaacgcccgcctgaacagcaacgccaatctgagaggaatttcgaacataaacaaaaaaaattggtctaaacactgaccacgacagacaattcggggtcaacgccgaaattggcgattcctgtaa

SEQ ID NO: 37879 - DNA, 800 bp, Heterodera glycines
ccccgtaaaaaaatgggtcaaatgatataccaatcgattcgtctctaggagctaagcatggaaaaatatgtctcgagttgcggaaatgccaaaaaaccggtttttgaaccggtttaaaactcgaaaaattgactgaaaaggggggctcctgaccctttaaatggccaaattcggacaaatttggtatcattctagaagctcttgacgagcttaacctaaaaatcatgtaatgaactctaaccgacgccatctaagtactgggacaactgagtcccagtgaaaatggacacttcactaccgaacaataataaaaggtaaataagaactcaaaattttattttctctatatgaatcatgaataaaactaccaaataatgctgaaaaattttaaacaaatctagattacctaaggttatggaaaaaagtgagaaaatttgtcaagccaagttttcgtacatttgcaaaaaaatataacgcttggcgccgaaaccacccccgcccggaagcaattaggatggacatatattttcgagttattgaatcttgtgttttggaattatttttaggttttcaaataaaatcatagaaaattgtaaagaagccatacccaaaattcattaacacaaagataacaaaaaatgaaaaaaaagtcactaataaaagatttaaaaaatttcaaaattattaattgtttctaaaaactaaaaatttcgtccataaattgtcgataaatcttcaatggagcatgaattttgggatgatatagctcaaggatcaattcactgtcgtgatgcacatgg

SEQ ID NO: 37880 - DNA, 981 bp, Heterodera glycines
  misc_feature (891)..(891): n is a, c, g, or t
  misc_feature (896)..(896): n is a, c, g, or t
  misc_feature (927)..(927): n is a, c, g, or t
tgactggagcaatcgaacgctaacggacgacctaatggtaaaaaatccccgaaggagagaatttaattaaatccattccttcgggggaccgtgccgggtgccgcggggtaagcagtgctggttcgtttcatcacggcaccgaaccttttggctagtcagcaatcgttgcttaacttgccagatcggacgggtgcgcatgattccactgttccaagcaccccaccaaaagcaaaacgatataaccaaaatataaggaaaaatttttaaaaaaattttttctccatcttcctttttgatactaaagcatcagagtgctaaaattaagttgtaaataaaatttggtgcgctttagagcactttctgaaaaaaatatttatgaaacaaaaaaatcgattttttcaagtgtccgtttggggtactcaaacaattatggggagcaaaaatccaacgcagaattaaagtacaggctataggaaagctactcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctactcccgaaggattcggtctccccataaatctggacgcatcggttcggggggactgccccgaaaacaaaaaaatcgattttttcaagtgtccgtttggggtactcaaacaattatggggagcaaaaatccaacgcagaattaaagtacaggctatagggaagctactcccgaaggattcggtctccccataaatctgggcgcatcgcggtttcggggggactgccccgaaaacaaaaaaatcgattntttcnagtgtcccgtttggggtactcaaacaattantggggagcaaaaatccaaacgcagattaaagtacaggcctatagggaagctatt

SEQ ID NO: 37881 - DNA, 874 bp, Heterodera glycines
  misc_feature (839)..(839): n is a, c, g, or t
tttcattattcatcgtttttcggcctcagtttccctcgctcatctggtggtagggcggcggtggcgtctgaactgcttgcactcgtcgtgctgcgccggtcggcactgtgtccatggacattgcgctcacttcttcgagcagtgagcgacgcgtccgcccgccgctcttcggcggtccgttgctgctcaccggactgcccatggtcataatgcacccgtccacctcgccctcctcctcttcgtccggctcactgcccactgtcgaagtgttgtcctccgcggcgccgccgccccttcagcggaagggagaaaatcatggccccgtgggatgagttaatgaatcagttccgaataagggaaaacgagcaaaatgaatgatgattagagatcggcatttgaaaaaacctggacctggattttctgaaatttgtttcaaaaagcaaaccaaagtttgaaaatgaattaattgctaccgacgtgtaaaaaaagttataaattaaaatatgcaaaaattctgacttttggtagtattcatcttgcaacttttttaaaagttgttcaatcgcttagaaatagttataaaaagcttctaaacgtgtagggctttcaaatgatgcgaatttataaaatttggccagctgaaaaaaagttatgatgctctaaacttgtcccagactaaaccggccagataaactgtcccctacccgcttaggtatatctaaaaaatttaaattatataataataatatgtttttaaatctatttaatcatttttgataagttgaaaaaaacattggtcacttaaaataattaattctaaaattttttccaggaaatcncaggtttttcgtgttatttcctggacaaaatccag

SEQ ID NO: 37882 - DNA, 191 bp, Heterodera glycines
  misc_feature (11)..(11): n is a, c, g, or t
tgcaggtcccntttaactctcgctaaaaacaggatgtgcatacagtgtttgtatgcgatttcaacaggagatgagttattagtggtggtgatggtaaagacagccgcggtcctggcggtggggtgaatggtgggccgacggagttgggtggaggtgtggatgcatccgatcactctggctggagctcggag

SEQ ID NO: 37883 - DNA, 986 bp, Heterodera glycines
  misc_feature (835)..(835): n is a, c, g, or t
aaagcttctcaacaattttaacgcttccaattccttctacaatcgcctttatacatcccattatgagcgctaaaattatcagagtgccgaaaatcgcatgtgatctaagcctagaaaaaaatggtctaagtaaaaatcgtaattacgctcaaaaagcttctcaaacaattttagcgcttccaattccttctacaatcgcctttatacatcccattatgaacgctaaaattatcagagtgccgaaaatcgcatgtgatctaagcctagaaaaaaatggtctaagtaaaaatcgtaattacgctcaaaaagcttctcaaacaattttaacgcttccaattccttctacaatcgcctttatacatcccattatgagcgctaaaattatcagagtgccgaaaatcgcatgtgatctaagcctagcaaaaaatggtctaagtaaaaatcgtaattacgctcaaaaagcttctcaaacaattttagcgcttccaattccttctacaatcgcctttatacatcccattatgagcgctaaaattatcagagtgccgaaaatcgcatgtgatctaagcctagaaaaaatggtctaagtaaaaatcgtaattacgctcaaaaagcttctcaaacaattttagcgcttccaattccttctacaatcgcctttatacatcccattatgagcgctaaaattatcagagtgccgaaaatcgcatgtgatctaagcctagaaaaaatggtcaagtaaaaatcgtaattacgctcaaaaagcttctcaaacaattttaacgcttccaattccttctacaatcgcctttatacatcccattatgagcgctanaattatcagagtgccgaaaatcgcatgtgatctaagcctagaaaaaatggtctaagtaaaaatcgtaattacgctcaaaaagctttctcaacaattttagcgcttccaattcttctacaatcgcccttatacatcccattatgaacgctaa

SEQ ID NO: 37884 - DNA, 1528 bp, Heterodera glycines
  misc_feature (1423)..(1423): n is a, c, g, or t
  misc_feature (1478)..(1478): n is a, c, g, or t
  misc_feature (1510)..(1510): n is a, c, g, or t
gaagaaaatatttatgacataaaaaaatcgattttttcaaagcctcctttgggggtactcatgcaattatggggagcaaaaatccctcgcagaattaaagtacagactataggtaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacagcctatagggaagctattcccgaaggattcggtctccccataaatctgggcgcatcggttcagggggactgccccgaaaacccaaaaaaaaatttttttgaataaaaattatttaaatgacctgactagataatatttaaaataggttatttctcttcctttcagtatccctgcaaagtttgctgcgcttctgatcagtttctgaaaaaaagttaagcctaacatcggttcagggggactgccccgaaaacccaaaaaaaaattttttattgaataaattatttaaatgaactgactagataatatttaaaataggttatttctcttcctttcagtatccctgcaaagtttggtgcgcttctgataagtttctgaaaaaaaagttaagcctaaactttttggcctgtttaaaaaggaattaaaaatttttaaaaattttattcatctccctttttgatagaaaaagcatcagagtgcctaaactaacatgtaaataaaatttggtgcgtttcagagccctttctgaaaaaaatatttatgaattaattatgcaaaaaacaaataaataatgaactctcttccttaataattttcctgcaccgaaggtactcactcggccgcttcgcggcctcgtggtgggccttcccccccgcccttcagagcacgacaaatatttcaacaaaaattttgaaaaattgactagagcaatcgaacgctaacggacgacctaatggaaaaaaatccccgaaggagagaatttaattaaatccattccttcgggggaccgtgccgggtgccgcggggtaagcagtgctggttcgtttcatcacggcaccgaaccttttggctagtcagcaatcgttgcttaacttgccagatcggacgggtgcgcatgattccactgttccaagcaccccaccaaaagcaaaacgatataaccaaaatataaggaaaaatttttaaaaaaatttttctccatctccctttttgatagaaaaagcatcagagtgcctaaactaacatgtaaataaaatttggtgcgctttagagcactttctgaaaaaatatttatgaaataaaaaaatcgatttattcaagtggtccgtttggggtactcaaacaattatggggagcaaaaatccaacgcagaattanagtacagactatagggaagctaatcccgaaaggattcggtctccccataatctgngcgaatccggttcgggggggactgccccgaanaacaaaaaatcgattttt

SEQ ID NO: 37885 - DNA, 1014 bp, Heterodera glycines
actttctcttaaactttctattccttttccactttctgttcctcttccattttctcttccactttctgttcctcttccactttctcttccactttctcttaaactttctattccttttccactttctgttcctcttccattttctcttccactttctgttcctcttccacttttctcttccactttctgttccttttccactttctcttaaactttctattcattttccactttctcttaaactttctattccttttccactttctcttccactttctattcctcttccactttctgttcctcttccactttctcttccactttctcttccactttctattccttttccactttctcttccgctttctattcctcttccactttctcttcctcttccactttctgttccttttccactttctgttcctctttctattccttttccactttctctactttctattcctcttccactttctcttcctctttctgttcctcttccactttctcttcctcttccactttctcttccactttctgttcctcttccactttcctcttccactttctgttcctcttccactttctgttcctcttccactttctattcctcttccacttctcttcctcttccactttctcttcctctttctgttcctcttccactttctgttccttttccactttctgttcctcttccactttctattcctcttccactttctgttcctcttccacttctgttccacttccactttctcttcctctttctgttcctcttccactttctcttcctcttccactttctcttcctcttccactttctcttccactttctgttcctcttccactttctgttcctcttccactttctgttcctcttccactttctgttcctcttccactttcttttccacttccaccttctgttcctcttccactttctcttcctctttctgttcctcttccactttctcttcctcttccactctctcttgcactttctgttcctct

SEQ ID NO: 37886 - DNA, 873 bp, Heterodera glycines
aataactaccaaaaagaaactgataaataagctaaatacatagaacaaatcttttttcacatttctatttcttttgcagatagaaatctgtcttttaggcggagttgtgttgaattttccaagttttccggagaaattaagggccataaggcttaaatcacctcaaacatgtgacccactgaattaaactggaagcacttaacactaaaataacttatagacctcccttaagcattttctattcactttatgtaagaaaaaaattcattaaacacaaattttttgtgggcgaaaaaatgtaaaaatctgggtaaatttgaaaaaaaaaattctagggggttgggaaaaattttccgtagaagatgattatgacgaacagaaagagcacaaaattctctacaaaatggcctttgaatgaggtctctaccagggatgggccgaggtttcgcttttcgcatttcgcctttcgcattattcgcattttttggcgtttcgcatttcgcttttcgcatttcgctttttggcgcgaaaagcgacttttacacccctaagaattggattaaattcccataaaatttttcaaaattttacctataaattggctaattttcagtgaaaaactgtttataaatgatcaaaatttccaattttttccccggcggcgccaatcggcaccgccgcgcccccaaaactcctattttttcttagaaaatggcccaaaatcgcaaaatttggtaatttgatgaaaaactgttctcagcggcgcgccaaaactcttatttctcattagaaaaatgataaaaatcacaaaatttgatcattttttagtgaaaaatctgtcaacaaattttaatccaaattttcaaaaatttt

SEQ ID NO: 37887 - DNA, 950 bp, Heterodera glycines
  misc_feature (16)..(16): n is a, c, g, or t
  misc_feature (864)..(864): n is a, c, g, or t
tggggtgcgattaatnagtttttggaaaacttcaaaaaattgcatcaacagcatctcgccgaatggttattaaataaaaaggctttcttcaacaacgccattaattcctaccaaaacatatcttttttgagccaaattagttcctaaaaaacaaaatccatattataaaaataagcaataaattgatttttaagcacttaagcattttatgaaaatactgctttgtatagaattttgaattttaatttagttttacatatttaaaatcttttccatgatatatcttaatgataaataaatattatataactttaatccatttactttttaatcttttaaaattttgaattaaatgtttatcacattcattgtattttatagattttataagaagcttttttttagaaaattgcaaaaaattttaacctttaaaaatatatgtgccattttgaaataaagttttttataatatgctaaaacaaaattacactttttataaactaaatattttcaaaaatctctaaaaaagttcaaaaattttcgatttttaatgtgttttttaattccaaaaagtcaatcctgagggggtgtgtttttcacttttcttgcatttttcatgccaaaatttccaaaaaatggctactctaaattaaaaataacaaaatataaatttattttcgaaaataccctgagtatgcattttatacattaaaaactttaccaaatcataaattttaacgtagaaattgcgatttttgagccaccttcttcatagcatatgcgtagaaaaaatgcaaaagcatataatttattgttctttttataaccatttgaattgttagtgttatacatattttgcattanaaatacatttgcttttttattttatgatagaataaagccatttatattcttatttattttgtaatcatcagaaaaataaacatcaa

SEQ ID NO: 37888 - DNA, 1170 bp, Heterodera glycines
gaaggcaccaaaacgcacaagaaagtcgtcagactatggtaactgcttttttaagtaggaaaccccggaaaaatggctttaaagtttgttcgagttcgaatcccggttttcgaacttttttggaggagtagacgaatcgccgcattttggctgagtagacgaatcgtctagtagacgaatcgtataatagacgaatcgttgacatttgaccgagtagacgaatcgtcacattttggctgagtagacgaatcgtcgagtagacgaatcgtataatagacgaatcgttgacatttgaccgagtagacgaatcgtcacattttggctgagtagacgaatcgtataatagacgaatcgttgaatagacgaattgttgagtagacgaatcgatgggaggcggtacccatagtgtatgtgtcatcgtttgaatgtggcgtttcgttttgttatcgctttgcgttaaaaaatgatttgaaaaatgtaaatgttttgttttacgttaaaaatgcgtgatgagacatttgcgccgctcagcaaagtcgacacttgcgccgcgacatttgcgccgcccagcaaaaatggacttttgcgccgcgcagtcaaaaatattatatacataaaaattccactattatcaataagttttactaaaactataagccatcgacaaaaataactaattgaaaattcgaaaaaattactagtcacaaagattgacattcaatttttaaccattaaaatcttaacattgaataggttcatcaaagatatgaaaaaatgattaagaatacaaactaacaaaaaactgaaaaaaagaattttctgtagaaaccccaattatttttttgcttcgaaaaaagaatgaaattcaattcctttgtaattaattttctcaataagttattttcatcgattttaatttaatttcattgaaaaaacgcactgattttcaaattttcgctcctattttaccatttttcgcattattgccgattcggcaatattttttaaaacacggcactatgccggtcggtcaactgtcgtccattcatttgctgtgactgagattgtgtaatgtcagtttgcctggattagtttgtttgggattaggattttgctttctcaagcctaattatatgtaaaactttagaaagtaaacatcgaatgaaaaag

SEQ ID NO: 37889 - DNA, 1350 bp, Heterodera glycines
ggcattcattcttcggtcaaatcgaagaatattttaatctaaaactgatgggaaacgcagcgggggggggggcgaagagagtaaccaccgccggtgctattcatcataacacttattccgttgcaaaattccattcctccgtgtcaatgggctgtacaaaaacagaagggggaaaaacaaaaacagtgagtggcggggggggggggcaccgaaaaagcccctcgggggatggcacttgacctcccttcccttctcttcctcccctcccctcccttcccccgcctttgaaaatccgacccgaaaaaacggaaatgagctcggaccaaatgacacttccgtttttgtccaaaattggattaattaatggactactgaacgaacaatcaatgcattaattacttcaattaggagagaaaatcaaaatggtccaactaattaaagggtttctgctgcccctgaggcgtctctttggttaattaattcgtccgccgttaattgctttgttcgcctgccaatgtcactttcagctgctcatgtactctgcttctcatttgtcgcattgtcgtccagtgctttattgcgtatgtttgtgctgctgctgatcacttctaattactccaattagtttggccatccatttttggcacattttttcggtttttttggcgactgacactttttttggcttcgttttgccgactttttggcactttttggcatttcgccctctctccccttttgttgtctcttcatttttgactttcctcctccctccctggtcagctgttgctgatctgtccctgtcccctcttctcatcgattgtttgtgccttcgctcctttcgccccgtctgtggcactgatcagcgaacctacgacaacatttgctttttacactgtgccaaacgtttgaacgcaggcaaaaaaagatgcgagtggagggaagagaaagtgccaacgcgtccttttcagaattgcgattggcctacgacggcgtttgttgtcctcgtgccgaactgtgcacagactacgaggatacggtgtgtgaccaatttggtacggtgcttaagggaatgcgaagagaaaggggtgggtatttactgggtggccatttgaatcgcaaagaatcaatcattttttggcaaattgtctctctttttttgtccatttgtcaggtgttcggtacgacaacgactgcgtcttcgagtttcacaaatgcattcgccggcgacgcattggcggcgaacgttgcgcgttggtggggaggggcgagcgaatgtgcggggcgaagcggcggatggcggcgagcgagcaaagcgctgccgacaacggcgagcactgctcgcccatc

SEQ ID NO: 37890 - DNA, 916 bp, Heterodera glycines
ttcgggttcggggttcgacatatggtcaaaattaatgtctgattaggattctctgatccttaaaacccctaatatgaggttttcttaaattttcgactttttttcatgttggccgaattccaatacttttcagaacaaaaaaattcttcaaaaagggtggggtgccatctatagtattacctttttttcttaaacggttatataaaacccactttttgcgccttattttttgctcaaaaaatgtttaggcaaaaaatcccgagttattcaattggtgctgatttgatttggcatttttctcgtcagttttcttcatcctcaccaaatgttggggcttcgtattcctcgaaattcgccattgttgttcaactgttgcgtgtcaccgcctaaatcggaggttgtctgattggcataatttcaaaaatttcaaatttcaatttccacttttttagtttgctcgtttccatgtcgcccgttcgttgatcagtgggcccagcaatttccgtcatgcatttgaccatttgatcaaaaggttttctctttttttaacgagatctcatggatttattggccggtcatttgtctggttttttgtaagagtccgggcaggatcggtattaaaaattttggctgtaatgcacttaatgagtcaaagggtaatttttatgaatcctatcaaattcaaatctttgcttcaaagaacataatcacaaaaaaaaataataaaaactataatgaaaatcttaaaatgaattttgtaaatgtcactagcacaattcacttcgcactaaactaaagagaatttctttttccctcttctcagtgttacctttccaattcaaatttcttagtaattatttcttcactaatttttgaatttccgtctttaattttgaaatattgtttcagcattgct

SEQ ID NO: 37891 - DNA, 984 bp, Heterodera glycines
tttcagaaagggttctgaaacgcaccaaattttatttcctccatagtttaggcactctgatgctttttctatcaataatgtaggtgaataaaattttaattgctttttaactttgggaaaaagtttaggcttaactttttagtgaaagtttgatcactcatatttttttagtctaatctactcaaaacggttcagaattcaataaaaataacattcacggtgcgaaaaatggggtttgacaagtttattggggaaaaaaagactttacaaaataatacccctgggagaagggagtgggaaacatgatttcaaaattttcaattttttctagtctaatctactcaaaccggttcagaattcaataaaaataaaattcacggtgcgaaaaatggggtttgaaaagtttattttgaaaaaaagactttacaaaataatacccctgggagaagggagtgggaaacatgatttcaaaattttcaattttttctagtctaatctactcaaaacggttcagaattcaataaaaataacattcacggtgcgaaaaatggggtttgaaaagtttattggggaaaaaaagactttacaaaataatacccctgggagaagggagtgggaaacatgatttcaaaattttcaattttttctagtctaatctactcaaaacggttcagaattcaataaaaataacattcacggtgcgaaaaatggggtatgaaaagtttattggggaaaaaaagactttacaaaataatacccctgggagaagggagtgggaaacatgatttcaaaattttcaattttttctagtctaatctactcaaaacggctcagaattcaataaaaataacattcacggggcgaaaaatggggtttgacaagtttattggggaaaaaagactttacaaaataatacccctgggagaaagggagagggaaacatgatttcaaaattttttcatttttttctagtccaaatctact

SEQ ID NO: 37892 - DNA, 1011 bp, Heterodera glycines
tgcctcgcccgtcccccctctcatttcattgcttttttgtcaggtccacattttggagctgttggccacctcaagtggaaatgtgccgaggaaagcgcgcgaattgcttcagtccaatatgcctcatgggcatgatatgaactcattggcgcaatatttgatcacaagtattatgcggcttttccggtcgtctctttacggtcctttcaggtcgtcagtcgtacacaatgctcggtctccgacttcgggcagagcaggacaaaagtaaacttagttttccaattttaatttcgcaatccaaattgcgaagggtttcggcaaactttgatggaaacgggcgattcgcttctgattgtgtgcgaccggcgcgaccccgagttgggcattggcatggacgatgaacaatttgtggcatttgctcgtcaccggcacgccaacgccgaacgcatttcgacatggatgcacgacgaaaaacagaggccccgcgagttgggacagaaccaactgggcttctttctgatgtggttgcgatatgagttgaggtgaaagaacggactttataagtggttttgtacggcgaatagttcattgtgccagaagtttgaaggaatggaattttatttctatcatcagggaaaaagagaaggcgggatggctgtcgaccgttgaaattcgcactgaaggcctttccacggaccaagacgaccttccagtgtccatttccgtgtcttactttgcactcgcccttcaggggcccttccaacctctcagcaattattacgcgttgccatttgagttcaaaggtcacagactcaatggcactctctcgacaaaaataaacatcaaattcaggcgagtcctatcggtcggtcgaacattacgcctaccagcgccttttcgaggctctgaaatttccgcctgaggaagtgatgcgactgcgcacaactgttaaaccggcggacgtggccaaatgtgcgcagaaagtgttcgataagcagcaggtttcaaaaa

SEQ ID NO: 37893 - DNA, 1069 bp, Heterodera glycines
catcgcgaattgccattcaatacggaacttcgttgagttatgaattcaatgccaatttaaaggtatttttacaacaaatctttctggtgggccattggcaccgcctgacattgagccgtttttttaaattttgatgaataaaaacactttaaaaattaatacaaattaatttcaagtccattttcgaccaaattgaacctgcggatgtgcgtgcagtgccccctcgtgtccaccccctctgttggtacgcaatttggcgtgcaacagatcgtttccgtgcattgaatgggcgattccccggaagcattgcttcttctcagaagggagatgcaaaggaattgaaggaaatcgtcgggaaattgttttctgagactcaggtggtcgtttgttatcttttgcaagttaacaaacttccgaattttgcagaatgccgagctgatctccagccaggacgaattggttccaccggaaactatcgctgaagtttgccgttacggtggctcagagccgcacgttgtggccgctatcctcggcggctgcgttgctcaggaggcaattaaactgtgcacacaccaatacatgcccgtggacaattcgctgctgttcgatgcccattcccaacaggcggcctcttttcgggtggtcgcctcacaaagagaggaacagcggaccaggaagacccgttgatgccgtgattgttcgcaataatgaaaccaaaagcagtccgtcaccattttttttgtttctgttattcactgaccattgtattgctttaaatttccgctttcatttcacttgaaaaaaccatggtaaaatgaatgaattttgttatacagtgggaattaagggggtaattccaaaggttattagcctttaatttgtccttttaacggaaattcggcttcggtccacgttcgttctgttaagatacgcttccaacaagcccgcctcgctcagcaaaagattcctaaccgactgttcctggaacgcgttgttctgttgctccaaaatgacaatgcttaggcggaaagtgacgtgcaaatctgcgccactgggggagaggcgggga

SEQ ID NO: 37894 - DNA, 563 bp, Heterodera glycines
acagttcaggccccgtaaatttttttcaattaacaatcaaaaaacatttcaatatataggtttcggtagcacgaatccggcattcatttcggccaattccgaagcttaacaaaaatgtcctagattttataggtatataaataccattaaccattaatattgaattttgtcaatttagttcgcctattttttcatttttattttgattaccaaaaaaaatgtccgacaattcgaaagaagctgagaaagaaatggaaaaagcaatgtaacaattcaaatttgaattttccatgctaatcattttgctgtttcagcttcatctctgccgactgttggctcaaagtgttcgatttgcttccacgccatcagcttggcctcggaattgcgatgatcagccgccgatttgactgcttcgttgacgaacacttcaaaacgcgcaaatggacattgggcaaattgaaaattcgactcaaatttggaaagaatggcgccgttgaaatgaaaattgtcaattccaatggaaaaactttgccaaccccgcaaaatccgttgccgaataaagt

SEQ ID NO: 37895 - DNA, 1029 bp, Heterodera glycines
acgcagcagcaggagaacagcgacccgagctgggactacgcggttgaggacgtgctcttccacctgcaaaggccacaccccgtggccaaagtgttcgccgcgaaattcttaaaaagtccgtttccgcgcggcgaacaattcgaaaccccgcgggtcgtttagggacaaaggctttccgttctgccaaacgatgcgccgtgcaaagtgcatttggggcgaagacatcgaatggacagccgccgcagcagcaaacggaggggccgcggcggaaggccgtggcggtgccggaaagtgaggcggaagaggagaacgaattcgtggcccaataccggtgggattgctttgctgtgatccaattagcaaatcgatcgcttcctccaggccccgtcaggaaacgtactctttggcagactttgtcagggaaacctgctcccctccggtgatggttcggagacagcagaaggggacggaggcgcacttgtcggaagaggtgggaacggcacgcagccgacccccaccctccgcccccctctcctctcagttcgctattgtgccgatgcccgaatgcgtgccactctcttcccgctgcccttccgctgattctcctgccgtctcttcgccggcctttgccccctacgactccttcccaaatcgcctttcatccgccaatcccggcactttccttcgctttccgttcgccgccgatctttcgctttttaacgatttgaaggtttccaagtcggaatggcatccgacttggctttgtgagggcactctgatgttcgacttgagtcggcaattatcccccaaaatggaaacgccggtggcggtgatggtcagtcaaagaaaggcattgaatacatcagcaattggcataatttgcagattttggatggagcggaactgatcatcaacacggtggttccgctttcagcggattccgagaaactgaatgaattggtcaatgcatcggcggagttggggacggacagaaaaatggacgaattgctcaaagagattgggcccgac

SEQ ID NO: 37896 - DNA, 1121 bp, Heterodera glycines
  misc_feature (28)..(28): n is a, c, g, or t
  misc_feature (131)..(131): n is a, c, g, or t
  misc_feature (993)..(993): n is a, c, g, or t
  misc_feature (1083)..(1083): n is a, c, g, or t
tcgtaatattcggctagggttaatttgntgtatatatacaattttggcgattttcaagcagtcatgatatttaattagtgaagttgaattattttatgcaactttttgactgattaattgggttttaaatntaaaaaaaataaagtgtgatctaatatagcctacttagttatttttcttactttttgatttgttataaattaaattaaattaaattttattttataaaaaaatcagtttatttttttattctaaatataccatttgtcgccattttcaatggttcatcatcaacagccgacaaaatcagttgtaaaattttacgttgccattgacgagatctatcataattatcaccatcatcatcctcaccggtttgaccatgattttcatttttgttaccgtaattctcatctactatacatttaccgttgaattccctgctgtttacccataatttggccaattcttttatcatgttcaagccgttttgtctattcaagggcaaaatttgatcatgcgaaatttggatgtgatcagtgagcagaaatgccgcatcaacaatttgctttttcaacattttcaacgcgtttacattaccaaaatctattaattagtgaaattggataaaattaaaataaatattattcaatacctccttttaaagtattgaaagaagtttgtaaaagcgtgaaaatgttggccaattgtggcttttcctgtttaataatggcccatttctctgacaaaaagtttgccacttttttctcccgattttcttcatttttcttctaaaactaatatttattttgttttaaataattttgaaaattttgataaaataattatctctgtatttgactcacaaatgaaatacttttttataattcaattattattaattatttcttttgttataatttttattttatgtatttcatttcattcaaataaattgcaataaaattccaaataaaaaatcttcaagcttanattaccacagttaattgatgaactaattgttttgatgtaattggaaataatttgtccaaaaataaatggtgctcttccaattcacacacnaatttgtgcaattcgccagtgccatcatttgcagccaa

SEQ ID NO: 37897 - DNA, 1103 bp, Heterodera glycines
gcagacacagagatagccaattttccaaattttcgcaaacagacgcgcagagaagcacattgcagatcggcgtaattattgtgagaatgcggtaggaattcctattactgatgagcagagaaagagatagccaattttccaaatttttcgcaaacagacgcacccagaacacatttagtatcggcgtaattattctgagaatgcggttggaattcctattactgttgagcagaaaaagagatagccaattttccaaatttttcccaaacaaacgcgccgagaaacaaattccagaacaattagtatcggcgtaattattctgagaatgcggttggaattcctattactgttgagcagaaaaagagatagccaattttccaaatttttcccaaacaaacgcgccgagaaacaaattccagaacaattagtatcggcgtaattattctgagaatgcggttggaattcctattactgttgagcagaaaaagagatagccaattttccaaatttttcccaaacaaacgcgccgagaaacaaattccagaacaattagtatcggcgtaattattctgagaatgcggttggaattcctattactgttgagcagaaaaagagatagccaattttccaaatttttcccaaacaaacgcgccgagaaacaaattccagaacaattagtatcggcgtaattattctgagaatgcggttggaattcctattactgttgagcagaaaaagagatagccaattttccaaatttttcccaaacaaacgcgccgagaaacaaattacagaacaattagtatcggcgtaattattctgagaatgcggttggaattcctattactgttgagcagaaaaagagatagccaattttccaaatttttcccaaacaaacgcgcagagaaacaaattccagaacaattagtatcggcgtaattattctgagaatgcggttggaattcctattactgttgagcagaaaaagagatagccaattttccaaatttttccaaaacaaacgcgccgagaaacaaattccagaacaattagtatcggcgtaatattctgagaatgcggttggaattctattactgttgagc

SEQ ID NO: 37898 - DNA, 1554 bp, Heterodera glycines
  misc_feature (65)..(65): n is a, c, g, or t
  misc_feature (110)..(111): n is a, c, g, or t
  misc_feature (119)..(121): n is a, c, g, or t
  misc_feature (1487)..(1487): n is a, c, g, or t
  misc_feature (1496)..(1496): n is a, c, g, or t
gccaatgggagaaggcattgcaaactgcgaagcagcaaaatgtgagagaaaggaaacatggaaantgatttaaaataataataccatgatgccaattaagcatcggcganngctggacnnngatttgtccgtttacacggcacaattattggcccacggaaattacggcgacgcattggacgcactgcaaaaatatggcatttcaacacacaaacaaatgagggaaatatgcgaacaaattgcggaaaaggtcctcaaaaaggaaagaaatattatgatgttaaaaagaaatgtgtataatgaaaagggaaagaaaaaaggcggcaaaattttgcgattcctaagccaattttgccaacaaaaaaaaaagcaaaaggaataatttaatttttaaatgccgaaaaatgcaagaaaaaaaaccgaatgccccaaaaacgaaaaaagacaaaaaaaaaaagataaattgaaaattcaaacatttgtttgacgcaaataaaaagctagaaaaaaacacgtgccttaacatgggattcttaataataaattatgaaaaagtcaaaactgaaaagaatttaattaataataattttataattaactaaaatgaagagtttattgtatgtagttaatttattccgtttgaggtgataaatgatcgccaacaagaatttttaacattagccaaactgagggacgttttgtttgatttgtgccagcaaattcattcggaaaacagccaattcgatgctttgactgtgaaagtaattatcggcctattaaaaataaatatgaatttgctaatttagcaattacaaatttgctaatttagcaattacaaaaccatctttatctagcacatttttgtgtgttacgaaacgcattggacaaaattaaagaacagttgcaaaatgaggggaaaactgtgccggccgaacttcaaactttggcacttcatcttggcattagccaattacggtaatcggtgtcaacataatgaccagaaatgccgcgggtcgagaaaaataatgacataaagcaacaaataagcgagcttgcaaattcttccacttttcaaattttatttaagatacattgaacctctacgagcggataaagcattttacgaagcgggcaatgcttgtcgggtaatttgaaaaatatgaataagaaatggacaaagtgtttgttaggcatcgggtgggaatcgaacccaaacatccacccaatccgtgggcgacttaaccattgagccaccgaggcacatccgccttttcattacaatacattaaaatattatggcacttataaatcccattttccatatcaaaagtaaagtacccaaccataaatcattttttctactttatgactaatatttgctgtcattaaattttcaatttttaaatttgttttccacctcattagttatacggtggtgtcgcctacgagggcatggcgtttactctgctcagccattatttggccgnggtggatgngattcaggaagacgacccaaatttggtggacaattcggttttcgatggcacagatgtg

SEQ ID NO: 37899 - DNA, 610 bp, Heterodera glycines
cccccccccccccattgatccgtccctttcgttacaattatttctttcccttttcttccgcccttatcggtcggtcggtgttcagtgggacgaccttctcataaagtgaaagtgaaaaaaacacaaaacataacgagagagagagaagctcaattcagatccaatcgaatgagagaattagtgtaataagttaatagaagagtgttatgcacaaattgccacaagactttaacggtaagggtcagttgcatctgaggcacgggccataacttttttcgaaatatgttactttttcaaaattgatcaggggtgttattttacttggaaaaccgggcatttgcccggttttgggggtctgtgcccggtttttgaatttgcccggttttttgcctggttttgggggttttgcccggtttttccaattttcttgttttcctttcatttatttgatttttatgtatacatttcgccaagattaatagtctaatttttatagcccggcaaaaaaaaatttccgtgagcggcatcgggagttcacaattttccgctacgggatgcgcgatggagattctcgtgaaaatcccgctcccgttggaatcccgtccatttt

SEQ ID NO: 37900 - DNA, 965 bp, Heterodera glycines
gcaggacacgccaagtacctcaaacttgggtaattacactgaagaaagaagtgcagtggggaagaatgacgcccaaaatgaaggaaatattcgatgctgtgcgaactctttgtgacccctctctgactctgccaatgcagcagttgaccatttttaccactatttttctctcattcatcgtctgctcgtctctcctttattataagctattttcctaagccaacgcccttttctccctcttttctgttagtcatttctcattggtgttgacgatccaacattcagtgtacaaatttgttaaacctctcaacattttaaatcaaaatcctaataaaaatttcgttgaatttctccgcctcttatttgtgcaaaattttcgaaaaagtaattttctatttaaaattaaaaaattcagaagcaaattcaagaattttttttatttttaaatgcattttttaccacatgaattatgattaaatttttgcgtttcgaattcattttggaattaagaaaaataaaaattgataatcatttgatcatttttagcgcactttaagcaccgccgttaggcagcgcagttccaaaatttattccatgccacagatattatgggcaggacacgccaagtacctcaaacttgggtaattaaaccgaagaaagaagtgcagtggggaagaatgacgcccaaaatgaaggaaatattcgatgctgtgcgaactctttgtgacccctctctgactctgccaatgcagcagttgaccatttttaccactatttttctctcactcatcgtctgctcgtctctcctttattataagctattttcctaagccaacgcccttttctccctcttttctgttagtcatttctcattggtgttgacgatccaacattcagtgtacaaatttgataaacctctacacattttaaatcaaaatcctaataaaaatttcgatgaatttctc

SEQ ID NO: 37901 - DNA, 999 bp, Heterodera glycines
  misc_feature (924)..(924): n is a, c, g, or t
  misc_feature (933)..(933): n is a, c, g, or t
  misc_feature (973)..(973): n is a, c, g, or t
cctgggcttttatactccccggaaaattaggccacgcccactttttaaagctatttaagccaagattttctcgcaaaatcaaatcagtcttgcaaaatttcatcaacaacaatggtagatcaatttgtacaacccgaaactgcggaggagcaacaagtgaaagctaagaagccacgcgttgatgagcgatttctttggaaaatcacgcggggccaatttgtactagcgattcggctgtgttcaggttaatcaaatttttgacgaccaaattaattgacaactttcagaggactggaacaatttatttcacaacaaagacaagacacgtcggctggaagatgggcgagtggcgattggactcgagatgtgtgaagaatgtgccagaatcaattgctgtgtcagtgatatgattgccgatcaaaagaagaagccaaaaaccaccgaataattcatcaaatttttcgcattagttgtagccaataaataaatatttttaaatgaatgagcgtgtatctgatttgtacctctcccccataagccccaacattcccttctctttgaaacccagaactcggtccttcggcaatcagacctctatgagctcggcccaccaatagccagcatccctaagagttcggtcctccggtagccaatactccgaaaagctcggccctccagtagccaatactcccaaggactcgaccctccggcgaccaacactcccacggacccggccctccggcgaccaacactcccacggacccggcccttcggtagccaatactcataaaggattgacctccgatggccaatacacatttgcgttttcgtatttaaaaaataaaacaattgtcccaccatttttgacccgggcggcggttgtttcttctcgcctgctcctcctcctcgtccttctttggcttntcttcattntcgcttcgcctcccctctattgtttcttttcctcctcctntctctccccttcttccttcttttttt

SEQ ID NO: 37902 - DNA, 1051 bp, Heterodera glycines
gaacatttgcaaccacagtgccaaaatgacgtcagaatctcggagtgcttatccatctcattaatttttgtgactttggtggtttcaaaagtcggcaattaattcctgagatttttccctgggttacacgaacatttgcaaccacagtgccaaaatgaagtcagaaactcggagtgcttatccatttcattaatttttgtgactttggtggtttcaaaaagtcggcatttaattcctgagatctttccctgggttacacgaacatttgcaaccactgtgccaaaatgacgtcagaaactcggagtgcttatccatttcattaatttttgtgactttggtggtttcaaaaagtcggcaattaattcctgagatctttccctgggttacacgaacatttgcaaccacagtgccaaaatgacgtcagaaactcggagtgcttatccatttcattaatttttgtgactttttggtggtttcaaaaagtcggcaattaattcctgagatctttccctgggttacacgaacatttgcaaccacagtgccaaaatgacgtcagaaactcggagtgcttatccatttcattaatttttgtgactttggtggtttcaaaaagtcggcaattaattcctgagatctttccctgggttacacgaacatttacaaccacagtgccaaaatgacgtcagaaactcggagtgcttatccatttcattaatttttgtgactttggtggtttcaaaaaggcggcaattaattcctgagatctttccctgggttacacgaacatttgcaaccacagtgccaaaatgacgtcagaaactcggagtgcttatccatttcattaatttttgtgactttggtggtttcaaaaagtcggcaattaattcctgagatctttccctgggttacacgaacatttacaaccacagtgccaaaatgacgtcagaaactcggagtgcttatccatttcattaatttttgtgactttggtggtttcaaaaagtcggcaattaattcctgagatctttccctgtgttacacgaacatttgc

SEQ ID NO: 37903 - DNA, 1121 bp, Heterodera glycines
  misc_feature (20)..(20): n is a, c, g, or t
  misc_feature (42)..(42): n is a, c, g, or t
  misc_feature (78)..(78): n is a, c, g, or t
  misc_feature (142)..(142): n is a, c, g, or t
agctggagctgaagaagacnccatcgctgggtgagagaaatntggggtagggagaaataaaaattaaacattttaatntaataaaaataaaaatttggctaggccatgccaactctcaaaatgccacaaaacagccacggcnctatcgttttacccgaaagggaagaggcgggaaaacctgacaaatcttatagaaagatcgggaattccatttctgatcgcaatgccaaagaaaaggaatttatgaaaaccgggaacaattgttgaagatcaagggctattttttgtggaaatgccgggatgaaatatcccagcaaaactcggagataaagaaagaatctcggtttagccaattcttatgaacattattcttaaatttacaaaaacaattaatgaaaatttttgtaaattaattaaattagaggaaaaataaaaatataaaatatgtactaattaaataaaaattactagagcatgacctggacctagatccaggcctgggtttttcaaaattttgagctctaaaaattatctattgcggaaaaagtaaaaaaaacagaaaataatgaatatggagatggggcggttggcggctgattgggaaaattgattacataatgaatgtgtggaggatgatgatgattgtgcaagtgaatgttttgtggtgaatgaaattggtgcagcaaattatgataacaattattaaaaagccaaaaaaataatcggaaaatttgccaaatttatttatgaaattttaatggaaatttaaaaataaatccttttttagctacacaatttaaccaggaagtactcccatcggcggtttgagctcgatttcaaagaaaatgcaacaatccgatttatttccaagtaaaattgtgggaaaaatacttaaaatccaagaaattctcatcatatacaaaaaagaaaaaaattgtatttcctttctaattaaaattgtcgaatgtctagacctatcggcagaatgggcaatgttcaagtacataaataaattcaagctcgcgagatttgttaagcatgttgccctatttctcacagtatttacctgctcattcaatatatgaaatgctgttccatggaaaaacgtaggtttcagcgcc

SEQ ID NO: 37904 - DNA, 983 bp, Heterodera glycines
gctcgagagcatttgtatgtgtataaaatttatcaaaaaaagagatagacatttttctgggatagagtataaatttaaaaattccctcaaaaataaaaggtctattgcgcaccgccctccctatcatgctcgagagcatttgtatgtgtataaaatttatcaaaaaaagagatatccatttttctgggataacctctaaatataaaaatcctctgtgaaataaaatggcgattgtgcacagccctccgtctcatacgcaagcgcttttgtgaggtataaaatttctcaaaaaaagagatagccatttttctgggatagagtataaatttaaaaattccctcaaaaataaaaggtctattgcgcaccgccctccctatcatgctcgagagcatttgtatgtgtataaaatttatcaaaaaaagagatatccatttttctgggataacctctaaatataaaaatcctctgtgaaataaaatggcgattgtgcacagccctccgtctcatacgcaagcgcttttgtgaggtataaaatttctcaaaaaaagagatagccatttttctgggatagagtataaatttaaaaattccctcaaaaataaaaggtctattgcgcaccgccctccctatcatgctcgagagcatttgtatgtgtataaaatttatcaaaaaaagagatagccatttttatgggataacctctaaatataaaaatcctctgtgaaataaaatggcgattgtgcacagccctccgtctcatacgcaagcgcttttgtgaggtataaaatttctcaaaaaaagagatagacatttttctgggatagagtataaatttaaaaattccctcaaaaataaaaaggtctattgcgcaccgccctccctatcatgctcgagagcatttgtatgtgtataaaatttatcaaaaaaagagatagccatttttctgggatagcgtctaaatataaaaatcctctgtgaaataa

SEQ ID NO: 37905 - DNA, 1203 bp, Heterodera glycines
aacaaagcacttttttttatttgattgcttatttgaaattatgaatataacgcgagaaaacatgcaccaaaagtgaaaagcatgaccaatcggtaaagatgagggttggatttgcatatttctgtacatattctattaagaaagggtctattatttctacgttaagtcgttttgattaacgttttaatgcatataaatacatatttcagagggttttcgagaataaattcatatttcgccacttgactaattttaaaaaaaatcggaaaatttaattgccatgtgagaattttagcaaatttatatttaaatcaatttcgaatttttccatatttttgacatttttttagtttaaattagggactgagcccgggctgggccccatgtttcataaattttccagtttgacaaaaacgtgaactttaaattttaccaacccaaaaaccggttctgggccgatttgatcggcttgggagaggccggacccgggaatcagttgcatttgaaaataccaaactcggtccggcgtatttgaaaatttcggtctctaatttaaatattttttgcattttttttggagatattttttgcatattttggcatttttcgaatttgagggcatgtttgtggttttagtgcatattataaacggtgctgggacattatataaaaaccggtgctagatcgaacctataaaagtatcaatggtgtgaagctaaaaaagtattaatgatagtaatatttataaaaagagtaaacttttgaaatttttttcactttttttttggtccaatttttttttttgtttatttttacacataataatgaatattaaacattaacaagacaattatggcgaatgaaattataattatggcgaagaagatcacagaaagcattaaaaatagattttcctttagtcttagcattaagtcgaaaaatttgttcacacatatatgaattcgttaaatttgtactggttccatgaattcttttcgtcttttgtttcaattgagcccagagtccttcacatttattcgtgttgacgttgaattcggtgccgtccgggagcatgacaatttttgagaaaccaccaccggtcgattttttgtgtctgatgagcatgtgttcgtactgtggcaagtgcagagccagtttcaggtacgccggccattcatcgctgatgatcactgagcctggacg

SEQ ID NO: 37906 - DNA, 903 bp, Heterodera glycines
attttccaatttttcccaacaaacgcgccgagaaacaaattccagaacaattagtatcggcgtaattattctgagaatgcagttggaattcctattactgttgagcagaaaaagagatagccaattttccaaatttttcccaaacaaacgcgcagagaaacaaattccagaacaattagtatcggcgtaattattctgagaatgcggttggaattcctataactgttgagcagaaaaagagatagccaattttccaaatttttccaaaacaaacgcgccgagaaacaaattccagaacaattagtatcggcgtaattattctgagaatgcggttggaattcctattactgttgagcagaaaaagagatagccaattttccaaatttttcccaaacaaacgcgccgagaaacaaattccagaacaattagtatcggcgtaattattctgagaatgcagttggaattcctattactgttgagcagaaaaagagatagccaattttccaaatttttcccaaacaaacgcgccgagaaacaaattccagaacaattagtatcggcgtaattattctgagaatgcggttggaattcctattactgttgagcagaaaaagagatagccaattttccaaatttttcccaaacaaacgcgcagagaaacaaattccagaacaattagtatcggcgtaattattctgagaatgcggttggaattcctattactgttgagcagaaaaagagatagccaattttccaaatttttcccaaacaaacgcgccgagaaacaaattccagaacaattagtatcggcgtaattattctgagaatgcggttggaattcctattactgttgagcagaaaaagagatagccaattttccaaatttttcccaaacaaacgcgc

SEQ ID NO: 37907 - DNA, 105 bp, Heterodera glycines
cgctgctgacgaggaatttgcgttcgatttcgatgcccatcgcgccattatgcgcgatgggcatgacagcccgtcagcgcttctcgaacaccgcaatgctttcca

SEQ ID NO: 37908 - DNA, 1397 bp, Heterodera glycines
ttattttttattttagtatcaaaatattcaatttcccatttgtttaaaattgtccaacataaaattccgtcgtttagtgaatcattggaataatttttaaacatcacaaaacatttgcaattttccatttatccgattttgtaaaaataaaatgcctttctccatatattttttgctgctcatttattatattatctccaatgaaaaagtttttgctgaaaatggagaaaagaagtttctttgcaaaattaatcacatttaaattattattattttaagaaaattgtttttggatttaaatggcactgatcggaccattcggctgaaaaactgcggcaattgcaaagggttttaaggcttaaaaagccaataaataagtaattgaggtgttaattaagtctgccatgtgctacaaaagtgtgttgtccggcgaagagaatttcccgtggaaagtgtcgcgtcggtttcgcttcttttcctatttgttggataaaagcggaaaatgtggcaaaaaagttcgtattgcaatgaatggcacgcaattttcaatgggaagagcatgcttcaatatttgactttcaatttttaaaataaatatttttaaattctaaaattatgaaattggctattttttgattttgaaattcaatttccaatttcaaaattggccctacaattaaagaattcattttaaatcgctctccctcatattttcagatggttggtggtgtcgaaattgacataaaaactgtgccgtggacagtgctatttcaaggcttagtgaaaagaaatgaacaaaataaaatgataatatttcaaaattgcgctagcatatttatttcgccggaatttgtgctgttagccgcgcattgttttgacaaaatcaaagagggaaaatactttcatttgggtaaaaaataaaaacaatttaaatgctctttaaatgctttgcttataactttgctctaaacaatccaattttaattctcgatatcatacgatagactaaatgttttctattagtctgccaatcaaaaaaatttgttaactttcaaaaaagttatggcctcaaaaaccaaggttttttgagttcctctagtcataactagggctccaatttataattgctaaaaactgccaatataattagtttttagtttctaaaaaacccccaaaatagttgctaaaaatgggtaaatatttgctaaaaactttcaaatttaggggagtaaaatcgaaaatttcttcaaaaagcaaaaatattatgccaaatcattaatgagatacataattttcaaaataaaaaattatcgtcaataaaataattaaattaattttggagatgattttttgaaataatttccatttcttatgggtgcatttttgaaaattttcgg

SEQ ID NO: 37909 - DNA, 1331 bp, Heterodera glycines
aacttccgtaagtcgcagcaacggactcggccggttcgtgttcgcggcttcgggctctattcgcgcgtaagccgaagcagccaacgaatcattgggtggcactcaaataaacttcccgccgatcgaaattcactctttcgtctaaatctcgggtttaaatctcaccatctttcatctaaggaacgatcggctctcgtatacgaaaacggtataagaaaatatacacaatcgaatacagaaattaaaaactctcgttagaaatccaacatcttatcttaaaacatcaagtatccaaagccggctccccggaaaatgcgagtattaaaaaaatatatttaaattttcgaaaactaagtctatatattttcgactcttcactacgctatagtactttatttttcgaaactcgtagttacaccattttctactcgacgcattttccgggagcctaaaaaacatccactcgtgattctcaaaaacattttaaccccgaacaacatttaaattgaaggaaataatcttgggttttgggtctttcttttcaggctcgaaacctccgctccaaaatgaggcggcatcacctctcacatccacagctgagcacacgtaaatgcgacattgatacttttttttttcaggcatatttccaagtgatgcgctctagagataataaattctggggaatcattttttagagaaacaaaccacagtgagtccaacagacgaccaactcttaggctggatgaaccccattgtcgagtacccggtatgcaactttaccggacatttgtcgtcaaatttaacatggaacgtgacccgaatctgaatagtattttcattcctgtagagaataacccaaaaactttttcgttgttttcgattatcaaaaacttgacagctccccccggttcgatgtcaacatcctgcgctttgactttcaattcgattcgaccagaaatttcaggagatgaagaggacgatttggaacgggaacgttggtgtgtgtgtcgcgacatcctaattaacaaatgcgcgacaaaaattagattataaacgtgatctctttgttaggttcgtaataagctactactacttaacagaactttattctttgaaatttctgtaattgtacggatggaaaccccttgtttgaaatttatttctaacgaaaatggttgttcgaatttgagatcagtaactccaacctaagaaaactttttaattattcgggggagggcgggataaaaaagatgtgccctcaattttacacaaattcacctggatgcaatcagactcttaaatgcacttcttcaattattgtcgtatccgat

SEQ ID NO: 37910 - DNA, 424 bp, Heterodera glycines
tcagggacggtcccaggattttggcttggggggggggcacctccccccgggcgacgaccttttttttttttgcttttcacacccgttttttatgtggcgaggtttttccaaaaaaatttttgggggacaggggatgcggcggtgccgataggcgccgtcgggaaaatttttgcggttttaaatgcggtttgttaacagattttgtccaaaaaatgaccaaattttgtgattttgagccatttttagcagattttcattaaaaatttgtggattttttgaaaaatttagcgacatttcttggaaaatttgggtgtggctaggtctggggggggggtaccagcccagcaaggaaaacctaaaattttcagccaaaatattatttttccttaaaaatttttggacccggggggctcttggggggggg

SEQ ID NO: 37911 - DNA, 1205 bp, Heterodera glycines
aaaaaattctcgctaacatctatgtataagtctcggatgacacgtatttgcacagacaaaaaataaaaaaaattctcgctaacatctatgtataagtctcggatgacacgtatttgcacagacaaaaaataaaaaaaattctcgctaacatctatgtataagtctcggatgacacgtatttgcacagacaaaaaattaaaaaaattctcgctaacatctatgtataagtctcggatgacacgtatttgcacagacaaaaaattaaaaaaattctcgctaacatctatgtataagtctcggatgacacgtatttgcacagacaaaaaattaaaaaaattctcgctaacatctatgtataagtctcggatgacacgtatttgcacagacaaaaaataaaaaaaattctcgctaacatctatgtataagtctcggatgagacgtatttgcacagacaaaaaataaaaaaaattctcgctaacatctatgtataagtctcggatgacacgtatttgcacagacaaaaaataaaaaaaattctcgctaacatctatgtataagtctcggatgacacgtatttgcacagacaaaaaataaaaaaaattctcgctaacatctatgtataagtctcggatgacacgtatttgcacagacaaaaaataaaaaattctcgctaacatctatgtataagtctcggatgacacgtatttgcacagacaaaaaataaaaattgccattgataaattatatattttatatattcattttatatgttatcaaaatcgaataaaatagttggcacttttacgaaacgaccacagtggcacttttacgaaacattcccaaggtggcacttttacgaaacgcccatagtggcactttttacgaaacgacccagcacgtaaaatttggacaaaaactgaactcgaaggaaacaaattaaccggcaaattacaaccaacctgagcattcaggtttgatctttcttcatcaaattttaatatttaatattgattttaacgattttaattgctaggacacggatttatgtggatttcaatatttttttgcacacatatttcggccggactcgaacagagttgggccccggctgataaaaattagagttgcacgggaccgggaattttttacaaaaacgggatggacttgccggaaccagaaaagtcgggacgggacctcgattttcg

SEQ ID NO: 37912 - DNA, 673 bp, Heterodera glycines
  misc_feature (652)..(652): n is a, c, g, or t
actttctgaaaaaaatatttatgaaacaaaaaaatcgattttttcaagtgtccgtttggggtactcaaacatttatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggctcggggggactgccccgaaaacaaaaaaatcgattttttcaagtgtccgtttggggtactcaaacaattatgggggagcaaaaatccaacgcagaattaaagtacaggctatagggaagctattcccgaaggattcggtctccccataaatctgngcgcatcggttcggggggact

SEQ ID NO: 37913 - DNA, 1014 bp, Heterodera glycines
taaccccattcagagactagtcaaaaaaaataataatacggctctggactactatactaattagaaattttagaacgtgtccgttaaacgcaaaaccgtcgtgaaaaatcgttataactcctttcagagaagagatagaaaaaaaataaaaatagggttagagagcccgtgaacagctcgcatcggatgcaagtgccgccgttgctgtacgcctaacagttggtgagcaatgacggaaaattgcttaaaaaagaaaccaaacaaactcatcaattgttagctcccgttggcaaaccgaagggtacattggggcaatggatgttgggctaccgtatcagttattaaaatttttgtttttcaaaaaggatactaaaactgggataaccccattcagagacaagtcaaaaaaaataataataggcttggactactatactaattagaaattttagaatgtgtctgttaaatgcaaaactgttgtgaaaaattgttataactcctttcagagaagagatagaaaaaaaataaaaatagggttagagagcccgtgaacagctgcatcggatgcaagtgccgccgttgctgtacgcctaacagttggtgagcaatgacggaaaattgcttaaaaaagaaaccaaacaaactcatcaattgttagctcccgttggcaaaccgaagggtacattggggcaatggatgttgggctaccgtatcagttattaaaatttttgtttttcaaaaaggatactaaaactgggataaccccattcagagactagtcaaaaaaaataataataggcttggactactatactaattagaaattttagaatgtgtctgttaaatgcaaaactgttgtgaaaaattgttataactcctttcagagaagagatagaaaaaaaataaaaatagggttagagagcccgtgaacagctgcatcggatgcaagtgtcgccgttgctgtacgcctaacagatggtgagcaatgacggaaaattgcttataaaagaaacc

SEQ ID NO: 37914 - DNA, 719 bp, Heterodera glycines
tttaccatttattaaattaattttaaattatttttttcccccattttgatttgatcaatttccaacttctggatcggttcgacactgcgatcagtgtcgagcgcatgctttccgcgctggagtccattttgcgccggaaaacaatggtcacgtttgggtcgtcgttgaccaacgcgataaaatccgtataaaaatattggcataccctggaaaattaatctttttttattaattaggttctaattaaaattaattaattaaataagtaaatcggttggtggccggctgatcaaattaattaaatccgttggtgtccggctgggcaaattgttaaattaatctttttaaactagttagggcaaattaaattaattaaacaaataaattcgttggtgtccggctgggcaaattatgaaattaatctttaaattaattagtgcatcactaatttaaaattaattaaataaatccgttggtgttcggctgggcaaactgttaaataatccgttaaaactaattaggggcagcccataattaaaattaaataattaattaattacatccgttggtcgtccggcgtgtatacaaatgacacttcactccaattgtaattgcccaaaattgagcgaacagccattgcgagccttgaaaatagggttaagccccgaccccgagcctcccgacccccgacccgatccgagacgttttatggacctatt

SEQ ID NO: 37915 - DNA, 1034 bp, Heterodera glycines
agaagtttcccaaaataaaatcacatttgggagagtgcaacagcaaatgaataaataataacgggtcgataaaaaaatttaaaaaaaaattggccgcgcatttcggcccggggcatttttaaacttttgacattttatggccatacttcgcactcatttattcatttttttattttttatgggtcaaagtcaaaattgtaaaagtcggattagacataaaattagggggaacataaaatttaaagaaaaaacaacgaatttcaatcctccaatatgaatgaaattcatcaacattttctgcgagcgtcaaaaaataatcgacgttgactttgaacattttgttgccgcaaatgcaaaccgacgaaagcaaagaaaagcgacgacgaatggttgttaaatgtctgtttttacaatattaaatttcattttctccttatttttcaaagaatttttaattgagacgcagtgattctaagaataaattttggtggaaaagctgttactttcaaacaaagattaatacttgtgtaatacataacgtggtgagccgaagtgcaaaaagtgcgaatgagtggtgatcagaaggggcgggtcatttcagtaccgaagatttattctaatgattaattattatttaaatttataattgaatgataagctaataataataaaaaatatatttggctctatttcagtttacaagaccacgaaaaattgacatgacaatataataattttacaaatttaaggcaccgtaactttttcaagaagcatccaaattaaacattcttggtaccatttgatagcctaaagtgttccattatttgcctttaaaatttcaaaaaatttcgttgagtttcaaagaagttgtggtcaaaaaggtttaccaaataaatttatgaaaattacaagccacaacttttttgaaacaatgaaattttttgaaattttataggtaagtagaggacacttacagctatcaaagcataccaagattggttaatttggatgcttctctaaaaagcgatggcgct

SEQ ID NO: 37916 - DNA, 1763 bp, Heterodera glycines
  misc_feature (11)..(11): n is a, c, g, or t
aattttaaatntaattcaaattattaaatatttattcattttatccccgtgcatcaattttttgactctttaattacttaaaatccattattcaattttaatcaaattcagttgcccatggcccgccatcaagcccaatgtgttggccagctattccgtgtccgatgccgtgtccacctattacctgtacaccaaatacgtgcacccgttcatcttcgccctgtgcacaatcatcccgctgggcccggacgacgtgagttggggtggaaataaatcccgaattccggcaatttcctcatcaaacgcttcaatttcgacatttttctcaactattcccgattttcaacatttttcggtactttttaagtttacgagggtatttttaacgatacattttcagattcctataaatgtgttttagaaattaatgaaaataagttttaaggggtcgtcgaaggtcgcctgatcacgaatccgggctcagatcgagcgctaccgattcactacgatgagctgtacgagggacaaagaattgataggcttcctgtaccaataataccctcattggcgagatgcccgtgaggatgggtgcactacgtttcccccccgccgtttcccccccgccggttcccccccgccgtttcccccccgtatcgagttcccccccgagctcggttcccccccgcgatcgtttcccccccgagaaaatttttttaaaaaaaattgctaacttagaaatttttcgagaaaaaaatcttagaagagtttttttacggagaaaattctaagaaaaaaaaatttttgagaaatttttatggtgaattactatgatttttcaaaaaaatttcaaaaaaatcgctaaaaatttctcaaaaattttttttttcttagaattttcttgtaaaaaaactttctaagatttttttcttgaaaaatttctaagttagcaattttgtttttttaaattttctcgggggggaaacgatgcgggggggaaccgagctgggggggaactgatacgggggggaaacggtggggcatcctaaaccccgaccttttcgcgacccgatttccaagatttttctcgtgtacccacaattttcggacggcccgaattctaagtaccccgaatttttctcgcctcgctacctaagccagaaattataacatggccgtccaggacccagcttctcccaaaagtgcctgccatccctaccccaaatagtcggcccggcttttaaaggtccggattctgtctcagccacagactcgctttttttgtcttgggctttatcgaatccctaaaattatcaaccaggtgtcattttgtcactggaaaaaagtgtgcgctgttgacattgggcactcgaagggctgtgtgaacgtacatgatagcgtcttcgcgaattatgggagatgcaaggccccaaggatgggatggaatttcaaaaaaaaaattggagtgaaccggaaaatttacgaaaaatttccgactaaattctaccccatccctggtaaagtaatacggaatttgggttctcaatttattgtaaattattaatcctaaatcttgcgggagtctgatctgaacatgtaagtttctctaatccattcaatgaatattaaattaagtataagattgaacattttggaataaaattaattatttttatcgatttaaatgtaaataaataaataaaattattaataccgaatgcccctaaatagaacagttgctaactgtgctatactgctttatctgt

SEQ ID NO: 37917 - DNA, 997 bp, Heterodera glycines
agaaaaagagatagacgttttttcaaattttcagaacttcctcgcccagaaagaaaatccagaaaaattagggtcgtcgctattattccgaaaatgtggttggagttcatttgagtgttgagcagaaaaagagatagacgttttttcaaaattttcagagccaaactcgcccagaaagaaaatccagaaaaattagggtcgtcgctattattccgaaaatgtggttggagttcatttgagtgttgagcagaaaaagagatagacgttttttcaaaattttcagagccaaactcgcccagaaagaaaatccagaaaaattagggtcgtcgctattattccgaaaatgtggttggagttcatttgagtgttgagcagaaaaagagatagacgttttttcaaaattttcagagccaaactcgcccagaaagaaaatccagaaaaattagggtcgtcgctattattccgaaaatgtggttggagttcatttgagcgttgagcagaaaaagagatagacgttttttcaaaattttcagagccaaactcgcccagaaagaaaatccagaaaaattagggtcgtcgctattattccgaaaatgtggttggagttcatttgagtgttgagcagaaaaagagatagacgttttttcaaaattttcagagccaaactcgcccagaaagaaaatccagaaaaattagggtcgtcgctattattccgaaaatgtggttggagttcatttgagtgttgagcagaaaaagagatagacgttttttcaaaattttcagagccaaactcgcccagaaagaaaatccagaaaaattagggtcgtcgctattattccgaaaatgtggttggagttcatttgagtgttgagcagaaaaagagatagacgttttttcaaattttcagagccaaactcgcccagaaagaaaatccagaaaaattagggtcgtcgctattattccgaaaatgtggttggagttcatttgagtggtgagc

SEQ ID NO: 37918 - DNA, 869 bp, Heterodera glycines
ctccatgaagccggggtttggcgtgatgcagtccctcttccgcttgacgtactccaacgcctcgtccagtccccagccgtacgctttcattgcgtaagcgatgacagtggacgcggaccgactgatgccctttttgcagtggaccaacactttggcacccttttccctgcggggaatatttttgaattatttaaaattggcacttttttggcaatttgcccacttggcctccttgataaagtcgtaagtgcgttgccaatgcatcaaaagttcggtggtcgcctcgtcggacacccaaattttaaggtaagtgaactgagtggggaagaaattgtccacttccttcgtcacgttcagaatgtattggacactgaaaaatcgagttaaatttaattaaaaagcattttaagttttttccgggataatcaaatttcaatccatacttaggcatttttcggtttcgactcatttttgccgacagatagtccgtaaattatctatcttttgtcccacccattcgccttcagctcctcccaattggacgcgttccattccgtgccaaggtaaaggtaatcgaagattttcgagggccgatccaattgacctggaaaacaagtgtggataatactaggatcagatatggtatatctgaccaaggatgacgagcatttggtggtcgatgaactctttgtagcgccgctggtccaccgaaatttgctcgctcaaccgccggcggatgtcctgactcgtcctgcaaatggggccttacgtattttttcaactttttccgcttttacacgtcgtccaagtccacgctttgcatgatttgcttcagtgccgttttgatgcgctgctccgtctccaattgc

SEQ ID NO: 37919 - DNA, 1217 bp, Heterodera glycines
  misc_feature (26)..(26): n is a, c, g, or t
tatcatcataataaaataaactacanttttctccccacccggaatagttataaattgaatagaaaataaaagtacccccataaaaaaatttatatgaaaaatatttaaaccataaaaaatgtaattaaatacttatggattattttttaaatgcaaatttaagcattaaaatgataataaaattttaaaaaatatactcatattttctaacaacggactaatcttttttagtggatttcggttgatcgaatgaatttcaataagtattaaatctccaaattataaaagtgattaccaaaatttttgattttaaataaattaaatgccttttacttgattcttgtttaaataaagaatttttctattttaaaattaatttaattgagcaatttagtttatttttaagatttttacatttcatttttaaagaaaaagcgcattggattaaatcatgattttttaaaatttattatcagttaagaagaagaaactattaaaacatttatgttataaaatttttctacattcaattgtgcagaaaaggtggtcttgcgaatttcttttaataattctttaaattgctcatttttatcatgttattgttgactccttttttagctaaattttttatttttatgatgtcattccgatttaattatactaccctgattttacttgacaaatcgtgcctcggaaccatattgtccatttcacggcaagcaaaaaatagatttttgtaaaatgattccaaattttgagctttattttaattctccgaccaatagctttcaaaataattcggctgatcagaccaaagccggttcgtccgtctgtccctagctcctttgattaaattataatattataaaagtcttcagtttttcattattttaagtgttcaaaaaaaactaagctgagtgaaccttggaaatattcttggatattaaatttttcatgcactactaatggtgtctaatcattttagatttttatataagtttatttactttttatggtatattattttatattattataaagaatttttttgatttttccatttattgctgcacggtcctttatcgtttccaacatatggggcttcataggtttaaaaaatttcacttaaataatagtatttatattattggtatagtatttttattatgaaatttcaagaatttttttatttcataaataatgattaattagttaat

SEQ ID NO: 37920 - DNA, 991 bp, Heterodera glycines
  misc_feature (92)..(92): n is a, c, g, or t
gctgctgctgcttcttttttctgcttggcttacactataatttttgttttcattcgaaattaaataaaattgtaacaattttatcattttcncaataagccaccgttttagtgccaatttctgctgatggcacttccttgtgctcggctttgtgcccttttctcagttttggtcgtcacttggaatggtttcgtttcctttttaatgactttttctttcctttttctctctctctttttaaataattttaatttgattttaatttaattaatgtttttgaattcacttcagtttcccgtgcgtttattgtcgcgcgcgttgcgaaaaaggaagtgccggccgagtgccgaattctgaaccacgagacggtgtccgatcaaacggtgcccgacacgataaccgtcaacgagatacggtattgggtgtacggtcaaattcagcacggagccaccagcaaggcaagtcgcggactctgcaacgcacctttggcattatgtattttcacacttttgaaggtgttccatggggtcgaaagaatgccaatggcccatggaaatcgttgtgtggccatcaaagtggtggacatgaacaaaatcgagccggagaaggtgaatcagctgaacaacgaggcggccattctgcacgaactgaaagcgcgcggagtgaaactcatcccccaactgtacacaatgtacggtagaaaaacgaaaggggaactcatcccccaactgtacacaatgtacggtagaaaaacgaaaggggaactcatcccccaactgtacacaatgtacggtagaaaaacgaaaggggaactcatcccccaactgtacacaatgtacggtagaaaaacgaaaggggaactcatcccccaactgtacacaatgtacggtagaaaaacgaaaggggaactcatcccccaactgtacacaatgtacggtagaaaacgaaaggggaactcatcccccaactgtacacaatgtacggtagaaaa

SEQ ID NO: 37921 - DNA, 636 bp, Heterodera glycines
ttgtcatcccacagaactcattttagcgaaggtggcgttcgtaagacaattttactttttgttttttggctgcaattgggttagccatttctgaaaaatgtccaaatcagaatatacatcaaattggttaactatgtattaaaaaataaaataagtaaaattgtaaaaaatgagcgaatgttaattaaacctaacttatgccaagtggcgagggatccctcaggcttagtttttagaatcttaatttttaaaaaagcacatttttctatttttgggttgggccccaaacgaccccggggcccaaaaacgggggcccaaacgctctggcccatacgcaaatttggtatcattctaaagctcttgaatggtaaggtatgaaatcggaactgacgccgtccgagcactgcgacaactgagtcctgctgatgtatgaactttcatcactgcttaactatgccagatcggacagttgttcatgattttctgaaaaaaatatttatgaaacaaaaaaatcgattttttcaagtgtccgtttggggtactctaacatttatggggagcgaaaatccaacgcagaattaaagtacaggctatagggaagctattcccgaaggattcggtctccccataaatctg

SEQ ID NO: 37922 - DNA, 620 bp, Heterodera glycines
cggtgctgtttttgaactcgcatctccaaaattttgtcatcccatcagaactcattttagcgaaggtgtaaaggtggccttcgtaagacaattttactttttgttttttggttgcaattgggttagccatttctgaaaaatgtccaaatcagaatgtacatcaaattggttaactattaaaaaataataggatttggaataagtaaaattgtaaaaaatgagcgaatgttaattaaacctaacttatgccaagtggcgagggatccctcaggcttagtttttagaatcttaatttttaaaaaagcacatttttcgatttttgggttggggcccaaacgaccccggggcctaaaaacgggggcccaaacgacccccggggcccaaaaacgggggcccaaacgctctggtccctcaaatgtcgggtcctcaattgtcgggatactcaaatgtcgggtccccaattgtcgggatcctcaaatgtcgggtagccacgctttcgccggtttgggcccccttccacagaactctcagaatttcatgcacatgcaaagaaagacagccacccttttttttgtttggctttacatttgtcaattcttcatttttcctaatttattatt

SEQ ID NO: 37923 - DNA, 1329 bp, Heterodera glycines
agggcatgcccaccaactatgactatcatagcaagcgattatggaaccgctcatggaactcaaagtgtgtggcactaccatcccaaagtgcacggtttggtgtaggcctccctatgtcgggtaattactcccttcataaggcacttgcgccaacgcccacagcacatatgagttccgtcaacgcggattttaatccagggtgttgagtttgagcagctgcgcgttcgacactgctcagtgactcacggtcctccgggccagccagtcccggttattctctcgctgtaccaatgcagcccgtaggcagggtacattagggctaggaaccgccacccccgctgctaggaacaggcacaccttcaccctcaaggccagcgagtgaagggcccccgtccacaccagaccgactatctggctgggcttaaacatcgctgtgacacccggcgggctatgacggaaactgggtttcggtcagtcactgccgcagccctggataccagcggaataagccccgtggacagtgaacgcccgtgcccacccctctgggaagtaacccagtaccggggcagggctcctcggtttaaggatggcccccaggatatttgaaaaggcttaacaaatatcctaaaggggtttagtaccgagtaaaccaacaacataacaaaatggggtgagaaaggacagtacaaagtacttgtgatcaaagaaaaaaaacaagggaaaaatgaagaaaaagataaatttgggaataataaaattaattttaaaagaggaaaagaaaaaatttatagaaaaaatagtcaaaaatggaaataatttgaagttaaaaattttaaataggacaaacataatgccaagagtcaaaataatttttaaattaaaaaaaaaaacggaatgcaaagggttgaaataatttttaaatttgaaaaaaaacagaatgccaagggttaaaataatttttaaatttgaaaaaacagaatgccaagagtgaaaataatttttaaatttgaaaaaaacagaatgccaagagtgaaaataatttttaaatttgaaaaaaacagaatgccaagggttaaaataatttttaaatttgaaaaaaaagaatgccaagagtcaaaataattttttaaatttgaaaaaaaagaatgccaagagtcaaaataattttttaaatttgaaaaaaaaacagaatgcaaagggttgacataatttttaaatttgaaaaaaatgccgactgaaaataattttaaatttgaaaaaacagaacgccaataatttaaataaatttaaaatttgaaaaaacagaaagccataatttaatttgaaaaa

SEQ ID NO: 37924 - DNA, 704 bp, Heterodera glycines
tattagcattacaaaaagtaaaaagatttttcggcttttgaaaaagttattaagaaaaaatttcaaaatttcgacttttccgcaattttcacgtataacttttttgataattatctaaagaaaacctataaaagtgtttttatgtgttgtcatattcgaacaagtttttgtgggttttgaatagagatcgacattttgaaaaaagcctggacctggacctgggttacatgttggacctggaccttgatttcctggacaaaaatccaggaaaatccaggtccaggaaaaatccaggctcctcgagacctggatccaggcctggacctggattttttgaaatttattttaaaaatcaaaaaaatgtttgaaaaaattaattatttgcttagaagcatctaaaaatatctaataaataataataataatgtgtttttaaatttatttaatctgtttttgaaaacttgaaaaaacatcggtcacttgaaaaaataaattctaaaattttgtccaggaaaatccaggttttttcctgttttgcctggacctggattttttttcacatttgacctggaccttgatttcctggacaaaaatccaggaaaatccaggtccaggaaaaatccaggttgccgaaaaatgcctgggacctgggacctggatccaggaaaaacccaggactgtatccaggtccaggacgatctcta

SEQ ID NO: 37925 - DNA, 994 bp, Heterodera glycines
tttcaattcatgcaaggaatttcttgaatctataaattgattcactagaaaagcgttagtagaaaataaaaaataattggagcccatattttcgtcataaattgagtcccgaaagataaatagcatggcaaaacttgaaaatatttgtcgatttattgcctattttccatccatgtttgggatgaggaaatatataaaaagataaactttgtataagtatttattatcatggaagtcgtcagaataatatcaaaagacttcgtataaacaatattgcaataatttaagttcgttttatttttcagtcaacaacacggccgagagaaattttgatacatcaaagacacacctaaaatacaccgcggtgagagccctagcgaaggctggactataaaattgcacaacaaatatacctactgttcgagttatgttttatacgagtcagatatgagtttttcctatggcaaggttgtgaaattcctcccaaaaactttcttacggaaaataagcagcaaattttaataaaaataaatacttttcaattcatgcaaggaatttcctgaatctataaattgatccactagaaaagtgttagtagaaaataaaaaataattggagcccatattttcgtcataaattgagtcccgaaagataaatagcatggcaaaacttttaaatatttgtcgatttattgcctattttccatccatgtttgggatgaggaaatatataaaaagataaactttgtataagtatttattatcatggaagtcgtcagaataatatcaaaagacttcgtataaacaatattgcaataatttaagttcgttttatttttcagtcaacaacacggccgagagaaattttgatacatcaaagacaacataaaatacaccgcgggagagccctagcgaaggctggactataaaaatgcacaaacaatatacctactgttcgagttatgttttatacgagtcagatatgagttttccta

SEQ ID NO: 37926 - DNA, 992 bp, Heterodera glycines
aggcctgcaaatttggagagattatatcgattttagtgcgttaagttcgatgaaactttttaaaatataagcctaaactttttggcttatttaaaaaggaattaaaaatttttaaaaattttattcatctcccttttgatagaaaaagcatcagagtgccttgattaacctgtaaataaagttttgtgtgtttcagagcactttctgaaaaaatacttatgaattaattttgcaaaaaataaataattaatgaaaaagtcagaatttcgaaaaattttaaaaacaacaagcgttggcattttttcaggttaagttagtcctttacaatggagaaggcctgcaaaatttggagagattatatcgattttagtgcgctaggttcgatgaaactttttaactttttggcctgtttaaaaaggaattaaaattttttaaaattttattcatctcccttttgatagaaaaagcatcagagagccttatttaacttttaattaacatttggtgcgtttcagagcacgttctaaaaaatatttatgaattaattttgcaaaataataaataattaatgaaaaagtcagaatttcgaaaaattttaaaaacaacaagcgttggcattttttcaggttaagttagtcctttacaatggagaaggcctgcaaaatttggagagattatatcgattttagtgcgctaagttcgatgaaactttttaaaatataagcctaaactttttggcttatttaaaaagcaattaaaaatttttaaaaattttattcatatcccttttgatagaaaaagcatcagagagccttatttatcttttaattaacatttggtgcgtttcagagcacgttctaaaaaatatttaatgaattaattttgcaaaataataaataattaatgaaaaagtccgaatttcgaaaaattttaaaaacaacaagggttggcattttttcaggttaagttagtcatttacaatggagaaggcc

SEQ ID NO: 37927 - DNA, 1264 bp, Heterodera glycines
  misc_feature (161)..(161): n is a, c, g, or t
  misc_feature (1248)..(1248): n is a, c, g, or t
aagtcaagaggctcgcgcaacacgggaaacgtgacagtgatgaatttccaaataccagcgtaaccgtgaaagatatccctttgcaaagcattccagggaacccaatgaattggccaccttcagtgtcaagttttcagaccatattttcatcttctgacccnacagcagcatcaacgacaaccaatgttgtaaacaaatctccacgaaaaaggcttaggccctcttctgttttgcaaatcggaacgagcacaaccactttgattttgttgctgatgatcgcgttggtcgccatacctgtgaacgcagaacaagcatcggaatccgacttgaaagccggaacgggtatttttctcacattttcggatttgttggcactgcttggaatcgtggtctctcttggtgcaatggctggattcattgcatgccatatgagtgcgctctcaaagaacaggagtttttgggctatggcctcatctaatcattccattatggaagaaattgttgctaatcatacaatgacgccacgcttaacagcgacagtccgttccctgattaacaacagaccagtaagctgtctggctgataccagagcaagtgtttctcttgcgccgatgagtcttatcaatgaattgaaatgcaaaatttttccgacaaatcacaccgttagttcagcctccgggcattggatcaacataacagcagcagccatggtacatatcgaaattgcaggtcagaaaatttttggcgaaataaaactcattcaggatgaagttatgagtgacagaagggattatcaagtcattcttggatgtgacttgatggcaaaacttccaccgattacttttgattttgttcaaggtctaatcagtatttcaggaaaatctgtaaccatgggagaaagaggtgacttgctttactccaatgtcaaagttgtggcacgtcatcatgttgacattcaaccaggatcctatagcatgctgaccggcaaacttgattcacaaattcaacttgatcaagttataacacattcactggatggacgactctccaaaatgcatctcgggatgatctcaactgtcgcaaagcccgtggagggatgcatcaagatgatattgaccaacccaactgatgcaccaatcagcatttgtgccggaatgcacgtagcacttgtcaatgaattgaaacaaagcgtggacggtccatggcttgaggaacaatcgcaagtaaaggaagccaatgtcaatccangaaattactacaaatg

SEQ ID NO: 37928 - DNA, 818 bp, Heterodera glycines
tgtcaatatataaacaaaataatgtgctgtttattatttgaattaatgtcgattaagacgtctattaattgtaatcataatttccggttgaatttgtttataacatttcttataacaaattagaattaattttaataggtccattcaattagtgtttgaatttaacttatcctgtttgctagagtatcatctcggcccagaacaaaaaattggagtaaattttgggattgatcgatgtacaattaattatgtaattaaatcagttaggtttcgatttatcagcatcttgcaattaatgttaattcttattatttattaattataaataatctgtattttaactttctttaatttcaaactaaattacgaaatttaacgatattcgtttaacaaagattaatttctacatgtagaattatcagagtagtttctcacttcatccttgggggggggggggtcttcattcaatttgaattttttttattcggtttgcgttatctcctcacgactcggcacgtaaatttatcagcatttatatgatgatttttatgattttcatttttataaataatttttttaatgtttttaaatatttaattccattattttatgcttgaaatttttagggtaatgtgctggttattatttattaaattcaatcaattaattttacatttctttacaacatttttaataattttgcaattctcatgctcgctgattgtacttctgttttgtctgagtcaatctcgattgatcgtctattgacacacgcggttccactcatcattttctcttttttcaaatcattatttctg

SEQ ID NO: 37929 - DNA, 825 bp, Heterodera glycines
  misc_feature (729)..(729): n is a, c, g, or t
  misc_feature (781)..(781): n is a, c, g, or t
  misc_feature (787)..(787): n is a, c, g, or t
  misc_feature (797)..(797): n is a, c, g, or t
aaaaaaattcccaatcgcttcgggaatttttttctaaaatttccccgattttcagtgtattttcgggtgttcaggtcaccatgaaggagtgatctgaccatgttggtctaaaagacttttttgatcagcataggaaatttttctggatttttttttctatataaaattgagtttttggtaaattaaacattttgctccattacttttgtgacaccgaaaaggggcgctgtttgggttatgaccgattttctcgacgaaaaagagagttatcgggtcagtttttgggtatttattaaaaaataatgtttaattgctttaacattttataaaatggcagcgtttaactctttttctgtgtaaaaagtaaaagatttgttaattgtaccgatggtactcccccccaacttccttttttgttaagaaaaatttcaattttttctcgagattgtttttttttgcataaatacgattttgttgaaaattgaattttcggctttttgtccgaattcggatttggggttcgaaattggcccaaacggaagtaagaggcgggttttccgaccctgaagacctctaagaggattttatctcaaaaaggaaattgaattaaataccatcggtaatttgtgcttttaccaaagatttaaattgcatggattaccttaataagttctttttaaggctatattgcataaatttctgcaaaatgttctgagtttatatcgcggntttacgattataatggatgatgacagaatcggaaggggaaattgtttatgancagcantgggtagaangagacacacactggattaaggatgtttt

SEQ ID NO: 37930 - DNA, 1191 bp, Heterodera glycines
catttggaacaaagcatttctacgaatgcatttacgccgcccagtcgacgcttccaagtgcaaaactgtcgcttttgtgagtttggagtgatcaacgacactttgtgtgcgcacaatgccgatcagtggcggagagaggaagctgtgagttgcttttgctcctctccgatcgcttttcgctcagatgggccatttcagtacaattggttcaatgatcttggcttactcattattctcggaattctcttcggtctcgtgttgttcctcgtcttcgtcattctctgcctttgttctaagttggcattttgcctttttggcattttctttttgccattttttagtcggcccaaaactcagagaaaagtgcgacggggcgaccattacagaaatggcgggccgggaacgtacagacgcagcgaattgagcgtcagcgaaaacggatttggcaatcggttgggcgaccccttggctcatccgctgcttctgaacggacacatcgacagcagcgactgggccaagcccaagcagctgccggcagcagtgcagcgaggaatgaacttacaaaaacagctgcagcagcagaagacgagcagtggcagaagaagcgaagaagatgccgaatcgacgacgacggcacaacggcaccacgggggaactgaagacaatgagaggagcccaaacaccagcgaaagtgtgaggaatgaatcgggggagggagaagggaagggattaagagagggagagagagagagaggggaggaggagagagagcgtgagaaatgtaatgagagaaacggagggagagagattgggagagggggaaaaggagtggacaaagagaggggaagagagagagcgtgagggatgagagaaacggagggagagggattgggagagggggggaagtgaggggacaaagagaggagaatagacagagcgtgagggatgacatactagaatggagaggaatagcgagaggagagaagttaattattaaacaattcaatttataatcttacataaatatgaggaagttttattttagttgaaacggaatttgtaccgttatcagtgtccaattcaatttttcattcctttaagatgtatcttgggccttaggatgttatttgcttactgaaaatgccaatcaatgcccattcatccaattttcacatttttttataagacaga

SEQ ID NO: 37931 - DNA, 1038 bp, Heterodera glycines
  misc_feature (219)..(220): n is a, c, g, or t
atttctccgtcattctttttacagttttaaatcaatttctcagccaccaaagaacacaaaatgaatgaatgataataaatgaaagaatgagtgagtataaataaatgcaatcggcggagaaaacggagggaaaaaggggaaaaaagggggaaaagggaggcgaaaggggcggggcaaaaaatcgctgctaaaaatgggggggggggggacggaagaacnnacaacagaatttaatagctaattttattgtttgttgctgatactgctgcactttgtcctctctctcttcgaccaacaaattttcggaaaataaaaacttttaaaaaaaaaaattccgttaaaaccaagcggaattttttacattttttcgctgtattaagggggggagaggcagagaaaatggagatagcaacggaacaagtttttgtgctgctggatggatggatggatggtggtgagggtgtattaaaagcggggcgtcgtcactatttatggcacgtccgtcctgccctcccgcgcccaacccaacccatccaaaatgtctttaattgggcaattaaccaatcaatcaattaattagtcagtgtcattaagtctgtcgccgacagcaaagagcagcccaaattagaagcgcacgccgcccaatttagcacgccaatgttttacgacatacacagcaaatacgcatggataagcaaaactgtgtgcatttttacgatttatgatggtcataaatttgaaaaatgggagagaaaaacggcgctaaaaaattcgccggaattccaaagattcgccgagcgcatttttgtatttgtgcgaagaatttttgggtaaacattttgacaaaattttgcgaatttcgagtcaatatattaaaatgtttgttttgcgagtctttggacaggaaattatttaagaatagtgtaatggctgatcgaaaatagctgtgggagcaaagcaacaggggccaaaatgaaggaaagatggccccaaaacaacagtcgtccctccagtggtggatgtggtctagtggctagg

SEQ ID NO: 37932 - DNA, 876 bp, Heterodera glycines
tttctttcactgcgacggtttggcggcgattgttttgatttgtgtacgtggcacttttttatttacttcgtcatcaaaatgcaacaaattgtcaacataaactccctcaattcccccccccccccaacttttttggcattttgtcataaaatgtttcgttgtccctttattccctcccctcgtcgttttgctgtttcgtgtgcatccgtcgcgcttttccggaagaattgcatcggccgcgggttccgcgcagaatggaagatgattatccgtccataaaatgttttgtcctcctcgttttgattgcttccaaacattttatagtctctccacgttgaattggggtgaaaatgcgcgacaataaatccttcgctgctgggctttttttccccaaaattttgtaaaagtcgggtaaaattcgcggaagagtgcctaattagagggttctttgcgctggacagtcgagagtgacgagttaatgggtcggaaggcagtcgagattggcactttgtcgtcttctgcgggagaaggccaaatggctttcttttctggggaagggggaagccgtgggaaaatgaggctgactttggacgcaaacattgtcaactccatccatctgtccctacgtgcctcggggaaatcggcatcgaaattcgggtgccctgagggctttttaccgtattcctccggttttccggcaaaacaaacattcgtttcgtttcatttttccctcgtctttttaaaacgaattccttttttcccataaactaaatttcgttcacagttaatttgttcctttttttacgtttttcttcacatttttcccatttttcggtaatttgtccataaaacaaagcgaaaaatgcgataaatcat

SEQ ID NO: 37933 - DNA, 965 bp, Heterodera glycines
agatttacgatagccgacaaattttaagtgatgtaggcactatgccaagaaaaaaaacagaaatattaacaaaaataactattatattattaatttctcttttatttattataaaaattttaagttgagatttaactaggaactttttcttcatcgatgcataattaaaataaatcattttaattatttttttgtgaggcaaaatattaaaaaaatattttttttgcattcaaatttcaaaaatgttaacaaacagcgcgatcgccatgcggatccattcgatgatattttggcccaaattgttgcttttatgcctcccaaatacctagctaatttgtaagcgctgtttttgggtgttcagcgcgctctttgttaacatttttttaaatttggatgtgggtcccccaaacggaaaagtacctaaatgtttccttgttaatttcgttaggctttatgttaagctaaaaaaacaattgtctaatttttccaaattttaattttataaaaattgtcatcgacccaataaaaaagcagtttttcaaaatttgcaccactcttttgccattggcgccactttttcaactatttatttcgcaattttttgccagtaattaggtttgtttaaataaattcacctccccatgtgcttcccatgctgcctccatagccacgccagttcatgcttggcgaataggtccatgagcgatagccttgccaaggtcctccaccaccacaaccgccacaagtggaagtagcgcctctaccataatgcccgtaattgcgaccataagaaccgtagcgtaagccataataaccaccgtaaccgtaccgagctgtaccacgaccgtagccaccatacccgtacccagatccatggccgtaccgacgtgcatcagtggtgtgagcaatgagcagcagaatgatttgcatgaatatgaccaagacaaacatagtatacttactaa

SEQ ID NO: 37934 - DNA, 117 bp, Heterodera glycines
ctgacgcgatgcttgcatccactgatgaaggtattccgattgtctttgctcggcgcgcacgtcaacttgaagaggatctcgctgcagctgagaaaactctggcatcgcaggaaagag

SEQ ID NO: 37935 - DNA, 975 bp, Heterodera glycines
  misc_feature (851)..(851): n is a, c, g, or t
gcgctaaaattgtttgaaaagctttttgagcgtaattacgattttacttacaccatttttttctaggcttagatcacatgcgattttcggcactctgataattttagcgctcataatgggatgtataaaggcgattgtagaaggaattggaagcgctaaaattgtttgaaaagctttttgagcgtaattacgattttacttacaccatttttttctaggcttagatcacatgcgattttcggcactctgataattttagcgctcataatgggatgtataaaggcgattgtagaaggaattggaagcgctaaaattgtttgaggagctttttgagcgtaattacgatttttacttacaccattttttgctaggcttagatcacatgcgattttcggcactctgataattttagcgctcataatgggatgtataaaggcgattgtagagggaattggaagcgctaaaattgtttgaggagctttttgagcgtaattacgatttttacttacaccatttttttctaggcttagatcacatgcgattttcggcactctgataattttagcgctcataatgggatgtataaaggcgattgtagaaggaattggaagcgctaaaattgtttgaggagctttttgagcgtaattacaattttacttacaccattttttgctaggcttagatcacatgcgattttcggcactctgataattttagcgctcataatgggatgtataaaggcgattgtagaaaggattggaagcgctaaaaatgtttgaaaagctttttgagcgtaattacgattttacttacaccatttttttctaggcttagatcacatgcgattttcngcactctgataattttagcgctcataatgggatgtataaaggcgattgtagaaggaatgggagcgctaaatttgttgaggagctttttgagcgtaatacgattttacttacacattttttgcta

SEQ ID NO: 37936 - DNA, 948 bp, Heterodera glycines
  misc_feature (905)..(905): n is a, c, g, or t
  misc_feature (922)..(922): n is a, c, g, or t
atccaaattacaaattatggtgagttatcaagatttacaacaacaaaaaaaaattacgtaatttggaaaatggcagatcagccggtctcaaacccgtttaaacttggagtttccgaaaataggccaactgggttttcaataaagctactttcgataccaaattattaaattggttgcgataagacaatcttacggcaaaaaaacatcttggaacaagatatatgttatatctttttgtaaaagttttaaaacaaacttcttttcgtatacagaagaatggtttaaaaaagttttggtactatttggtggagttgtataaaggattcaagccggtcacaacgttggaattggcggaatttaagaaatttgtcaagttatgcgaccaacagaatattaaagatgtgggaaataacatattgaaattttataatgtgtattattagacaaaatgttaaatttaatttattagaatccaaaatgagcgaatattttatttattaaatatttttgccacgaaaaaaattataaagatttataaaaagagaaattaatgaataagaatttggtgataaaatttaaaaaaatgaaatcttttttaaatatgaatcaatatttttaaaaaatcgtttaaattcctaaaatcaaagaaggaacaggaaatattcgttcaagtaaagacaaaaaaaaaacacaataaaatttgccaaattattatttaaaattatttagggccaagcatgtgcagctaccataagtccggaagagaagtcccgtctccgggaattgcatgaggaatatttcaccaaacaaatcactcgctctctgaaggacatgctcggcattttcaaaatgccgtcaacaaaacacaaagccaaaattgatcttcaccggctgatcatttcgcngtatcagcacgatttgngtgacataatgcgcagcattgaccga

SEQ ID NO: 37937 - DNA, 910 bp, Heterodera glycines
  misc_feature (812)..(812): n is a, c, g, or t
tgaacctaaagttggtggtggtgttggtatacgagtgagtggcgtattgccatggttgacaagccctatgagttcgtggatcggaactccttgcctggggaccagtgtgcttgcattcgaaaaaacacgagacataagcgcccgaaggcctttggcctgaggaagtgtcctaaccgggaaatccggagtgctcgtgtgagtgcctgtgcactgccctcggagctgtgtccagcggcgagatggttcttcccaagtccgggaagctcggatgcctggccagcgctgtgtcattaccacttgctcggtcgccttcgccgcccatgcgcacgcttgcgctgaacggagttgtttctgctgaaactatccgtctttacaagacggctgtaatagcggcgcttggcaacgctcgctagcagctatctggttgatcctgcctgaactgatgtgttcatttcaaagattaagccatgcatgtgtaagtttaacctgccagacagggaaactgcgtacggctcattacaccagctataatttacttgaccttgacttcttacttggataactgtggtaattctagagctaatacatgcaccaaagctccaatctccccagagcggagcgcatttgttcgccacaaaaccaagcgccctccgggcgtccagtgttgactcagaacaactaagctgatcgcacggtcttgtaccggcgacgtgtctttcaagtgtctgccttatcaactttcgatggtagtgtatctgactaccatggtgatgacgggtaacggaggataagggttcgactccggagaaggngcctgagaaatggccactacgtctaaggatggcagcaggcgcgcaaatacccactctcacgcgaggaggtagtgacgagaataacgagacgatctctt

SEQ ID NO: 37938 - DNA, 1784 bp, Heterodera glycines
  misc_feature (62)..(62): n is a, c, g, or t
gacggacgcattcaaatggctgaatcacatcaaaaaatattgaatatattgctaatgcttgncacgaagtgacgaaataggcgatggtgtaggaacacattttaaaggcttatatgaacatatgcattagtaaacgtataactttcacttagatgtcacattaatagtaaattcattttgataagttagatattgtttatttagagtctaataaaattcggtataaggtcactcaatttttttcatttcgcctacttcccgtggaccaaccgagcttgaataacaaaaaacttttttcaaagattccataaattctgggaaaatattcaacttaatcatttgcaacacttgcacagcttacatttggggaataaagagttgagatttgaaactctgacaacgatactaattataaacggcacgcctacatttcgcctactaagccaaaaacatttatttcgactacaaagccaaaatcggacatttcgcctactgacatttcgcctacttgtcatttcgcctactagccaaaaatcatttcgccgactggaaatacataatgccaaagagaaaataaaaagagaatatacaatatctatgtcggaccggatcagtttagtctggccggtttagtctggccgttttagtcagagggtcggtttagtctggcaagctgtttttgtccataactcttacaaatgttttttttgtcaattataaacaaggaaaaagcttcaaatatctatgtttagctacaatacaaatgaaatatcccaattaggaaacaagaaaaaagcaaaactttcattttggcgccgcctttattcagtcaaattttattcttcaggcaaagtaaaaccctaatttttcacgtttttttcccatataaagcttcaacgggcttatgcttgttcatatccaactgtcttccgcttcatcaacacaatttgatatgagataagtcaatcgatgcagacattgcacgatgcgtcgctggtgaagtccctcctcaaaaaacgcgcaaatatcgtgccgtcgatgcgagaattctcgactcttacagggttacaataccatcaacaacatcaaccctgcttaccaaaatgatcaaaattaccatacaatgttaatcctgataatatcttcaattttctcgttgaatttctcaaaaattatgaaatacgcccgtagtcattcttcaatgttttgttattttttcgttgaaaacactgataaatatgttatggtgttaattttaaacatttttcgaaaaaaaatctgagtagaatctattttggacaaaaacagcttgccagactaaaccgacccccaccgcactttcaaatgtgactcagtttattcaccgccaaaaaatgcttaaagtgcaaataaccaatttaacacaaagcgagtcaattttgggctcccatgcaaataagctggatttttcgtttcagtggtctgagttagtcaccaaaaagagggtccaaggttcaaagcctccttatgttgtgtgtaaaaaaatttcaattcattttgcattgggagccgaaaattgactctctgtgttagtgaatgaatgatattaggtatttttataaaataacagcgtgcaaaaacactaaactgtttcgtgttttataaacaaaagtgaaaagaaaaaaacatttatttaattattcctttgaaaaatacatataacaaaagtaaaaaatgaattgaaaaagtacataaatttgaagggagattacgtgcaaaaagaagctggtttttgacctaaaatt

SEQ ID NO: 37939 - DNA, 1553 bp, Heterodera glycines
aatgagagaggcactgtgtgtgaaagttcaggtacagtacacctaccgggtgtccagtgtgtttttgagggagtaccgtaccctcttgggcggcacgctaccgtacactgccatcagcacaaagatcgtttttgatcatctaaaaaatgaaagggccaacattacagaaatcccgcccactgaggtttttacacttgtgcaaaatcggaatgggccgaaaggaataattttcaaagctgaaactaaaaagtaaaaattatatttaagtaatttatcggcccatccgaaataaattagggaactgaaaaaaatctctttaatagctgctcaattgatgaaagttgtggagaagggaggagagtgttcgttctgtttcaaggtttatagcaaattgttctccggtcgtttttcaccggaggcacaaacgaccacaaattgcgccattaatttacattccttcgattttcagggaactcctaattcttccattaaaggcccgaatttatcgccgtcgtcctttgtcaaactctcccttttcactttatattattatttttgattacgattatttatcttttactttcttataataaatgtgtgttctttacagtgaggatggttttatatgttatatttttctgtggaataaaatataggggacgggacgaaatctcgccggtcgaaatctcgccaccaaatttttttttaattttcaaatttcaaaattatccaagaaaaaataaaaataaattccaaatttgattaacaatttttctaacattgcacaataattaacgggtcaacaaatttaattcatctcgcaataacatcaataaaattcccattctattttgccctttccattcttttttcgacatttgagggtcgtccattgcctttccgcatccccaaaacaaatcgtgtggggagctctcagccaaaacctttgaaccggtttttataagcatttctttgagcggctcgttctgttggaatttttttcgaaggcctcgcatcatcagattttcacagacacctcgccaaatgacaatattgaagcatttaatccggttatttttcccgagttttttaatttctgccggagtttttgccttcataattggacaagctgcttcaaagtcgcggaaaaacaaagctttttgatgctgataaaattgttcagtcgacgcataaatgatcccatccaattcaaaggcacgttaaggtttaaccatttccaatcgcaggcctcctcgtggccacgtgctggaaactctactatctttttttttacttagatagagaggctaatcctagtcgaaaagcgactaggaagcgaacaaatggttgttgattaaatttaggcacttgagctgggaagcgaatttgttaaatttatttttatttgttcttgaataattttgaaatttgaaaaaaatttaaaaaaatttggtggcgagatttcggcggcgatattttgtctcggcgagatttcggcggcgatattttgtctcggcgagatttcgaagggcgagatttcggcggcgagattc

SEQ ID NO: 37940 - DNA, 933 bp, Heterodera glycines
gatagccatttttctggaatatatattaaatttaaaaattatatgaaaaatataatggccgcggcgcaccgcacttcgtttcatgttcgagagcgtttgttgcatagagaatttctcaaaaaaagagatagccatttttctggaatatgtattaaatttaaaaattatttgaaaaataaaatggccacggcgcaccgcacttcgtttcatgttcgagagcgtttgttgcatagaaaatttctcaaaaaaagagatagccatttttctggaatatgtattaaatttaaaaattatttgaaaaataaaatggccacggcgcaccgcacttcgtttcatgttcgagagcgtttgttgcatagaaaatttctcaaaaaaagagatagccatttttctggaatatgtattaaatttaaaaattatttgaaaaataaaatggccacggcgcaccgcacttcgtttcatgttcgagagcgtttgttgcatagaaaatttctcaaaaaaatagatagccatttttctggaatatctattaaatttaaaaattatttgaaaaataaaatggccacggcgcaccgcacttcgtttcatgttcgagagcgtttgttgcatagaaaatttctcaaaaaaagagatagccatttttctggaatatgtattaaatttaaaaattatttgaaaaataaaatggccacggcgcaccgcacttcgtttcatgttcgagagcgtttgttgcatagaaaatttctcaaaaaaagagatagccatttttctggaatatgtattaaatttaaaaattatttgaaaaataaaatggccacggcgcaccgcacttcgtttcatgttcgagagcgtttgttgcatagaaaatttctcaaaaaaatagatagccatttttctaaagtatctattaaatttaaaaattattgaaaaata

SEQ ID NO: 37941 - DNA, 933 bp, Heterodera glycines
agaattaaagtacagactatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaagctatagggaagctattcccgaaggattcggtctccccataaatctgggcgcatcggttcggggggactgccccgaaaacaaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaaggcagaaataaagtacaggtatagggaagctattcccgaaggattcggtctccttataaatctgggcgcatcggttcggggggactgccccgaaaacaaaaaaatcgattttttcaagtgtccgtttggggtactcaaacatttatggggagcaaaaatccaacgcagaattaaagtacagactatagggaagctattcccgaaggattcggtctccccataaatctgggcgcatcggttcggggggactgccccgaaaacaaaaaaatcgattttttcaagtgtccgtttggggtactcaaacatttatggggagcaaaaatccaacgcagaattaaagtacaggctatagggaagctattcccgaaggattcggtctccccataaatgctgggcgcatcggttcggggggactgccccgaaaacccaaaaataaatttttt

SEQ ID NO: 37942 - DNA, 1000 bp, Heterodera glycines
ttttttccttcactcgtcaacggcctagtgcgcgaaaacaccctttttcgtacgaagtactttcctcggagggcaagtactttcgtccactcacacaacacctttccaaccctccgttcggacgaagtgcttcctcagagggtaaacactaagtccgctacgtccctcgtgaagttatgcctcggaggacaataactacacgaaactatgaacactagacaagcctcagagggtccttgtctaggctctctaatttgcttttcccttccccctttgtcaccgggatccgtcgatttcagtccgtggttcacagcgaatccacccaggagcgccaatttgtcccgacttgctctggggtcgggccaaatgaattccacggtgcggggttcagggggcaggcagggacgagacacggaattaataaaaaatttattccgggaaatgacctcaaacttgggtaattaaacaaaaaatttgaaatggtgaacaaattatcacaaattgatcacaaaaatgccatcaccggggaattatcacaaatggaattgggcaccgggatgggacaggaaaatcacagaaaacaaatgaatgggaccgggagaaacagaaatggaaggcaccggggccacagaacaaagatcaataaccgggggtcaggaaatgatcacagttggggaggcatcacagttaaaggctggagggacggggagagaaacggcaaaaatgcccaatgaattttgggttgtaaattttgggggcatttggccgtttaaataataataaatttaaataaaaagtggcaaaattgggcagaacgaaatggggccgaaaattgtgaacgaaatgaaaaacgggggacaaaattgaacagatgaacaaattggtggaaaaacgggaaatttgggggttcatcgttctttggagtcgcattcgccaaattgggggacgggggcgaacggcggtggggggatgagttgttgttaattcgtgcgcggggcgg

SEQ ID NO: 37943 - DNA, 1100 bp, Heterodera glycines
caatctttttttctctccttttctttacccccaaattacccacacattcctactctctttttaatgcgcttccatgccgctctctcattcttcgcgctcttttcgcctttctttagtgtctctcgcgctctctcacacagtcttttaccactctcattctcattacccacaagttatctacactaatgtgctttcctgctgccgctctctcattcttcgcactctttttcaccctgctctgctccccatacaaaattaattgttttactctctctctctctctgctaaattgattgattttgcttggcgctgctctttttgctgctctgacgatgtcatttcgccacatggcccctaaagcaaattattgtgggcgctgtggcgcggggcgggggtggagaaagaaagaaaggatattttcccaaattcccacttcaccagacaaatatcaaacaaccagaagcgacggcggagtgttctctccctcatttgccaaccaaaattttgtaccccaaacaccgccattcatttactatcattttgcttagtttttgtttgaaaaatttaaaattttgtgagttatattgttgtttgtccaaaaatcttgaaatatttgttactttttcaaattttttgagaaattttcaaggggtcgccgtccttatgggtgcatttttttttattgcattttggtaagaaatttttcaaaatgccgaaataggagcgaaatgccaaaaagtgcaaaaatagggaggaacgcctctatttttggggcgaaaagcaaaacctgattcctaaggagcgatcgggacgttaaaatgaagaattttcgtactaaaaagtgctttttcgttcttttctcattaattaaaaggcgcagaaaaaaagaagtaaaccctaaaaatccgttccctatttagaataaaaaataaaaaacgcgaaatataaaatggggtaatgtttctcatttggctggcaagaaaaagcctaatttattaagatgtgaaaggaattggtgattcaacggggatttgttttttttgttaactataataaaattagagctacatatagattttgtttaattaaaataccattat

SEQ ID NO: 37944 - DNA, 1580 bp, Heterodera glycines
  misc_feature (1528)..(1528): n is a, c, g, or t
  misc_feature (1554)..(1554): n is a, c, g, or t
aatatttctgatcagagcaaagaagaatatcgatgataaagccgacaatcatgcaaatctatcaaaggatatgctgaaagagacactaacagaagcagtaacatcgtcgtaagaataagcgaagaatgaattggaggaagcggagaaggaagaaagaaagcaaacgtcactcggaagtgaatgtgaacagcaaaaagcgatgagtgactcctccgaagagtacgtccgtgaacactttcctctggacgagcatatggactgctccccgctttgccacgacccgaccttcggcaacctgtgttccttcttcaacatgttcactccgatgttcgactttaagcccctttccttttcacaattagagaatatgttatgcactgtggtagaagccgatggttcgcagtaattgcattttcttattagttaaccattccatcagcaactcgcgagcggattcatcttcacataccgctaatccgaaacatctaattgaagtcgtctcgggcggataaatgggaacaatcgcatctaaaattaagttcaaaggaaccgtgaccggacccagaatcacggcatggcacccgatcaatattgacttcaacatattttaaaagtgataaatcgcacgaatcagtgcgctgtatttttaagactgtcaaaagtactacttgcgttcctactattgcttccgtgtgagactttttttagggaatagaatggtcagcaaccaatttcggacgctttttgcaggtttaacgtataaagaatgcttttccaacgattgaatataatcacaagcaatttaaattattgcctatgaagctttgcaagaaaagtgatgtagacttctatgcgagggttaattattcacgaatattgaaatttttattgttggagttcatgagccagtttttcaaaacagcaggaacctgaccaatttagaacccgtggaacccatcaatattgacttcaaacatattttaaaagtgataaatcgcacgaatcagtgcgctgtattttaaagactgtcaaaagtactacttgcgttcctactattgcttccgtgtgagacttttcttagggaatagaatggtcagcaaccaatttcggacgctttttgcaggtttaacgtataaagaatgcttttccagcgtttgaatataatcacaagcaatttaaattattgctcatgaagctttgcaagaaaagtgatgttgacttctatgcgagggttaattattcacgaatattgaaatttttattgttggagttcatgagccagtttttcaaaacagcaacctggccaatttagaacccgcggaacccatcaatattgacttcaaacatattttaaaactgataaatctcacgaatcagtgcgctgtatttttaagactgtcaaaagtactacttgcgttcctactattgcttccgtgtgagacttttcttagggaatagaatggtcagcaaccaatttcggacgctttttgcaggtttaacgtataaaagaatgcttttccagcgattnggatatatcacaagcaaatttaattnattgcctatgaagctttgcaagaaaa

SEQ ID NO: 37945 - DNA, 1066 bp, Heterodera glycines
  misc_feature (1023)..(1023): n is a, c, g, or t
caataaattttctatagtgcttaatgttttcgaatatttctaagttaattaattaaataaacgcgaaagtgaaccaaaaagtcgcgaagcattctaaaataaatttgcgtataattatgtccttgaataaatcaacaaaatatatttttttaaacctctttttgctacaattttcaaatattgggtaaaaaataaattttcatagatcattgtagacttagtgcatggccctggagcctataaagcttacacatttatcagtgttaaaggcacatttaattcttttgagggaatttacgcgtatgaatgtctataaagtcttgtaaggatattatttagaatatgctggttgagaaatagttgaaaatagaaaacagtacaacaatgggcaataaattttctatagtgcttaatgttttcgaatatttctaagttaattaattaaatgaacgagaaagtgaaccaaaaagtcgcgaagcattctaaaataaatttgcgtataattatgtccaatatattttttaaacctctttttgcaacacttttcaaatattgggtaaaaaataaattttcatagatcattgtaaacttagtgcatggccctggagcctataaagcttacacatttatcagtgttaaaggcacatttaattcttttgagggaatttacgcgtatgaatgtctataaagtattgtaaggatatcatttagaatatgcgctagagaaatagttgaaaatagaaaacagtacaacaatggacaataaattttctatagtgcttaatgttttcgaatatttctaagttaattaattaaataaacgcgaaagtgaaccaaaaagtcgcgaagcattctaaaataaatttgcgtataattatgtccttgaataaatcaacaaaatatattttttttaacctctttttgctacaattttcaaatattgggtaaaaaataaattttcatagatcattgtagacttagtgcatggccctggagcctataaagcttacacatttatcagtngtaaaggcacatttaattcttttgagggaatttacgcgtatga

SEQ ID NO: 37946 - DNA, 1243 bp, Heterodera glycines
  misc_feature (1110)..(1110): n is a, c, g, or t
  misc_feature (1129)..(1129): n is a, c, g, or t
  misc_feature (1146)..(1146): n is a, c, g, or t
  misc_feature (1157)..(1158): n is a, c, g, or t
aatatatttatatagcatctctgctagatttcattatatttaatatcttataagtaaaatttaaccgattttcggttttgtaaaacaggggaacggttccggggctgaaaaagagcggcgttgtcaaaaacatcatcagtgtgttccggctatgtttaaaaatccaattttttgtcattcacaattaaattttcaaaaaaatttccccaagccgcctaacggcaccaccggacccataccccccccaccccaagtttcaaaagtttgaaaaaaatgtgtcacgatattgctgtcaaagttaaagatcactgaataatttttcaaccaaatacacacaaaatatatttgtttacttcgcatttaactttttaaattgatttaaaattttaaaatttaaccctattaatagagaccggatttttatgtttttacatattttttttgcggcttagttatggcgagagaagcccaaaaatagcattatctccgaacaatttttgatttagagcgacttataaaaacataaaaacacatattttggcgttttggcacataaaatatgttagcacatattttggggtttggcacatattttgcacatattttggcatttttgagaaaaattgcaataaaaatacaagaaaattgaaaaatacacccctaaaaattgacttttttcctaattattaacataattttcaaattaaaaaattttttcttcgattgtagaaactaatgaaatctcgaattcattaattcgtcattggatttcgaagttctctgctggaactttcaatttatagaaatgatttatcaaaaaaagacaattttaccccaaacacttcgaaatgtatttgatttgcgttgtatgggctaaaaatgataaagaatgagatttttgggaatttttatgcaaaaacacacttattttttcaatttttaacacatattttagcacatattttggcatttttgggggtttttagcacatatttcagcattttttagcacatattttattacatatttcaggatttttagcacataaaaatccggtctctacctattaaaaatattaattctattattttttcaaaaaatttctgcttncattagaattttttatganatttttttcatctttanattctccagannaactttctcaggaaaaagtcccgattggtcccggcccgatctcgaccagggatgggcaaacttcgagcttcgtgctttcaaagta

SEQ ID NO: 37947 - DNA, 1134 bp, Heterodera glycines
ataaactatttaataatcatttaaatgaccaaaattaattttttgtataagttttacgtgttttgctcccaaaaaaccttataaatttttttaaaatgccttttttcatgcctttttcgggattttcgtgccttttcatgccttttttgcgatttttggtgcctttttttgcggtctctaattattaccataattagcgaggcgggggcaaggcaatgttaatgtttcatcattctctaacagtctgtcctcctattttcgcacattctctcgccgtctctctattggcttcgcccaatactaatttgttaattttgcatatttccttggcccacttgtgccttggagaaggacgtgcgcagctttttctgtgccgcgggtgccctccgccgttcgtacggatggcccgcgcgtctgccgcttccgttggccgtcgttccgcgcctttcgctgtcctttgaatgcgccgcgtttcctcccaaaaaatgcccgtctctgaacagcgcaatcgcttccgacacaactaaaaaagtttaaaaagacgaaaatggatgaatggcacaactaaatgtctaaaagagtaaaaattatttatttaaatatttcaaattcgactaaaatacgaatcaaaaagagtgaagcatcggttaaaatttgaattcatttttctatttatattttctatttctttcggtgtgatatgtatacattaaataagaaatgggcaaaatgttaggcatcgcgtgggaatcgaacccactcgtccaccccattccgtggacaattctaccattgagctatcgaggcacatccgctctttctttttatggattttatctgctttccgcattttaagtgcccagcagccagcttcttccttacaattactgtgctttaccgtatttatgggtttatcgtgggatttttgcatttatgttactgtattttgcgttttctaacttctaacaccttctcgttctccattattccgctcaaaaaatgcgctgctaaattcagttggaaatgcttttggcggcggttctaagacaaatgttggcactttgtcaaaacagcggccgaggaaatggtgcggaagcaatggccttaatattttggtcaattttcataataatt

SEQ ID NO: 37948 - DNA, 1057 bp, Heterodera glycines
  misc_feature (1022)..(1022): n is a, c, g, or t
  misc_feature (1028)..(1028): n is a, c, g, or t
gaatcgcatttcagacagttggttttaattttcgtttttaaacgcgtatttacggtcgtcgataaataaataaatttcacaatatattattgcagcatttttattgaattgatgatttttttttcataaatgctactagtttttattttttatccatatgaattaatcttatttcagtcctcatgtgccagagtttagtcagtctaattccactcttctttttatttattattgtttattcattttatttttatattatatttttaaatagaaaatcttaaagatgtaaaaaatttgaaaactcctattcaaactgttcataattctattattatttatttaactgataattgttattataaatttttattttataattattaactttcaaaatcagtagtttaaataggaattctttgttataatgaaaaaatattttatgtaaatctcaaacgttctgaagtttatttttttattattatttagttggtttattttcgtgtaagatgttgaaatggttggaattaataataattattattgtccactaaataagggccgatcctccgttctttttcatagctttttattataattggatatggtattgtttcaattttattatttatgcattaatgtgagggtaaactttacgtccagacagatgccgtccattcttataaagtcttccatgaaacaacataaattttttgcgtaattaaaatttttaaattttaaactttcatattttttcgccattatgttggcaccataaagtattacgatgccttttcgagtaaaaattttaaaacaaaataatctctaatttaaaaaataagaatttttatttaatttaatttaccaaactcattttgtttttatacttttatatttataaaaatctatatttaagaagaattattaactaatttaatcaattgctttaaactccttgttgcgcgacgcaatcaagatttatttcgtatgttggcagtattgtttcaaatataaaatttaattanagattngtgctgttttattctatataatatatagt

SEQ ID NO: 37949 - DNA, 1106 bp, Heterodera glycines
  misc_feature (1005)..(1005): n is a, c, g, or t
ttattcaaatgtatcaaattggcaaaatgtttatgttattgaaaagcttcttttcctcaaatatcaattctatcctttagatttttcatccagacccccccccccccacattcttacccgtgcttatttagtcctttcgggaacgggactggcaaaatcgggatcgggatttcaatttttccaaagacgtcggaattccgacttccgaaatttttgataaaaactcggaaattttcggaattttttttcaaaaaattagcaaattttgtacaatttttgttaataattgcattgaaattttcaaaattttcccagcggcgccgaccggcacagccgattttgataaaagtcatgaataatttcccaagcagatacatatagaaatataccaaaatatttttgaaatcacctttcatttggtttagaattttaaaatttaatctaaaaatatttttaaaaattttaccatattttatatttttcaatccgatttccgacgttttggggtcagaattccgatttccgaaaatttttgtgccctcggaatgccatcctttgtttgtaaccaaagcatcagaacccgtcagcagttgggccttcagactataacttttttctttgtcaaccaatccaacaaactagtatttacatgctctattagccttacaaaaaacaaagattttctagcatttaaaaaatttatcaaaaaaaatcaaaaaatttgattttttttgcaattttcatgtataacttttttagtaattgtctaatcgctaagcaatagattagaaagagcatcaaacatgttaagctttcgaaggatatcaacaatgttggatttggttgacaaagaaaacttcttaccttttacaaatgaagttgggtgaaaattatccgtcgaattgattatttgattgatttgggtggaagggggttaaggtaaattgcacggcaaatttcatcattttgcaaatattctcctctttagtgttcgttcctcttctngtgtggcactgccattggctctattccagtttacgcgtccattgattgacacactcaattttttaggtcataacttttttcttatatatttggtcaatcca

SEQ ID NO: 37950 - DNA, 1134 bp, Heterodera glycines
  misc_feature (1053)..(1053): n is a, c, g, or t
  misc_feature (1097)..(1097): n is a, c, g, or t
tttctcttttctttgtaattcgcgacatttaacttttttctaaaatgtttttctatttttaaaagccttcgaattcgaatgatttcatgtttgttgaatttcactgtataaatcacaaaaatgtatgaagcatatacaaacgaagaaattgtttctaaattaccaatcgaagcatcatccatcggaagctatggtttgttttatgaacaactttctctttatgagatttagtttcgaaaggaaaattattcattggatccagacaaggccatctcataacatgcaatcagaactcagcaggttgtttgtgccgtcaattataaccaatcgtaatgtttagacacttccaaacttcattatgaatatcaagtatgtcgtacttttgaaagacgtccaataattgagcttcaagtggttgagtcgcacgatctaattatatgtttaacggatgtacatttgtcaattcatgatgctgtagaaccatttaagtttgtgatttacctttttttaatttggtcctctattttcaggctcttggatgtatgttctaagtacaaatcaatttccgcattttctcattttgtgacagaggtgagcaaagacgattatcaatagtttttgttttttcagagccaaactattcatattgcaatttccgcaagaaagcatttacacattttcaaatatttattgggtgaactttgtgaaattaacgactgtgcaccgattactcttcctgagaatgcccaagccgttgtgtggtatgtgttaaatacacttttttttgttagatttgcgtaaattatcctctgtaatatcaattttctaaccttcgtgctccgcataatggatttaatggtcattacttactgttaatacttattggtaatttttaaccaattttaaggtgcggtgtcaacaatttaattctggcatttaaatgcgagttccaattctgggacatggaccatttcctccacagagatgatttgatcggcgaaaaagtaacaaccaatttatttttgtgagttcgtcatttagagcatgagtctncgcaaaagtcccgacaaagtggaaacccattcgactgagtcaancgaaattgctccactgattgtcgctatgtcggacctg

SEQ ID NO: 37951 - DNA, 1060 bp, Heterodera glycines
agggaattttaaaattcattctctatgccagagaaatggctatctcttttttgcgagaaatttgtagccatacacatgttcccagcatgggcagaggggcgcggagagcaatggccattctattctacagggaatttttaaatttattctctatgccagaaaaatggttatctcttttttgcgagaaattttgtaccatacaaatgttcccagcatgggcagaggggcgcggagagcaatggccattctattctacagggaatttttaaatttattctctatgccagaaaaatggttatctcttttttgcgagaaattttgtaccatacaaatgttcccagcatgggcagaggggcgcggagagcaatggccattctattctacagggaatttttaaatttattctctataccagaaaaatggttatctcttttttgcgagaaattttgtaccatacaaatgttcccagcatgggcagaggggcgcggagagcaatggccattctattctacagggaatttttaaatttattctctatgccagaaaaatggttatctcttttttgcgagaaattttgtaccatacaaatgttcccagcatgggcagaggggcgcggagagcaatggccattctattctacagggaatttttaaatttattctctatgccagaaaaatggctatctcttttttgcgagaaattttgtaccatacaaatgttcccagcatgggcagaggggcgcggagagcaatggccattctattctacagggaatttttaaatttattctctatgccagaaaaatggttatctcttttttgcgagaaattttgtaccatacaaatgttcccagcatgggcagaggggcgcggagagcaatggccattctattctacagggaatttttaaatttattctctatgccagaaaaatggttatctcttttttgcgagaaattttgtaccatacaaatgttcccagcatgggcagaggggcgcggagagcaatggccattctattctacagggaattttttaaatttattctctatgccagaaaa

SEQ ID NO: 37952 - DNA, 1070 bp, Heterodera glycines
gtgttcattggtgatgtgtttggcacatttttcgcagagtggaaagaggagtcactcatcaaattttatgggcattacggtcacattgatattcctgtttgggggtaaaagtaaaacttttaaaagtcccttgtatggattgtcggatggagctcgccagttgacagtttgctcatttaatctaaagctgataatttttgggtgaccgaggggatagtctgtagagaaattggtccatggataaaggctggtgaagtccttgtagctgattttttgtcccggcttagctgtgtggagtagcttcattggcccagtccgtcctccatgaaatgcgtctctgatttatattggtgagtggtctttccagttgtcgaaaaactccctcatttgcttgtccttcttcagctgctcattgatttcgtgttcccagatcacctccaagtctacgtaccggctaagaatctcgtgcttccttacctccctctctcttaattgtcctagcgtctttccgttcggcattttcgtttcgtcgtccaagtcctcaaaacattcctcacacccgtgccacagacaaccatttacctcaataattttatccctcttcccattagtcccttttatataaccatccacttgatacacctgaccctcgcgtttaaagacatattcaccatagcgggagtgtgcagtttgaatgttgacattgttgatgtgggagtaccagtcgaggtatttgatggccagtgcactttggttctgttgtggtgtatagcctttctccgagacgatggcgagcgagttgggcttcaaatgattgagtgcaaagttcttgacgcaggcgctggcgatggtcatggcttgccaaagaatgtcgattcccccgtgttttccgttccgttgtgtcagttgtttgaattcctggcgtaattcgacgagggcgtgggtgagtatttgtacctcattacaacaatattcagggagtttttccttaaggttaaaaaggtggtttgaaattattattgaaccttttgccaaatttcggttgatcggggattctcatttgatcagga

SEQ ID NO: 37953 - DNA, 912 bp, Heterodera glycines
  misc_feature (806)..(806): n is a, c, g, or t
  misc_feature (869)..(869): n is a, c, g, or t
  misc_feature (872)..(872): n is a, c, g, or t
tttttcgtgcctttcagccctcccacagtccaggaaaaaatatgcatgtgcatataatttgcagccctactaatgaccaattaattttaatactttaacaattttttaggggagggtctcaaaacagaaaagtaccagcctttggccatttcagtcctgggccataacttgatttcgaataacaaagtccatcaaaatcttggtattattcgagtgcacttaatgttctctattagcaggcaaacattatgaaaaggttttaaagttatgagcaaaagctcaagaaattattttcattgtacgagttgggtttttcccaatccaacatggtcaattgaaaaaattagaatcctggtcatgaaaaaactatttcgtaaatcaactgaaaacattttgggggattattttatctgtcaccgcataatttgtcgtttcccatcgctcataaatttatgcaaatcgctacgattttaagaccctctctctcatcgtcccttttctttctctaattcttttatttttcacacgttttcgccggtctctcttttttcaaaacggattctctctctctttctcctctctctctctctctatatctcctctctctctctcgctctctctctctctttctttctttctttctttctttcacaactctcgacctttctcattgtctctttttcatttgcactcagtcccctctacaatttccccctgcgtcctctggtaatgtacagtacaaacggattatgcaaatgattactctgtacaataaaagcaacaataacaacaaataggctcattanagtgcttactcatgaggattaaacctgcaccattataagcaataaatttgacactgaatccantanaaaattatgtgttcaaaattgacaaaaatgtttgccagcg

SEQ ID NO: 37954 - DNA, 616 bp, Heterodera glycines
tttcctccggcgaaatatgttcagcattacccgcgatcttccctgatgttctagacacaaattgaagtccatttgaaatggacagcaaagtgatagccccgggggtccgacttctgaccccagaaaacccaattaggaaataatgatgctaatggctggcttattggagtgccgtaggatcagctaattacccccccccgcgtccatcgttttgctgcgctgtgacctattcggagtgtgaagttgataaatgagtctcagcgtgtcacacacttgtcgagactgaatgtgctggcgaagtttgtccaattccaattgagtgtaaatccgagccttaaaaaggaaatccaaaagcaataaaaacaaattaaattagaccgaaaagcacaaaacagtaattaagctcgagtcttttgagtttcaattgcttaaaatatgtttttccaaactaaaacaaacaccaaaaaaataaaaataattaaaaaattcggtaaattcacaaaaaatattaggaaaaaataaataggctcattagaaagagcataaaatctcaaaaattgtttttggatggtgagtatctcctattaatgcttcctaataatatgtgaacatttta

SEQ ID NO: 37955 - DNA, 1158 bp, Heterodera glycines
gcctggcaggtctataatctaggattggatcgggcatttattgtgtttggaaaggacgcaacggcactcattttgcttgcacgggtaattattatttacttttatttaattggtttgattaattgggcatgcacactaattgacttctttcaacaaaaattcacaatctttcataaaattagcataattttataatcgtggatcattaaaattcataaaatttgaaaatgttaaaaaaattatgccattaaaattttcgtcaaaattaatgctataaaatgacgcaaggaaattcaaatatagttgttgtctaaaatttatttataattcaaaattaaatatgtaattgaatattgtcatattttttaccttaattatttttatgtttaagctttttttaattaaaattaaatactttattgcttttattttcgtattttttttcaatagatccaatcggaaaggagtcaataattgcacttttttaatttttaaaaatattttaaggcattattagaagataaaatggacggaaaacaattggaaaattatttgaacaatgaccaaaatttgttcaacaacatcaacattgatgatgatgattattcatacatcaaaatggcatcaaaattaggcaaaatttcaaaggattactaagcaaaggaaaatttttatcattaggacaaattattgttgattaattaattgtaattgaatcaagtaatataaataccccaaattgttgttgtgggaaatcataaaagttaacaatatctttttttttgcaaaataaaattaatttttgctcaatataaagcgttgtgtggctattagtactaattgatttgactgttggcgctttaattgaaacatgaaacatttcttggctgtttttctggtaattgttgcttgctaaaatgatcgagcttatctctttaatgtatctttgaatgccttgcgatatattgaactaaaataacaaaaaaaaaattttttagtccggtgtggtaaattaatttttgtaaatttggtataaaattggcgcatttgaaatggcactgatctgaagtggaatggctgagatcacaaagccaaaccaaattatgatggacgattttaataagggcaaaataaaaaggcgaaaagccctatgtaaaa

SEQ ID NO: 37956 - DNA, 1507 bp, Heterodera glycines
tttttttgttatatttatgaattttcgatataaaatttacgaatgtggagttaaaatgacaaaattttggttattttagtttccaagctttttcacatcgatacttgtacaacatctcgtacgaaaacggccgtacgaaaacgaccctgaccgtggtaaaaacccataattattgaatctaatttggcatagtgttcattccgtaggcattctctggcactctttcaacagatcggaatttgctggatttaccatttaatgttttgaaataagcagtaaaacacgtgccttttttctttctttgcaagccgtggtcttggcttgcgattgacagttcgtccctccccccccccaaattccctgtcactctttgcttatcgctgtccccccccccccttatcatctgctccaaatcgctcctctaaagtccttctcgcctccctctcccattcactcatttccatccaatttcatctccgtacaaccaattccctcccatgttttccctccatttttcgtttcgccccattatttcacaaaacccttcagccaaaacataaaattttccgcttttgcgctccttttaaataaattcactgattttttttcctttggcaaaatgcgattggcttcgttattttctgttctgctgtttttattgttcatccatcgaacaattccctcaccttcgccaaaatttgatgaagccataaaagacaatggcattttcgcattcgattcgtccgaggacagtgccgaggaagtccctccttcgcctgcttttgccgattctttgcggtcgcctcactcctccgaggccgaggaggacggtccatctgctgaagaggaagaacagtttgtggacaatgtggccggatggcggccacgtccatctttcctgccgccttttgctgttcaaaatcgatgcctaaaagccaaattcttcgattcgaaatcggacgaatgccgcccttgttccatttgtgggcccgacctttagtgagtttgtgtacgatttgtcaaactgtttcaaacaatcgctgtaaatgtaaagtgagcgggaaaagtgccgtacggacagtgacaccgtctgcgagtggtgcctgaccaatttgcgagtgattgtccgcaacagcgactttcgcgtcaaatgtgaacagctcattgccctccgtgaccaattccgcgcggcattggctcaacattccgttgttgagggaaaagcgaagccaacgatttattcgggtttttgtcgcaaaaatatatttaaatgcgaattgctgactttgaaatacagtttcgatgttcgaaaatgcctccaaactgtggaagatcgagttgtttgtggagatggctttttacatcactctgattgccctcgtgttggcggtcattcgctttttggtcaaaagtcggtcgaacacgacgtaccgtactgtgacagtaacaccgccgatgctggaggagtgtgcacagaagagtgagtgggggggaagcatcggatgaa

SEQ ID NO: 37957 - DNA, 1260 bp, Heterodera glycines
  misc_feature (1184)..(1184): n is a, c, g, or t
  misc_feature (1192)..(1192): n is a, c, g, or t
  misc_feature (1221)..(1221): n is a, c, g, or t
  misc_feature (1227)..(1227): n is a, c, g, or t
aaataaaaagggcacttatgtatatgaaagtaatggcgatatttggattaacggagaattaaagggaagaaatgccgaatattcctacggtgttggcgataccgtaggaattgtcttcatttcgtccaatcggcagatcattttcaccaaaaatggactgcgtttgggttggtaaatgaataaattattaaacaaatcttaaattataattttatttaattgatttttatgtttgaattttcaaaaatcccttaactttttcacagatacctctgattttttcgttgcttcatcttttgctgatggttctctttatccattcgtttttttgttgcgttctgatgaccaaattgaggcgaattttgggcccaatttcaaattcgatttggcaactctctgaggaagaagaaatattcactaattgttgatcaatgcgcttcttttaatatttttttatgcttttcttcttcaattgtattttgttttttaaaatataaagcaatttaaaatcaaagtattattccgcaaaaaatttcttgtaattttacttttactaagttggacagactaggaaattcgctttattgcacatgtccattactacattcaataaaacggctgatttttctgcccaatggccaaaattctggaggttagaaaatctccgttatttaactgaaatgcattttgtacaacggatggacgacttctttttgcagcacaaaaagagatggttgaaatacaataaccatgaaacggatttatatggtttaaaaaacgccaaatatgcacttatataagtgccaaaaacccctaaaatgagtagagaaattgtgcatttaattaaattccaacacgttacaggtgccgaaaggagcagacagaaaaattcttaaatattttggcaattttgtcaaaaattctagtgccaaaaagctacaaaaacagatttttaaaaaatcgcaagaggtgctaaaaatcacaaaaattaaaaaaatattcatcgacaattcaaccgtacttggcctagcgggggaagcgcctatccccccgctgttgttcttttgaaatttgatattgtgggtattggtgagaataagacgaaatcttacgaacaaatttttttttgacaaaaatgtcaatttttgggaagtcatcaaaaatttagtaaaatattttattanagtacaantcagtaaaagtatacaatcattttccggnactctngattcaaaaaaaatcaaaatttatatttttaaa

SEQ ID NO: 37958 - DNA, 1018 bp, Heterodera glycines
aaaaaggggaggagactaaacgggggaatgtactaaatgactttatttgtcgaaaagcgatgccatgaggggattttcgaggagtctaaagggtacgcacaacaaatcagctggcaattaggcaaatgaaccgctagggatcgtaaacgaaaaagaaacattgccatgaaaaacggccattagcccatcagcaagaaaggattacggcacaaatgccgaaagggggaggggaagaaaagcaatgggcaatgccaccagaaaataaacaaattaattgtcttagcttgatttaaacggaactactgctcctcgtcagtttcttttttgccgtcgtttcttttcttttttagctcttcttcgtccgtttctcttctcttcatcttcctctttctcctcctttcttccttttcttcttcctaatgcttctctcgttttgtctttgtcttccttttctctcttcctttgtttttcttctcttcctccgtttcttttctcttccattcatcttcctctttctcttcctttcttctttttcttcttcctattctctagttttgtcttctttttctcttctcttcctctttctcctcttctcttcctccgtctcacttctcttccattccttcttctcttcctcttcctctttctcctcttctcttcctccgtctcacttctcttccattccttcttctcttcctcttcctctttctcctctgctcttttcctcatcccccgtccctttccttgttgtcctcccccaattgggccattattaaacttcttttacccttttggccatatgttttcccgctctcccacagcccattacttttccaaccgcacatttccttggcaatgtcgctaattacatatttattcattgctggagcgaatgatggccggtgggggcgggggtgagagataatcgggcaaagcacaagcggatcccctcacccttcaccctcccccgcgcccgttaatgcagatggatttggatttcattgcacagccccatcag

SEQ ID NO: 37959 - DNA, 818 bp, Heterodera glycines
actagcatagaagctataaaatttatttgttctcttatctccacaagatgcaaatcatacagtctgttttttattcgggcctaactctatggctgaaaatagtcgcatttattacacaaatatgccactagcatagaagctataaaatttatttgttctcttatcgtataaatatgcaaataatacagtagttttttattcggggcccaactctatggctgaaaatagtcgcatttattacacaaatatgccactagcatagaagctataaaatttatttgttctcttatcgtataaatatgcaaataatacagtctgttttttaattcgctcaactctatggctgaaaatagtcgaatttattacacaaatatatcactagcatagaagctataaaatttatctgttctcttatcgtataaataagcaaataatacagtaagttttttaattcggagctcaactctatggatgcaaatagtcgaatttattacacaaatatatcactagcatagaagctataaaatttatttgttctcttatcgtataaatatgcaaatcatacagtctttttaataaggagccaactctatggctgaaaatagtcgaatttattacacaaatatatcactagcatagaagctataaaatttatttgttctcttatcgtataaataagcaaataatacagtaagttttttaattcggagctcaactctatggatgcaaatagtcgaatttattacacatatatatcactagcatagaagctataaaatttatttgttttcttatcgcataaatatgcaaataataca

SEQ ID NO: 37960 - DNA, 910 bp, Heterodera glycines
cattaaatattacagatactccgttgctgggtcagccattaaatttgttgacactggcacttcaagtgaaattcggcgatgtattatgcaatattattggaacacacagtcaaaattcaatgcattaattgcccaatttgacagtaaacatgcatatttggctactgtattgtcaaaattagacagcaattcggcatttttgaattttcgaatgcgcacaaccgatgcggagcaagccgagtttattccatcaaatgaattgttagaaggcataatttataaataccatattttctctaataatcccccatatcattaatcccacagtatccatttgtcccccagcagggggataaatggaattctttagtaagaaattgtatgatacagttttttaatgaattgaatactataaaaaaccatcaaaattataatttttaaacttacaccttttaaatcataaaagaattgcataataattatgttctaatagggaacaataataattcgtaacagaattccaataattaaaataaacatttaaaacacgaattaaattttttttttttgtaagcctcgagtataagccgttaagtcaagtttcggggttgagtgccgagaaattttcggtcactgttttgtttgtatctatttattttttaaataagaaaatatgccaatgtcccctttttacagaaaaagtatgtataaagtgtcaaaaatttattccattaattattaaattgctttatttaatttaattgcactttaattttagttccttattccttttaaacttggctcatgtttacaagcttgtgacattgatcatcgaggcgtaaaagtttatgatattggtgaacaaattggaaattaataattaaaaaaatttaaacttacagaattgcat

SEQ ID NO: 37961 - DNA, 1501 bp, Heterodera glycines
cttcaaaattttgaaaaataaataaaataataggagactcagaattttgaaaattttttataaaaactgatgacaagctaatgtgataaaacaggttaattcttttcctttcagtatccctgcaaagtttggggcgcttctgataagtttctgaaaaaaaagataagcctaaactttttggcctgtttaaaaaggaattaaaaatttttaaaaatttattcatctccctttttgatagaaaaagcatcagagtgcctaaactagcatgtaaataaaatttggtgcgtttcagagcattttctgaaaaaaatatttatgaattaattatgcaaaaaacaaataaaaacgaaagactcagattttcgaaaatttttttaaaggaattaaaaatttttaaaaattttattcatctccctttttgatagaaaaagcatcagagtgcctaaactaacatgtaaataaaatttggtgcgtttcagaaccctttctgaaaaaatatttaagaacaagttgtgcccaataaaaataataacgaaacactccgagtctcaaaaagtattttggtccgactagaaccgcactcatttccgtgtgagcgaagcctttgacgaggaggatcactgcgaagtgtgagacgcttctgctacggttaattcacctataggtcctcggaccatgcacagatggggcaagcacaaactactttgaaataggtcaaaaccacctagaccaacgacaactctaaagagatcaccgcgcaacgagagaactcacccggcatcttggccgactacgcgacagccgccggcaccgtgcttatcgcctacgccgcaaagcccgggtcaaccacaggcagtgccaccagcgactttgtcatacaacactaattatccgggagcccccggctagtccgagtcaggaaaattcaacagtaatccggcttttgattgtaaattttttttaatttcgagatgataagtgtaataacgctcctgtaattctttttaaccgcatcagtgtgaacataggatgatttaattgtcgcggtgcatcaaatttgcctcctaatgatggtgcgatgatgccagaaaattgttatcaaggacgttggaatttttttgtgaatttaaattaatttgatatataattcttcacagggggggacaacaaccctaattgcaggggttaaaggggattttttgaaattgttctttttaaaacgcccggcaattacccccccctatcgtatgtttttaatgaatttaaaattttttggggtttaaaaaaacccaaggaccccccctgccgggtttattaaaatatccctttttcttttttaaattttttttcgtgggaaaaaacaacttttttattattttctctttaaagaaacggggggccccccccgcgcagcccccccccactcccctcaatttttttttttttttttttttttttttttttttttttttgtgtgtccccccccccccccccccccccc

SEQ ID NO: 37962 - DNA, 1167 bp, Heterodera glycines
ggcgtcaaatggacgggaaaagtaaaaaattaaaataaaatttcaaagaaaatttcttgaaatttttaggcccctaaattttgttcctccctcggccaaccttttaaaaaaaattttgatcgatttcccatttccatctctttttcatgtccaaaatccgggaatttttcttaaattttcggcccctaaattttctaagtcctccggaattttcaaaaaaataattaggccccttaatttagcccccccccccgctccttctctacacttctcatattatcctaatgcaacttgttcatttattaggcttaaagaattttgtaaaaaaaatttcgcaaattttgtaaggcatcctaaaaattttcaaaaaattgtttaggcccccctaattttctttcctctcaggttgtctatctgaccgcatcatttccctatttgatgctgttctttttgcttttgcgcggcctttcgttgcctggcgccagcctcggcctcgagtgaggcccaaattttcaaaaaaaaaaaaattctaaaaaatctatcctctaagattttatttgaaacccgacttttccaaactgttggagagcaaagtttgggttgacgcggtcacacaggtcgaaaatttaaaatttgattgattttctaatcacatgatgaaaatcatagatttttgcagttttgacgtcagattcatgatcagctcctaaaactacattagaaaagtactttcctttgtcaggaccatcacatttttatggggggggggtagcaaaacctacaagtacattattattattattattattatacaataggtaaaatagatctaatgaaacacgtagaaaaggcaactcgtacaatggcttaggctaggcttaactttaggcttaaactgatcccacattttataccaaaaagatcaatcactcttttttaattaattttttagaaatgctaaactaattttctatttttattcttaattagaggggcctcggtccctcggacagtccctgggggagggggggggcgagctgctcgttctccatttttgcatgttactcaacttgcggttctgttatagccgaacattatgcatttaatttgtcaactgaaatgtttgttatgtacatatgacacactgacgaaaatgtgtcggggaaa

SEQ ID NO: 37963 - DNA, 953 bp, Heterodera glycines
tcagaaaatatttatacattcatcgttcattttatagacaattttcctctttgtaatttagcccaaatgaccaacgaaaaagactttatttgcttttattttgacaaaattcacaattcttcttatgccaaatgtaagattgagcttaataatcgcaaaaaccaacctttttttgttgaaaatctgttaacaaattgcacccaaatttttaaaatttcccccggcggcgcctatcggcaccgccggaccccttctttcccaaaagttttttgaaaaagcgctccgaaaaaaagtgatgtgaaaatcaaatctgaatttctattaatattcgatgatttagtccaaaaatgattaattgtttgaaataattgaagaaaatttgtttgaaaattttcattaatttaatttattaaataaaaaaccaaataattttgtattattttcacttgatataaattaaaatttgattttttttttaatttttaaaatttttttgaatttttaaaatttcccggttggtcccggttcccggtttttcttgcggtcccggtcccgaaaaaaaatcgaggtcccggtcccggcttctcaggtcccggcaagtcccggttttggcaaaaattcccggtcccgtggcactctacttttttgtatgcaggatttattttgaatgacctccgaaaaagtctctcgcatgaaaatctcgaacggcttatttttcttcatcataatattatcctttacaattttgattattgataatatgggaattttctaattatgcttttacaaatgtgcgatccgcggcgttttttgcgcgatccgcgatccgcgaccgcggcaaattgaatccgcgatgcgcgatccgcgaccgcgggattttttttgcgcgatccgcgatccgcgaccgcggcaaattgaatccgcgatgcgcgatccgcgaccgcgggattttt

SEQ ID NO: 37964 - DNA, 1105 bp, Heterodera glycines
  misc_feature (6)..(6): n is a, c, g, or t
agcatntcggccaatggcgagcaccatgagaattgagctctgtgtccatttggacgaacttcagatgggacaaaagagggagcaaaacgaacaaccaaaaaggggtccaacctaaaaaggggcaaaagaatggaatgaatgggaaaaagaaagggggtaattaggaataattaataaaaagcatacagataaaatggaaaatgacaacgcggagaatggagcggacagcgcgtgcagtgtaagtgacggaacctaaaatgtaaagggcaattagcgaaaggctaattaactagctaattagtaaatataaaaggcagcaagcaaaacagcagcgaatggctggctactcattttttgactgttttttacctcgcggtttgcgacgaaggtgacgaataatgaagaaatagcagacggcgatcagagggagaggcacgatgaagccgaacaaaagcatataggagatgaagaagggcttaagagggagggagagtaagagagagaatgggagagagacagagaggaggagaagaggcgaagagagagagggaatgggaatttggaagagggagagagagagggagagaaagagagggcgcagagagagagagagagaaagagaagagagagaggagagagagagagagagagagagagagagaggagagtagaatatggaagaggaaggaagagagagagaagagagggacagagaggaacggggagaagagagagtttggaaatacaagtgaaggagagaaaggggtgaatatggcaaaccaaaggctaggggtagtgttagagcgagcgatcaggtgtataattcgctaattaacaaatccaattagttgattaaagtgtaacccaccaaaaggcggtcgggcagttgcgagccgcaagtggcgtcttccatctccacgctttcgtccgggaatataagcatgtaatggttctgaattggcaaatgccgcgtcactttgtctttttctctcaccgcttgcgcaaaataaatcatcggcgtgcacagaatggcgacagtgcccagcaaaaggccgagcagtgcgaacgcattgttcagtcgcttttgactaattcgaatgcccag

SEQ ID NO: 37965 - DNA, 1102 bp, Heterodera glycines
  misc_feature (1029)..(1029): n is a, c, g, or t
  misc_feature (1034)..(1034): n is a, c, g, or t
  misc_feature (1053)..(1055): n is a, c, g, or t
aaaaatgctattgttgctgaacgacttgtggttgcggcattgcggttttaggaataccatgctgttggtttttgtcacccatattttgtctgtttggcaaattttggtgtacagactgatgcacgttttgaatgagtaattccggaattattgggccacttataggcgtggatgttcgaggcaacaagttttggttgagattgcgatgaccatcatttctattttcgtctccaaccaaccaattttctcttccgtcgtttgttcccacatttcggaatctcattcgcaaacctccgcgttgttcttcgtttccattgttttccgctccgttctcttgtccttcattttgtctgttcggttgagccaactcaagaagagcatttcgaatttgtgccgagtccatatttccgttcgtccttaaaatttttccatcaacaacagaattttcaagaacattttcggtgttagcggtgttatgcggtctttgtgtgttttggtgttcgttttgttgctgcggctcagtacaaaacgagtacttttaaacaattggcgagcagaagttgtacagtcccacacgaggacaaaatcaaatcaacaaaatgcgccaacacgagggcttttttcaaatttcttcaaccgtcggttttcaagcaattttatgaccgcgtttatccccgtttaatgaaaatgtcactgagccagaccttggtcgtccaggagcgccaagttacaccttttgaacaattaagctttggctttattctccaaattggcaagcaaaggcaacgaaagcaattcgatcaatttaaatttgttgatcagtcaaaggtgcttgccctgtctcaaaataaatcgaaacaataaaattatgctttatgcaaaacaaattaaagacacgaaataaccaaaacatacacaatttcaaacaaacttgaaaatcggcgagaattaggcacagaagaaaaataatcaatcacacaattaacttttatttctcaaacataagcactaattaaaaaaacaaaggcnacttntttaaggtcaatttgaatnnncgcctcttaaggacaaacataataaattaaataattaatgaagtcca

SEQ ID NO: 37966 - DNA, 818 bp, Heterodera glycines
ttctttagtgaaaataagcacttcccagtcaattttaatgggtggagaattaatagaaagttgacaaagttggaaatgggctctttggccaaaatttcgatttttgaggcctcataactttttgggaccttgctatatgctcgtaatattaaaaattcacactagaagtcgacctttctctatccaatggtatgtaacacatatgcattttccgagttacagttcgggtggttcccttgttagttaaacaccacttaagacatcgaagctcaaattcagccggaaacgcgtgaaccaccaaagcgagccagcagaagaccacgatcgagatcaagctcacacagtcgtgagcgattgagtaagccgtttttggtattttgcgccagaaattccatgttttttttttgtaaaaatataataatgatctatttgcccaatgaaaatgtttactttttgatcataccctggaaaagtgatcaaaatgttaacttcattcttcccggcgttcctatctgttcttcgggcaattaattaattttgataaaaaaaatattaatttatcaaaaaaaaaaaatttcagtgatgtacgaaaaaatttttactaaaatttttttaaaattttttttccattttcaggagctaaccttaatcactcatcaagccgaggtgaccctgatcggaattcagtgcaatggcaattagatgtagaccattattcaagaaatgctgcccaagaaacttttgagccaccaagtaaaattaaaataatgataaattttctacttgaacattaggtaaaaagaatgccggaccaggac

SEQ ID NO: 37967 - DNA, 1202 bp, Heterodera glycines
  misc_feature (1102)..(1102): n is a, c, g, or t
  misc_feature (1145)..(1145): n is a, c, g, or t
  misc_feature (1160)..(1161): n is a, c, g, or t
  misc_feature (1178)..(1179): n is a, c, g, or t
ttcaatgatccacatgaattgatcaaacattggcctactttgaccaatcggcaggcgatccatcgcgtttttgtgctcaaaaactcgtttaaatctgtccctaccaattgcgtttcgccccgaatcagaaaaagggcaattccaatgccaattatggcaatgtccgccgcccttcccgccatttccaatgcctttttattttccttgaaattctcttcaattttactgaatttattagcaattccatcctaaatcggaaaagtgaaaattccttgatttttttttgtttttttaatttatcatttttaatttgcctattttttcgatttaattcgtaaagatatttttgtgaaaatccgcgttgaataaattcaagctcttttccaactgtctgttcagtgttttagacaaatagggaagtcacagtttgggaaaagaatgtttattcggtaagcgccgttcgaaatttattttaaaacttttaatgtttttgacttttcaaaaatcccattgttttttcttagcctgtgcttctccctttttttctgtgctaattgcgccttaattggttaattttaatccctttaaactattcaaattcgcccttttcttctcacatatccctccgtttccaatgcttttcgtttctccgttaattcgcccatttgtgcagctgcaatttgtcctttgattttcgcccacattttgttgctattatcgacaaatttttcaattgtttggtaaattcgtccgacaaatttctccaaatcaattttttctactctttccgatgtttttttgtcttttcctttttcggcacttttttcgatcatttcccgcacaatttcaacttcgtttggatcagtcaaaaattgatcaccttaaataaaattttacttgttactctttagcgcctcttattcaaaaaaactatttaaaaatttttaagcaacaaaatacaacatgcttctaagggtttttggttcgctgatcacgaatctgaaatcattttcataaattcaaacatttgatttaattcagaacaaattttttaatttattttaaaaatcgagttagaaattatgaattggataacaaaatncatattcataatcaacaatcctaaaaggcaaataaaaaggttnccttttttaaaattnnaattgattctatacaannaaagttaaataaaaaaacacccc

SEQ ID NO: 37968 - DNA, 157 bp, Heterodera glycines
agagaaaggagagagagagaggagagagagagagtgtggaagagagtgagtgggagagagagagagggaaagagagagaggagagagagggagagagagagagagtggaagagagtgagtgggagagagagagagggaaagagagagaggagagaga

SEQ ID NO: 37969 - DNA, 589 bp, Heterodera glycines
gtgcgtaaacaaaggttgaacaaaaataagaaatttgaaagaatttgaattttcgactttttgttagaatttgagttcggggttctgaattgggcgaaatagaaggcgtattcgtgatcagctacccagaatacccctgggaacatgttttcataatttttgaaattaaaaaaaaatcgaaaaatgttcgaattcgggtccggtggagaaataggtcgaaatggaggtcggattcgtgctcagcgcctcaaaacacccctagaaacgtattatcagaattttcagaaaaaatgaagaaacaaaattttcgggaccaatgatcgacatgattgccaattattttggtgggcagaaacagaaatgtcacattgagccaaagtttaagtttaaaaataaaaacccgggcaccaaaacagaaatgtaccgaatttatttacttttttatgacagaaaacgcatcaaattgttaagccatcgaaattaaaatacctatgaccacaaaactgtcaatcccgttcgtaccatccactgtgcaaacaaagccttttgctggacaaaaaccgggcaccagcggtctccgaaaacgagt

SEQ ID NO: 37970 - DNA, 819 bp, Heterodera glycines
ggcggaggcgccacacaaacacaacgccaacacgccaacgacaattcatctgcttcttctggtgttggcaccgcttctccttttacccccgggggaggggacggcactcaatcccatcacccaataatgcatttcatattatattgtacatttctttgttttgttgtagctaaattgctctcatattcttgttttgacgtgcgctggccgagagtctcgtgtataaggacacgaaatgttgcaaagttctgttcgagtttgggcccgacataattttcaggaggggtctaacggcgttggcagattttctcttgggtatcattagtcataatgattcgctaattaattggctggaacaaaagcattatcatccaattagggccttcgaatctccactcggcgttcactatttgtgagatttagggtaaaatttattcaaaaaatttaaacaaaattcggccccgattctcttcaagttcgtctcagtattgagtcctgagcctcataattacactatcaagcaggaagttttaagaaattcatatgggcaatcctatatagcttgttgtcccattgttctggccaaccccaagatggcactctcgataagcaacccatttaatcaatttgactcggaaatatttcaaaaaaaaaaattaatgcactttaaaaggatcgaaattgtgcgcaaatttcgcctcaatttcgtccccgaataaattaattatataaacaaaaaaattaaaataaatatgcttaaaaaacagtgtgtacattcgtagtcattaaagcttgtcctaatttgttcttaaatgttta

SEQ ID NO: 37971 - DNA, 1320 bp, Heterodera glycines
  misc_feature (1114)..(1114): n is a, c, g, or t
  misc_feature (1123)..(1123): n is a, c, g, or t
  misc_feature (1188)..(1188): n is a, c, g, or t
  misc_feature (1297)..(1297): n is a, c, g, or t
cattgaaattcttttgaaaatttgagaatttattacaaataatagccggattttttgatttaaatgcacaaatcagtcccttaatgagtctttaatttttccgttttaattagtcggaaacacttgcatgttatatgagagaatttttatttagcatttttttaacaaaaattttaagcttttttgaattcaaaaaacagatttcctttaattgggtgtgtaaattttactttctaaatgggttgggataagctcaggaaaaacggggtaaattccacataaattattagaaaaaaattttttctatgaatttctacacaaaggcaccgagcgattagaagtaataaaaatgtgccgacattaagtgttagtttgagcatgaaattttcatttgcccaaggcctgttttgaaaataaactcaaaatttattaaaaatatggtagggttttagaacctttccacccaaatcccattcactataaaaggaataaaaaagccctgaaaaaattgccaaattggaaaattgtcccgtgatctttttttagtatatttttttatttttcttttgtgggaatctctgctcatttcagccaccaatcccgatcatttacaaagaacacttaacacactaatgacagggacacttaattgagttaattcaaaattaccggcaatgtatgtaaaaaacagtgtattaatttatatttttgaaactcagatttataaaatttccaattgttgttttgaaactttcaacagaaaggtgcgccgcgatcccggtcaattacagagaataatgaacccattaattaaaatggcaattcatccaattaagtcaatttcggatgcattttgtaattttccaaaacatttctgaatttctccagtttttaccaggctaacctaaacctgtagaatgaaatttgtgtatccagtttagagaatatttttcaaattaatcgaaaggaatcgcaaagaggatttatgatacctaaatattcaaaagtaaattttcagaaatttttgtcaaaaaccgtcataatacggtttttaggctcaacaaattcgtgtccattttattttcttctctaatatcggaatcacttggtttanatgcagcgnaattaaccgggtgaaagactggataaattcattgaaattcttttgaaaatttgagaatttattancaataatagccggattttttgatttaaatgcacaaatcagtcccttaatgagtctctaatttttccttctaattagtcggaaacacttgcatggtatatgagagaattnttatttagatttttttaacaaaa

SEQ ID NO: 37972 - DNA, 360 bp, Heterodera glycines
gccggggaaaatttttgaaaatttgattaaaatttgttgacagattttcaccaaaaaatcatcaaattttgtgatttttgtatcatttttctaatgagaaataagagttttggcgcgccgctgagaacagtttttcatcaaattaccaaattttgcgattttggccattttctaagaaaaaataagagttttgggggcgcggcagtgccgataggcgccgccggggaaaaaattggaaattttgatcatttataaacagtttttcactgaaaattagccaatttataggtaaaattttgaaatgatttatgggaatttaatccaattcttaggggtgtaaatatccccgctctcttccat

SEQ ID NO: 37973 - DNA, 867 bp, Heterodera glycines
attttttttgaatgattttatttttttaaattaattaagtttattaaaaataatttattttaaatattaaaaataataattctttcttcctaatttagcccaaaaatctattgtttgaccttttttgtgcaaaatcatttaaaaaatggagacaaattaataagttacctaaacataaaattataaatattttatgccaaaaaaagaaggaaagtgaaaaggaaatgcggaagagaaagtggaagaggatcagaaagtggaagagaaacataaagtggaagagaaagtggaagaggaacagaaagtggaagagaagaagaggaacagaaagcggaagagaaagtggaagaggaacagaaagtggaagagaaagtgtaagaggaacagaaagtggaagagaaagtggaagaggaacagaaagcggaagaggaacagaaagtggaagagaaagtggaagaggaacagaaaaagaaagcggaagaggaacagaaagtggaagagaaagtggaagaggaacagaaagtggaagagaaagtggaagaggaacagaaagtggaagaggaacagaaagtggaagaggaacagaaaaagaaagcggaaaaggaacagaaagcggaagagaaagtggaagaggaatagaaagtggaagaggaagtggaagaggaacagaaagtggaacgcaattttcatgtataacttctttagaaattgtctaatcataaagcaatagcttagacaaagcttttaaacatgttaagatttcaactaataccaacaatgtaacattgttggctttggattaccacgaattaacagtataaaaattgacaaaaaaatgtttctgatccaatttaacagaataaattt

SEQ ID NO: 37974 - DNA, 1202 bp, Heterodera glycines
  misc_feature (1023)..(1023): n is a, c, g, or t
  misc_feature (1101)..(1101): n is a, c, g, or t
tgcttttgctgctagaacaagagcaattacacgtctccattccaacagaattcggaaatggctctcaaaattggtgaattccatacctgctggagcttctgctacggtatctgctacgaccgccgcctgatttgctgcccgcgagtagaaaaaaggcaatgatcacccaaatgatgataatgaacagcagaattaagctgatgcactgcagccatgcttcacaatcaatcttgcgacgtcgccgtcgctttttttgcagttgtttaagcactgtaaatacgtagtatacggtgttcggatggataaaaatacataattatataaaaagtaaaattactatttttatttttagtaaacttaagaatgaaaattagaaattttgtccccgtttccccgtacaagtgtcaaaattcaccggctgtgcgttccctccccgcctttatttttctgtgattacagtaagcccttttctaccgtcttccggaaacaatcgatcgtacacgcttttgacgagttgcgcattgtcattcaaccattgctcaaaaatgcttctcccgtgttcttctccttgcccattattttcgtttttcttcccatttctttgttggtgtttcgcttttttctcctccttttttctgtttgcttcacttttggcattgtgccccccggtgccatttttgaacagttcagacaatgcgccaaaactgcgtattgctaactgccaatttgaaatttgcactatgtcataaattggcacattttgccaatccaaattgtcggcttttttggacaacaattcatcaaattgacttttcacttcaatcacttcatcttcggacgtaatttggcccattttaattttgttcagactttgcattgccttctctaccatcaccttttgttcatttggaaaatcctctgacaaaattggcacaattgactgatcaatttgaccgaaaaatttgtccaaaatcattttgtgtgattgcgtcacaaaatctccccaatttttccatttcttanattttactttatatttttttaataatttttaaaacaaaaacctcagccgatgcgcattccttaactattttatcatgntccgaggtcgtgtgcaaattcattttctgcatcatttcgatttaattgattttattttgatttccaaatttcatttggcatttctgatcacttctctatcg

SEQ ID NO: 37975 - DNA, 827 bp, Heterodera glycines
  misc_feature (803)..(803): n is a, c, g, or t
tttttaatatatatttacataatattgctatttttccgttttttaggacataaaaatcccatccctactcataactttgttggttaacaaatttttttagaatttcgtaatataatagaaaactcttgggctatcgaatgatttattttattatttggttgactttgaacgaagtttgaaaaattttccatttgatgattttttgactaacgccctctcaccgtcatcatggtcaattttgtcgaaaaaattaatcataaaacatcattgtaagtattatttttagtgggatttataaaatttcaattgtcaaagagtgtgtccatgaaatttacgctattaattgtttaatatatccaaatttatttaaaaaaatatttcgaatgaaaaattttaaaaaatctttctatttttaactgacgatttgacttttttggctatcaaaaaattccattatttcttttcgagaatcagcatactgtagatcttttccatacattttccatgtaacttgtggtggttttttcattcgcgatttcttataaatccgctcgctatgcgctaaaaattattttttatccgacataaatgataacatttaaattcctcataaattttatttacacgccattaccaattagacaattttagtctaattcaaatacaagtaacaattatttgtgaagtctcataaagacacaattataaatttattgtcaacattcattagcgttttgccttttatttatgttgctttgacattatatttttcaatctatggtggggagattatatttttcaanttactaccatttattttttaaaat

SEQ ID NO: 37976 - DNA, 1183 bp, Heterodera glycines
  misc_feature (975)..(975): n is a, c, g, or t
  misc_feature (1147)..(1147): n is a, c, g, or t
atggaacggatgctaaaaataatagacaaattaacttcttaaatttaatttttcacttactgttaattggaattttgaaatcttttctttggaacaaaaagaatttaaacaaattggacagtttccaagttttgttttttcattttcaatgtaagtctaaaatttatttttattattgtttttaagaaaaagattttttacttttaatttgtaaatgttaacggttaaaccaaacatttgctttccataaaatttgctcaaatcaaccgggatattgtaagataaattaacgtcctaaatatcaaattaaaaatgtgatttattattaaattaatattctatttaacttggtagctttaatttgtaagcgtctttcttaattagaataaattattttcaaaaactaaaaatacgatcaccaaaaataaaaatagaatatttcaaaaagatgaaaatttcagaaaattttcaatttacatattttcactttttttgtcataaatcactaaggaaaaatagaaaacctatttttatgaattaaaatgtaaatttttatttaaaataaattaatttttttattaacaataaaattataccccattacggtttttattcaattttgaaccattttttatgaaagtttcagagcccaatgagaaccatgaagaaaatttgtcgattttttgcgatgtttcattggcactctcgctcatcaatggcacatcaacaaatgccacaatggcttcattctcccgaattggttgatcgaaactcaactgccctgagaagctaatcttggaatatccggcttggcccaaatttaattgataaattttgccataatctggcttaaaaattttcagtttgactacacgcgaaactgttttcagtttccttccaagttcaatgctggtccataaaatatttaattgaacataaacagcaaactctgcttctgggccaagatccacctanattaataattgtattttaaaatttaaattaataatagtaaattacaaatttaaaaaggatttacaaaaatttttttttgtaaaaactaaaaataatcgaaaaatgtacactcaaagatcgaaaatttaaatttgatgcgtataattaattactttgagatcgtctaaacaanaaatgatcaaaaagctggatttttgagttctacttc

SEQ ID NO: 37977 - DNA, 975 bp, Heterodera glycines
aaaaaattgattttttcagtgtccgttggggtactcaaccattatgggagcaaaatccacggcagaattaagtacaggctataggaagctatccggaaggatcggtctccccataaatctgggcgcatcggtcggggggactgctccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctcgccataaatctgggcgcatcggttcggggggactgccccgaaaacaaaaataaatcgattttttcaagtgtccgtttggggtactcaaacaattatggggagcaaaaatccaacgcagaattaaagtacaggctatagtgaagctattccggaaggattcggtctccccataaatctgggcgcatcggttcagggggactgccccgaaaac

SEQ ID NO: 37978 - DNA, 2589 bp, Heterodera glycines
taattttctataatacaaatactctcgatcatgagcgtctgggcggtgcgtaatggcccttttattttttaatgaatttttaaattgcatctgtatcccaaaaaaatggctttctcttttttgggtaattttctataatacaaatactctcgatcatgagagggagggcggtgcgtaatggcccttttattttttaatgaatttttaaattgcatctgtatcccaataaaatggctttctcttttttggataattttctataatacaaatactctcgatcatgagagggaggacggtgcgtaatggcccttttattttttaatgaatttttaaattgcatctgtatcccaaaaaaatggctatctcttttttggataattatctataatacaaatactctcgatcatgagagggaggacggtgcgtaatgggccctttatttttttatgaaattttaaaatgcatctgtatcccaaaaaaaatggctttctctttttttgggtaattttctataatacaaatactctccgatcctgagaagggaagccgggggcggaatgggcccctttcattttttaatggaattttttaaattgcattctggattcccaaaaaaaaagagttttctccttttttggggaaattttctataatacaaaataccctcgaatcctgggaaggggagggcggggggcggaaagggccccttttttttttttaatgaaatttttaaaattggacccgggatcccaaaaaaaaggggttctttttttttttggaattttttttaaaaaaaaaaaaccccccccccctaaagggaggggggggggggggggcgaggggccccttttttttttttaaaaaatttttttaaattgggacccccaaaaaggggattttttttttttgttgtttttttttttttataaacaaaaaaccccccccccccgcgagggggggggggggggggggaggggggcccccttttttttttttttttattttttttttattttttcttttctcccccaaaaaaaaaaatgttcttttctttttgtgtatattttttttttaaaaaaaaacaaacaccccccccacagaagggggggaagggggggggggagggggggcgggcgtttcttttttattttatattgttttttattattattttttttcgttgttccttccaacaaaaaagaagatatatttttttttttttttttttatttttttttttttataaaaaaaaaaaaccacctccccctcaaagaggaggggaggggggggggggggggggggggggtttttttgtttttttttttttttttttttttttttttattttcttttcccgccgcgggcgggatataaaaaaaaaaaaaacccccggggggggggagagaggggggggggaagttttgggggggggggaaaattttttttaaaaataaccccggggggggggggggggggaaattttaataattttttttttttttttttaaaccccccaccgggttgaataaaaaaaaaaaaccccccggggaaaaaggggggtaaaaattttttggggggaaaaaaattttaaaaaaaaacccccgggggaagggggggggaaacatttttttaaatttttaattttttgttctttaaacttcccaacccgtttaaaattcaaaaaaaaaaccttcccggggggaaaaaaggtgtttgaaaaatttttgggggaaaaaagcctttccaaaaaaatccccttgggatagggagggggaaccagattttggaattttaaatttttgtactttagctactcaacccgttcagaatcaataaaaatacatttcacggtgcgaaaatggggtatgaaaagtttatgggggggaaaaagactttcaaaatgccaaaaagtttaggcttaacttttttttcagaaactgagcagaagcgcaccaaactttgcagggatactgaaaggaagagaaataacctattttaaatattatctagtcagttcatttaaataatttttatccaaaaaatttttgtttgggttttcggggcagtccccctgaaccgatgcgcccagatttatggggagaccgaatttttcgggaatagcttccctatagcctgtactttaattctgcgttggatttttgctccccataattgtttgagtaccccaaacggacacttgaaaaaatcgattttttgttttcggggcagtccccccgaacctatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtcccccgaaccgatgcgcccagatttatggggagaccgaatctttcggcaatagcttccctatagcctgtactttaattctgcgttggatttttgctccccataattgtttgagtaccccaaacggacacttgaaaaaatcgatttttttgttttcggggcagtccccccgaaccgagacctcaggcagcaagctg

SEQ ID NO: 37979 - DNA, 955 bp, Heterodera glycines
  misc_feature (825)..(825): n is a, c, g, or t
cccatccctacgtgtttgtgacgattttgaggatatcactgaccccgaggtggaactcacattcattttttatacgaatgcttttcctttgttaagcttattcgttcggaccccaaagtgtcgcgttcggtttctctttacggttacgttcgcggggttcacctgaagaacaattcggctgttcagttaatattttacatttttatttcctcattgaaatcattttttagtctcccgggtgtcggtgatttccgtgtccgtcgcattaccattctgtccgacccgtgccctttgccagccaatcggacggcgaaacggactttgaacgaacgtgaacagattgtttacgcaccgatgtccggactcgggggactcgtctacgacaaagacgccgtttacattgacattggcggaagcaaatccttctccagagcggtgggaagcaaattacgaatttttgcattttgatccaatggaattcagcggaacagagacgaattcatcgaagcactcgaaggaatcaaagagccgttggattcgaaaatgggaaaagcgactcttaagcttctgaaggaaaatcccgacttggaattggtgcgtttaatccttacaagggaacctcgcgaactgttagtcggaaaatgcatatgtattatataccattggatggatagaggagggtagacttctcaattttttgcgatttttatccatgcgacgacttttttgtttttaaaaaacgcattttttgcggcgcggtttttaaaaatttttttgagagacagggggtccggcggtgccgataggcgccgccggggggggggnggggaaatttttgaaattttaatgctatttgtaagtagattttgtctaaaaaaatgaccaaatattgagatttttggctaattttttaaggaaaaatagggtggatttttgggggccggcggtgtcgata

SEQ ID NO: 37980 - DNA, 1496 bp, Heterodera glycines
  misc_feature (837)..(837): n is a, c, g, or t
tcagggttcgcaagtttttttttcaaaataaggacagatgaggctaaaactaagactcggaccccaaaaataagattttttctaaaactgatgtagcgcgaatgaaacgtaataaaaacatgaaaaatcgacttaaaacaatattttattagcgcaaaaacaattgaaatagattatcaaaagtatttttcccatccgccgattttctccaacaatttgtgattggaaatgagcatttggtacatttgtgagcaagaaagatcaaaattggctttggtttggatcaacgccttgactgtttcaactttcaacaaattccgcgtgtcagtccattgtgatccgcacaaagagaataccctctcaacaaatgcattcgagacaggaacggaaagaacaatgctgaccagcttgagcagatgcggcaaatttgcttcaaacagcttcttccacttctgttcgggggttaatttttgaaattcatcatttggaaaagaattcagttatttggtttgcttcgctaacatcgtcaaacaaatcatttgttaactcgggcgcaatttgtcgtgccagagacaacgcatcgtcgtggggaattttgcgggatgccaaagcaacccattgcaacttttccggaaatcggtcaatgcgatgccatttgtccaaatatgccaaaactgaggtgtaaagactggaaaatttggaaatttaataagcaaccgattaatttttacttgaaattgttcctccaacgcttcgcgtgtgctctcatcaactttttcaaatcggcaccataaaaccgttcatgttttcgttgttcaatttcgctctaaatttgtncatttccagcaagagttcgggcaaaatggcttttcttttctgaatttatgaacagaattttcattcataattactataacaacctgaaaaagtcaattgtcttgttaaagaggcctagcacgtggtataaaaaatgaatgaccacaaacgattgttcagaaaaaaacgaaaaaaaagtcgtaaagaagtgccggacatttgtcaggttttgaaaagtaggcgattaagacagattccatccgaataattttgcccaacacgctgtgcatcgatgtccaccttgttggcccatgacgattcaagcgttcaaattcaacctaaattaacagcttagaatttttcatttcttagttccgcacctccaattcctcacaaaatcctttcagctcctcaattcgtttggtcgaatttttaaaatgtcctgccattttaaaaatcacagcctcaatgtccattgcttttccttcaattctcaaattatccgttgcctttttgccgcattgtgcaaaacatggcacacacatcccacaccaatcaatcattcattttgttgttttagacggaaaaataaattgttctctcctgcacgctcttctccaccgaaattgctttttgtgttgtacgcgagaatgtgccgtcaaattgacacattcaaatcg

SEQ ID NO: 37981 - DNA, 660 bp, Heterodera glycines
gaagaggaagagggggaagaggatgatggcggcgcggcggagggaagtggggaaggagaagaagaaggggaagaggaggaagaagaggaggaagaagaggaagaagaggaagaagagccggaaaatggccagaaatttgattatgttttttaaaaaaaaacattttgatttgtgtttcgtttttttgttggaaaaaaaatttgttgttgttgttaccacaatcggaattatatttggttttgtggttaatggaagaatttgcaagaaaaaagaagttaatctccccccgtccatcaaattccacatataaaatctgctcaaaatttgctttaaattaacccatttttagcgcgtctttgggtgttgtaaatttttttagttcgccctataaaattgttttatttgcctacccatttttccacaatgcgcgcccattagtccgcccatcactcggccaacaactgctgctggtcatcacacgctcggacaccgcgttgaactgttggaaaaataaatatgtaaatttaggaaattaaaataaaaatggtcatggtgacaaatggtccagtgggataaaagtgggtgtgttggcttgtcaaagttcaaacccacgccaagttttttcatttttttattaatttttgaatccgtgcggatttt

SEQ ID NO: 37982 - DNA, 725 bp, Heterodera glycines
aaaagttaatttttaaatactaaatttttaaggaattcttttattaaacgcctcaaaaaatatccaaaattacacaattttttcaaaaatttaaggaatttatagaaatttctcgtgaaaatctaatattttttcatgaaaatgtatcctaaaaaatcgttttttttccaaaaaactgataccaaaagttaatttttaaaatactaaatttttaaggaattcttttattaaatgcctcaaaaaatatccaaaattacacaattttttcaaaaatttaaggaatttatagaaatttctcgtgaaaatctaatattttttcatgaaaatgtatcctaaaaaatcgtttttttttccaaaaaactgataccaaaagttaatttttaaaatactaaatttttaaggaattcttttattaaatgcctcaaaaaatatccaaaattacacaattttttcaaaaattttaggaatttatagaaatttcttgtgaaatctaatattttttcatgaaaatgtatcataaaaaatcgtttttttccaaaaaactgataccaaaggttaatttttaaaatactaaatttttaaggaattcttttattaaatgcctcaaaaaatatccaaaattacacaattttttcaaaaattttaggaatttatagaaatttcttgtgaaaatctaatattttttcatgaaaatgtatcctaaaaaatcgtttttttccaaaaaa

SEQ ID NO: 37983 - DNA, 496 bp, Heterodera glycines
catcacagcactaccaccaccatcagcagcagcagcctcccccagagcattcgtcctcctcctctgcgcccagcggttcctcaaagcgtcggaagagtcgcgcgaacgcttcggcggcgctaccaccgcaacagcagcagcaacaggtggcgacggtcggcaagcagtgtcaagacaagacggcagcagcggtaaatcaattgctttgcccgcccgctgagaagcaacgccgcacggcggaaaatggttacccagcagaaggcggtggcagcggcagtccggcggacgtttcgtgtgcggcggtcgttatgcgtgacccgtcccggtggaacttggcatctacaaagcaacggtccagctcagagtccgcgttcaacatgccgtcctcatcggcgactcctgatttgccgctaccgcagcactgcagctgctgttccatgtgcaagtcaatgtccacggatggtgcgcaccggtgcgtgcatctgccgtatgtgca

SEQ ID NO: 37984 - DNA, 1018 bp, Heterodera glycines
aatcatgtttcccactcccttctcccaggggtcatgttttccactcccttctcccaggggtattattttgtaaagtctttttttccccaataaacttttcataccccattttcgcaccgtgaatgttatttttattgaattctgaaccggtttgagtagattagactacaaaaaatttaaaatttcgaaatcatgtttcccactcccttctcccaggggtattattttgtaaagtcttttttcccccaataaacttttcataccccatttttcgcaccgtgaatgttatttttattgaattctgaaccggtttgagtagcttagagtacaaaaaattgaaaattttaaaatcatgtttcccactcccttctcccaggggtattattttgtaaaaagtctttttttccccaataaacttttcataccccatttttcgcaccgtgaatgttatttttattgaattctgaaccggtttgagtagattagactacaaaaaattgaaaatttcgaaatcatgtttcccactcccttctcccaggggtattattttgtaaagtcttttttcccccaataaacttttcataccccatttttcgcaccatgaatgttatttttattgaattctgaaccggtttgagtagattagactacaaaaaattgaaaatttcgaaatcatgtttcccactcccttctcccaggggtcatgtttcccactcccttctcccaggggtcatgtttcccactcccttctcccaggggtattattttgtaaagtctttttttccccaataaacttttcataccccattttcgcaccgtgaatgttatttttattgaattctgaaccggtttgagtagattagactacaaaaaatttaaaatttcgaaatcatgtttcccactcccttctcccaggggtattattttgtaaaaagtctttttttcccaataaacttttcataccccatttccttagaaagtgaatgttatttttattgaattctgaacccggtttgag

SEQ ID NO: 37985 - DNA, 975 bp, Heterodera glycines
ttgagtaccccaaacggacactgaaaaaaatcgattttttgttttcggggcagtccccccgacccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataaatgtttgagtaccccaaacggacacttgaaaaaatcgatttttttgtttcataaatatttttttcagaaagtgctctaaagcgcaccaaattttatttacaacttaattttagcactctgatgctttagtatcaaaaaggaagatggagaaaaaattttttaaaaaatttttccttatattttggttatatcgttttgcttttggtggggtgcttggaacagtggaatcatgcgcacccgtccgatctggcaagttaagcaacgattgctgactagccaaagggttcggtgccgtgatgaaacgaaccagcactgcttaccccg

SEQ ID NO: 37986 - DNA, 764 bp, Heterodera glycines
gaccggatgtcgtgtgagatgccctgcgggtgaaacccaatttttactgaatggcacactccggtatattccaccccagcgccgatttggtcatcggcaacgaaattccgaactgctagtgaccgatcccgagtcgtatggcctttggttcggcttcggcctcgacatgctgtcccccctccgttttttgggccctggtcccatcatcctgctcggcataaccgttgtgacaatcggcctttttctcctatttttattcgtcaaatattcgccaatcttcgccacgtatcgcctaattttacgaattttcgtcgggtgtgtgttgattcgccccgcaatttcttcatcaattgaatttgttttccccaccccctccccaacctattcttcacatactttcgccgaatcgcaaactttgggttatcactttctccaagtgtctgcgttgtcctttgtgtcgccatgcccgctgtacagcaagtcagccccccctttccttgctccccccttttttgtcatcgccaagctcctccaaattctccgtggccttcggcagatgccttttggtggccatcacatcaacagggggagggggaggaaccaatctttggagtgacaaacaaaaggagacggataagttgggcgggtgctgtacgatcctttattttgggaagggccgagcccatccgtttataaatacattccccccccccctcgggcgacatccacttcattcatcaacattttttttggatttcatcact

SEQ ID NO: 37987 - DNA, 981 bp, Heterodera glycines
gataatttagcgctcattatgggatgtataaaggccatgtagaaaggaattggaagcgctaaaattgtttgagaagctttttgagcgtaattacgatttttacttagaccatttttttctaggcttagatcacatgcgattttcggcactctgataattttagcgctcataatgggatgtataaaggcgattgtagaaggaattggaagcgttaaaattgtttgagaagctttttgagcgtaattacgatttttacttacaccattttttgctaggcttagatcacatgcgattttcggcactctgataattttagcgttcataatgggatgtataaaggcgattgtagaaggaattggaagcgctaaaattgtttgagaagctttttgagcgtaattacgatttttacttacaccattttttgctaggcttagatcacatgcgattttcggcactctgataattttagcgctcataatgggatgtataaaggcaattgtagaaggaattggaagcgctaaaattgtttgagaagcttttttagcgtaattacgatttttacttagaccattttttctaggcttagatcacatgcgattttcggcactctgataattttagcgctcataatgggatgtataaaggcaattgtagaaggaattggaagcgctaaaattgtttgagaagcttttttagcgtaattacgatttttacttacaccattttttgctaggcttagatcacatgcgattttcggcactctgataattttagcgctcataatgggatgtataaaggcgattgtagaaggaattggaagcgttaaaattgtttgagaagctttttgagcgtaattacgatttttacttacaccattttttctaggcttagatcacatgcgattttcggcactctgataattttagcgctcataatgggatgtataaaggcgattgtagaaggaatggaagcgctaaaatg

SEQ ID NO: 37988 - DNA, 1037 bp, Heterodera glycines
  misc_feature (942)..(942): n is a, c, g, or t
  misc_feature (960)..(960): n is a, c, g, or t
  misc_feature (962)..(962): n is a, c, g, or t
  misc_feature (1021)..(1021): n is a, c, g, or t
atcagtcccatcatcttgaaattaatcccatggacacaagtcctggcgctgtacatgcatttcaagacgaacatggaaattggctcacttattggtttggatcaaaaagtgagttggcctatttctgaattaaatacatttaatatgttctttcaaaggttctagtactgcccaaccatttgtgcatctgccgtcttcgttggataagtcaaaacacgaaaaaaggcatgaaattaaatgctcaacaaaaataataatcagggacaaagagggtgtggttacagccttataacgtatccatttaagaaaagtctcgagtgacaacagcaacaacggacagtcgtacaaagagcagccgacggtggtcaatgtgatcgacacatcctcggccagggatgttgagaagggccaaacgcggcaccgattgtcgatttcttcatcctctgacaatgagtccttttcgagcgaggaacatccgacagaatcagacaaaaaactgccagcagaaaacagctcctcatctgatgaggccagccgatacataaagccaatgaatttattacggaccaatgttgggacaacggacgaaacgggcggaccaacggaatcaaaagcggagccaatggcacaagaaagtcaaatgtcatcagactcaaggcatttcaataccattctatcttttcttaaaaaaaccagtactgtaattatattctatagtagtcacctcacattgatgcaacggctttgtcaccttactactggggaattggaacccactccgagagtggtctcgcattcccgaacacgttcgttacgcttgccaatggtcaccgcttccaatgtcttagaacggatggaaggtgactgatcacttcatggcctttttctcacaaagtgttccttcaggttctccttttcggctattaaatgacctcccaatgngacgtcctctcccctccngncttcttttttaccattcggttcgcgatgcgcttcacagtcggccccgccagaaatattngtaccgactaatttta

SEQ ID NO: 37989 - DNA, 897 bp, Heterodera glycines
agagagaaagagagagagagagaagaaagagagagagcttttactgaaagagaaggagagatcgtatggaatggaggtggtgagagagagagagagagcagaggagaatggagtgaaagagaaggagagatcgtatgagatgaagagagagagaagagagagagaagagagagagaagagagagagaagagagagagagagagagaaagagagagagagaagagagtgagaagagagagagaatggactgaaagagaaggagagatcgtatggaatggaggtggagagagagagagagagagcagaggagaatggagtgaaagagaaggagagatcgtatgggatggagatagaagagagagagagagagaaaagagggagagagagaaatagagagggcaagtgcgttgttccatacattcaaaaagaattaatttgcaaagatctgctgcatatcgagataatttggaaagcgatcgcaagtgaaaaatgataattaaaaaaaatgccgaaaagggaagacacaatgaaccaaattgaatttaccgatcagtgatcaaatcgaccgaaataaatttacttgaaaataacagtctcgattaaatgaataaaaaacgggagacgaatgtgaacagaaaagagtgcaaaaatttggaatcataaaaaatatatatgtaggtatgtgcgtccgcgcgagcacaaccaacacaacacacgtggctcctttttctctctctctcttttctctctctctctctctcgctatcccggtctctcactcacttcctatctctaaccttctccctctttatccgctcctttctttctcgtgccccctccccctccccctctctctcttcctctctctccctccctatccctccgctcctttctctc

SEQ ID NO: 37990 - DNA, 1139 bp, Heterodera glycines
cccccagaacccgatgcgccccagatttttaagggagtcggaatcctttggggaatagcttcgatatacctctactttatttttaccttggattttgctccccataattgtttgagtaccccaaacggacacttgaaaaaatcgatttttttttgttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgatttatttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagtctgtactttaattctgcgttggatttttgctccccataattgtttgagtaccccaaacggacacttgaaaaaatcgatttttttatttcataaatattttttcagaaaatgctctgaaacgcaccaaattttatttacatgttagtttaggcactctgatgctttttctatcgaaaagggagatgaataaaatttttaaaaatttttaattcctttttaaacaggccaaaaagtttaggcttaacttttttttcagaaactgatcagaagcgcaccaaactttgcagggatactgaaaggaagagaaataacctattttaaatattatctagtcagttcatttaaataatttttatccaaaaaatttttttttgggttttcggggcagtccccctgaaccgatgcgcccagatttataaggagtccgaatccttcgggaatagcttcgatatacctctactttatttttaccttggatttttgctccccataattgtagagtaccccaaacggacacttgaaaaaatcgatttttttatggcggggcagtccccccgaaccgatgcgcccagatt

SEQ ID NO: 37991 - DNA, 1067 bp, Heterodera glycines
ttcagttttccagaaaatgccttcattcaaaacgcttcatagtttgcggttttcacggttataagctgtcaaaaagtactttccggaatgtctgaaataatttttgcaataatttttattcacgaaatattagaaaaaattataacgggataaatgttttttagttcggtaataaattcttttcaaatcactctcatatccgaattttttttcataggatgaattaacaattaaaaaggatagtttgttgggactactccttccactaaaatattcttgactggaaacaagccaacggcggcagttttctagtacaaaattcttaaaaaaagaaacttgccaagcctgttgccgttgtatgcacaattatttttggcaaaattcggggactttaaactctccattgcaagtcgatacgggcacctgaacttaaagaggacttaatttgaaaattgtacttttctattcaaattttaaaaattattattattattaaaagtcttttgaaaaagtgcgttgcgaaaaaaagatgttttgaaaaacaaaaaaggtaatcagaaatttttgattttttttgaataaaattcactatttttatttatataatttattttttggaaggcaatttctcgaaagtaccttttttgccacaaagaaagcttttttgactatgtgcataagaaaaaaaaattaaaaccccaacctcgtcgacccttacattgtctcacaatcaccagaggaattgcataaagaatttatgaaaaaagcagtcaatcatcagaacagttaagcattaaaaggtgaattttttgagtctttcaaattcatataatttttgtaaaaaaaatttcgcttttttgtgacatttcgctttcgccttttcgctttttattttggtttcaattttcgctttttattaataaaaaacgctaaaaggcattttaaatagttttattagggtaatttgtagcgctgaacccgaatatgacctttattttgcaaaatcccgaacctcgaaccccaattcgaacaaaaattcgaaatcataattaaaaggaaaaatattt

SEQ ID NO: 37992 - DNA, 1229 bp, Heterodera glycines
cagttccccatgcgttttgctcgaagggcacgccaatcggtggcaaatcgcgcgacttttcagccccgaggcgattcgcctgcggatactgccgttttgggtcctcaaagcatgtcaaaaagtcagagatagagaaaggagactgtgagagtgcggataggataggatgaggatagacaatctagagcggagtgagacaaaggcattccatccgtttttccttccattttaatacctgtgctgttttgaactcatttgtccattgtttttggcgtactattgcccccccccccctcccccgcccggcactccaaacagagacgcactatcaacaatttgtagcaattgttgcacaccggcaccggtttgctcggggacaccgatggcacagcgcacttttggccaacgcatcgctcgcaaaagccgaaacgacatacggcacaaccgatctgatttggatggcattttttcccattttgatccataatcaagttctcccacttcttttctgcgtcgtgtatattccgccatacaatttgtgcatggcattttgcgtcctcctttctgccgagtgccaaaacaaacgaacaaagccgaaggggacacagagaaaattggaaattttacaaatcaaaaaattagtgcataaattggcaatctggtatttgttaaaaaatgcttttacatttttattggaatccttaaaagtcaaggacaggcggaagggaatggtcggtgttgtgtaagcatataggtacattatattttatggattggaattgcgcaacctcaagagcagaggaagggacaaaaaaattagagaacgaagcactctcgactcgagcccggaaatttcaaatttgcggatcccgctgcgggactggaactcaaaattttttgcgggacgggatcccgcgggattaatcccgcaaatcccgcatttaaaatttgcgggatcccgtgcgggattgcgggattttggaagattcgaaaaaatttcaattaaatttaaaaaatttccaaaaatcaaaaaatgctgaaaataaatttttaggggctgtcgggatgcattaaaaggggctgatgggtcgactaaggtttttcgattggatccgacggtaaaaagttgatcggaaatcaattattaacgttcataatttgactatttttttttcttcaaaccacttttttgcggtgcagaaatcgggaattttcaaaaatatacatat

SEQ ID NO: 37993 - DNA, 1015 bp, Heterodera glycines
  misc_feature (935)..(935): n is a, c, g, or t
  misc_feature (998)..(998): n is a, c, g, or t
ttatttttatttagttagtgataataattggggggatttggaccaaaagtcaactctaaaaagaaaaagggcatccccgaaaattattggcattcattgaaagggattttgggaaaaggagggcaagtttaacgtatttaaatacgatattatttttatttagttagtgataataattgggggtattttggaccaaaagtcaactctaaaaagaaaaagagcatccccggaaaattattggcattcattgaaagggattttgggaaaaggagggcaagtttagcggatataaatacgatattatttttatttagttagtgataataattggggatattttggaccaaaagtcaactctaaaaacaaaaagggcatccccggaaaattattggcattcattaaaagggattttgggaaaaagagggcaagtttagcggatataaatacgatattatttttatttagttagtgataataattggggatattttggaccaaaagtcaactctaaaaacaaaaagggcatccccggaaaattattggcattcattaaaagggattttgggaaaaagagggcaagtttagcggatttaaatacgatattatttttatttagttagtgataataattggggatattttggaccaaaagtcaactctaaaaacaaaaagggcatccccggaaaattattggcattcattgaaagggattttgggaaaaagagggcaagtttagcggatttaaatacgatattatttttatttagttagtgataataattggggatattttggaccaaaagtcaactctaaaaacaaaaagggcatccccggaaaattattggcattcattaaaagggattatgggaaaaagagggcaagtttagcggatttaaatacgatattatttttatttagttagtgataataattgngggatattttgggaccaaaagtcaactctaaaaacaaaaaagggcatccccgggaaaatattnggcattcattaaaaggg

SEQ ID NO: 37994 - DNA, 1358 bp, Heterodera glycines
ccccataaatctgggcgcatcggtcgggggggactgccccgaaaacaaaaaaatcgattttttcaagtgtccgtttggggtactcaaacaattattaaaaatttttagatttttattcatctccctttttgatagtgaaagcatctgagtgcctaaaataacttgtaaataaaatttggtgcgtttcagagcagtttgtgaaaaaatatttatgaattaattttgctaaaaaaataaaatagtgaagctttaaaaattaataaaaaattttaaattcagaattactggagttagcatcatagcagtgcttttccttgtctttttgatgccctcgcaaaatctggtccgcttctgatcagtttataaaaaaaaagttaagcctaaaatctttcgcaaatttaaaaagcaattaaaaatttttagatttatttattcatctccctttttgatagtgaaagcatcagagagccttatttaacttttaattaacatttggtgcgtttcagagcacgttctaaaaaatatttatgaattaattttgcaaaataataaataattaatgaaaaagtcagaatttcgaaaaattttaaaaacaacaagcgttggcattttttcaggttaagttagtcctttacaatggagaaggcctgcaaaatttggagagattatatcgattttagtgcgctaggttcgatgaaactttttaaaatataagcctaaactttttggcctgtttaaaaaggaattaaaaatttttaaaatatttattcatctcccttttgatagaaaaagcatcagagagccttatttaacttttaattaacatttggtgcgtttcagagcacgttctaaaaaatatttatgaattaattttgcaaaataataaataagtaatgaaaaagtcagaatttcgaaaaattttaaaaacaacaagcgttggcattttttcaggttaagttagtcctttacaatggagaaggcctgcaaaatttggagagattatatcgattttagtgcgctaggttcgatgaaactttttaaaatataagcctaaactttttggcctgtttaaaaaggaattaaaaatttttaaaatatttattcatctcccttttgatagaaaaagcatcagagagccttatttaacttttaattaacatttggtgcgtttcagagcactttctgaaaaaatacttatgaattaattttgcaaaaaataaataagtaatgaaaaagtcagaatttcgaaaaattttaaaaacaacaagcgttggcattttttcaggttaagttagtcctttacaatggagaaggcctgcaaaatttggagagattatatcgattttagtgcgctaggt

SEQ ID NO: 37995 - DNA, 1316 bp, Heterodera glycines
acttgcgcatgggcctgggagtttctcgtacacaaactttttattccacccgaatgtctctatgtctcatattttggtggcaattctgcgaatggattggcttcggacgaagaaagccggtagagcattttggaaaaataacaatagataattgattatttcctttaagtaaaaattggttagacattggtattcctgccgagcgtatcctcccatttggaatgaaagacaatttttgggaaatgggcggtacggggccgtgtgggccttgttctgagattcattatgaccgagtcggtggaagaaatgccgctcatttggtgaacactggcgacccaatggtggtagaaatttggaatttagtctttattcagtactacaggtaaaccgattcttctttttttaaatatcattattatcctattatttagggaagaaaatgcgaagttaaggccactgtccagcaaatacgtcgattgtggaatgggactcgaacgattggtgtcagtggtgcagcaaaaaatatccaactatgacactgatttgtttgttccaatatttgatgtcattcaaaaggttctttaaacaaagatacaaattttgttatgaattaacttattgcatttcccttagatttctttaaaataatataggcaattgacaatttctgggcctaaatttaatgtttattcattgccattgcgaaaaggtaatttataaaatttagttttttggttaagtgtactgctcaaaaacacaaataccaagggcgatttggggactctgacaaagaaagtattgacgttgcttatcgaatcgtttccgatcatatgcgagctgtgaccgttgcattggcagatggaattggttttactaatcaacaacagaaaaagagctcgtgaggaaatcattccaatcagtcagtttttaaattttcaggcgtaaaattaaggaattgtttaaacgcgccacgatttatggttctcaaatgctcggaatggaacggatgagcatgcatttgatggtgccggtcattgttgaacaattggtaatttaaaaatgcagaaactcataaaaaatgtttatagggtgaaacatttcctgaaatggcgcagaacaagcacaaaatcgccgatgctgtcagaatagaagaagaacgactttggaagcagagagacgatggaatgcgtcatttggaagaattgtttcgtaaccatccgccgacgagcaaagtttttccgggtgaactaatcgaaagttaattattcatcgttacaaacattgtgttcttaaggcaaatttgcatttatcattgt

SEQ ID NO: 37996 - DNA, 902 bp, Heterodera glycines
gtctcgagattttataaatgcaagaaaagagcaaatattggcattaaaaaagaaattacaatgaaaaattacgaaattcaacttttccgagtataattttttgtctattgcctttatcaaaaataaacttatacaaaagcttccatagaccttaagctttagtttaataccaagaatataggtattgaccaagtaataaaaaagttatggtctaagaaactgggtatggtcattcatgggacgcataatatgacatgggacgcataaaaccgactataaccgcctatttttgcctatttcggggtttttgtgctaaaatttttcaaaaaaattatcccaaaatttaatatttttttcttaataaaaatcttttggtttaaaaatttgttcatattcgaaaaaactctaaaacatttaataatttcatttacaattgaaatatttaaagttttaacgtgttttgttacctaaaaagcgttaataaaaaattttatttgcctatttttgtgcctatttaatgcctatttcgcgattttttgtgcctaaaaatggaagccctaatgatgacacttagtctaatataccatgaaaggattggaagaaacacagaaggtggcagggctgtgcaaattttttctgcttatttttcgaatttggctcagccctggagaaagtttaagaacatcacgattggtttgaggatttacatgaaaggacaaaaactaatgcacagaatctgctggttggttgtggcacacaaacaatctcctctttccatcaaatccctccaccagtttcttcttttgcccaatctgttcacattccgtcgtactttggccctccgccgccctccggggccacccaattgatgttttgcagcgggtctttgatgtcacacgttt

SEQ ID NO: 37997 - DNA, 1123 bp, Heterodera glycines
cccttgtcgccttcccttcttcatcgccttcgtccttccctctgtccgcttcctcaacgccggccaaactgctgatgtttgacaaatatcatcatcagacgccgccgccccaccacttgccaatcttggtgagtgagcactgattggccaaccatgggactcttggtagggcaccagggatgtacggaatcccggctttcgatttccgaaatatttgggacctcggaatgccatccctgataggcattaatcataatttgccaatcttgatgagtgagcactgattggctaaccatgggttgggtcttgattggtaccagacatgcacggaactccgactttcgaaaatttttgtggcctcggaatgccatccctggtaggcactaccaccatttgccaatcttggtcggccggctcattttatttaccagtcttgatgggaactggtcggcattattgagggctaatcgcccccttcctttaccaactaatctttgtaagggctgctgatcggtcccaccctttccagtcttggtaagggctgatcaattctataatattgatccccatcagggctgcacgcgattgcggattacggaaattacggggttttgggagttacggattacgggttacggatttttgggatttttccgtaattttgatccgtaatttgacttttggattatttttcgagacgatttcttgtacgattatttttataaaaaacaaatttttctattttttatttaaagggctacccgtatttcgatttatttaagaattaaaataatttataattttttatttgttgttgttaaggctatttgggtagttcgcctagaaaatagaggcatcacttttttgtcacacctatttttcacgcattttacgaaaattcataaaaccttagccaggtgaggggaggaattccccccctcccccgcccgaaatgaaaaattaaaaatttttacaggaaaaattgggacttttaaatttttttgtcgatttttcttaataaaatcattaaaattttaaaaaaaatttgcccggcggcacctatcggcagcgccggaccacgatttactcgattttaccttattttttaaattttgactacaaa

SEQ ID NO: 37998 - DNA, 458 bp, Heterodera glycines
ctcgtaaatttccggcagctgcggttcggcggcgaaggctttttccagcgtcatgcccggatccggcggcaccagcttggagatgcgatcaacgaagccgtacggatgccccagcacgcggcccacgtcgcggataaccgctttcgccgccatggtaccgaaggtgatgatctgcgataccgcttcgcggccgtacatctccgccacgtgctcaattacctggtcgcgcttctccatgcagaagtcgacgtcgaagtcgggcatcgagacacgttccgggttcaggaagcgttcgaacagcaggtcgaattccaacggatcgaggtcggtgattttcaacgcataggccaccagcgaaccggcaccggagccgcgccccggccccaccggcacgttgttgtccttcgaccactggataaactccatcacgatcaggaagtagccggggaaccccatct

SEQ ID NO: 37999 - DNA, 977 bp, Heterodera glycines
cggaatttctttctgggcgagtttgattgtgaaaattttcggaaaaacgcctatctctttttctgctcaacactctagacaattccaaccccatttacggaataatagcgccaaccctaatttttccggaatttctttctgggcgagtttgattgtgaaaattttggaaaaacgcctatctctttttctgctcaacactctagacaattccaaccccatttacggaataatagcgccaaccctaatttttccggaatttctttctgggcgagtttgattgtgaaaattttggaaaaacgcctatctctttttctgctcaacactctagacaattccaaccccatttacggaatgatagcgccaaccctaatttttccggaatttctttctgggcgagtttgattgtgaaaattttggaaaaacgcctatctctttttctgctcaacactctagacaattccaaccccatttacggaatgatagcgccaaccctaatttttccggaatttctttctgggcgagtttgattgtgaaaattttggaaaaacgcctatctctttttctgctcaacactctagacaattccaaccccatttacggaataatagcgccaaccctaatttttccggaacggaatttctttctgggcgagtttgattttgaaaattttggaaaaacgcctatctctttttctgctcaacactctagacaattccaaccccatttacggaatgatagcgccaaccctaatttttccggaatttctttctgggcgagtttgattgtgaaaattttggaaaaacgcctatctctttttctgctcaacactctagacaattccaaccccatttacggaatgatagcgccaaccctaatttttccggaatttctttctgggcgagtttgattgggaaaattttggaaaaacgcctatctcttttctgctcacactctagacattccatcccatttacgga

SEQ ID NO: 38000 - DNA, 923 bp, Heterodera glycines
ccataattttttgagtaccccaaacggacactgataaaaatcgtttatttcgttttcggcgcagtcgccccgatccgatgcgcccagatttatggggaggccgaatccttccggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttccggaatagcttccctatagtctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataaatgtttgagtaccccaaatggacacttgaaaaaatcgattttttttgttttcggggcagtccccccgaaccgatgcgcccagatttatggggagaccgaatccttcgggagtagcttccctatagcctgtactttaattctgcgttggatttttgctccccataattgtttgagtaccccaaacggacacttgaaaaaatcgatttttttgttgtcggggcagtccccccgaaccgatgcgcccagatttatggggagacc

SEQ ID NO: 38001 - DNA, 337 bp, Heterodera glycines
  misc_feature (305)..(305): n is a, c, g, or t
tttaagttcgggagggaaagagtgaagggggggggggcgaaaggcggcataaattggccgggaagggccccacagggaaattcgaagaaagagcgcaatcggcagctgcattccttttattcattcattggcattaaagttgggccaaaagtacaaaagggtgacgaaaattatgccgaatttccaaattgtgaatttttgacgaatgcctttgacagtttggggccgtccctctccccggcggcggtctgttgttattcaaaatagtcctttccctgccattccaaacaccttttatccccccngggcgtcagctggcaacagtcattcccaattc

SEQ ID NO: 38002 - DNA, 765 bp, Heterodera glycines
aaaattatatcctctgatataaaaacgctgcagtcgtggatttgacaactgagatggaaccaaaagttccataatatctttccataaggctggaaaggcagaatttgaatggccagtctatatttacactgagaaccgttgaagcgggtgatgcgaagccatagcaaactgtatttttaaattctggccgcaattctaccaaaaacgtgtttagaccgcagtaactcggctcagagtgaagattaagggacgcaaaagagacgatttaaaagcgattcgaaaattctatcgactgatataataacgatgcagtcgcggtgttgacaactgagatggaaccaaaagttccataatatctttccataaggctagaaaagcagaatttgaatggccagtcgatatttacactgagcacccgttgaagcgggtgatgcgaagccatagcaaactgtatttttaaattctggccgcaattctaccaaaaacgtgtttagaccgcagtaactcggctcagagtgaagattaagggacgcaaaagagacgatttaaaagcgattcgaaaattctatcgactgatataataacgatgcagtcgcggtgttgacaactgagatggaaccaaaagttccataatatctttccataaggctggaaaggcagaatttgaatggccagtctatatttacactgagaaccgttgaagcgggtgatgcgaagccatagcaaactgtatttttaaattctggccgcaattctaccaaaaac

SEQ ID NO: 38003 - DNA, 837 bp, Heterodera glycines
ggtggcgaaaagaggcataaggtagaggaagctccatccccatatgagacgggaagaaacaaagaagaattgaatgaatggatgagcttggatgggaaggatgaataaaatgattttgatttggaatgaaacatttttatgattggtggtttttcggaagaaaatgcaacttttaagcattccgcagcaggagaaaacatctgtcggataaatttttaaaaaattttctgatcaaaaaaaggctaaagaaagggggaggggggggggaaagatgggtttgttgagatacatataaattagagagagagaaaagatcattttgatcacttcaatcacagaaagtaattggcaaaattttgattttctcactgtttcgtcacaaattttgcgcaattgcaatggtctggttggtgcggaaggggttaagagaaattggcttgagcgtgctcatttgtcgagaatctcgagagaatctatggcctttatgatgatcggccgacacctccaatgtctcaatttcaccaaattttaccaatcatttgcattgatgagcagaaaataattaaggacagaattaatgtgcaaaaaaatgatgggatgaactgctggagaagacagacggaagtgttgtgtaagaggggcatgtagcagatgaaagagggtgatgatgaaagtcatcgaaaaaagtgtcaaattgggaaaaaaaagtttcgaaattaaaaaaaggggaggggtaggggttcaaaaattattaatgagttttgtgggctcccctccatgccctgctttttaataaactggttttttgctgatttttttgattttaatcccctaaaa

SEQ ID NO: 38004 - DNA, 639 bp, Heterodera glycines
cattggcaaattgccaaatgaaagggcaaaagcaaacctttaacgaaggaacaactatttattaattgtatgtacagcgacaaaccatgctcattttttaggtttataaatttcatctttaaaacaccgaaattgtttacaatcagtgacaaaaatttagctaattaatctctgcaaatgggaaaattattgagtatcagtgtaaaatgggaaaatgcaatcatatttattgatgaaacccgagaaataagtcaaaaaatgagaaagattctgaaaataaaaccgtaaattacgatgcgtcaaagggttttcacttgtcggcggatttggcttcggtcacacggaaaggctttcggctttgtcgagcaattcgtctgccaaagttttctgttccgttgcactcgacagaatgtccgccatggatttcaattcgttcgccgcctttttcgcgttttgcgtgctcagagtgaccatttgctgattttcttgcagcacttcgattgctttctgaaattgcctttgccatgacaattcgtttattggtccaacaaatggggcaatcctgcagtttactggtccccgtttttttttttggaaaatcctgggaaaaactttctaggggtattttaaggtactgag

SEQ ID NO: 38005 - DNA, 955 bp, Heterodera glycines
tgtgaaattaaatggcgattgcgcaccgcacttcctcccttctcgagagcatttgtaacgtataaaatttctcaaaacattagatagtcatttttcttggatataagataaatttaaaaattctctgagaaattaaatggcgattgcgcaccgccctccctctcacgctcgagcgcttttgtaacgtataaaatttctcaaaataagagatagtcatttttcttggatataagataaatttaaaaattctctgtgaaattaaatggcgattgcgcaccgccctccctctcacgctcgagcgcttttgtaacgtataaaatttctcaaaataagagatagtcatttttcttggatctaagataaatttaaaaattctctgtgaaattaaatggcgattgcgcaccgcacttcctatcatgctcgagagcatttgtaacgtataaaatttctcaaaataagagatagtcatttttcttggatataagataaatttaaaaattctctgtgaaattaaatggcgattgcgcaccgcacttcctatcatgctcgagagcatttgtaacgtataaaatttctcaaaataagagatagtcatttttcttggatataagataaatttaaaaattctctgagaaattaaatggcgattgcgcaccgccctccctctcacgctcgagcgcttttgtaacgtataaaatttctcaaaataagagatagtcatttttcttggatataagataaatttaaaattctctgtgaaattaatggcgattgcgcaccgcacttcctatcatgctcgagagcatttgtaacgtataaaatttctcaaaataagagatagtcatttttcttggatataagataaatttaaaaattctctgagaaataaaatggcgattgcgcaccgccctccctctcacgctcgagcgcttttgtaacgtataaaatttctcaa

SEQ ID NO: 38006 - DNA, 425 bp, Heterodera glycines
ttaaaaacgggcgcgaagcgcccgtcctgaggccgccctcgtgcgaatgtccctaaaaaaattaaaaaacgggcgcaaattgcccgtcctgaggcagcgaagcgtccgaatgttccccacaaaattaaaaaacgggcgcgaagcgcctgtcctgaggccgcgaagcggccgaatgttccccaaaaaattaaaaaacgggcgcgaagcgcccgtcctgaggccgcgaagcggccgaatgctctcaacaaaattaaaaaacgggcgcgaagcgcctgtcctgaggccgcgaagcggccgaatgttccccaaaaaattaaaaaacgggcgcgaagcgcccgtcctgaggccgcgaagcggccgaatgctctcaacaaaattaaaaacgggcgcgaaacgcccgtcctgaggccgtgaaaagaccgaat

SEQ ID NO: 38007 - DNA, 430 bp, Heterodera glycines
ggaaaagagagactgaaaaagagagagagaaagatcccttcgagggagggagggagagagagagggagggggagagagctagagagagtgagagagagagagagggggaggaagggggagagagactgagagagtgagagagagagagagggagagagaggggggaggaagggagagagagtgggaacggaaagggagagagagaggggggaggaagggagagagaactcgactaacacgataaatcaacgtcatatcatttttaatttgtaaattaccttatgtgattaacactgatcagcaaataaaggacagcagcaaaagagacaaaactcgcaaaaaaatctccaattgccctgttaattagcaaagcactgaattttcggctgacacttcgggaaccaatggcgcgtacggaagcgaaaatata

SEQ ID NO: 38008 - DNA, 794 bp, Heterodera glycines
taccaaggggtaccgcggatggatacggcttcaaaatctcctggatatagacagatgtgaatataaaaagtcagggatatatccggacaaggtataattagtatcaatatgacttataataattttcttcgttttttcatttcaattttgaatgcaaatatcattgttcaaattttctcaaatcgtttttgaaaaattttatttatttaatctcaaaaaatctacaaaaaattaattccaataggtaaaaatgaaaatcattttaaaaagttgtttaacaataatataagataaatattttaaaattaataatttaatttaatcattattttttaattacctattttcttggctttactggtaattttttggagtccatcttcgacccggtccttaagttttgattcttttccattaataatttcatcgaccgtaggaattttgcactttgtacaataatcatcgtcctcattcatttttcttttgatttttcccaatactttacggtatctgttcatcgtattatcaattggtacttaaaatgatccaaataaatcgaaattcataaatttaaaataaaaaatatttctttttttatttgtttaaataaattcagcaaaattatgatggaaaaggtaaattttgataaatttaaaaatggcacaggccgagcttcacttacattttatttattgagttttgtacaatttttattattaaattattttttaaaaaccaattttttgaaaaactccaataatttcaaaaatcaaatattaaaaatttggaaaaaa

SEQ ID NO: 38009 - DNA, 1321 bp, Heterodera glycines
ttttgtaaaacaaattattaaataatcaatcttcgcaataaatttatgaactatttttatctttttatttaacaatttaaaaatgaagaaatcacagtttcaaaatagattttgttatttaagagatacttttagattaatgaaaaattcttactaattttaatgaaaaatcaataaaaaaaagttacaaaatttatcaaaatgaatattgaattttcaaaataccctattaaaatgatgcttgcaaatatacatttctttgaataattttgaataaattataatttattatattctgtacatagcataataaaaaataattaaaagaattaaaaatcgaatatttagtatttatttttaatgaaaaaaaaattaaatattataactctttcatttgtttacgaaaagctgcattctggtatttttatttatatgtataataattgaaaaaaatatattacctatacttattaatatgaaagcattaataattgtgaaaatatatttaacctaaataataattatcttcggtgacccgtcaacagaaaaaatcataatatgattttattttacaaaataattagctagctgaaaaaataattttatttactatatttatttttcatcagttatattcatatataattttttagataatttgaaaaaattttataatagcaaatataatttttaattaaaatccgttcttttaattaatttaataaattgatctttaaaaaaaatcaagaaatgtatagattcaacaaagcaacacttaaccatcctgtcaggaagtagcgcacatgaataaaaatattcttggggtaaattaattcatcgatgtctaatattatttcaaattttaaaataataaaaaatttcaactcaccaaatataaagttttttcacgggctatcaaacgcaacacattaatttatttttttaaatgaaaactatttctaaaaagtttttactaaacttccctgatcaaaatttgatatatatattttataaaattttcattaaataattttgaaatcttaataattatttgtttttaatcaataatttatataaaataatgtaaataaactaatataaaattcatagataaaaagattaacaatttaaaatatatagataatttggtcgaacagaaaaaatacgatgatagcataaaaataacaataattaaaaatataacaataaaatattattaatttatggattaaagtgaaaattatttttaaaatatttatagcaaaaaactcatttaaattttttaataatcatcttctttcataaaaaaaacaatttatac

SEQ ID NO: 38010 - DNA, 724 bp, Heterodera glycines
cgccaccacctaacaagtatttaatttcacatctagtctttcgtgtcagttaacttacatgtccaagctttccaaaacaatggttcgcacgtgacaaagctcattttcttggcgtgggggttcagcagtgaatagtacgcgtgccccacttcgtggagcacttaattgattgttcacactcaagttattaacattaagacaagtctcacccgccagccatctgtccggcaatgacaaaattatttccaaggccacgttcgatccgctcaaatatgtcactgtgattgaacataattacaaatgaacagaaaaaagcaatacttctcgtctcgtcaataatgttcaaatcgacagacacttttcggaaatgggcttcattaagtgacagttgaatgatacgcttaatgtctggacacaaattataaaattatcaagcacgcgatgtaccgtatccggtcagagtttgactgagaagccaaataagtcaatgaaaggctatccaaagtcatgtgaagcgactgtaatggaaagaattttggatatgagcagcaactttttttttaatgtattctcttttattgtgcagtacctgaacatttcgtaacggtcactttcaaacgggtttgagagtccgacggcgatttaaaatggatcagcggcgttgatgtctgtccaatttgacgtcgtgccaatcacaaaaatttcgtgcttcgcgtctcgcact

SEQ ID NO: 38011 - DNA, 1036 bp, Heterodera glycines
atcacagtgaaagggacggcgaaaaagccccaacgaacagtgaaaaggcgagcctttacagcaaaagtcaaaaaaaaatcagtttaaacaaaaatctttttttaatttgtataaccttcttattgccagttttttttgaacactaaaaccaaatattgataagcaataaaaaatacctggatagtttcgggttcgatcttcccatagcctaaaaagggtaaaaattaattattccatttttaattgcctcttttttatttgaatatttattttggaaattcaggcaaattttcattttctgaataatttaaatttgtgatcccttccacaattttcaactcttcattttgctgtttcagatcggtgttggttgtcaaagtttgctggaaggacagcggggaaatgccaaagtcaatcaatcgcgatcgaatttcatcagtttttttttgcctttcattttcctttcccatttcccgaaaacttaaaacatgcttttaacatatttctgatcacttttttgctcggaaatgcttttcctctttccatttccaattgaaacatttatccgctcgctcacttcaaatcgaatggatttgttctgtgtgtgtctcctcccatttcacactgacaattgccattaaagacatcccaacatcagcagaaagaagcctcaaattcgcttcccatgggaagcgaagtgatcagaggcaaacggagtcagtgattcgatcgcacgccttcggggggggcagattgagggtggtcggcaggtgatcggatgagatgatgatgatgatgatgaggatgataagttccacttaccccccccccccgccacccgtccaaaagttgggaaccatcttttcaaacttttcacatccatacatatggccaatttcaattgatggcaaagtgaagggaatggacaggtgcgatttgaagagaaaaaaggcacttccccagggcgggcgcttcttctcattttcttataatggttctattttcctgctgatctcattatgtattctcgttgtct

SEQ ID NO: 38012 - DNA, 1196 bp, Heterodera glycines
  misc_feature (10)..(10): n is a, c, g, or t
tgcaaattcntgttttataaataatgtcggtatgcctacattaattgaatttaaataatttttatttatttttaaaaaaatacaaggaaaggaaaaacaaaaatgcataaaaattctttgttttattttataaaattataaaaaatatttcatccaataattcataaaaatgaaatattttctcaaatttactaaacgaatattttttattgattaaaaaggtaaaaaaagaattaataatttctcattattatattatttttaacgacttttaatttttatatgaataaaagaacaaagataaaaaaaattataaaaaaaaaatgtttgaattggaaatgtatgggagaggaaggatggcaagagactcaaaataatctaaattctactcaaaataatgcccatcgaaattaaatataatttatctaaaaagattaattttcaaacagttttatttacaaatttataaaaaaaataaaatttttagtattaattattttattttattaaattaataaatatgataaattattgaacctgaaatgcaaatgaattattaaaaaatcttttagcactttaacaataaaaaattataaaaataatgtaatcaataaatagtaaatgcatcccaaaatttttcaattcttctccatttatttgttttattttttttgataaaaattttagattttaaaaattatttattaaatactgatttttctaaatttttgtttctttgtgaatgaattttgtctttttataccagaaaataagtaaattttaaaatttatataaaaaaattgtcttaatggtttataaaggaagtatatttttgaagaaaaaatgaagaatcagtcaataaaaatcattaaaatttattaattaattctcaaaattaatcttcaatctataaaagaaaaacattggattttgagaaaagatgtaacaataattaaaataaattaagcgttatttaaatatatttaagagttttaattttttggaaaaaaataacatttggaaaagaaaaataactaatttaaacatttattaatgttataatgaatgaataataaatattatataaaattattattattataattattatttaaataaaaaaaacaattttaaacatattaaaaataatgctaagcaggtcaatagaattaaatacaatgatgttaaaaatagca

SEQ ID NO: 38013 - DNA, 754 bp, Heterodera glycines
  misc_feature (536)..(536): n is a, c, g, or t
  misc_feature (670)..(670): n is a, c, g, or t
  misc_feature (692)..(692): n is a, c, g, or t
attgatcgctggcataacatccccgaaagatttgtcgccgatcgacgattttgcatcaaaattgacgttaattctattgcatccatttcaatgccttgtctttatccaaagaaatgagcaaaattgttgtaacagtaagctaacaatcagcattaaatagagaacgagaagaccccaacagattgcttgttgataaaaattatcaccttccgcacggtctttgcaaagctgaatgagaggaggtagaagagaggagactggcgtgttttcgctcaacaatttttgattctttgggagagttgttaaaattgtggttgattttgtagcagaaggcgttgaagtagtaatggaaaaagatttcctttttagaaattctgggaggcgagtagtgatgatagatgattttgtagtcctactcattgtcagtcttcttatgtattcagagtattcagggatttgttcctcggaaacaacaggtaaataaatccgaataaagaataaaattatagaaagctgtttgtaattcatatttattncataagaatttttataaaaatggctccttaaatagtgatatcggtgcttattgatcggttcttgtccaacatcaccagagagtcgcattcacccatcaccactagcattatccctccggcgggcactgcctggntgaatttgatgctcaccgctgntgtcccatttttttatagatcaaacagcgcagcttgatcatcgccgctgttggtcaaattga

SEQ ID NO: 38014 - DNA, 615 bp, Heterodera glycines
tctctccctcccactctctttctctctctccccccctctctccctcccactctctctcccctctctccctcccactctctttctctctctctctcttcatccatctccctttctttttcctctctctccttctctcttttttcattcatctcttcctccctctctctcttcctccccctctctctctccctcccactctctttctctctctctccccctctctccctcccactctctctccccctctctccctcccactctctttctctctctctctctcttcatccatctccctttctttttcctctctctccctctctctgttttcgttcatctcttcctccctctctctcttcctccctctctctctctctctcgtccactctcgctttccgccacacatccccccattgtcgtcgctcatttttgtgatgtactttggtcgtgcaatccgctgaaagtcaagattgtgtttctcgtattttccttccccatcagcgatgcgatgcgtgcagtttggcattgttcaatttaaatgttgtaatgcattaatttgtttgatggtatgcgagtggatgaggagatatttttattgtcgctctttttttatttata

SEQ ID NO: 38015 - DNA, 1082 bp, Heterodera glycines
  misc_feature (30)..(30): n is a, c, g, or t
  misc_feature (57)..(57): n is a, c, g, or t
  misc_feature (84)..(84): n is a, c, g, or t
  misc_feature (103)..(104): n is a, c, g, or t
  misc_feature (148)..(148): n is a, c, g, or t
  misc_feature (150)..(150): n is a, c, g, or t
  misc_feature (156)..(157): n is a, c, g, or t
  misc_feature (217)..(217): n is a, c, g, or t
  misc_feature (239)..(239): n is a, c, g, or t
  misc_feature (249)..(249): n is a, c, g, or t
  misc_feature (272)..(272): n is a, c, g, or t
  misc_feature (277)..(277): n is a, c, g, or t
aaatctaaaattcaaaattttttctccccnttaaattttttcctattcacataaaanatttaaaaatcaactattttaaaaatnactttctttatttttcccnncttataaatatccctttcaatttttcattaaaaaattcatattntntattcnntatcaacaatttatatatttctatcatttttctttttttacaaatttcaaacactttctnttctttttttttcaaatttctnacttttcttntccttttttttttttaatttttnataanaattctcaatttattcttcaacaattaattttttgaggtcaccagtaatgtactacatattatacctaattagaagaatgattcattcattttctgttcattaaggttcatcatccatcttatctcttcttcagcagcatccctttcgcaaatttctgccaaaaatgcaaataatcccccctcccacccctcaattttttccctaatcaattttgccccctccgtctttcattctgccacggcaaatccaccgatcctctctcttttgcataagtattcttacttaactaaccgcaaaaggcgaagttcatatttgttgtgccgtgtttctgttatctttaatgtttggaaaaaaccaacccccccccaggggtgcctcaaaaaaacaaaaataaaaaagcatcaaatcattctatcctttcaatttaatttacatattcactatatttagttaatggatttaaaaccaaatccggatggtaatttcaaccagagcattaggacttttttctaattgatattttaataaatttaaaaaacaatttttttttgtgaggtcgaacgggaagggggggggagggagtgaggcaaaaaaatttttttttgtctcattcaacaatcataagctgcacatttatttgctcaaaagcatacatatactcgttaagctaagcaaataatcacattaaaatttccaatttcaatccatcatatgaaacaagagaaggaatccataaaaacattaaaaaatttccttaaaacatcaaaataaattgaccacatacagtcagtcaaggggataaaa

SEQ ID NO: 38016 - DNA, 1491 bp, Heterodera glycines
tggaattttgaagggagtttttgagaaaaatacccgttttccagaaaaaaatcatacatttataaccctaattatcagggaaaatttttgtgatttttgtctcatccaccagtaattttttatgaaaatttctaaagttgttattgaacatagtattttaatcaaatcatgtttacattcaagaatttacgatcgttgaattaaattttttaaaaaggtagttattatttccattagattataatttcttttctccaaaaaaaataagaataatattagtaaattgtaagttaaatttagcaaacaattcttactgagtaacaattagttatgttaattttatatatatatatatttttattaatctttattgtgatttctcttaaaaaatttgctttattaaatctatttatcatctgttcagattctcatatttgggggcggatcattattcatttttaacaataatttaacctttgtttatttctaataaattgttaattaataattttggtaaatatataaaaagcacataaacatttgttttgctatcttttatgcttttctttatttaaatcaaattcattttttcttcttaattattaataaaaacaaagttatgaatatgattcttttcaagttaatactcccttttttaattcttaaaatccaatttctttcatatccaaaaataatgacaaaattttgtttgtaaagaaataaattcggtacatattttaattcacatgtaaaattacaaagtattatcttaattttcttttttgagaattttttaatttataattttgttttttatttatattttccttataaacatttgacaagtttaatatgaaaatagaacccgaataaataaaataaatttaattatttaatgcattattaaattaattatattatcaaatgaaattatttttgttttgtttattatattcggatgtaacttttaatgagcatttcaaaatatgttatttcttttaataatataattaaatatataaatattgtttataattgttaattaattttaatctgtttttatttaaatctattttcatgtttgtttcttcatggttcctcggaatcataatggctcttggcgctttctctctttaaattttatgaagttaatattatgaataacataaatgattaagactaaagatttctatttttatagtttattctgttttattttttatttattttcatttacttcacaattaataaagggttattttattaacctgatgagaatttttctaaattattatttaattcatttattccaaaaaactatgttaacatattttgtgtgtggtataaaattctgtaaatgttgttattatttgttaaagattttttctttgaaattcacattaataaaaattttattatatttgttttttttttttattttacaaattcataaaacattattatgtcttaatttaagcttttcatttcatt

SEQ ID NO: 38017 - DNA, 781 bp, Heterodera glycines
tctctctccttttcttttcttccctcccccctcctccccttctctgtcgtctcttctcttcatcgctccttttcctcgtctttcttcttatttcctctccatctctcttcctttgattctctcttctccaatgtacatatctaggtttcgtcttttcttctctgagcatctctactcatcttgcgtctcttcttaactcctccccctctctcttccctcccttccctacactcttctatctctcaccccccccccccccctctctcccgtctctccccatttcctgcactctttcccccctctcttttgcagcagtgccaaatttagcttatccgacgcttctcatgcgaattgaacacacaaaatggcagtcggggctaacattacacataagccacagagaacaattatttgaacagcactgatgaaaatgttgccaaaggatacttttttcctttccattttttcatttaaaatttttaaatctcaaatttcaaatttaaatccatctcccaattaaaaaatattcaaattttgcactctcacaaagccaagaaaatgccattttcaaaaatttattcccccgcggggcgttcccttgccaatgcgtcaacagacaaaataatgccacagttcaaaattttgcctaactgctgtcccctacccaattgtgtgaaaatggaaatgacaaaattgcaaatagtggaaatgccgaactttcccatttcccgggcataatgccaaagggtgggaaatttttaaaatgtcaaggggaccattt

SEQ ID NO: 38018 - DNA, 1596 bp, Heterodera glycines
attacaaagtgtgttttcggatcaatcactgatggggctcggctcccctctacccccgggcctttttctcgccatttcttcgtttgttttgctttttgttctgttgctgctctgttccgtcgtccttctcttagcttttcctcccctgatcagttccgggtgcatctttctgaattcgatcagcagcgttctcagcgcattggcccaaaagtctcttttcactgtttctgtttgagtgctgttttggctttggcttttgctattgctctgcttcatcgtccaatcttttccctcctctttttccttcttctttccctccttttctctttccctttcctctttactctttcctcctgtttcgtttttctctttttctttttcctctttttccttttcctcctctttcttcttttcctttttctccgtcgtcctctctccttctccttctgtttctgtgttcgtcatctttgcttcttcgcccccacttttttccacaaaatccgattgcacatttaggccaatgccatcattttttggcatttcctttggctctgattgtttggccatttctgaaataaaagcattttgaaatggtcagttcagaaatttggatcacttatcacagtgatcagtgtgttcgtttccactcactttcttcttttctgatcacatttttcttcgtttgccttccgtccgttgtgccaattcgtcgccgtcgcttcggcaccagcgaaagggcgggcgaaagcattgccaaaggggacgccatcccttcgccgtcgtctctgatttcgtccaccaaattcacaacgttcggtctcatccaaagacccttccgccccttcacaatgtccacgtcgaccattgtcccgcggccgtcgtcccttggcaattcattgatcgtccgctggtcaatcggactgatcggtccgtcctcccaaagggactgaatcggtgccactgatcggcttttcgtttttggcatttcgcccttctcttccccactttgccacatttcttcttcttcctccgtcgaccatcgttgtaattcgttcatttcgcccttttcatacgcttttatttcgttgtcaaatgccaaaaatgtcggacagagaaaaaacattttgaggaggcaaaaaagcataagaagttccatttgcattataaactcagaaaattctgctaaattttgaaaaattatttaaaattcgaattcaaaataaaaaaagaactgaccattcaattcccgaattaattaataataattaattcaaaaaatgaaatcaaattgggaattttgcttttggttcccataaatccgtccgtccctctcggcgtttattccttctgatcggaatggattaataaatgttttccatcggcgatggatcggcggacggagttttgggtttgttcttcgctcgcttttcactgattgatgggcgaattcattcgttcgttcatccgacgaaaattgggtgaagaagaacagaaaagggaataagcagaagaaaaggaagaagcggaggagaaaaagggaaaaggacgagaaaagagaaaagggaggggacgaagaaagaaatgatcgaagatgaa

SEQ ID NO: 38019 - DNA, 902 bp, Heterodera glycines
ccgaaggccccccacgaggccgcgaagcggccgagtgagtaccttgggcgcagaaaaattattaaggaggagggttcattatttatttattttttacaaaattaattcataagtatatttacagaaactgctctgaaacgcaccaaaatttatttacaagttgaataaggcactctgactcttatattatcaaaaagggagatgaataaatattttaaaaatttttaattcctttttaaacatgccaaaaagtttaggcttaactttttttatataacctgatcagaagcgcaccagattttgcaagggcatcaaaaagacaaggaaaagcaccgctatgatgctaacaccagtaactcttaatttaaaaatttttattaatttttaaaacttcactattttaaattttttatagatttttaaatgtttggattttttttggcttaccaaaacttcatcgaacctggttctttctattctctttcaaatcgccccaaatttttttttacagcttaactaggccctattaagcttatttccagaaaatctcgcatgaattctcatttaaaaaattttttaattgctttttaaatgtttgcattttttttggcttaccaaaacttcatcgaacctggttctttctattctctttcaaatcgccccaaattttttttacagcttaactaggccctattaagcttatttccagaaaatctcgcatgaattctcatttttaaattttttatagatttttaaatgtttggattttttttggcttaccaaaacttcatcgaacctggttctttctattctctttcaaatcgcccaaattttttttacagcttaactaggccctattaagcttcagaaaatctcgcatgaattctcatttttaaattttt

SEQ ID NO: 38020 - DNA, 859 bp, Heterodera glycines
aactagagtccggtaaaaaaaaatttccgggagcgggagcgggagttcaaaattttccgggacgggagtcccgaacgggattcccgtaaaaatcccgtccatttttaacgtgagtcccgggctggagcgggagtaattcgaaaatttaattaaaaactcacaaaaatatttttaatgcacaaatttaaaggacaatcaatttattaaattaaaaatatatagaaaaatttataaaggacaaatttgaaataaaaaatcttttttttgagtcaaaaatcagaaaattttttcaaattgcttaaataaattattttttattttaattcgaacaaaacatttattaactttatatttttgaatccctttattaattttacaaaattttttgcggtgtatttcttgaaaaaactttttggtgaccaaggaggaggagggaggccggcggtgccggtaggcgccgccgggaaaaaaattgaaaattttaatacaattcattgttagattctgttcaaaaatgaccaatttttgcaaattgagcaagttttttaagaaaattaaggattttaaagatccggcggtgccgataggcgccgccgggaaatttttttgaaattttggctatatatttaacagattttcaatgaaaaatcattatttttaccaaaaaaatcaattcttaccagtgcatttttactcccgctttttggtaaaatttccgggagcgggagttcaaatttttccgggacgggagtcccgaacgggaatcccgtaaaaatcccgctcccgttaaaaatcccgttcaccgaaaaaagcgggagtcgggagcgggacgcccgtaaaatcccgcggtagatccgat

SEQ ID NO: 38021 - DNA, 1103 bp, Heterodera glycines
  misc_feature (1038)..(1039): n is a, c, g, or t
  misc_feature (1069)..(1070): n is a, c, g, or t
  misc_feature (1084)..(1085): n is a, c, g, or t
caatgatgatggaaattgttgaaaagtttcacttttgtaatgtgaagaaacgaggtcattatcgagatgggtatactgtatgctactagttttgctgtggatagcaattgttatgacaggaattttcttctattttaactctttaattagaaatttatgtaagcttatgcatatatgtagagacgaaaatggacacaacgacgataaatcggattctagcgggaaacacaaagaccagagaactctacttgggatgcttcccttgcgacaaactcccaaacataatcaacaagtacccttcaactttggtggcgaataatgacccatcgaataaggaaggaacgcattggatagcaatgttcatcgttgacgataggaccgtctactatttgatagttttggtaggaaaccgaacagatgtatcagccagtttttacggaattatgaaaaagtgatttcgaataagccagctattcagtcagtctttagtgagaattgcggttattattgcatttattttatttattgtatgtgctcattaggaggaagaaattatgagagtaattttgaaaaagtgacaaaaaagttgataggagaagataatccagatttgtttgtcgtgaattttgttaaaaaaatgataaaaagtatttaaggaatttatcattaactcatttataaaaatggaccgattagacacaataattgcttctcttctgaactgtcccgcacgtaacttgtgcgactgcttaaatcacccggatgagatacaaaaagtagaaaaatacctcaaagggaaaactctacagacaacatacaaaaatcaactagatgaatagaaagattttgagtacggtggaattacaagagaaagtgcccgtaagcaaatggcttacaatggattcaagaatgtgaccgtcgaccagaacttttatgtacgtcaccgcatttgtcgtcgctacgccaataatccttgcgtaattgagaagcacaaaaacggacacgaacgattctaccccacttgagcttttgtaagtnngaacacgtgacaaaaacgatatttatttgnngacaaatttcctannagtcatacctttacttga

SEQ ID NO: 38022 - DNA, 1038 bp, Heterodera glycines
  misc_feature (582)..(582): n is a, c, g, or t
gtatagagccaaactgattaatgtcatttatttctcctcctcgcagattcaaaagcgtatggcgctgaagaagcgttctgctgtccaatttgtgtccaattgccatgtgccgtcgggacgtgatttgctgacggcccgactccaaaaactgctccaagttgatgtgtatgggaaatgtaacaatagaaaatgtgatgacaaatgcgaccaacgagaacggggcgagtctatttggcattcatttgtcaatgtcaggcgtttttaggcattatttttggtgataaatttcaaaccttttttggtgccaggttcaatcctctgcatgcaaatattttttttgcaaattagattgggcgccggacttttcgacagaaatattataaatttcaggaagggacttttcgacagaaaaaactaataagtttcaaatttaggggttgtaaaatcgtaaaatttacccaaaaaataaaaaaattaagtcaaatcaatattgagaccaataatttttaataatcaaaaagaaaataaattaattaattaatttttgagaaaatttttcattcttttatgggagtatttttnaaattttagtgcccgattcttatggaatattttttctgaaaattttcaggaaaaaaacgtataaatcgtataccaagtaataatgatttaacaatgcatattagtatgttaatttaaaagagattagtaaaactgacaaacaatataatttattttaataagattaattgtttttatatttattgtcgaaaatcccattattttttggtttactgtcgaaaagtccttcactgtcgaaatgtcctttgctgtcgaaaagtcgggagccaattagattagcaaaagaatatttttgaacaaaaacactttttctatgaatccataggcgtgctgtcgcgtttataaaaaccgccaactagtcgcgttttataaatccggcaaaatggaaagtcgcgtttataaaaccgccagtcgcgttttataaatccgccaaaatggaaagtcgcgttttataaa

SEQ ID NO: 38023 - DNA, 786 bp, Heterodera glycines
gatggaggatgggaaaataatttgataagacgacggttggtgtccataaagtcgaatttggtgatttcctccggcaggcagtaacgcttgtattcgccgaagcggccggattgagattagtcatcagaagttatactttggcttcattcgccatatttgccgctgcgcaatccaatgcaaattggaagcgctccaaccactcctcaaattcttcggcattttctgttgaaaatgggtgaatgtccggcaaagtgatgttttgtgccggtggagttgcggtggaagtcggcgcgctctgctgcttgatcgcttgcgtcaatttttccaaaatatcggcgagcgttttgtccattgatgatttggaggtagaaatttgacgaataaactgcacacggcagaaccgcacacaagattagtgattggttttttgaagatttctgcgaaatccaaaaatcaacacgagatttttgaatttccacaattcgaacaatttcaacacgagaaatgttcgaagtgaagtcctgaagaacgggcgtcgccaattgagccggttaattgctcaaacaattatttgtggaagtcgaacaccaaataaatttattaacacaaatggaaaataaataacaaataaatatttgtcggagggacggagcaaattggggagcaccaaaaataggaaggaaaataacacaatgaatgaggatggacgaagggaagggcatgaatgaatggggaaaaaatcaataaggggtcaaagagcccaagagagggaattacaaatatttg

SEQ ID NO: 38024 - DNA, 1360 bp, Heterodera glycines
tttaagccgaatttgtcaaatggttctctccccgatggaattaaagaatgaagaaaaggggattggaaacatagaacaaaaacgacgactatttatttgtcaattaagaatggaaaaattaaagcaatatttttattcgataaaaatttctttaatggctaattaaaaaacatttttaatttttaaatttttcaataaattaatcccattttgtcattttagagcccttgaagaagaaaattctccatcaccaccaacaaaatattagacagtattacgaaccttactagtacagtacccgccgaatacagaatgtcaatattgtccatgactggagtgggacacagtcatttggctttcacagttggccgtttgcctccccttttaaaatggcttttttataaagttcgccaaaaagccgagccaaaatggccgcgccaaaagtatggcactttttttgaaatattttaaagtgttcattgaacattaattgacaaattaattactgtttaaagaatcagcgacaatttctacacggcacgaacatttgacattctgtatttaatgctctaataaaattgtctttcgtctatttggtgagaaagcggagagtgattttgattaacacgacagatgaggattatagactcgttcgcccctcctcccccacctcccccaccttcattctggcattttctcattcatttaatttttttgcatcaattattgggcatcaattactcaaaaattaaattaaacgacaaaataattaatttttttgaataatttattttcacgtatctttaagcataccaaaaaaaagttagtacaaaattggggttgtttatcagtgaatttatctctattatatttactactttggatcatttttgaactgaaaaaccctaattacttaaaaccgaaaaatcaaacatgggtgaggcgcaaacaactcctattaatctctttggtttttgaaaaagcattcatttattatacaatatttcttcaatcctgtgttgtcaaatggcttttccatatttagtcaatgtcccattaatagaggtatgttttgtacatatttattctcatctccatttaagctcactttccactttccttttcaattgtcccattttccgacttgtcggcaaaccgccccccccctcccccccaaaattgcttaattgtccccatggatcacctattggtaaagcatcgttctctcccagccgaactcttcgacgaaatgtcccgtttcgttcccggccttttttgccgtaaaactttgagcaaaacaaactcaatattttaccttttgtatcgattcacaaaacgcgcaaaacggtgaaaatcgaag

SEQ ID NO: 38025 - DNA, 417 bp, Heterodera glycines
atcatttattataaaaaataatacacgaaaaaatgaacttttaaatcacggatccataacacagttatttgaaattcccctcagaaattcaataatttttgggcatcaaaattttcaataatattcaaaattcgcttgtccgccttctggaacttctttttcttctttggtggttcttcgccattttcttgtcccacgacatcgctcagcgcagtaattgcagcagtcaaatgctgaattggcacaaatgcgagcgcggcgatcatacgagcagtttctgcgaaagcgatgacacttcgatagcgctaaatgggatggaatttctttcttttaaaaacagaaatttacattttgaagaccttccgaaatgacgcgcttgtgcagatctgcgcactacgtgaaaaagacatcctctaa

SEQ ID NO: 38026 - DNA, 883 bp, Heterodera glycines
tggaacataaaaacatatcgtacacatttcgtgggtttgtcacatattttggcatttttgagaaaaatttgtaataaaaaatacaagaaaattgaaaaatacaccccctaaaaatcaactttcttgcttgccatttcctaaagtttttcaaaatttatctatttatttcgaatgcgaaaatagccaaatcgagttcttaattgtgtcattagatttcaaagttctctactgggaacttttaatttataaaaataatttatcagaaaaaaagaccaatattaccccaaacacttcgaaatgtatttgattctcaattgtgcggacgaaaatgataaaaatgagattttttggaatttttatgtaaaaatacacttgatttttccaatttttaacacatattttagcacatatttcaggatttttagcacataaaaatccgggctctagtgattatccttttatttattatttttcatgacgattgttttgcattattttccccatttgaacattttgttgttgtcatttattattagtagggttataagttgtatgcactaaaaaatgccaaatatgcgcataaaataggcactaaaaatcccccaaatatgccctaaaaacccgaaaaatgcccaaatatgcactaaaatatgccttaaaaaactgcaaaaatggcttttagccctcaaaaaatgccaaaaattgtgtataaattaagaattgacttttaaaacaccaaaacaagggctaagaagcatttttagacaattgcaaaaatattgaaatttccaaatttataaattttattatatgataaaacaaaattacatttttatatacataattttttttccaaaaaattcttacaaaaatttaaaatttt

SEQ ID NO: 38027 - DNA, 898 bp, Heterodera glycines
gggggactgccccgaaaacaaaaaaatcgatttttcaagtgagtgtccgtttggggtactcaaacaattatggggagcaaaaatccaacgcagaattaaagtacagactatagggaagctattccggaaggattcggtctccccataaatctgggcgcatcggttcggggagactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacatttatggggagcaaaaatccaacgcagaattaaagtacagactatagggaagctattcccgaaggattcggtctccccataaatctgggcgcatcggttcggggggactgccccgaaaacaaaaaaatcgattttttcaagtgtccgtttggggtactcaaacatttatggggagcaaaaatccaacgcagaattaaagtacagactatagggaagctattcccgaaggattcggtctccccataaatctgggcgcatcggttcggggggactgccccgaaaacccaaaaaaaaattttttggataaaaattatttaaatgaactgactagataatatttaaaataggttatttctcttcctttcagtatccctgcaaagtttggtgcgcttctgatcagtttctgaaaaaaaagttaagcctaaactttttggcctgtttaaaaaggaattaaaaatttttaaagattttattcatctccctttttgatagaaaaagcatcag

SEQ ID NO: 38028 - DNA, 618 bp, Heterodera glycines
aatttcacaactttttacataattttccatctcattccttcaattcggccaccatacaatgcctcttgctcttgccttacttcgcacaataccaaaatgagctcgatgaatcaatttcaaaacttggctttgcattccttgcggaattactatttgcattcccggccttttcctgattaaatttccctccaaaaataagtttgctctttctctgaaatacgaatttaaattttcgttcactggttccgcccaattatccttcaccttactaataacttgggccaaaattgggtccgctaaagtctccttttctaacatttgtttgtcaacttttcgattttcgtcaattgttaataaaaaaggcacatcttccttactcttttcctctacttggtcccattttatcggaactctcgataaagcgtccgcgattttggtggcctttccttccacatagatcactttaaggtccaattcttggaaaaccattaaccaacgaataattttaagaattgtgctaacttttgaaaacagaaaagtgagcggaccaagatccggtaaaattggtaattccgctccataaataattggcctaaaattctgcacagcatgcactat

SEQ ID NO: 38029 - DNA, 704 bp, Heterodera glycines
cctccgcttttatggtttaattccaaaaagaggtcactctcctaggttcgacaaccgttgaccgaccacaaccgtcctacttatattttcaatttgcaacaacttttgaaagcagattttcccattataacaaacatacaaaactcttaagcttcgtttgtctgcgattgttaaatcgcaattcgaaatgtccaatttcgatctgacgaggaattgaaattattttattaatcacttaagtataaataggaaaaatagttggacctctcatctgctgctgctggtgggcacatttcaaattaaatcatcaaattaagcttgcaaacactttttccgacgctcaatttcgttgatgaaggaatacaattgcaagaacgatgaacaatgcaatgccataaaaggtgaattatgaaagaagacaactcttaaaaaggaaatttcattttttaaaataattattttttaattttagatcaaaaatgtaagcgatgccgactgaaacggtgcctttcagtcggaatgaatccgcgcggcgtttgcactaacacaaattgtggcaatgatatactggcatttgtagaaacgattaacagcttgacaatgaaagcgcaagctgcataaactccaatcgacaaacaaatgtccaaattggcatgaattggcactggcaccgaacatggcgcaacagtggcccgtcaaaatgg

SEQ ID NO: 38030 - DNA, 926 bp, Heterodera glycines
  misc_feature (136)..(136): n is a, c, g, or t
aaattcgctccccaatcgccccagccaatcccattctttcattcacagagtcattcagatgggatttggatttggatttccgcccatgagttggtgatggtggtgtaggagttaagcgatgaaggctcccccaccnccatccaatcgctaaatcacccaccgattttttcgtccaagaaaatttggcggtcggccccgcagggcaggggcggtccgccgccgcgacgccgttgatgcgatttgcgaccgattaatgctccctctgccgccccatccccgctaaatcgctgggcccgcccgcctggagccgcagccacttcattcgcgccatctcagtccctttattccccccccccgacccgcccgcccaaatactcttttatgcctgccgcccactgtcccgcgcccacaattaccgtatgcattaggccataaagttttgaaactacgaaagactctttcgttttgctaatacccgaactttatggtttctgctttttttaatctgatttttgtcctaaattttacatttaatttataccaatttatgaatggattagtgcacagttgagctccgtttcatatgaatagtatgacacatatcgactttaccaaaaacaatccaacaaattttatttatttttccattttatttaattttaaggtattttaaaatttaaaactgcacttattgcgtcgaattttaaattttttttattttaaaattttcaaaacctcttccaaattttatagtaaagttttctcaatcggcttttcattcataaaaccataaaatcccggatggcttagcttagagctgcttaactaattggaaaaggctttaatcaaaaaaaaaattaaaaattccgagcaaacttgatcttgacaagattatatcttatggttggagaggggagggggggggg

SEQ ID NO: 38031 - DNA, 1070 bp, Heterodera glycines
aattcgttaagttccaaaaaagttataaccaataatctttagagaacccttgttttttaagttctcctggccataacttttgtgaaagtcaacaaaaaattttgaaattttgaagtctaatagagaacacttagggctatcgaaaggtatcaaggattaaaaatttggacattcttgagcaaagttataaataatttttcgtaaaaaattttccatttaaggcttttttaagtaattaccaggcacccaccccacatgtttccacaatgataccctgattgataccgtacccgattttatctgctagcactgcgtgtactgtagtaaaacaattatacctacgctatgaaccataagcagcatcacttacccccctttgctgatgagtgtgtggcaccacgaaaattttcgaaaaaaactttttatatgcttctaaatttttttcccaattttttttttcattttgaatttcgctttttctattttttctctcttttttgtcttcattttataattttacattttctattgttggggagacaaagtcaataaattaatggggcaaatgattaattatttttaattggtcattaggaaaagcatttaaaaaatcaaaattacatttaataatgaaaaaattaagtaaaaattacaaattaattaattattaattaattaattaaaatttaattaataatgcttttatagctccgccaataacgcgtcggccatccacatttgcacatacaacaccagcagcagcacggttttcagttgcgccaaacgacccaacattgtacgcagtaaggcccacaacgccgatgaatgggctgggcttggcaagcagtacaccaacggtatggtattaggggtgcactacgttctccgcccccggcgtttcccccctggatcagaaatgagaaaaaattttcggtatttttttttttggaaaaattttgcataaacttagtaatttatcataaaatttttaaaagatttttcttggaatttcttacaaaaaaaactttcaaagagatttcttgaaaaatttccgaagtttgtaatttaag

SEQ ID NO: 38032 - DNA, 932 bp, Heterodera glycines
tttaaattttttatagatttttaaatggtttggatttttttccggcttaccaaaacttcatcgaacctggttctttctattctctttcaaatcgccccaaattttttttacagcttaactaggccctattaagcttcagaaaatctcgcatgaattctcatttttaaattttttatagatttttaaatgtttggattttttttggcttaccaaaacttcatcgaacctggttctttctattctctttcaaatcgccccaaattttttttacagcttaacaaggccctattaagcttatttccagaaaatctcgcatgaattctcatttttaaattttttatagatttttaaatgtttggattttttttggcttaccaaaacttcatcgaacctggttctttctattctctttcaaatcgccccaaatttttttttacagcttaactaggccctattaagcttatttccagaaaatctcgcatgaattctcatttaaaaaattttttaattgctttttaaatatgccaaaaaatgtaggcttaacttttttagtgaaaattcgatcactcatattttttgctaattgagcagaagcgtaccaaactttgcagggatactccccggtaaaggactaacttacactgaaatgagcgccgagctagctggctcaaaaaaattttcgaaaatctgagtctttcgtttttatttattttttgcaaaattaattcttaaatattttttcagaaagggttctgaaacgcaccaaattttatttacatgttagtttaggcactctgatgctttttctatcaaaaagggagatgaataaaatttttaaaaatttttaattcctttttaaacaggccaaaaagtttaggcttaactttttagtgaaaattcaatcactcatttttcgagtagtgatcagaagc

SEQ ID NO: 38033 - DNA, 860 bp, Heterodera glycines
cctggacccggatttccaaattgacctggatttcctggacaaaaatccaggaaaatccaggttgccgaaaaatagcctggacctggacccaggaaaaatccaggcctgtcctctcgtcgcatttcaataaaatattttgaaaataattttgatttgaattttaagctttgacatttttaataaaaagtggcaacatcattttttctgtgcgtttttttaaagaattttgggcaaaccgagggttcggcgttgcccgggaaaatttttgaaaattataatgtaatttgctaacatattttttcgagttttgaaaaccggttcaaaaatcaggaaaaaattacaaataagaaaaattggttttcattaaataaattttcagtttacaagaatggcgaagagtgggttgtcctagtgcgatttgtctgcaacaattgtcgattatgattagggctgtgaattttagtgaagaaaaacttgcacaaatcgccaagcgtaattttctaactcagctcattgttttcagaagagtttgaaattttgcattaaaatactttggtataaggtctaggcaccttgccaaattttagaattttttatgcactcagagatttttaagaaaatccgctttttccagcctgaacgccaactttgtggtcaagttttgaaaacaggcggttttttgtaaaaaagttttaccaatatggaaaattctgaaattttgcagggtggtaggactcatgttaaagtatttttatgcaaaatttcaagctattttgataattcgaaccaaattaccaaaatcaacttgagcaaaattcaagtttttattcactagaaatcgccagcccctaattatgatt

SEQ ID NO: 38034 - DNA, 932 bp, Heterodera glycines
aacgaaaaaaacttgccgaaaaaatggctttctttttttctcctggggatttgcccgcaaacttgttcccacattttcccttctttagtcgggctcttccaaacactcacacgatatttgaaatgctaacgaaaaaaattctgcccgaaaaattgcctatctcttttttctcctggggatttgcccgcaaacttggtaccaacattttccttctctagtctggctctaccaaacactcacacgatatttgaaatgctaacgaaaaaaattcttgcccaaaaaatggctatctcttttttctcctggggatttgaccgcaaacttggtaccaacattttccttctctagtctggctctaccaaacactcacacgatatttgaaatgctaacgaaaaaaattcttgcccaaaaaatggctatctcttttttctcctggggatttgaccgcaaacttggtaccaacatttgccttctctagtctggctctaccaaacactcacacgatatttgaaatgctaacgaaaaaaattcttgccgaaaaaatggctatctcttttttctcctggggatttgaccgcaaacttggtaccaacattttccttctctagtctggctctaccaaacactcacacgatatttgaaatgctaacgaaaaaaattcttgccgaaaaaatggctatctcttttttctcttggggatttgaccgcaaacttggtaccaacatttgccttctctagtctggctctaccaaacactcacacgatatttgaaatgctaacgaaaaaaattcttgccgaaaaaatggctatctcttttttctcctggggatttgaccgcaaacttggtaccaacatttgccttctctagtctggctctaccaaacactcacacgatatttgaaatgctaacgaaaaaaattcttgccgaaaaa

SEQ ID NO: 38035 - DNA, 866 bp, Heterodera glycines
gattccaatttcaattggttctcttttgcttctcgtccttcttgtgacatctatcattcatttatttatccccaaattcgtcccaagggcacataatcagcaaatcccccggggcgatgaacagctgatggcaaagttcccggattatgggccggaaataagccaaagattcgggtcgatatggccacaaaataagagaatataaaacgaaaatcattaatattttattaaagtaaatttaaacaaaagtatagcatgaaaaaacgaatattttatttagggggagcaggcacagagaaaattaaacattaaaatttaaattaacaatttttaaattattgggtaatgtttttttaaaacaggtttttatgtatttaatgtttttgattatgcattaatttgatattctcaaaattcaaataaaattttatgccaatccgatgtgttaataaatcaaaataaaacattcaaagtgacaaatataattttaagtgttaaattcttgagtgggaagaaattctcgaaacattcaatccataaaataggagggaagagaaacagaatagggcaaagagctaggaagttcattaagtggatactgtgcggtttggttgtgtattacggtagttgcttgcgttgaaatcatacggaattcatttggaaaaactttcacaactcataattttaaaatattttatataatgaaacaaatattttttggtcatataaaattgggacaaattgcctaaattttgaattaaaaaaggcacaaattgctaagtttttgaatttaagtgtataaattcaatgaaatgacaaagtgtcccaaaaatctgcaaatgactgtagttatacttcgataaatt

SEQ ID NO: 38036 - DNA, 910 bp, Heterodera glycines
taaataaacacccagcttgtctacattttagtctaatcacaaaaaaactttattttttaaaaaatcaaaaaaataatttttaagaaataacattaatcaatgagtctataaaaagaatcaataaaatcattggttaatcacatatatatcatctatctatctatcaagtaaaagagaaaaaaaattgaagaatttttatatcgaaatattttaaatgcacataaatatttttgttccatttttatttctatttgttatttttaatggttgtcaggcaaaagaactgaaaatttgtgtcaaatatgagaaaacagtggcaatgcgcgaaacgcaaattaatttaactgcaattagagtgaacagcaaaaatgaataccgaaatattaaagaaaatataaaaattggtgaatgttttggcatttccatccctcagcaggaaaataataaaacgcaaaaaatcacttttgaatttacaatttatgtcaaaccattggaaaatgagtaccaaccgccggcggatgaccacgacgaaaacccatccgatgaggggccgtatgaaaaccgaattttagacatcaaaatggacgacattcggacaatggtccgacgcaacaactttgtgatccatgagcctaatccgtcaatggtgtacacgttcaatttgggcacaatcgatccgccagggtttttgtggaaacgcaaaatttttgttttgccggagaacgatttgggcaattaccatgcttttttgtatgccgttgcctacaaaaatcaacggactcaggacaatttgaatagtaaaagttgcatgaaactgttgagatatgcgccatttgtgaaaattgacaaagaaattgcgcccaccttgaaacggatgacaaaagggtggaaataaattttaaaatctctg

SEQ ID NO: 38037 - DNA, 1157 bp, Heterodera glycines
  misc_feature (75)..(75): n is a, c, g, or t
  misc_feature (79)..(79): n is a, c, g, or t
  misc_feature (1033)..(1033): n is a, c, g, or t
  misc_feature (1043)..(1043): n is a, c, g, or t
  misc_feature (1126)..(1126): n is a, c, g, or t
cggggacctctagagtctcaacagaagttttccaaaaaaaattgtcagctatctttttaaattttatgaggaaanaaanatacggggccacttctttccattaattattcgtatcctgagaaaaattccgaacttttttttttggaaaataatctctgcccaattgtggtcttaatctgggcctaattgtcatgaagatatctttaaaaaaaatttaaaaagcttatgtgaactgattatgatatgattgggatgtccaattgtccatttctaggaatgccgtgccgattgcaacccaaacatttggttcggcaacttgttgctctttcttccaattgtcgctgttcgtgcgcaaattttaaaacataatttatgaaataataaaatatgcttctggcttggtcccgccgtaaattttctgatcaaaatgcctaagagatgatgattcgggagttcaaaaaacttgtttttgttttatgtttcagacctcccagtccaagttaaaaaaagacgcatgtgcgttaattaactgccctaatgagatgatctggtctgatcacaaggattgatcggcttgattttgcaagacccgaactgatcacttttttcttgcttggggactcttgtcaagatttctatgatttaatcatttaatcattttttgccacacaaatttcagtcgttggccaatgcgatgtgtgagaatttgcgctttgcacaaacattcagcttgctgggcggcattccgctgctcacctcactgttcggttgctttccggtcgagccgttcaccgcgtccgaatcggaaatggcggcgctcggcgacgcgtcaaatgccgataaagatgacgccggcgacaacaacaatttaaacaatttatgcgcgtctcatcagcgaaaggcatcgaccgaacgcggcacacaaacagacgccgggcatctggcaattttgcacgatcaattagtgagtagtactgctcaagcgtctcgctttcgagcaccgggcagggacggtcccaggatttcggcttgnggggtgaggngtgccgccccccggacgacgattttttttcggccaatttttttttgcagcgcgttttttttaaattttgaggaacaggagggngtaggcgggaaaatttttggaaattttacca

SEQ ID NO: 38038 - DNA, 1387 bp, Heterodera glycines
  misc_feature (1240)..(1240): n is a, c, g, or t
  misc_feature (1260)..(1260): n is a, c, g, or t
  misc_feature (1268)..(1268): n is a, c, g, or t
  misc_feature (1294)..(1294): n is a, c, g, or t
atgaataaaaatctaaaaatttttaattgctttttaaatatgcgaaaaattttaggcttaactttttttttataaactggtcagaagcgaaccagattttgcgagagcatcaaaaagacaaggaaaagcactgctatgatgctaactccagtaattctgaatttaaaattttttattaatttttaaagcttcactattttatttttttagcaaaattaattcataaatattttttcacaaactgctctgaaacgcaccaaattttatttacaagttattttaggcactcagatgctttcactatcaaaaagggagatgaataaaaaatctaaaaatttttaattgctttttaaatatgcgaaaaattttaggcttaactttttttttataaactgatcagaagcgaaccagattttgcgagggcatcaaaaagacaaggaaaagcactgctatgatgctaactccagtaattctgaatttaaaattttttattaatttttaaagcttcactattttatttttttagcaaaattaattcataaatattttttcacaaactgctctgaaacgcaccaaattttatttacaagttattttaggcactcagatgctttcactatcaaaaagggagatgaataaaaatctaaaaatttttaataattgtttgagtaccccaaacggacacttgaaaaaatcgatttttttgttttcgggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgagccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgagccgatgcgcccagatttatggggagaccgaatccttccggaatagcttccctatagcctgtactttaattctgcgttggatttttgctcctcataattgtttgagtaccccaaacggacacttgaaaaaatcgatttttttgttttcggggcagtccccccgaaccgatgcgcccagatttatgnggagaccgaatccttccggnatagcttncctatagcctgtactttaattctgcngtggatttttgctccccataattgtttgagtaccccaacggacacttgaaaaatcgattttttgttttcggggcagtccccccgaacgatgcg

SEQ ID NO: 38039 - DNA, 899 bp, Heterodera glycines
attttaaaaattttttaattgctttttaatatgccaaaaaatgtaggcttaacttttttagtgaaaattcgatcactcatattttttgctaattgagcagaagcgtaccaaactttgcagggatactccccggtaaaggactaacttacactgaaatgagcgccgagctagctggctcaaaaaaattttcgaaaatctgagtctttcgtttttatttattttttgcaaaattaattcttaaatattttttcagaaagggttctgaaacgcaccaaattttatttacatgttagtttaggcactctgatgctttttctatcaaaaagggagatgaataaaatttttaaaaatttttaattcctttttaaacaggccaaaaagtttaggcttaactttttagtgaaaattcgatcacttatattttttgctaattgagcagaagcgtaccaaactttgcagggatactccccggtaaaggactaacttacactgaaatgagcgccgagctagctggctcaaaaaaattttcgaaaatctgagtctttcgtttttatttattttttgcaaaattaattcttaaatattttttcagaaagggttctgaaacgcaccaaattttatttacatgttagtttaggcactctgatgctttttctatcaaaaagggagatgaataaaatttttaaaaatttttaattcctttttaaacaggccaaaaagtttaggcttaactttttagtgaaaattcgatcactcatattttttgctaattgagcagaagcgtaccaaactttgcagggatactccccggtataggactaacttacactgaaatgagcgccgagctagctggctcaaaaaattttcgaaatctgagtctttcgttttatttatttttt

SEQ ID NO: 38040 - DNA, 1052 bp, Heterodera glycines
ggacgggcggcggccctttttgccgatctgtccgataaaatgtgcgttttgggccaggaaagcgctcaattctcggaccattcattttccatccttccgggatttttcaaaaatccctccaaaatccgctttagtttccaaaaatgtttcgtcatctacttcttttctcaattccttcccattttttgtttgtacgttctgtgtcaagaagaagacacaaatgtgccaatgcgcatttaaaatccaattttttgaaaatctcaatgtcttaattaattctttaatttgctgcatcccattaattattcaatggacaatctttaagtattaaaattcgccagtttgtccaccctaatttctgctgttctgtccccgggttgaccgcaacaaggagtgcataaaatcctccagtgccgtaaaatgcgatattatgcaccttcttattgcgcttagccggggacgaaaaggacaaaaaaaatggacatcgtcagaaatttcggcatttaaatatctgtatgtacaatacgttttgacagtttattattattttttatttgtaaaaattggcaaaatacaaattaaaaggcacattttaaaatgtgttgtgtacaaagatgggaggattacaaggtgaaaaataataaatttacaaaaaataaataaaatttaaaagtaacaatatgtataggtatttgggaattaaattatttttagaaaattcctggattattttatgcattattattttttattttttgctgtctcggatgatttacagtaagtcacgcgtgttggcgatgtgcacaaatgaaattgtgtgcggaaatggcgctgaaaccggccaacacaatgccagccgagtcggacagcgcaacaaatgccatggcgaactcgcggttcggcttggacacctgggcactttgtgtatagtgaatgaatgacccactttttgatttatattatctcatatgccagccactatttggcattggtggacaattattctttcttttttcttacttttcagttaccgagaattggtcaggcgacga

SEQ ID NO: 38041 - DNA, 597 bp, Heterodera glycines
ttgaagaatttgcattcgctagtcactttatatatttttgatttttgttgtgttgcgtgtactgctccaaaaacagcaaaagttcaacaaaaaagtgggaaaatgttcttcgccatttatataaatgtttaagaaagagtttattacaacggcaccagggttgttccgggttacccgaaacccgatacccgaaacccggcctttttctcgacccgaaacccgacccgatgattttgggacgggtttcgggtcgaaataagcactggtaagaaaggggtcggtgtgaaaattaggtggataaggaaattgtgaattttttttgaaacgattgtgttcaatggaatcgaaaattttgtatttgtttttgttcattattagggatgtcaattttatgtaaatattgtacatatttttttcctggcttctccatgctctaaatagtaggaaaaactttcttttttatgtttgcaaacaaaaatcgggacttttatttacatatcttaacctatctcggggttttatatatatttgagacatgttttggactttatacttcatttttatgatttaatttttaaataatttgctgggtttttt

SEQ ID NO: 38042 - DNA, 496 bp, Heterodera glycines
tttttcttgaaaatttctaagtttgaaaattttttttaatttattcccggctgtgtttcggcggctgtgttttgtcctgttccgctccccggttataggtatgaaagtccccaaaattcgttcaaaaaatcgccgttttccaccccccccccccctcccatttcccctgcctctctttggcgttcgctttccgtccccccgaggacgccgccccgctgctgcgcgttcacaaaatcggtcacactctccgcgtcgatgggctccacgtgggcaattttcagaatggcacccaccgccttcttgacgacgccttcaaaaaatgatcaataaaattaaaataatgacgggaccaaaaaaattatcaacaagaagattgactctaagggggggggggggaagaggtattattttataattttagaaatatttgttttttaaataaaaatatagtcttttttaaaatttatttactaggaaaaagcctcacaattgaaag

SEQ ID NO: 38043 - DNA, 1032 bp, Heterodera glycines
  misc_feature (892)..(893): n is a, c, g, or t
acattttaaatctttgccttgcagatttacagtttctttaaattaatccaggccatccattcttttcttatcaagaaatttgaaaatagagtgctttacaaggaaaagattaggataacttcactcaaaatttgaagatttttagctttttaaaatggcagctatttattctttgccattttcattttcccttttctttaattcaccatttctctctttttccaatttttcgcttgcacaattttcatcatcttctttacgttctttccattaaattacataaaatcaatcgaaacacgcgaagaaaaatgaacggacggaattaattcaaaaaggcatagaattcgttaatggacacaaaatttgtgcatttcttttcatcgatttgatattatttaatttttactgaaaacattaagtcgaaaaatagaaatacctgcattctgcttttattttgattttaatgcccattttcaaactggatcttttatttaccatagcagtcgttgttatagaaatagttgttgcagtgcaaacattttttgaagtagccttgttgggcttcgcagggatagtcgacgcccacctcacggcacccgtgacatagtgaagagcattttgaagagtgttcaaatttgtggctgtaggcagattcacaggagatgcaatagtaacgtttgttgaaaaattttgaaagagttttgatgccgtcaaagtggttgttgttgtggtagagaagaatggggaattggtaatcggtgatatcggatttggtgattgggcgcatctgataatcattaaaaataaatattttgtactcaccgggatatttgacgttccataacccttgcacttgatgtatataaacttccgcgtcgtactccgtctctgnntgtagggatcccgcctcggcgaagcagttgctggcgctttttgcgaaaaccgttggtttgggtttgttgttaatcccacgccagttatcacgcgtgataattcctcgtttatacaaagagtagtagcgcatcagttcca

SEQ ID NO: 38044 - DNA, 866 bp, Heterodera glycines
acggatttatggaaatctaagtgacaataaatgtcccttccattttttcgttaaaatttttcaatggtattaggggtaatatgtttgacaatttgtgtccgatggccacccaccgtctcaactttgcgtagatggccagcccaatcagtgccgccatggaacagtgcggaatggtcggagtaaagcgcacgtcgacgaaagggtcggtcgggtcggcgctgacttggatcagttcctcctggagaacagaggaaaagtaaaggggggggggggcaattggtttcaatggaaatggatataaatttcaaaaaatgcggggactaaacggccgtgttaataccaagccgaaaaaacgggagcagttcgttccccctctccaatatcgtgtcgttcgccccgaataaattttaatatttttttcgaattttataataatttactaattttccaaaaattttcccaaaaatcctaaaattaagtcaaaaaaaaaaaacacggaatttctaactgtgccccttccccacttggacgacgttcagctgttccaacgtgtacggatgctcggggtcgttaatgtcgcggatgtgttcgaagatttcggtggcatcgatgggctccttcgtgccgtcgtccaacgccgtggccgcttccgccgccaacgcacggcgagctttggtcgcgtaaataactgaacaaaaaagggcaaatccattgacggaatgaaatgcgaaagaattaataataattaaagagtaagtgcaaccaattaattaaccattaaaaaaataacccgaagtgataactaatgaaattcattatttatcaggatacccggcgcggcgttatcgagtcccattttgcgtcaa

SEQ ID NO: 38045 - DNA, 615 bp, Heterodera glycines
  misc_feature (53)..(53): n is a, c, g, or t
  misc_feature (504)..(504): n is a, c, g, or t
catcaaaattaaaaaacgggcgcgaagcgcccgtcctctttctaagaagcggncgaattccctcaaaaaaaagacgggcccttagcgcccttcctgaggccgcgaagcggccgaatggcccccaaaaaattaaaaaacgggggcgaagcgcccgttctgaggctgcgatgaattgctaaattacatcactttctagcgacgcgatttcatgaaaattatttttgctcctaaattagccaaaatgcatttttatggcataatttgaggtgctgaaacgtatatacgctttattttgcgtttcagactttttggaaggtggttacaaatttttgaaaaatcgtcactatttgggccccgggaaatccagtgaaatttcgaaaattcataactctttcgtttttgatcaaatttagtggaataaggtttgaaaaatagcaaaaaattaggtgaattttatgagatttgtttggaatttctatcttccaaaataaaaaagttattctnaaaattctggaaattttcgatttttcagaaaaaaattcagaactcggttcccgtaaggtggtttttgaattttaaatactgaaaaaatccgcaattttttgctctatttta

SEQ ID NO: 38046 - DNA, 1232 bp, Heterodera glycines
atgcacgaaatactttatcttgccttctgaatcgatttttctgagagattaagcacaacaaattgagatcgatcatttctcaaatacaattaattattcattttcgtacacttaatcagacgacatttttgttgctttgatccgcttcttcttctccttctttttcttccgctggtggcgccaatggcctaaaattaattaaatattttatttttcgataaaatttaaatgctgttgctgctcacccaatggatttatcgaaactccacagatcaaatctgacattgttcaaattggcactcggattttcgcggttttcccacttaactggcgccgtcgccgtctccccaattgggcaccgttgcaacagccaattatacacatttaagtcgaattcgtcgatctcctgtttcagtgtcagcttttctttcgtcacttcgttatccaattcaaatggttcaattgacgtcggttccacccaaaaataaagttgaattttgtaactgacagaagtggtggcatggcgaaatgtctaaacacaaaaattggtaaaataaaaacaatttgacgaaaattctggcgagacgacctctttgaagctgttgacccattcgaaatttggtggactcacataagcacggaaacgtaattgctttggttgtccattttttgtcggagtgtgtaaccatttggccaaagcttggccagcagttgcattgggtccatgtcagcaattccttctgggcacagatgaccggaattgatcgaatgcaattcatcaagatcagtgagaatcgttggcgaagtgcgacgacgcaaattgtccaaatgatcgccatcgtcaaagcccaaacggtgaatgtttgtcgcaaaaataggccaaatttcgcgggtaaaaacatcccaaatgagcttgacgtcggtcatatataaaggcacaaacaaattccggcatcggaaaatccatccaatagaccaatagttttgcttttggtcctttgtccttttcaattctgatacgtctccaaattgtgaattccgtttttccatcaaaatgcgtgtcaccaaaacatcgaaacggtcggaaatttcttaccgtcgattcatttttgtggctcaattttccctttttccaattgattggtgtgtcaaaaaagagctaaggcaaaactctgttgttatgtaacttaaaaagagagagttggaaaaatgagagagcaaaaagaacgcaa

SEQ ID NO: 38047 - DNA, 944 bp, Heterodera glycines
attccgatttcctaatctaaatttgaacaaaaaatcttttacttgaaaattcaaaatttcgatttttattcgagttcgggttagggattagaaattagtcaaaatacatgtcagattcgtgattagcgacctttaaaaccccggataaaaaattatcatggttttttatcttaaaaaattttgcaaaacaaaatggtccccccttttgtttcataagtggtaacttttacagtagcgccacttttttgaaccttaacaaaattttaaaaattttgcaggctaatagaggacacttagggctatggaatgataccaaaattgttggatttggttgtcaaacgaaaaagaccccgacccttgtcttttcctaagcttactgttttgtggcacattttttttgttcgctgttgatcgtgttcgtcttgatatttcagattttatctgtgaataaatttgcggacgaattatcgttgaaaacactgaacatactttgtcttctctccgttgagaatttccagaaagcgacatttaaacgaatttaaattgaattttctattaacagttctagcaaaaattcattttattgtcaagatttttgaatgtttagcgatgtcggtaggctgtgctgacaagtttcttaaatctaccaaaatggagttgggtaaaatactatagatgctatcacatattttctgaatgcacctctctgagctttcttgtatttataaattcccttgataccaagaatgtatgggcatttgtttaaaaatttattttttcaaattttctgttttaagaataaaaaggattttaatggaatttattcaaaaacattggcattacctatatgtatcacacctattttgtaaaataaaatgcgcacatacagtataaaaaataatagagatcgggaaattttcaattgcgggtcccgctgcactatg

SEQ ID NO: 38048 - DNA, 895 bp, Heterodera glycines
tgccaataaaatttggtacgattttattgcttattccattaggagaaccgaagaaaatttttttaatttaagcctactctttttggcatgtttaaaaagcaattaaaaattttattcatctccctttttgatagtaaaagcatcagagagccttatttaacttgtacataaaattttatgcgtttcagagcactttctgaaaaaatatttatgaattaattttgcaaaaaataaataaacagttaaaaactcagaatttctaaaaaaatttaaaatcaattacaattgtcattttttcaggttaagttagtcctgtaccggggagtatgccaataaaatttggtacgattttattgatttttgaaagagctagaaccgaagaaaatttttttaatttaagcctaaactttttggcatgtttaaaaagcaattaaaaattttattcatctccctttttgatagtaaaagcatcagagagccttatttaacttgtacataaaatttgatgcgtttcagagcactttctgaaaaaatatttatgaattaattttgcaaaaaataaataaacagttaaaaactcagaatttctaaaaaaatttaaaatcaattacaattgtcattttttcaggttaagttagtcctgtaccggggagtatgccaataaaatttggtacgattttattgcttattgaaagagctagaaccgaagaaaatttttttaatttaagcctaaactttttggcatgtttaaaaagcaattaaaaattttattcatctccctttttgatagtaaaagcatcatagtgcctaaactaacatgtaaataaaatttggtgcgtttcagaaccctttctgaaaaaatatttaagaattaattttgcaaaaaataaataaa

SEQ ID NO: 38049 - DNA, 1133 bp, Heterodera glycines
tgcttcggggaattcgcccccgacttcttctgcctgcattgcttgaggtccgtccgtgccaaacctgtctcctccttcatatctcgtcgaattcggctgaaacttggtaggagcattggggagacttggggccatcgaactatctcccaaatattttttctcatgtctctgagaatttttgaggagattattcaaattttacaacaaaaaaaattatggatttttttaacaaaatcgtaagtagtatatggccgcaaatctcggtgtaaaattatctgcgataacccctttccttcctctttagaccccgtggcactaaccatttcccttcatttttcccttctagccgtatatttgtgatgtttaaattgattgaaaaggagggaatcataattgttttttactaataaactaattgtaaaatgattgaaatgagtgaaaaacttatgaccacatatgatcaaaaatgataacaggtaaaatttagtggcaagcggaaacggcaaaatagggaaaaatcataagaaaaaaaggtcatacccgggaaaagagccataagaagttcaaaaaaagtcaaaattgtgtgaaaaatattgtcatagcaggtgaaaaaaggggcagaacaggtgaaaaatattgtcatagcaggtgaaaaaaggggcagaacaggtgaaaaacattgtcatagcaggtgaaaaaaaaggcatcagaacaggtgaaaaatgtcataacaggtgttaaacaggcgatagcagatgaaaaaaagacatctgaacaagtgaaaataggtgaaaaagggtgaaaaacaagtgaaaagaagtgataaacagatgcaaaataagttaaaaatatgtggttgtaaaattatgatagcattgaaaaacaggaaaataaatgaacaatttgttattgttttaaacaatgttgcatttaaatgaagtattcgccagatagatatattatttgcaaatatttgtttttaaattcaccggaaaaataaaacgcaggaaataactaattcgccggaaatgttatttatttattttggaactgctgtttttcatatgatttgaaattttaggagtatataagaacggtaaaaagacccttattaaatattaaattactcttaa

SEQ ID NO: 38050 - DNA, 67 bp, Heterodera glycines
tccaatttttaccatataaaaaatattttttaaaaacttaaaagggctggaggggttacaaaacaga

SEQ ID NO: 38051 - DNA, 785 bp, Heterodera glycines
ctttgatatagatgaatgaatatatatatatatatatatttataatgtttattgttatcacgatgtatgcatatattttatatttaatctgtaataatgtttattgttatcacgatgtatgcatatattttatatttaatctgtaataatgtttattgttatcacgatgtatgcatatattttatatttaatctgtttaggtcttttttcgcttctttaactttcactcattaattcagcttcagaagggggtgggggtaaacattcaaacattcacatcggttagacacacacacacttaaaataaaattatatgaatttataatatatataatctacaccgtatacggtacttcagagttttgtcacgcccccccccccccttgaaattttttgtaggctgatttaatatactgatctcaaatctgaaatttttttagctacaacgtgtttccagtgagttcgtaaaaattcacatgacatgaagacgaaaaagtattagttaggtggttcccccctattttggaagaaaaaaattttgttttaaaaagtcgtgaaaaaagggtttttggtgttgctgatcacgaatattacatccattttggcctattttgaatcccgaaccccaattaaaacaaaaagtcaaaaattcggatttttcagaaattcatatttatgtttgcatctttctgctgtgcataatgaatattttttggtggtgtaatggtcgtgattattttttgattggtttaatctatcttaaaaaaaaaaacgaatttttaaaa

SEQ ID NO: 38052 - DNA, 718 bp, Heterodera glycines
ggtggcaacgacgtccctgaccaaaacagtggaggcggcggtgggcccaacggcggcttctgctcttccgattgtagcaatttcggctgttgcatgggcccagcgccgcaggggtgttgcccgcaaggccaatgtatgccgacaatgggaggcgggggatacgcccaggggggcggcggggcgcagatgggaggcggcggagcgtaccaaatgatggcggagagacggcgccggcggaagcgacgacggaatgccgtgccggcgacgacggcaccgcacagagcggcggcaccttcggctgatgttttcccattgtgagactcgaaaaaacaaattgtttaattaatttattttaaaacccatgctatgtataaatattgtaaatgtgctttattcgctttgttgaaaatacatcaaaaagaaatttatgccaaaatgtggccgctatattggagaaagaaagcgttgtgagtgttctccaaaatataaaattatacaatttaggaaaaaaaacaaagaaaaaagcaaaaatactgccaaattatgagagagaagaaaccaatgaatgaaaagcattaattaaatgaaaatagaatagcacaaaaatgggataaaaagcggcggactgagagattaaaggaggcgaagacggacgacggaagcggcgactaattgacgatggaaatgccgaacgcctcgagttcgtcgatttggtatt

SEQ ID NO: 38053 - DNA, 588 bp, Heterodera glycines
ttaaaataatggaaatttttgccttatttgttaagcgtttttgtttatgaaatgttctgttttttaaatttttgagcataaatttaataaaattctaacgaactttttggcccccggtgccaatattctgcggaggttttggatgagatttttaaataaacaggtgaatcgctttcactactatacaaaaaaatgagcaaaaatattacatggaagggaaccgaactttggttgctaaattggtcggggagtaggcccaaaggttcggggaaaagttcggggaccggggcggtgaggaaccctagccgataaataaacataaatttcatcctttattttctgtttttcaccattccaattatgtattctttttattttttcattcaaaacacgaactcccccatcacggcaaaggtatagattattggtcccgaaaattttttttaaataaaatttaagaaaattatttttaggggtaatctgaggcgccgagcacgaatccggtcttattttggctcagtctcgaacaaaagttcgagaattcaatttttcgtacttcgcagttttagttcaaactcggctatatac

SEQ ID NO: 38054 - DNA, 838 bp, Heterodera glycines
  misc_feature (756)..(756): n is a, c, g, or t
cccgttaaccgtgaccgtgaattgaccccgtgaaccgtgaccgtgaatcggtcccgtgaatcgtgaccgtgatcgaaaaacccgtgaaattcacggttttcgtgaccgtgaccgtgaatttatgagtttttcaaatattatataccaatttttaccaatttttcaactgaatttttttcaaaaatgagttagttttgcgacaaattaaaaaattctagataatataagcctttttgatctaaaattcaatgtatgagtatatcatacccgaaatcaaacatttctggtgaacagataaagctctgattcaaatgtttcgtagcgccgaggaaaattttttgataatttgttggattttgttaacatattttgcccaaaataactttcttttagcacattttttaacgaaactacataatgagttttaattatttaagttttaatactgaatttaaaaataaaaataaggaatctttgggagcttcagcataaatgtaaaaagagggagagggaccggcggtgccgacaggcgccgccgtagaaaaattttgaaattgaatgaaatttattaacagatcttcagcaaaaaatgactacattttgcagttttgaaccaaattttagaaatattttgcattctgtcctttaaaatttcaaattaaaaaatggagtgaaaaatccttattcaaaaataaaaacattaaattttttctgaaaacaatatttaaaaacccgtaaattaacatcgtgaatcangaccgtgaccgtgacggaaaatatgtatcgaccaaaaaattacctttgcattcacttcgctcaatttgaatcactcttgcgt

SEQ ID NO: 38055 - DNA, 894 bp, Heterodera glycines
taaaactaaggttttgtttttagttgggattcatttgaattttaagccgatgaatttaattgtatttgaaaaaatagaagaagaagaattgccaaagatggaagaaaaaaagcagaaaacgaaaaatcaaagctaatgaaaatgtttcacagaaaaaacaaagccgagaaaaaagccaagaggaaaaagagagggccaagacaattaaatgggaagaaaaagttatcaaattgacccattttgatggtaattccaataaatacatacacataatggtgaattttatggatggctttcatgctcaatttgggttcatgtcgaatgcgttcagcacgattgaactctgaaaaaataaaaattttcaaatattgtaaattttatgtaataaatattttaaaaattaattttttgatttttttaatcaccgtgcccggcacggacaatgtcagaagagaggcgttggaatgttttgctattgtgccgccattcatttgctgaatctcttcgatgggaatgcttctgccaaaaaaatgttggaacaaaacacttattttagaataacaaaaaaaattttgtggtaaaaatttctttggaagtaattttttgattttttgcaataagaaaaaggaatttgtcaaaataactttttaaatttacataggttccttttaataagaatgttatttaattttgtccaacaaatttaaattccctttgaaattctcgaggtaattagcccaactcaacaaaacccgaaaatatggcaaaaattcctagattttactttaattttttctttttagaaaaatccgcattatgtttctgttttcgaccccctggcattttcatatttctttggatgttcgacttgaccccttccattaatttttcatc

SEQ ID NO: 38056 - DNA, 963 bp, Heterodera glycines
  misc_feature (6)..(6): n is a, c, g, or t
cataanttctgactaaatcactaatctggtgggttcagcttcctcacgtaaaaatattttttggcttaatgtttttaacaatttttctaagtttaagggagggggaagaattactcaaaaaatgggcaggacaagattcaattcgggaattggttctgtttcaagaaaagcagtaaattatatttttaatgtcaattttttcgcgtcccgacatttaaggcccccgacatttgcgcctttgtacaaaatcgagtacaaaattaagtttttcaatccctgatcacccaaacagctttaatgagtgatagaaagtgattgtgtccgatcatttgatcgttagtttcaaacagcaaaattaatgtttttaataaactagaagacttttaattttaatgctgtttaaattatcatggattgaaaaacttaattttgaaaccgattttggacataggagcaaaagtcaggaccgcaaaagtcgggactccatctttgagtttcataaaaacagtttttttttaaattttttatcaaatgtacgtaaatgagccaagaaaaaaaaactcagtaaaaaattgccaaagaaaaatatttttttttctcaatcaaacacaaacatcggaaggaaggcgggacctattcattcactgtgctaccgaattgtgagcatcaaatccctgcgcaaactttgcgggaaagagagcgcgacaatctttccctcccctcccccctcataaattttttttcaaaaatttttttttcgaggggtaggcttgggaggtgggtatccaaatccaaatcctgcttctcctccgctggctgatgaatggacgaacaatgaatggaacaaaatgtgtttttttctgttcaatgtgagcgcagccgcaaatgcgcagcattttttttttgatcgaaaagcagcagaacattttgaagcgcaaatgcttttatgtttgcgtataaata

SEQ ID NO: 38057 - DNA, 696 bp, Heterodera glycines
ttctgctccccataaatggtttgagtaccccaaacggacccttaagggtcgatttttttgttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaaaccgatttttttgttttcggggcagtccccccgaaccgatgcgcccagatttatggggagaccgaatccttcgggagtagcttccctatagcctgtactttaattctgcgttggatttttgctccccataaatgtttgagtaccccaaacggacacttgaaaattcgatttttttgttttaggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgattttttgttttcggggcagtccccccgaaccgatgcgcccagatttatggggagaccgaatccttccggaatagcttccctatagcctgtactttaattctgcgttggatttttgctccacataattgtttgagtaccccaaacggacacttg

SEQ ID NO: 38058 - DNA, 1482 bp, Heterodera glycines
  misc_feature (89)..(89): n is a, c, g, or t
cgctgccagtccacctcgctcggctcccttgcctgcgccgatcgctcccatcgccggccgctgccagtccaattcgcccggctccctgncctgagccgtccgctgccagcactcagccaaagggagccatcgctcccttcgccggccgctgccagtccacctcgcccggctcccttgcctgagccggccgctgccagtccacctcgatggactcccttgcgatttaaaatatttttgattataatttattcaaagagagaaattacacaaaatccctgtcagaacaatgagaaatttgcaaaacaaaaaaaaagagggcgggagaatcggtaatttttttaactttgcggttaactaatggatgtgtgcactttcgttggtcggagcaaatgtcgcgtaaaatgtttgattttaatcgtttttttttgttttcttttcagatcattttggaaaataaaataaagctgaacaaaattttattttactttttttttattttgtcaaatctaaaaagaggttaaactaaaagtaaaagtaaaattagtaaaagtccaccaaaaaaaacaatgggaaaggtcgggggaattcaaaaaataaaaattccatgaaatctgtcgcgagaaatgcaaacagaaggggcgggggcggaggagaagagctgcttcttcttcatgtaagccttcaacacattcccacaaaaagcatgcttttcattcattgtcccccgggggcgaattcttcgctgatcgatcggacccctctcccctcctccctctcccccactttggtgttgtggtgggcgggtgcatctcccatacagcagcagtaggcattgttcaacaaccatatgaaaatttgattgatttggcaagccaaaggaacatgcttaagtgaacgcttgggaatggatgcaatttgcatgggatgagtttggacagaatgaaaagtcaccgcgaaagggaaggggagttaattagagaatggtggttaatggaaaaatgaaaaaaatatgtacacataagcaagaacattgctttttcccattcgaagaaaaaggagaaaaaatttattgaaattttaattgatgattattaagcaattttattagacttttttataaaataatatttggtttttattaaaaaataaagcaaaattctgttgcgtttgtcctttgctctcgcaagcttaatttttatgtgtacaaaaatcaatacacacatcatcacatatttatgaagctgtgtaaataaaaaaacaattcatttttgaggatgattggcacaattctggggtgcattataaattattaatttcaaatataagtcggttttttgtttcttccattccagaaattttttttcttaaaacacgggacactactggtaagaatgaaggtcagaagtgaaaagatcgagtcgaacgggtttttatcaatttttcacgcctaatattaatttttaagaaatttgagtccagcgg

SEQ ID NO: 38059 - DNA, 1083 bp, Heterodera glycines
  misc_feature (50)..(51): n is a, c, g, or t
tggcacttaatgtttaccgctgatcagcagacgtttctgtgcctgccgtnnggacaagtccatcgatgcactgaaaatgattggatggggcatttgctgctgatgctgaaccatcgtttgtgcgttgccaaatgcgttttggagttgcgcgttcgcttggcgtactaagtcttgcgtgttctctgtgataacgaaagtgtgcctttcctaattccgttttcttctcaccgcgttttcttcgccgttcgtttgtcccattttctaccgtacctttgcccttttctgttgccactgtttgttttcgtccatttctctcccatttaccgtaattttcctcactttctaccgtaccgtttcccttttccgttgtcaattttgtgcccttcggcgtttcttcgctcccattttttacttcttcaaatgagtttcaaagatagatttgctttcttttaacttttactttttacgattgcatccgccacttctccttcctttggcgccatcatcaaaaggagttcccctaattttaaattttccattttaaattccaatttcatttccaagtccgtcccctcccctctcaccgtttccgcagttggtgctgttttcccctttttcttcctcctcattgtcttcttcctcctcctcgtcccctccttctctttgtcctcctccctccgtttcttccctttcttttcccttcccttcgccgttcgcttccgatgagttcttcttcgcttcttttttttcttctgcgccggacgatgtctctgaagagagccgtccgctttcgtccttttcttttccattttcagttgaaaaatgttcgacggataccgtcgaatcggctaaatttctttttttatttgttgtcgaatttcgagaaatttattctcgaatattattgccatttctttcccctttttcccccttcaccttctctcttccttcgtttttctcttttctgtttgtctttttttgtcgaatttttctctccaaaatgtgccgttgtcgttgtgcaattgttcccgcgatttgccttagaattaattaaactactaattggccaattagcaagctaat

SEQ ID NO: 38060 - DNA, 1799 bp, Heterodera glycines
  misc_feature (243)..(243): n is a, c, g, or t
gggtaagcagtgctggtcgtttcatcacggcaccgacccttttggctagtcagcaatcgttgcttactttgccagatcggacgggtgcgcatgattccactgttccaagcaccccaccaaaagcaaaacgatataaccaaatattaaggaaaaattttttaaaaaattttttctccatcttcctttttgatactaaagcatcagagtgctaaaattaagttgtaaataaaatttggtgcgctntagagctctttctgaaaaaaatatttatgaaacaaaaaaatcgactttttcaagtgtccgtttagggtactcaaacaattatggggagcaaaaatccaacgcagaattaaagtacaggctatagggaagctattcccgaaggattcggtctccccataaatctgggcgcatcggctcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcagggggactgccccgaaaactcaaaaaaaaatttttttggataaaaattatttaaatgaactgactagataatatttaaaataggttattactcttcctttcagtatccctgcaaagtttggtgcgcttctgatcagtttctgaaaaaaaagttaagcctaaactttttggcctgtttaaaaaggaattaaaaattttattcatctccctttttgatagaaaaagcatcagagtgcctaaactaacctgtaaataaagttttgtgtgtttcagagcacgttctgaaaaaatacttatgaattaattttgcaaaataataaataattaatgaaaaagtcagaatttcgaaaaattttaaaaacaacaagcgttggcattttttcaggttaagttagtcctttacaatggagaaggcctgcaaaatttggagagattatatcgattttagtgcgctaggttcgatgaaactttttaaaatataagcctaaactttttggcctgtttaaaaaggaattaaaaatttttaaaaattttattcatctcccttttgatagaaaaagcatcagagagccttatttaacttttaattaacatttggtgcgtttcagagcagtttctgaaaaaatatttatgaattaattttgctaaaaaaataaaatagtgaagctttaaaaattaataaaaaattttaaattcagaattactggagttagcatcatagcagtgcttttccttgtctttttgatgctctcgcaaaatctggttcgcttctgatcagtttataaaaaaaaagttaagcctaaaatttttcgcatatttaaaaagcaattaaaaatttttagatttttattcatctccctttttgatagtgaaagcatctgagtgcctaaaataacttgtaaataaaatttggtgcgtttcagagcagtttgtgaaaaaatatttatgaattaattttgctaaaaaaataaaatagtgaagctttaaaaattaataaaaaattttaaattcagaattactggagttagcatcatagcagtgcttttccttgtctttttgatgccctcgcaaaatctggttcgcttctgatcagtttataaaaaaaaagttaagcctaaagtttttcgctcgtttaaaaagcaattaaaaatttttagaatttgtattcatcgccctttttgatagtaaaagcatcagagtgcctaaactaacatg

SEQ ID NO: 38061 - DNA, 817 bp, Heterodera glycines
  misc_feature (611)..(611): n is a, c, g, or t
tttacgcaaaaatttctcgaaccctctatgaattttttcattttcttctgaaaacattcccatttaaagccacccaataggactgttagatcagaatggtgcaattgacttttttgattaaaaaatatagtaacagaaactaattttttcaacttttttcgtcaattctttgactgtttattttgcgcattttataaaacattgtttcaggacgtcggcttaatgacgactgtactttgaaggattgcaacctcgtaaatggctccaccatccactgtttcccacgtcaatgtggctgttagagcagaacaattggcagaattttgattaatttccaggcccggaaatttgatcttttcaactgtttattcaatgttttccctcctatttttcttcgtttcattccttttaaaattccttacctttgatgaaatctatttttgctgcattattttttacaacaattttgagttaagctgtccggcggtgccgataggcgccaccggggaaaaaattggattttttggctgtttaaaaaatgaaataaatatttttatttatgtggttggaaaattttcgtaataaatttgaaggtttagccactagactanatattccttattattttggatttaaagaagagaaaattattttttcttctctaattgtttctttatttgttacaataataaatagtatgttttttaatttcgaataatttatttatttttcaaaattcaatgtcagtttattttaagtctttaactttttataattttattttttttaattgaataatatacaaatttttttctta

SEQ ID NO: 38062 - DNA, 559 bp, Heterodera glycines
atttccgcagctcttacggtaatggaaaaaattttgcctttatgtccggaacggattagcatcggggttacgagatagaaaattgtcctaaaaagagatagccatttttctgagaattaattcacaatttccgcagctcttacggtaatggaaaaaattttgaagaggctctccggaacggattagcatcggggttacgagatagaaaattgtcctaaaaagagatagccatttttctgagaattaattcacaatttccgcagctcttagggtaatggaaaaaattttgaagaggctctccggaacggattagcatcggggttacgagatagaaaattgtcctaaaaagagatagccatttttctgagaattaattcacaatttccgcagctcttacggtaatggaaaaaattttgaagaggctctccggaacggattagcatcggggttacgagataaaaaattgccctaaaaagagatagccatttttctgaaaattaattcacaattcccgcatctcttagggaagggaaaaaaattttgaagaggctctccggaa

SEQ ID NO: 38063 - DNA, 873 bp, Heterodera glycines
aatttcaatttgcggattccgctgcgggattcgatctcaaaattctttgcgggacgggatcccgcgggattaatcccgcatttaaaaaaaaatgtgggattgcggactgggatcccgcaaaatcccgcgcgggatcccgtcccgcgccggtctctagtgctcagcgcctcaaaatacccaaagaaacttgttaaagaattcccaaaaaaaaaaaattcgggaccaatgaccgacatgattgctctttaaatttgtggaaaatatagaggaatatatcgttctgcaatttttccttcctgcgttaactttcaatttgaagcatattaaattggagagaaactttgctgaaatatagcacattgaatacaattaactgttaaagaatttttgcttttaatgcattttttaacgaaatctggcggcgagatagccaaaaaacaaggcgcggcgagttggcccgcggcgagaaggcgcgcggcgagttggccggcggcgagttcgcggcggttccctttatatattcatgtgaagtcaaagtcagtgttatgaactcaaaaatcaaaacagaacaaattgcatcatcccattttatgctctatcagatgctaatatgagttattggcatcaaagtcaaacatgtccaaaaacgagtacaagaaaagccttgcctcaaacatgaaaaaccaccttaatagaaaaaacaaaatttataagtacaaaaactggaattgaaaaataggggaaaaattatcgtatttactgaatagagcccccgagggctttgtcaaacagccacattcacgaataaatggcataatttgttaggtttcgctggacgattgcaaataaaattgacgccgaaactgtaaaatt

SEQ ID NO: 38064 - DNA, 1078 bp, Heterodera glycines
ttgcttactgttagctaaagcgaagaatcaaaatggcatttcagctggagaaatgcctcttcggttaatttgaactttaattgagcaaattgttgaaattttcgcccattaatataaaaaatgataagcccactccgtagcctctcaaagttcaaatggacgctcaagaagagaaattttctcaagagtcgagaccacgactgtcgcatcattaatcagtacaaacggagtttgtgtgccatatttttctatttttcaactttttccaaatttgtatctcacttcctgtccacattcgtaaaattgggtggtgttccagcagtttaaattcttgagccttttttcaaaaatccctcatctgagagaggaaacattttgaataaaacaactagagaatcttttgaactgcttcctaaaaaaattatgaaaaaaattgaaagaatacagtaaaaaatgggatagaaacgtcatttgcccactaatcatccatcaccgccaacaggcggccctaatccaggggcttgcccccctcacgaaatgaaaaataaaaaattttcaagcataaatgggcaaattttttgaaaattttacacaagtttcttatattattgcttaaatttccacaaaaaaatttattggctgagcttatctgcaccaccggaccccattgtagcattatttattgaatgacccaaaaacggcaaaaatgcgtcatttttaacacaaaacgctataaattcctgtttttcgcccggcgctcaaaattttgaagaataacattcgagaaagtatttttttaaatttttggtccgaagagcaaaaaaataatataataaagcttttcgggtgccgtccacaaaattttctgggcacggatctgcccctccatcgtatataaatttacatttgctggatgatgatgccgttgcggaattgaggccatttcctccgccattgtcagccgccgccagctcaatgccgtggtgcaaagcgtgcagcagacaaagtgccaacttctcattgagtgcgcagtcggtgaggaacagcgtgggcagtgtgggcaactggggtaacattg

SEQ ID NO: 38065 - DNA, 545 bp, Heterodera glycines
ccgtccccgagaaaaaagggagaatggaaaaaagggaaagaaaaaagagagagaaaaggaaaaggaaagggggaaaaaacgagaaaagggagcggcaagttcaaggaaagggtcgcgcattgcgctcgactaaccctgagggcgatttgtcgaactcaaaagtggggacttgaaattgactatttccctaagaaatttcgccaaaattttccaatttttctgcgttcgacatcctttcctcgtgcgttcgaacgcaagaggaggggctgaataattcctaaaatcttgcctatatttttttaaatcttattaaaaattcctaaattctcttaaaaaatgacacaaaatcgcaaaaattttgtcattttttggtgaaaatctgttaacaaatcacaatcaaaatttcaaaaattttcccggcggcgcctatcggcaacgcctgacccaaccccccgtgccccaaaagttttttgaaaaaagtgcaacgcaaaaaaactggcatgaaaaatgcaaaagatgggcgcgcaaaaaattggccggccgct

SEQ ID NO: 38066 - DNA, 664 bp, Heterodera glycines
catttatgcctgggttattcaattctagcaacgaaatgtgcaatggtgtataaaaattagaccattaagatttaattcaacaatttgtgatacaaattcgaaagacaatgcgcttcataaatttcgagcttccttttaatcgctttcctaaaaaggaagacaagtgctttcaggatgtgcacagataaggtaaaaaactccatattttcctgcacacattataaaaagcgtctgtctcttggcttctaaggcccaaatcaacccttttatgcctttattattcaatgcaatcgatgcaatttgcaataatatatataatttagccattaatatagaattcaatcatttttcatacaaaaacgactgacaatacgcttcataaatccaaatcaacacatttatgcctgggttattcaattctagcaacgaaatgtgcaatggtgtataaaaattagaccattaagatttaattcaacaatttgtgatacaaattcgaaagacaatgcgcttcataaatttcgagcttccttttaatcgctttcctaaaaaggaagacaagtgctttcaggatgtgcacagataaggtaaaaaactccatattttcctgcacacattataaaaagcgtctgtctcttggcttctaaggcccaaatcaaccctttta

SEQ ID NO: 38067 - DNA, 1483 bp, Heterodera glycines
catcccccccctttctcttggccaggtccatcaccgcctctaccatctcggctgtgtgctgtgcatcagctgttgctgcatgtgccaacctcccttgacgccacaaccggggccatttgcgccacctgaacagcctccgctggtgccgcagccgacgcagcaaaattatgcccaattcagtcccaccaatgggggcggaaatgcacaaatggtgagcactgatcgtttaaatatcgttaaagcctgagacttaagcagcccttccatcacccggattttccatctctagcccaacaaaatcagcagaattgtatgtaaaaattaagttaattatgcaacaattagcactaattaattaattgtcttaaatttgacgctcagttggccctttcgcgggcagtccaaccgcgggctatttgagtccatcgtcagggcctgtccaaattggttcaactcagcaccagcagcagaacatgcaccaaatatcgttgagcgaattcggcacacgaacggaaacgggtggcggtgatcctggcattttgcgcaactttcaaggcgaccaattcaccgatggacaacgcattacggtgggtgagatattaaaaaaatttgcatttttatatacatatttttatttatttgaaatgtttaattttaattagtatttatggacgtgaaaaatgctttgccggttttaattttcacttttatttggcggagaaaaagccataaaataagtcgcggcgatttggccacgtcaaagtgacccgacctgttgattttctgttgtttttcattttaaggaaacgcgccaaatgaatggaccattttttgaacgaattggcggcgaaccgaactatgggggccaaggggaaggagaagcggagaacgaacggaggaaggaattcaaaattgcagagaagaaaaattagcaacggacaaatggcacggcataatttaaggggaggggactgatcagagaagctgatcaatggttgattaatcgattattaattgatcgatgatcaaggaaatgagcaatgccaattcaaactggatcaatgtgatcaatgattaattatggcggctttaactgattaattgttttcattttttatttaaaattataaaaaattcactttaaattttaaatacacgtgaaaaaattcattcaatcaaaggagcagaacattttgtcgtagaaggccaacagacagaagaagaaagcggttaccagtgaaaagaaaaacagcaaaagacgatccaacgaattggcgaggaattcccactcgagggcacacctggggagggggagggaggactgatcatacagggaacggactgatcagatagggaacagactgatcagacagagaacggactgattagacagggagcggactgatcagacaaagagcggagagggggaggcgagaactgatcagacaggcagcggagaggggaggcgagaactgatctgaca

SEQ ID NO: 38068 - DNA, 624 bp, Heterodera glycines
  misc_feature (253)..(253): n is a, c, g, or t
ccgtcgccgtcgaggtgtgaaatttcacacctcgacggtggccgggttttcacacctcgacggtccccggttttttgccttttttaccgcaaaaacccaaggatattggctgttttttcgcgcattttcggggaaggggagggaggcgacggtccctggttttcacacttttttttcgcgcaaaaaacagccaagggtattggctgttttttcgcgcattttctgggggaggggagggggggggtcgacggtnccctggttttcacactttttttcgcgcaaaaaaaaaacccaagggtactggttttttcggtaataaaatttaaatatttttgggtttgatttaagatttataaattttttcaactttaattttggtaatacaaaaaaaagtctaattttgaattacgcttaattaataaaatatttatgtgcgtctgcagcagaatgccccccccctccccccaattgaccacaggcaaaatcaatatggataaatggaagggagggagtaatgtgtggagaatggattgggacgagggatggaaaaagggaattaaatgaacaaaaagtaaataaaaaccaaacgatttttatcgacttatttttttctaaactaaaaaa

SEQ ID NO: 38069 - DNA, 916 bp, Heterodera glycines
tagagttgctcggtaccggtaccggtaccggtactggccggtaattaccggtttttttggtaccggtaccggtaccggtaccggttttttcaaaaatgaaagtaccgttaccggtttgtctagtaccggtaccgccggtaaaaatttgcactggtaagaatgggggtctggtcgagaaaaaaatagggaattggtgaagaaggagaaatttttgagaaaaaaataaattttatttcgtttagcaaccatgcatatgtagtgtaatggttaaaccttttgcctttcattatttttcgcttgggttcaattccccactgggatagtatattcttcatattttctttaccattattttaattgaaatttaattaaaaaaaatattccaactttttttctttcattttaagcatcctaaaaacccaaaacttaatcaattggtcattttttttacaaattctgttaacaaatcgcattaaaaattacaaaatttttcccggcggcgcctatcggcaccgccggccctccttgttccccaaaagtcttgagaaaaacgtgccgcgaaaaaagcggtgttgaaagcaaaaaaggtcattgatctacattaatttacatggccggagacacttcgcaaaattagaaaattggctgctgaccccttgttttgcaataatctgaattttaggtctatatctgaattttagtgttctttatcctgaatttgaaaaaaaaacttggtcaccctcaatatacatatacttctgaacaattctaatgctaaaaaacaggcactcgcgcgaaaactgaataaaaattttgtatttgaaaaattttgttcaaaaatttttacgttggaaaattaccggtaccggtaccggtggaaaaagttggtaccggtaccggtttttttacaattacc

SEQ ID NO: 38070 - DNA, 1594 bp, Heterodera glycines
  misc_feature (1440)..(1440): n is a, c, g, or t
tttttcaaattattatagaccaaagtccttttttcttcttacactgtattgtttttatcaaattttattacatatactttcctagttttttttaatttaattccttgattattatcgcgtgcgccgcttcatgtaatgcggttacttttttattttgaagttttgttttgatttttgtaaatttgaatatagctaaatcaacattttatttataaattctaatttaatgatttgatttttaattttcttatatttaattcatagaatattaaatattatgtgaaattggtttttatattaaatattatgaatattagttaattatgtataaatgcatttccgcagttttttgctctattatataaattttatttggcatttttatcacttttttaagaatttttataaaaataaaagtgattttgagattcgggaccaaaggggggtgaccaggatttttgagtgaaaaaattttttcgtcaaaaatcttccaaaaacatgtcattagggctattttatgacgctgatcacgaatacgtgatcagatttaacttttgacatagtcaagacctcagaatccctgtgtgattggggattctgaggcatcatttttgggggggggcaaagttcgaatccggacggtgtaacattatttttctgtgcatttttgggttattttgactgtttttaattaatttgaagatttcttttaaattatttaaatttattttttttaacttaaagaatttcattattttttttgaatttgtaaaaaaaataatttaatttcaaattaaataaatattcaattaataatttccaacgttgtttttaattaataactaccatttttttcgtgttttcattgttttattcatttaaaatattttttattttattaataataaattacatttttttatttgaattaaatttttataaaattcgagaaattagttcctttcaatttcaataaatattctatattataaatttctaactttatttttaataagtaaaaggattttttaatttgataaatttataatacatccaataatacaattttcttatttatttcattttaatccatgattgtacctcttctaatcacttttgttcaaattttaatcactgttgtacctattttactaacttttgtacctcttctaatcactgttgtacctcttctgatcactgttgaacctcttctaatcgcttttgtacctcttctaatcactggtgtacctcttctaatcacttgtacctcttctaatcactggtgtacctcttctaatcactgctgtacctcttctaatcattgttgtacctcttctaatcactgctgtacctcttctaatcattgttgtacctcttctaatcactttgtacctcttctgatcactgttgtaactcttctaatcactgttgcacctcttncaatcactgttgcacctcttctaatcattgttgtacctcttctaatcacttttgtacctcttttatcacttttgtacctcttttaatcactgttgtaccacctttaaatcacttttgtacctcttctaatcactgttgaatctcttttaatcac

SEQ ID NO: 38071 - DNA, 1050 bp, Heterodera glycines
atttcctccccgacgaaggtgttgctcccgacattcctttcatttctcaagccatccccgacaaattctttcggggactttcctccccggtccccgacattttgctccccgaggctcggggagcaaccctaaattaaagtaggtaatcttctcaaaatattataattaataaaataaatatatatttttaatatcttactattattgtttaaatttatctaaaagactcaaattaaaattgcaatatttttcttcttttttaccttttcattaaaaatttaaaaaaaaaaaccccaaaataaaataccaacaaaaaaaaatattaaatgctaaacatttccaaccgcctaattatcattaatttgcacaatttgactaatttggcacaccgttttacgattggggcggtttcagtggccggtgggctccctttgagcagatacttgctgcccgccccggtcacaaaacccttcacgttcagattgttctttgttgtgaatggcacgccgtagagcggcttggagaatgccaactgaaaagaaaaatatgccaattaaattttatgctgggttaattagtgcctaattatgagccatgtaattatcattaaaggcgtatcaaatgtgacgtttaatgacaatttattaataatttaattatgctacaattacaggaaaaactgctatgctttatccatgaattagcgtctatttatgctgaacaatgtctgattatgctcatttagaggaaaaacactgatccattaattagcgtctaattaggatcaattagtagaaaaactgctacactcggctaattattgatttaattgcactcagaataacaatttaattaatgcctgatcatgatcatttagaggaaaaactgctaaggtgatccattaatgagcgtctaattatgcttaattaaggaaaaactgctaaggtgatccattaattagcgtctaatatgctcaattaaaggaaaaacggctagactgagacattaattagcgactaattactttcctaattagatggcctcagcctg

SEQ ID NO: 38072 - DNA, 1557 bp, Heterodera glycines
ggaacggattagcatcggggttacgagatagaaaattgtcctaaaaagagatagccatttttctgagaattaattcacaatttccgcaactcttgcggtaatggaaaaaattttgaagagtctctgtggaacggattagcatcggggttacgagatagaaaattgtcctaaaaagagatagccatttttctgagaattaattcccaatttccgcagctcttgcggtaatggaaaaattttgaagagtctctgtggaacggattagcatcggggttacgagatagaaaattgtcctaaaaagagatagccatttttctgagaattaattcacaatttccgcaactcttgcggtaatggaaaaaattttgaagaggctctgcggaacggattagcatcggggttacgagatagaaaattgtcctaaaaagagatagccatttttctgagaattaattcacaatttccgcagctcttgcggtaatggaaaaaattttgaagaggctctgcggaacggattagcatcggggttacgagatagaaaattgtcctaaaaagagatagccatttttctgagaattaattcacaatttccgcaactcttgcggtaatggaaaaaattttgaagaggctctgcggaacggattagcatcggggttacgagatagaaaattgtcctaaaaagagatagccatttttctgagaattaattcacaatttccgcagctcttgcggtaatggaaaaaattttgaagaggctctgcggaacggattagcatcggggttacgagatagaaaattgtcctaaaaagagatagccatttttctgagaattaattcacaatttccgcagctcttgcggtaatggaaaaatttggaagagtctctgtggaacggattagcatcgccccctcccccgcccttcaaaattttgaaaaaaaaataaaataataggagactcagaattttgaaaattttttataaaaactgatgacaagctaatgtgataaaacaggttaattcttttcctttcagtatccctgcaaagtttggggcgcttctgatcagtttctgaaaaaaaagttaagcctaaactttttggcctgtttaaaaaggaattaaaaatttttaaaaattttattcatctcccttttcgatagaaaaagcatcagagtgcctaaactaacatgtaaataaaatttggtgcgtttcagagcattttctgaaaaaatatttatgaaataaaaaaatcgattttttcaagtgtccgtttggggtactcaaacaattatggggagcaaaaatccaacgcagaattaaagtacagactatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattaaggtctcccccccccccctgggaccgtccctgatatgcgg

SEQ ID NO: 38073 - DNA, 993 bp, Heterodera glycines
cgagttgacaaatgaaattcataaaaaatattttaaacatttcaacttttggcgcggccaattttggcctccgttataatagatgactttttgcctttttgtacgaagctcgaagtttcacccgtcctgctgaacgaaagttcagtagcaacaaaagagtgagtgccgaatgattcaattccaatcgggcacataaccccctgaacttcatgtacttgaaaaagcatatgttgcattggtaagtttgtattcaattttaaagtattttttaatatataaatttttgtcgttttacacgtttatttgaatttttaaatcctaatatttttgaaaaaataattggccactgtccgttttgcattggtctgctaacgtaccctaacgacctgtactccctcccccctctcccttttgcttttaacattaatttttatttgcactttttaagaatattaatgtgcctttggttagcttaaaaattaattttcaattttgcttttgctttcgtttcatttcacccatcgctcgcatttcgttaatctgatcagtgagtgatcactgatcagctccgctcatttgtcagtccgcttctcctcgcctcctcaatttgtggaagaaatgttgcctttcttcgtttttcttttcgcgaaaaatgggaatagcaaacgcaatcacagtttgatatgatggattatcagtgaaggaaagtcgaaattggaagagtgtgaagaatgggcgggggaagggattggcgatcggagtttggcgatggcattgcatcggacgaacgtaagcgaccccccccccctcccccaatttcgactcccccgtgtgccgatgcttttatcttcgctcatcttcgtcctaattccaaatgatctttcgttcgtcgctttttggtcatcccccccccctcccccgcatttgttttaatcattttattacttccattatgatcggttccattgcacacaaagaagaacggatgcacag

SEQ ID NO: 38074 - DNA, 1356 bp, Heterodera glycines
  misc_feature (49)..(49): n is a, c, g, or t
  misc_feature (130)..(130): n is a, c, g, or t
atttattaattaaaattcggcaatagttaaaaatacagacgaaatgtanctaaaaattaaaatgttcgagaaaggtgagtttgctttttttgagcaatatgcaagataaatttataatcatttttcaatntatagcacaaatactttcttcaaataattaaaacaaattattaataattcgaaagtgaaacacgaaaagactaaaaataattacaaaataaataattaaacaaatactaatgctacggtactacctctaccgtaactctacacttcacatcaaatccgacaagaatgataaaaaaattatctggtaaaataaaaggcaaagaatacaaacaaaatataattaatattaacttatttatttcattgtagtcaattaatcaaaattaagtttgaaagaatcatgcaaatgttcagaaaaaggaattaaacgatattaaaaacaatatcattataacaaaaaaatatataataagtagggctggaaattttatgtaaatacatattttttcctctggcttctccatgctctaaatagcaggaaaaccactttcttttttgtgtttgcgaacaaaagttgggacttttattttcatatttttacatatttaggggtttttatacatatttgatacatattttggaattgtttcttatatattttcatttttttttacatattttgagatttttttacggaagtttttgggaattctcaaaaaaacacaaaatttcggcaaattttttgttaaattctccaaataataataatgttaaaattttcggaatgcctttgcgccacaactctgtcctaatattttctattatttacatgtctaataaacaaatcatatttttataattttatttaaatgaaaataaatttataaataaaattattaattttagtattaattctttttctaatttactttttttattttggtttaaatggcttaagtttgtattatttatactaaaaagttttcctaaaattaatatttaaattaaaatatttattaaattaatataattaacatatacgaaatattaaataatcaaaaaatttgagaaaattaattttttaaaattaggggccttaaaattttttaaaagggaattataaatgacaaaatataaaagaaatatgaaagacaaaatctttaaatgacctataaactgattatttatatattacatttcttttcatatttctgttgtctgtctcccccatcttatgtgaatatatattaaataatcctttactttgctgctatgcaaaattatttcacaaataatttaaatttaaatacaaataaataaaataaaaaaatgaatttatatttgagc

SEQ ID NO: 38075 - DNA, 737 bp, Heterodera glycines
accgggttttatgctacttattttgaaaagagcctctcttagccagaattcatggaaaccgtgaccggaagaattccgtttttcctttgagattggaatttttctgaaaatcggcagaagaggcctgaattctgttccggaaaaccttgccgggagattccgattgggaaaatcgtgactgaatttttcactacttattctgaaaacggccagaaatctccattattctgaaacggccagaaacctctagaattatatgaaaccgtgcccagaagaattctttttttcctttgagatggaatttttctgagaatggtcaggagtgtccagaattcttttccggaaaccttgaccggagttccaattttggaaaatcgtgacagggttttatgatactcattctgaaaaagggccttaaatctccagaattcttggaaaccgtgcccggaagaattcttttttatttattctgaaaaccgccagaaatctccaaaatccttggagaccgtgaccggaatctccagaattatatgaaaccgtgaccggaagaattctgtttttcctttacgatcggaatttttctgagaatggtcaggagtgtccagaattcttttccggaaaccttgaccggagttccaattttggaaaatcgtgacagggttttatgatactcattctgaaaaagggccttaaatctccagaattcttggaaaccgtgcccggaagaattctttttt

SEQ ID NO: 38076 - DNA, 1005 bp, Heterodera glycines
  misc_feature (864)..(864): n is a, c, g, or t
acaaattttaatgaatttacataattttcatattttggcggttacgaaaatttgttaaaatcttaaaaaatattttctaatttttcagcctttggtacaaaaaaatttcgcgggcttcatttttatgaaacatttgctggaggttgagcagaaagtgcagagaattcgcaattcgataacgataattcccaagcaattttatgaccgttgtgtttcttttgagtcgattttagaatcaagttcgaaattaaattcttcattgattgcttgtgccgacagattctcggtaattaaatcaatcacaaaaaatgatgacgaattccgaatttaagactcaaatgccgagcccaccttcggaaatgttttacgaaattatccgtcagacggggcccttttctatgatgccaccgtatttggccttggatttgttgtttgtgttcgaaattggcaaaacgtttcccttctttcagcggcttagcatcagcgataaggtaaaaaataaattattttaaatatttttaaaaacattcccaataggtcggtgattgattgccaagttgaacaaaatggcttcacttaaaagcttttaacatgctctattagcattctgataacaatagagctgttgaatttatgactttaaatagccttaaaatgatttaaaaaagtacaccgaaaaattggacaacaatagaaataaaagaaataacataaatatttacatagaattgtcattatttcatgtatatactcgataccgattttgacttcgatactcgataccacacggaaaccccaaaaaattagaattttcttctctttcagcacaaaaaatcaccgattaagcactgtaaaaagcaccanattttcccaaaataagcatgaaaaagcacaaaaaaagcaaaatcatgggaaaaagcataaaaattaggggattacaggcacaaaaaattgaaaaaagacagcaaaaaaacgtttgtttgctccctgaatataaaaaccccc

SEQ ID NO: 38077 - DNA, 779 bp, Heterodera glycines
tctttagtcaaataaattcatagcattctgcattgacatataaaaaaatcgcttttcctttgtttttgagttcaaaaattatgtcaatttatcggagccgaagatttgcacagacttatgccaaccatgttgtgtgccttgatcattaaatcttgactataaaatgcgctgggtttttctgtgtagatttttttgcccctaaaatttctattttctttaatttgaaaataaaaagaaatggctattaaaaaagaatatataaaggcgattagtcagtgaacggcttttttatttaacagcacttaagtcagaaaaaactgacaactgcacggacgaataatgaaacggagataaaggagaaggtgcagacaacggaaaaaaggcaaaattaaaaaatataaaggcgaaatagcacagattgccagacagttagacaaattaatggcaaaacaaaaattaacatacaatcagagaagcaaacaaaaaggtgcagagaaagcacacaaagtcactttgcttgagggcacaaagaacgctttctctctccttattttctgctttgtacaatatttattaactagctgggttatcgccttaggcgcatataaatgtccaacattaaagatgaaaaagaatgccaagaagcgtagaaccaagtggagaatacagagcagggttgttccgggacgagaaaaatatccggattcgggtcgggtcggccgaaaaatcatcgggtcgagattcgggtttcgggacgagaaaaatgtcgggtttcgggt

SEQ ID NO: 38078 - DNA, 420 bp, Heterodera glycines
tttttgtcctcgtactgaaggcaaaaaaagggcttgagaatatcccccgcccataatgagggatagtacgaaaatattttacaagaatctgggaattgagtcccataccctaaacacccgaaaaatgtctccagtcggcacactcgctcaccgcccatcccccccccccccccgtcaccaacggcgagcagtctctgcagcagatccgcccgttcgtgcgttattcggctcgccaggcaaaccaatgccctgggcgagtgccgccgcaaatggcgcgggtggcaattgaaggcgggcaaagcgcaaagccgcgggtgcaattgtggcgtgggggtgccgagttttctgacggagaagggatttttgagattcgcggcgacggcatcggtcacctgtaaatcaggtcgagctgatcctcga

SEQ ID NO: 38079 - DNA, 1051 bp, Heterodera glycines
  misc_feature (1039)..(1039): n is a, c, g, or t
taagaatataaatacatatgcagcagatgttttttgtcaatgaaaagaggagacacaaaatgagtcagtcaacattttgttgtttactttaaggtgaaaaagagggagttaattgcgaaggaagggaaaagggagaacaaaagtcaaaggcaaaagacaaagcaacaaatattctgtgcacaaatggccaattagtggggctgaggaagaaaagagaaggcgaagagcgatgctaatgttagctaaacgatggggggagagcattgggaatataaatgaatattgggaatataaatgaatatgtgtaatgagaggggggggggggcaatgagaaacggacgactaattacggcttttaaatgcttattcagcaggcggggggacagcaaacgacgacgaatgattgactgttggccgtagaataaataaatgagtgaaaaggtggagccatttaattaaccattcattttggttatgtaattaatgatgtttatgtatgtactaattaactctgaagctctgtgtgtttaacataaagaaatatgccaccgttgattttgaaattaagttttgaaatgtaccattaagcacaaaaatgcctaatttacaaaagaaaaaggaactcatcgctctgtgtaaggagtgagtgaattttggaatttggtggaataaatgacttttgcttttacacataatggagaatgtgtggtgcacttaattattgcataataaatggtttaatcgattggcatttgtcctctccgctaaattaatgaattaaaatgcgacggaatggatgagccgaaaatgaggtcattaatttccatctgccgctaatttcactcaaaaagattaagctcattcaataacccgctcttttgaattacgctttatgtaaattgttgataaaaaaaaattgaatttattcataaaaatggcggagaaatgcaaaggcaaaggcactaactgctgaagcgagggggaaaatgtgcgtgggatttggcgaggggggggggggacgattatttgtgagtggggngggggggggggg

SEQ ID NO: 38080 - DNA, 737 bp, Heterodera glycines
attgggagttgcaaatgttcagcgacttttcgagttgtctctcaaaagtgtggtgtgtcggatttcagaagagaatttgatgatattttagaatatcatgagaccagctggggatataccaatttcattgcatttgatgtgagtgccaattaaattttcctagaccaattaaggatataattaaggaattgatggatacaaacaagggcttttacgatcaaaatgaggacaaagtgactttggccatcgatttcacggtgaaagaagtaataatcgagacaaattacaaatccccaaaatgatctggcaaaatctcaattgaattatcatactatatggacctattttctatcatatttcttatttttgaattttttaaacttttggatgaagctgctttttgttaagcctcttcttcttgagtattgttatgtcccagagtttaatgctttaagccattttcaaataacgggaataaatttggacaacaacaaccttagagcattttgggtgggtcagtgcaattggttatttgggaaaggattgatgccaaagcaaagaacagcacgactgacccaccgcagacatctcgcaccgccgaaggggaaaatgggatggacttatatattggcacaatggggatggactttggataggatgatgggtaatgacggcaaaaacgcaaagggaacgagagagaaatggatggcatatgaaaccgatgaaaagtgtttcca

SEQ ID NO: 38081 - DNA, 1034 bp, Heterodera glycines
  misc_feature (900)..(900): n is a, c, g, or t
tgacaactcattaaaaatcacatgaaaacgtagcttccctcccgtggtgaatgtataaaatagtaatgtagtaaaaattgcttatttcattagcgaaagtcgtaaaaaataatagatggtcaagagtaatattctggggatctgacatgcttaatttaccgttttcagaaagttggacaaacctatttgacttttagctttcttttggttgagtaagcagatagcgtttcagttgtaaatttgacgtgatttacgtgggaatgttagaatttatgttacttaattatgcattttcttttgtgaccgcgttccggcgacgctttctataaaaagcttttagaatgctaacattcgcagctacttaccaatgggttaactgaatccaaattcagtgacaactcattaaaaatcacatgaaaacgtagctttgaaaacgtgaatgtataaaatagtaatgtagtaaaaattgattatttcattagcgaaagtcgtaaaaaataatagatggtcaagagtaatattctggggatctgacatgcttaatttaccgttttcagaaagttggacaaacctatttgacttttagctttcttttggttgagtaagcagatagcgtttcagttgtaaatttggcgtgatttacgtgggaatgttagaatttatgttacttaattatgcattttcttttgtgaccgcgttccggcgacgctttctataaaaatcttttagaatgctaacattcgcagctacttaccaatgggttaactgaatccaaattcagtgacaactcattaaaaatcacatgaaaacgtagctttgaaaagtcgtgaatgtataaaatagtaatgtagtaaaaattgattatttcattagcgaaagtcgtaaaaaatatagatggtncagagtaatattctggggatctgacatgcttaatttaccgttttcagaaaagtggacaaccctatttgacttttagctttcttttggttgagtaagcagatagcgttttcagtgtaaatttgacgtgatttacg

SEQ ID NO: 38082 - DNA, 884 bp, Heterodera glycines
  misc_feature (143)..(143): n is a, c, g, or t
  misc_feature (172)..(172): n is a, c, g, or t
  misc_feature (174)..(174): n is a, c, g, or t
aatgaaaaatgcccaagctcctcgcttttctgaacaatgcctgcgcatgtggaagtgcagcccggagcgctcgcatgatggaagacatgccgcatgccttcagcatcctgtctcgagtcgccatccctaactaataatataangtcatatgtagttttcttgccttaattgncnggatgggataatggcacgcttcagttgttgaaggacttcgcgtaaatactttgacgctttaccaggcattaaggcttgcgctgcgacgaccatcgattgtttcacgtaacagccgatgacgaacacttgcgtccaaggcttgagatgggtgttgctttggattctccttgaccaatcgctcatctgattccgttttgactcgacatcaaaaatttttaaaaccttggtgccaaagacaaagcgctcctcggattgttttgccacgttagaaatgaacaggctcacaattttcttcatcatcgctctcaccgacgttcaaatcattgctggtcgatacaccttccatttgttgttctgcggccgtcctctcagcattcagtacgctgtcttcatttgttggatttatgggccgtttaattggcttttgcaaacactcaagaatttcgcgaacagttggcatttcttaatataatctgaatagaaaaaaaaacaaattctaaaaatttagcataaaaaatagaaagaataatgtatttgatatcagaacagattcgttttcctcttatttactattccttaatcattcttttttgatcagttagcgaaatgtcagttggcgaaatgaatgtttttggctgagttggcgaaatcaatgtttttggctgagttggcgaaatgaatgtttttggctgagttggcgaaatgaatgt

SEQ ID NO: 38083 - DNA, 822 bp, Heterodera glycines
attaaatttattaattatttcatcaatttccccataaaaacttacgcgagatatactcaggatttgtcctgagcttttcggcaatttcttccggcacttcctcgccacgaattgccttgaagacccagctgatcacagagttaacagtgaactctgtgacaagctcctgcgtgtccatccactcgctcaagacccaactatagtctttttgactatagcctgaatacattttattaagaattgtataaaattgttaaaaattaatttacctaaccactgaacatagaagatccgtcgtaattgcccatcctttttgtacgttgtcgtggccaaaatggcctgcacctcgtattttccctgcttagggttcttgcgaaccctaggcccaaatttttctgccggcgcgtccacgaacatttggccctaagaatttgcttttttttgtgcacgaattctataaattttaaatataacccacattttgtttccgttgttttttgttgaagttctgcctttgccttgcggtgtaggtcgatgtcgtgctcatcgcttcgtccgccgtcccgtttccgacactccccacatctgccgttgcattccccgcagtgtcagtgcccatcgcttcccgcacttttaatggatttgccgttgggttgtccaatacgatttgctgttggtcagaggattgcgctgagatgggctgaacaggttcagtattatttatggcattattttcatttgaattttcaattcgcttaccctttcgattgccattccgttggattcgtcgcaatccgacaaaaaggcgcggcgtggcttttt

SEQ ID NO: 38084 - DNA, 1578 bp, Heterodera glycines
  misc_feature (13)..(13): n is a, c, g, or t
gtaaaaatcaccnatttgacacacaaaaaagaagactcttctgataggcgccagcagggaaatgaaaattgagaggcacttattatcccaaaaatgatcaaactcacgatttttaagcaaatttattaaaatgaaggaaaaaattaaaagaaaaaatgtgaaaaccatggaacacagggaattgaactaataacgaacggcatacacaaaaaattacagaaaattttagcagttgaaattgtacaaatttccaaaaatgctttgagttaaaaacatgcataataaatagtaaattttcaaatttatggcatttttgatgctgaactgcggggtcttgccggtctagtacgaaatcggcgcaagagtatcatctgtcggaggtttggtcctattgtgcgccaccggaaataattttgaaatttagtgtatttaattaatggcagtatttgttccaaagtggtgtttgataaattgtttgatcaacaattcactcattgaccccatctgttgccctgatcatgaatggttttcgccaaattgtgtgcaattaaccgaaggcggttgttatttttagaatcaaatgtggctgattttttcataactctttttaaacgactgttgtttgtttcattggtgtttaatgaacagagtgggagaaagattcaatttgatcgagtacaattaattaattaaccaattagtaattgagtaaaaaaataaataatttccatttgtatcgctcactcatcaactgctgattgaatcctttcagtttttagcgaacatttacctaataagtttttttcgtacgtcaatcatcgtcatgaactgctgctctttatgaacaataaattggccacttttttcactattattttacgctatttaagcactaaatttgcagagggagcgatcacttttcatttttccaattaaatttaatcagtgacaaaaatgctccacaaaagtgtgcttctgatcactttacttcttctgatcggtgctttcatgcaaataccaaccaccgatgcatggggtaattattttcattttaaataaatttaaatcgaaaaatcacacacaaaaaattcaggtggttggggcggtggcccgggatggggcggtggacgcggctggggaggcggacgaggctggggcggtggcccgggatggggcggtggacgcggttggggtggcggccctggatggggaggcggacgcggctggggatggggcaaaaaataaaagaaaaccaaaattaattccatcaaaataacctcatataataaactcatgtatttgcttttataattttttgaactcgaatattcgaagcaagtttgaaattttattagcattaaaaaacaaagtcagtagatatttatttataaaataaataaataattaattgaaaaaatcgattttacaatttcattgggacgtgaaaaaatgaaaataggcaacccatttcttttggtgctgggacgttagtcgaaaagccatcacatggaaaatttttgacagaacattattcataatttcgctagaagagatgcatacaaaaacgaaaatacgcga

SEQ ID NO: 38085 - DNA, 878 bp, Heterodera glycines
gtgcttttcgtgtgaatgttgattttccaactgagtcccctttgaaaccgccatccgtgacattcgcaaccaaaatttactcatcctaacatcgacgataagggccaagtctgtctcggcatcattctcgcggagaattggaagccggcaacgcgtgcagagcaagtgatgaacgcgctgctgtcgctgattgccgagccggaaattgctcatccgttgcgctccgatcttgccgaggaattccaacgggacaagaagaagttcttcaaaaatgcaggtggagtgtcttgctattttaatttttcttacaattaattttagaagactacacgaaaaagtatgccgaacgtcgcgactgagtttgtttggacagatggagttatttgtgcatgaaagtcccgctggtatctacgaataatctctcgccactcaaattgttcaatttataaattattgtgttttgtctgtcgttgattattttaactttgtatcgatttaaacttgaagaaaatatattaataaggattctttgttaggatgtggaattccagaccattttgttttttgttcgtttgtcagtcgagtttttttttttagtttttcaaaattttcttagggcttacaactgatcgatgtcaagtgttactttgctttttctttggtttattttgttgctaattgatgcggaaattgacgtggacctaaggtgaggttaaattcatttttaattagttttgttcggtttagcgttgacaaaactaattggatcgatcccagtgacccgttttcaagctccgccctctttagaagtcatctggtcgagccgaacaaatgcgaccctgaccaaaatttgcagaaatgcattcaagtaattacta

SEQ ID NO: 38086 - DNA, 1079 bp, Heterodera glycines
  misc_feature (65)..(65): n is a, c, g, or t
aaatgctcttcgagcatgatagggaagggcggtgcgcaaattagaccctttttatttttgagggnaatttttaaatttatactctatcccagaaaaaatgtctatctctttttttgataaattttatacacatacaaatgctctcgagcatgatagggagggcggtgcgcaatagaccttttatttttgagggaatttttaaatttatactctatcccagaaaaatggctatctctttttttgataaattttatacacacacaaaagcgctcgagcatgagacggagggctgtgcacaatcgccattttatttcacagaggatttttatatttagaggttatcccagaaaaatggatatctctttttttgataaattttatacacatacaaaagctctcgagcatgatagggagggcggtgcgcaatagaccttttatttttgagggaatttttaaatttagactctatcccagaaaaatgtctatctctttttttgagaaattttatacctcacaaaagcgcttgagcatgagacggagggcggtgcacaatcgccattttatttcacagaggatttttatatttagaggttatcccagaaaaatggctatctctttttttgataaattttatacacatacaaatgctctcgagcatgatagggagggcggtgcgcaatagaccttttatttttgagggaatttttaaatttatactctatcccagaaaaatggctatctctttttttgagaaattttatacctcacaaaagcgcttgcgtatgagacggagggctgtgcacaatcgccattttatttcacagaggatttttatatttagaggttatcccagaaaaatggatatctctttttttgataaattttatacacatacaaatgctctcgagcatgatagggagggcggtgcgcaatagaccttttatttttgagggaatttttaaatttatactctatcccagaaaaatggctatctctattttttgataaattttatacacatacaaatgctctcgagcaaaagagggagggcggtgcgcaatagaccttttatttttgag

SEQ ID NO: 38087 - DNA, 1532 bp, Heterodera glycines
atttggtgcaactaatgttaaaatgaaaaaaacaattattttgcttattgcgctaaaaaccagcgcactctcgactacggcggccaataggtggggcgagactacgggctccggaagaaatccgcgcgtgatccgcagcaggttcgacttcatccccaattattagacttaacttgtcaagagctttcgaatcatgccaaaattgctgaaaatttttatttaaaatgtttttctggttgattttggttcaatttttcgtgatttaaaccgattaaaaaaccgttttttattttccgcgcctagggactattattatgatgcttagaggtcattagagattgattgcaactagttttaggcggtttttagcggaccaattctatttgtttagaaattatttgcggcaaaaagaagtgtaaataaaaaagtgaagaatttattacattaaaaaaataacagaaaaaaggattcacaaaatatgaattacaaacagtataaaacaaaaaaaggcaggtactgtaattgtgctactatcgactgtattcccaaagtcaaagggcattatttgaacgcgtttgctgcctttctgctgatctattctacggtgtctcagtgctttacgttagtgtatacggtaataaatggtcgtttggcatactgtaactctctctctctctcattctctttctctctctctctcatttggcgtttcgtcctccccacatttcttcactatgcttcgactttgcttttggaaatggacttcttgtcctcctcctcgtccttcaccagcggaatgccatatcgaatcaattcgcagcccaactcaaacaaatattcgtaacactccaacctgtgcagaatgccaatgtttccaaatttaaataaaaatccaattttaaaaaggcattcccacatcattttggtgcgttgccaagtgttgctgccgaacgcaaaaaagccatggccgcggacaagaacaccactcgcctcggggaacttttgcagaactttcatcagctgaggctgaaaaagcttaaccaacggctaattaagctaacattaaaaaaacaatgaaataatgctaacaataaaattaaatttgaatttccaattgaattgaaattggcacggcttacacaaagaacgaattcgctgatttcagtctcgatgatcggcaccacaacagtgtcaatgttttccattctgcgctttgtctgacgattctcaatgccctgaaacctttcaattatgctaatttgactcccttttcatcacttggatcatttcttggcccgaaatcataaacacgtcgccggtgatcagttgcgtgatcaaattggcccattttgtgtgcgtgtgaatgatgcagaccaaatctgaatgaaaagtacgaatttacttttggataggtggacggtgaacttaaacgttggcattttgaataagaatttgtgccgttctgtttccaacccaccggggttatcgcgcagcaaataaaacggtgccgtcggcgttctgtccgggtctga

SEQ ID NO: 38088 - DNA, 895 bp, Heterodera glycines
ctcccctattctcttccccccctctctctcccttcccattaagggccctattttatgcatgggctaggtgggaacacctttgacactttctcacataatatttcgaaaagaaattatttgccggaggcggggggggggggaccggaaagaaaaaagagagaaattcaccgacacaaaaaggattacaggatgagaagaaaaaggataaaggaatgaatgcccgggagggtcaaagggaaaaatgccaaaaatagccaaagggcggcacaacgccaacgcattgagcacataaataatatgcctcaaagaacagctgctgccacttgtgctgcttttgtctgtttgtttttgctattcccgagaaaaaagaagtgatggcggacataaaaataagacaaaaaagggaaacgaaatttgattaatgggcaaattatgagaaaaaaaaacatgcacaaaaagcgaaaaaaataacaaactctcggccaaatgtattcacacgcaatgccaaaaaaggaaacattccccgcgggcattagaaaataaaaaataataattaattgcatccatttttggcacataataaatgtggcggaaatttactgctaattttgcagaaaaagggacaaacagaaagacaaaaagaatttataattgttggatctattaacacccaaatgttccgttcaggtcaaaaaagtgaagggaaagtgcgtccgtttgcacggcggccaaagcgcgtgtcaaagtgcggattatttggacccggtgaacgaggactgcatgttcagctgaggaggcacagcacacagcacaacagcagcagaaagcatcaatccctaaataagcatgcgtaaaggggtcaattaataattgaacaatttgagtaattacataa

SEQ ID NO: 38089 - DNA, 1132 bp, Heterodera glycines
ctaaagtacaaatgccataaataaataaatattttcggccctttaaagtacaaatgccataaataaataaatattttggcaccctaaagtacaaatgccataaataaataaatattttggcaccctaaagtacaaatgccataaataaataaatattttggcaccctaaagtacaaatgccataaataaataaatattttggcaccctaaagtacaaatgccataaataaataaatattttggcaccctaaagtacaaatgccataaataaataaatattttggcaccctaaagtacaaatgccataaataaataaatattttggcaccctaaagtacaaatgccataaataaataaatattttggcaccctaaagtacaaatgccataaataaataaatattttggcaccctaaagtacaaatgccataaataaataaatattttggcaccctaaagtacaaatgccataaataaataaatattttggcaccctaaagtacaaatgccataaataaataaatattttggcaccctaaagtacaaatgccataaataaataaatattttggcaccctaaagtacaaatgccaatgtgattagtagggctgccaattatatggaaatccatattttttcctggactgcggtgagcctgaaacgcacgaaaaacatgtttttagcttagtttgaagcttctaagatggatttctatatccatattttccatatttttttcatatttcgcgatttatgtccatatttgtccatattgaataaattttaatttcttaaaaatcataaatttaggtcaaaaataagcaaaaaaagtagtttctagttgattttttgctgaaaatgagtaaattttagatttatcatttttttcttctaaaatgatttttaataccatatttagccatttttaaaagttttactttaatttagcgaatttgaaggaattttgaaaatttaaatgcaatttcaaccaataaatttgaagaaatttttaaactcaattttgaaaaatttatatccatattttgagatttttgccattttatgtccatatttcgtgatttttggtccatattttatggccatatttcgcgattttatatcaatatttttgg

SEQ ID NO: 38090 - DNA, 545 bp, Heterodera glycines
atttctaaggctgcttgagagagaagatgctaggcatgagcgctacaaattaaggaatattaattagtttattggtacataattaatgctcattggtttgaaaaatctaaaatagcttaaattaagttattaaaggcaaaagaattagttaattaacattcattaacaaattagtttttaaatcgaattcagtttcagaaatgtgcaaaaagaaagtgacgaggagcaacactgaaaagaaaagaaagaaaactatgaaaggggaaaatgaaatgagaaaattcactgaaaaaattttaatttttatttattttagagtgccacgggaccgggaccgggccgggaattcccggtcatccgaggtcccggttcccggtcccggattttgaaacgctcaggtcccggtcccggtcccggtagggcaaccgggaaccgggaaaaacaatcactggtaagaatgggggtctgagtgaaaaattagtgaagaaaattagagttaaaaggaaaaatttttttaaatatattaatatattgtttaaaagtaa

SEQ ID NO: 38091 - DNA, 1690 bp, Heterodera glycines
agagatgcgccgtgattcacggtcacggtcacggttaccgtgaatttcacgggtttttttcactcacggtcacgattcacggtaccaattcaaggttattccgtgaaaaatttacactggataaaattgaaaatttacgaattacatattgttttcatagagaaatttggtcattttttgggcaaagtttgctaagaaacagagcaaaattatcttttttgaacaaaaccaactaccaatattgtacgaaaaacaaataaaaagcaaagtttcaaggatgaccccagttaaataaaaaactcattaaaatttttttaaattcgctcaaataaagttaatttgggcaaaatcagtttaaacaaatcccattttgcaaatttacccttgaaatattttcagaatattttgggcggacccccgcgctgcaccaatccggacgacccactcggcttcagcaatattctgacacgcgttgagcaaatcttccaaaatcggcaaaggagtgccggctttagtgagggatgagaaggcaatcagcggcagaggacatttgcgagccgacatttgggcaccgagaaattttaaatgccattaatttgaaggtgcctgacggagcaattaaattttaattgtcttattaatcagtgtatttaatattctcagaatttattttgtattatgaattaaaacaataatgctaattaaagttttttggcatctaaatgttgacaaaaacgcgttaaggacgaccatgataaaaaaaaattacgtgaaatgtaaaattaattttgagaaattaattcaaatcattgtttaatctgacaaacatatatcttatgtagtcctttttattaatcagagactttgtttattcacataaaaaatgttttctgttcattaagcctttctccgggaaaatggccgtccgggaggagcgtgccatttgcaaaaaggaatttcggcacttttgtatatatctccggactctctgaagataataaaaaatattatgtagcaatattcggtaattgtgcaccttttgattaaatttttgtcatttttggttgtatttgaaaaaagttacaacaaaaaatttgttttgtcaccctgtaataccaaaataataggtttattagaaatctaccaaatagctcaaatttcaaatatcctcattcttaaaatatttgtgtttttaatctaattaaaaatatgaaataaaagtttgtaaatatatatatatatatatatatcgtatattttccagtttatacatatgctaatatttttaagattttttttagctaaagcataagatggggaaatcattcataatcaattcctctttctacatattgtcaaatattgattccattattattatattttatttatattttaataaaaaaattaacactaacgaattttcattcttattgcatatatttcttttttaatataaaatctttctgaatggttgcatttgttggactacaaccgcgacatgtttatgtcgcttttttaattgtttttgtgcagttgttcttgccaatggtgtgccaccgtcggcttgtcgtcgacgctggcaaagcaaattgtggcgacgatggcacggggccaaaagctacggatgctaacgataataggttatcaacagcaaaacaagaaacctttggccgaactgaggacctgc

SEQ ID NO: 38092 - DNA, 492 bp, Heterodera glycines
ctacacaatacagtacgtgcgtcttttcatgtcccacttttgtaccttctctccttttctttttgtctgtatttgttgttttttaaataattaattaactcttccgtcgttgactttcattttaatacgtttgtaagaataattaaaataggaaaaaatcattaattaggacaattaattgtgtgaaaagtgcatagaattgaacagtcatcttcttccgatcattcattcgttttctgtttttttcgttttcccgttgattttaattcccccccccctcaatttgtgctgttttttgagtgattaattggttaaaggatggaaaagtgatttggaaattcaatattagtacaattgagcagttgcaaatgttcaaatacaattggaaattggcggtgccattggcagccgaaaacggagggaaatggcacaatcgaaagggaaaattggcggaattttgattatggaaagcaaacattactttgaaataag

SEQ ID NO: 38093 - DNA, 994 bp, Heterodera glycines
ttaacttgaatatttaaattaagtattataaataatttctcctaagtactttcatctttttgtctgaccagtttctggcttttgtaggcgccaatatagttttttttggcatttaggctaatttaacaccaattcaattaagtcgaaccttaaaaaattaaaatcataaataatttggatgataatttattgtatttatttatgcattctttcttatataatttgcttcaattaaaaatttgttttttacaaaaaatttgacatttaataaagaagagcttttgtattcaattattaatttttattttattatataaaataatcttatatattaatttttttattttttggaaaaatgtttaggaaaattttcttaaattagtttatattgaaaatttcgaaatcttctttattagatgaaatacacttctaaatcagattttaaattaatttacaaaagtttttaaataataaacaataaataggttgaaaataaaaatttaattctaaggattcgattattattattttttaatattttgaaaaaaaattacatttttttatttttacatttttttatttataaatcataaaaaatatggtcctttcttgtcgaataaaaagatctacttcagaatttagtgttaatactcaaaataataatttttttattactgaattagtgatattcagaaaaatataataagatttatttttttttaaataatcaaaaaatatatattaaaattttaaattatttaattattgaattttttcattttcattcatttatttattccttaattaatttattaaataaatagttaatttcattttatttattttttatataattcttgacatagtgctaattttttttgtttcgtagcttaacgatgttttactttgtataaatttttaatttgtactttttattttcctttattccgttttatatatttaatggtactttataattgaaaaatatattact

SEQ ID NO: 38094 - DNA, 1485 bp, Heterodera glycines
tgcttgatcgattttttctgccttttttccaaccacgttaaattggaaattggcttactaatttttctcggattttttatggtcgaaaatgaaagctgacacaacaaagacaaactttttctgtaaattagaccagcagaatccgaatatgtcttaaatctgacctatctttgctacttgagcttgtagtgcttcaattccatgcatgaagttggagctgtacaggttcagtgagaattcagagatcaaatctaaggctatgttcgaactcagcgtggtcggtttaactagttcaattaaattcggaatttccaagacccctattaaagaattttgttatttgatggttttgaaaaatgccgtttctggaaaccactttcagactcggcccccccccctcaataattcaatttttatgaaataaaactttatattttagtattcttatagtactaactttgctctatttaatcactatttctcagcttctgtatctctcttcgttttctcaaaatcagccaccaaaaatacctacctcgaaaatgaccatttttgcttacctaattagctctaacttcttaaatacgtttccattgggattgatcttttacctgaaaaatggcaacacatcattgatatgatttgaatttataacattatttccaaaaattttacaaaataattattgttttaaatcaaagtgactcagaaccggcaaatgtatgtgaaaaaaaattacaaataaaaaacactttaatttttacatatttaatttaaggattctgagtttttgcgaatagcttagactcagaaaaagacaataaaattttaataataaatatttatcataataatatggaatatgtcctgcaaaaaaatactaaattaagatatttaaataaataaaattaatttaatagatccttgttaaattaaaatatgaaaaattacaatattttttcgataaaaattttcatgaaatataaatataaaacagctattaagggcccgatggacaaagcaaaacactaagtccgacaagcatggattggctacacgattttatatgtaattcagaatgataaaaaaactaaaactaattgagtgtctctgattatgtttaaattgccagttgggccttcggcaagccattaataaatttatattattaatttagcgaagaaaataaatatatttgttttacattttttgtttgtttgtgttgttatgcgccttttaagttaggtgtttctacagttgggccgaaagggaccgtacagacgagttctgtccgtaaattctggacgcaaaaaaattttcctcgaataaaatgctattaaattttcataaaattggattaattcgaaatattccacttcatcaacaatatcaaaaaaaatctctacaaagcatatttagagtattgtgccgcaaaatatgaaatggaattattttcaaataattttagaacccaatttatctgca

SEQ ID NO: 38095 - DNA, 1278 bp, Heterodera glycines
  misc_feature (73)..(73): n is a, c, g, or t
  misc_feature (1171)..(1171): n is a, c, g, or t
  misc_feature (1216)..(1216): n is a, c, g, or t
attcgaaaaatgccattttttgatggcatttctccttttaaaaaacgcattagccatccatcaatcaggcggntcgctttttttttcgttcgttctccgaatttttctctctttttctcctcaaaaagcaatctctgctcctcctctactccaattcaaatgtttgtttgtttgttttttcaccattttcagccaaattattcagcacagagttttattttatttctttttgtttggaattttcgtttcttttatttaattaaatttatttttatatatacacttatttgtttgttttttgtgttttgttttgttttgtcctccttttgcccaatttcctttctctcctcccaattttatgatgagtgttcgttcattattaaatcataagccattccattagaattctattttaaaattcgcattacaaacaaaatttttaaaaaatcgaatttttttttttggaaaatctccaatgggttgattatacgaaaactcgaaaaaaatttttttaatgtacataaccctctagaaaattgtttgtgtaatgtcaaaccttctcccctccccccacacttcctccttattttgtggaaatctcgactcttccaaagcccaaaaaatttaaaaattacaaattttcttcccccccctaaggggcattcaattctctttcttctctttctctgttgttttctctccaagcgtgtctgacaaattgttcaaaaatcgacaaattacattatacaatattaattattattttattaatttattctcttcttcccaggctttgtctcccggccagaaaagtccccactcatccgaatcccatccgaaaatcctctcaatgccgaattacgatgtatttcatgtttcattattttttcttaattttaacagatttaactttaaacaaattattattttcaaataataataacacatttatttcaaagaccgaatacacacacacacacaaaatcattgattgatcagagaaacacagcattttgatttaaaaaatatttctatatttaaatatttcattttttgtttcaatccctctcactctccattttaaacgagctattttttcttgtgtttactttatttttcgttcgcctctttcctctctaactttttatgataattattaacttttttattntattttttaaatttgaactttaattattttatttttggtcactanatctaaataaatttattttttatttcgacaaacatagataaaaaaaataaattaaaaaaaaa

SEQ ID NO: 38096 - DNA, 1048 bp, Heterodera glycines
gtcgccaattttccatccgtcgatttcgactcgtacgctggcaatggcattcagctgctcgtcggtcatttcaatggcaatttgcccgatgaaaagcgctcgttggtggccaatctcagtttgggttgggcttttcttttggaaatgtgttcattgatgctattcgttggaagaggaaatcaatgccaatggattggcaccgcgcgaaggcgccggagaaggcggaaaagcggtgccattgacggaggaggaggagaggagggcacaacgcacgtttggcatcaatcaggcgagaacaaagagcatgggcaggcagtgatcataaggcattcagttcaatctgatggcgagtgatcggatgtcgttgcgccgatcactgcccgacgttcggcgaaggcaatgccgccaaaagaaataccctccggcggacaaattgccgaatacaagcggtagggagggggagagggaggctgagttgggcattgggttgctgaaaatgctgatttttacttgcccagtgatcattgtcttccacaacgaagttggtctctgtttgccattttccattcaattatcatcctcccctcgaggccttttccacccttgcgcgaacaattaccaggtcagttgcaacacttgtccattaatgactaatgatgatgatcaagcactatttgctaattaccctcccttcccttcccctgaagtgtggtctcccactcgcctccttcgcttgtccatgaactgattctcgtcgacgatttctcagccagaagtttgtttcttattctcttctctctctctctccctctcgcactctctctatttctcttccttccccctctctccttctctccccctctctctcagtctatctccccttcattttccctttatcttgtctcagaatttctccgtactgaattggaacagtttctgaagcgtctttcgattcggactaaattgatcagagccaagaagcgtgttgggctgatccgtgctcgtctggtaacccttaaaattctctctgtcccctttactgcccccc

SEQ ID NO: 38097 - DNA, 550 bp, Heterodera glycines
gtcacattgacaattttgaaaaaataaaattcatttattaccccaacccctggtttattttatgaatattaaaaaagagaatataatttgcgttatattatagacataaaagaagaaaaaacattaaaataatattaaagcaaatgacgatgattagaaaaaaacacttatataattgcgataatagagtagagcggtaccagtacaggtaaaggtacttaattattggtaccgttttttgatgaaaagctgttctgaaaatcgccctatttcaaagtcaaaatataatgtaattaaacatatatgaaaaactcatttctaacgtgaaagataataatctaggcaccatgaaatgaaaaataatgcaaatttaaacagcaatttaaagcaaatcattaagaaataaatacaaatattaattaatttattgttaagcattttagttgtttttcatttgaaaaagttaaaacaaaacaattcaaaaaaaacaatttcttggatatcagatcagtgtaaacaaaaatattaattcaaagtgaatttaaaaaag

SEQ ID NO: 38098 - DNA, 913 bp, Heterodera glycines
tggcgcctatttttgcaacaattcttcgagccctttgctttttttttaaaaattaaaatccgtgcccaaaattgaaaatacaaaattttcttcgagtgcataaacttttactgtcaccatttcattttgttaatttctaatgctgtcttattatttcactgaattcttatgtcgattggttatcattttttgggtgtttatttattggttttttaatttttttttatttttgcataaaaaatcctatgacaaaacaccaacaaaaattacgaaagatcatacaagagttcggggaaaaattgcgtgaacgtgttaacaaaaaaagtgatagggattcctgaacggcattctagccttttttctgataccgctaaatcccgtccattttaacgggaatcttgtctggaaacatgaataattttcgaataaaaaaaagttttttttttgcaaaaattgaattaatttctcatgcaaaaattaaaattaaaaattttttttatgaaaatatgtagcaaaaaaaaaattacaaaaaaagcagactcactcaacatttcaaccgatcaaaaaattgttttttatgtaatttttgcaaaaacgtcgggttatcccttgcaaaatttgttctgagagatttacaatgaattttcagcgaaaacgatatttgttaaaaaaaggaagctatttataataaaaagtttatatggccaacgcaaacagaaacaatttgtgaaggaattgggcatttctgaagtgacatttttcaaatggaaaaaagaattaatggcaaattaccataagaatcacagtaagaaattttgtaatttatttatttaaattattattatttttttagtgaaaataaatattccaatgaggacaaaccaaaaaagatgaagcaatattttgaaatcaa

SEQ ID NO: 38099 - DNA, 770 bp, Heterodera glycines
tggcaagaatttcttattttcgacggcagcaatattggcaaggtcggttcctgtaacaaatattctatcaggcgaatttcaattatgaagagatgtattctcgttacttaatcgggacgtattcacagtttttttttaatgacagttttatcgatcaataaacaattgaataaaaaaacaaaaagaatgttagggaatgtttcataatttgtgagttgattttgaagttaaacaaatttttgaaaaaattaccgattcccgcgtgtagaaataggaaaaatatcatccttgaatgatggagataatgaagtcatattgtaatttaaaaataaatttagtttaaattaattaatcttgttattctcttttcttctttaaagcgtatttgttagagccgaagccgttcccgcccccccccccgcccttcaaaattttgaaaaaaaaataaaataataggagactcagaattttgaaaattttttataaaaactgatgacaagctaatgtgataaaacaggttaattcttttcctttcagtatccctgcaaagtttggggcgcttctgataagtttctgaaaaaaaagttaagcctaaactttttggcctgtttaaaaaggaattaaaaatttttaaaaatttattcatctccctttttgatagaaaaagcatcagagtgcctaaactagcatgtaaataaaatttggtgcgtttcacaagctttttctgaaaaaaatatttatgaattaattatgcaaaaaacaaataaaaa

SEQ ID NO: 38100 - DNA, 1036 bp, Heterodera glycines
ttttgagaaattttatccgttccaaaatcccttggagcctgataggaaggggcggggcccaatccccatttaatttttcggagaattttttaaatttttttttatcccagaaaaaatgctatttttttttttgaggaaattttattcgttacaaaagcgctcgagcgtgagagggagggcggtgcgcaatcgccatttaatttctcagagaatttttaaatttatcttatatccaagaaaaatgactatctcttattttgagaaattttatacgttacaaatgctctcgagcatgataggaagtgcggtgcgcaatcgcaatttaatttctcagagaatttttaaatttattttatatccaagaaaaatgactatctcttattttgagaaattttatacgttacaaatgctctcgagcatgataggaggggcggtgcgcaatcgccatttaatttctcagagaatttttaaatttatcttatatccaagaaaaatgactatctcttattttgagaaattttatacgttacaaaagcgctcgagcgtgagagggagggcggtgcgcaatcgccatttaatttctcagagaatttttaaatttatcttatatccaagaaaaatgactatctcttattttgagaaattttatacgttacaaatgctctcgagcatgataggaagtgcggtgcgcaatcgcaatttaatttcacagagaatttttaaatttatcttatatccaagaaaaatgactatctcttattttgagaaattttatacgttacaaatgctctcgagcatgataggaagtgcggtgcgcaatcgccatttaatttctcagagaatttttaaatttatcttatatccaagaaaaatgactatctcttattttgagaaattttatacgttacaaatgctctcgagcatgataggaggggcggtgcgcaatcgccatttaatttctcagagaatttttaaatttatcttatatccatagaaaaatgactatctcttattttgagaaattttatacgttaca

SEQ ID NO: 38101 - DNA, 1067 bp, Heterodera glycines
cccccccccccaactaaatgtaactttttcatcaaatgaattctgtggtcgtaaaaacggacaaaaagcaaaattgtaacgacaaatgaatgaattacgcaaagcgatttattttgaaaaacaaaaaatcttttgggcctttttgaaaaaaaaaattgtgaaaattttgcgctttcaccggttgaataaggcgtgtcaaagcaataaaggcattcgtccttgtacacaagctcagcgcggtctggacccctcaaattggtcgcctcttcactcaaatatgtttgcagtaatttatgtgccgctgctgcttcatccatttttagtaataaacaaaagaatatagggcgtttctcttaaaatttgaaatatgtagtaggggtcggggtccttttggcgccagcgcgagttttttgattataactttttttctttttattaaattttcaaattaagaacatcaaggccaaaaaataagagaggcgagcagacgttgtgtgagagaaaaatagtgctataaattaagaactgctgcattggaagagtcagagaagggaccacaaagtgctcgcacagcatcaaatattttcttcattttaggcgtcattttcccccactgcacctctttcttcggtttaattgcccaagtttgaggtacttggcgtatcctgcccataatatctgtggcatggaataaattttgggactgcgctgcctgcctaacggcggtgcttaaaatcaggaaaaatgcatctgttattttggtctttttaattttgtttttaaaatcaaatttgtcagaaaacagaatttattcaaaatttttgaggtgatacattaaatgaaaaaattcataaaaaaaatttaaaaagagattatttgttggatttcctttatttttttaaatcgaacatttctttttatcagaatttaatttttataacatttaaattttgattttgacataatttataacatcaatgatgaacaatttagaaactttttttttctaaaataaaccttaaaatcaaccaaattttcgcagaaattgttttttttaatccactaat

SEQ ID NO: 38102 - DNA, 892 bp, Heterodera glycines
ttttaatgttgtgggacaattagagcgatctgaggggggggggggggggtggtgatttaaaatccagggagggtcctaggagagaggaggtacgcgagaccggtccagcgccgttttcgtacggccacaagtttttggctataagtttttttctttgccaatcaaatccaacaattttggtatatcgatagccctgtgttgtgggtgctttgtctgtgggccctttgtctgggagccttttgtctttgttggtcctttatctgtcgatcctttgttactgtagcccgaaatcctaattgggcgaagaaatatggtggccgctttttagaatttcatcattttttagagtcccattttttctacgctgctttcgaaaattccgtctgcacagattatgtgacggagaaattttggatggcattgcgcaatttgattgtgccaattgtgttaagccgaaaagtgatggaagaggcgggcattccgaatggcacttttattgcggctgatgattttgacaatgtgcaagcattggccgaccatttgaaggcattacaaatggacacagacaaatacatggggtaattagtgacaaaaaagattgacacattggggataattattggaaatgattaataatttgggataattaataggaaatgattggcaaatacatggggtaattagtaataaaatgattgacaaatggggatgggaaatgattgacaaatacatggggtaattaatgaaaagattgacacattggcgataattaatcggaaataattataatttgagataattaatgggtaatgattataattagggttaattaatgtgtaattattgacaaatgaggataataatggaaatgaatggtgttttcttaattgca

SEQ ID NO: 38103 - DNA, 1243 bp, Heterodera glycines
  misc_feature (1236)..(1236): n is a, c, g, or t
acgccctgccgacatcgaactcaatcagctcgacttttttttgttttggttttgaacaaaacaattttgattgttcaacctttcagttgttgttcatcaattgttaatcgtcgtgagcagtgagcatcaaaaaaaaaatggccgaagcagcaattcaccaactgtccgacgtgttccagcagttcttgactgctcagcaagcaaacgcggcagcaccagcacaaccgactccaatgccaaatttggcaaatttcgactgttttggtcttggtgaccatggcgaaagcgacatcgagggttggctggaacgcttcgcccttgcgcttgactgctcaacaccgaaccttcaggacgaattgaaggttaagctcttgctgacaaagctaagcgaatcggcctacagcgagtacaccaaacattgtttaccgaaaaagccaacagagtttgactttggcaaaacttccgaaatgctgaaaagcttattcgcgaagcacaaatcagtttggatcaaccgatatgagtgcttaaaggctgaaaagcaagacgaggaggaatttcgcggcttcatcaaccgccacaaaaggctgttaagcgattttgagtttaagaaactcaacgaagagcagttcaactgcttgatgctcctcgtggcgcttaaatcgccgaaggatgctgaattgcgaaagcgcatactgtcaaagttggctgccgacggtgacagagcaacatatgaaagtgttgttaacgacttacaaatgtttctgtcgaccatatcggaggcaaaagtaatggagagaccatcgaactccaatattttggctgtaaagcgcagccagcaaccgatgatgccatcatcgtcgccctgaggagtaggcagcgggggggagaagagaggaccacattaaaggcggaagaattgggcggtggtggcacagagcaaagcaaaaacaaagcggcagctataaaacaaaaagtgcgttgggatggaaaaacattgcctcaggggacactgggggatgaccaccaattgcaccacgctggctgctgaaatgggtatttgtggaaattttatagtgagcaaagtgtggtgcctggggaaatttgggcggagggacggcttttaaaaaaaaagtggcaataaaaacaaaaaaattaattaatgaaagaaatgataaaaaacgcaaaacaacaacaaacgtaattattattgttattgaagcctgctttttattccgnagaacct

SEQ ID NO: 38104 - DNA, 1190 bp, Heterodera glycines
gtgattgaatgtccaattcttatgccaaactattcgtttttaaaaattagaatcaataaatttctgatcagactccgattaaaattttggaatttaatttcatcgatatatacaaaaattctcatttattcagaaaatctaattataataaatcttgatcagaaccgaaattcattgttacttacttgaattaaggatggcctcattttgtacagtgttcgaatttcattggtactctcatgtccaatgcatcttcaggtaaaaataaaaatttatattattaataaatttatttttaaataaagtactacccaatggatgtgcaaacttgcctgatcgatttggcatcttatgcatacactgactcggacattggtaatctttcttaataggatctaataattcatttttatcctgtcttcattatttaattagctacatcaatcagggattcctagaaattccgatttacgatagttttggggttgaattccgattcataaattggctttggcatctctattgaaatccttccttccgtgcttttgtagacctcttattcatgagatttatccagttctcaaatgagacccgctttcgtctacttttcgtatttatacatagaagtgatccaaaaaataataaaatttaaaagtaattcggacaattttctccatattttcgaaaatcttttccggaatagaattgctgtcacaataccaaattatgctttttagaatatcgctggaagcaacaagaccccgttcagcttaaggacggacttgagtgagtttggaataaataagtgtttatttttaaatatttttttcaccaattttcaggtcatctttgccgagctttcagctgacgaacgtgtccacaacctcgtgcacttcaaagacaaatacgggcacatactcgtaaacatattaaactattatttaattaaaacccgaccatttgtgaaatgataaaattatagccgcaatacattcccccaatcccaccccacctcttgaattacttagcccagctatttgaaaataaatttatatttttattggaaaaaactaacaaataaaatttagaaataaaaaaaaattcagcttttcaatgtttttggtggaatgccatgatcacatgaacttattagtaaacctcaaaaatagttaatttgagtttttaaatat

SEQ ID NO: 38105 - DNA, 755 bp, Heterodera glycines
acggaaaaggtaatccatcgggtttttgtcccttaattccttcacttccctctacttaaaaattaccaataaaataacaaataattattatgctaacaaaacttaaaaaaatataaattaaataagccagaggcactgaatttaaatacagtatcgaattccccgcagtgattgtgacaccagagcgctaatttcctgaagtggtagaggattcaaattgattggacatgataaacacagattcgtttatgcaaatccaaatatctttagtttaatatgaagcatatttaaaaatgctaaattattgctacacatgtcagtccctaataagtttgaaaaggtatgaaaaaaaattaaataaaaatgaaataacaaaattataatataaacgctgtttaaattgatgtacatataacatataagacgttcagtacataaatttatgtaaattttaacatttatttaaaaaatatatttaaattatctaaccccgctagtttacgatgaaaaatgagctaactttaattaaatttattatttaatttatttaaaaatatttggcattctgtcttagaaaaattttcaaaaaaataataaaatcccgcataatcccgcacaaaaaatcaaatttgcggatcccgctgcgggattggaactcaaaattctttgcgggacgggatcccgcttggattaatcctgcaagactgggatcccgcaaaatcccgcgcgggatcccgtcccgcgtcggtctctag

SEQ ID NO: 38106 - DNA, 848 bp, Heterodera glycines
agaagggagtgggaaacatgatttcaaaattttcaattttttctagtctaatttactcaaaacggttcagaattcgataaaaataacattcccggtgcgaaaaatggggtttgaaaagtttattggggaaaaaaagacttacaaaataatacccctgggagaagggagtgggaaacatgatttcaaaattttcaattttttctagtctaatctactcaaaccggttcagaattcaataaaaataacattcacggtgcgaaaaatggggtatgaaaagtttattggggaaaaaaagactttacaaaataatacccctgggagaagggagtgggaaacatgatttcaaaattttcaattttttctagtctaatctactcaaaacggctcagaattcaataaaaataacattcacggtgcgaaaaatggggtttgacaagtttattggggaaaaaagactttacaaaataatacccctgggagaagggagtgggaaacatgatttcaaaattttcaattttttctagtctaatctactcaaaacggttcagaattcaataaaaataacattcacggtgcgaaaaatggggtttgacaagtttattggggaaaaaaagactttacaaaataatacccctgggagaagggagtgggaaacatgatttcaaaattttcaattttttatagtctaatctactcaaaacggttcagaattcaataaaaataacattcacggtgcgaaaaatggggtttgacaagtttattggggaaaaaagactttacaaaataatacccctgggagaagggagtagagaacatgatttcaaaattttcaattttttctagtctaa

SEQ ID NO: 38107 - DNA, 505 bp, Heterodera glycines
aatggttgcttaacttgtcagatcggtcgggtgcgcatgattccgctgttccaagcaccccaccaaaagcaaatcgatataaccaaaatataaggaaaaattttttaaaaatttttttctccatcttcctttttgatactaaagcatcagagtgctaaaattaagttgtaaataaaatttggtgcgatttagagcactttctgaaaaaaatatttatgaatcaaaaaaatcgataaatctgggctcatcggttcggggggactgccccgaaaacaaaaaaatcgattttttcaagtgtccgtttggggtactcaatcaattatggggagcaaaaatccaacgcagaattaaagtacaggctatagggaagctattcccggacccccccccccaaaaaaaaagttttttttaaaaaagcgcatcgcaaaaaaaagcgttttttaaagaagaaaaaagtcgtcgcctggctaaaaatcgcaaaaatctgccaattttcgaggaaaat

SEQ ID NO: 38108 - DNA, 1140 bp, Heterodera glycines
  misc_feature (91)..(91): n is a, c, g, or t
  misc_feature (1083)..(1083): n is a, c, g, or t
  misc_feature (1119)..(1119): n is a, c, g, or t
atgagacttctgtgtgtttcatcaatggtcggcaacaagaaatgttccgacagcttttttaagcttaaaactattttcctccagacctacnccattcatgagtaatttgctcggtatttgtgagtaaatatgtgtgttttttttgttgcatttactcagattcgtttattagtggtaggaccatattcagtgaaagtgtgcattaatgattttgattaatctaaattcttggctgataggactcattacacacagaaaaatcattcagtgaaccgttttggtttggttatagctaatcgatttctcagcgaatatcttctgtcaccattaatgtctgcaattccttgattgatcacattctgtctgtttgtaatggtcgattcactgttttcttgattcaaattaccagcttctgatggttcattgctcagcgcttctacatcagcatgaactgataatttttccggcactatttgctcatcattaggagtttttggcgatgtgcagggggggcctattagctcaaagcacttttttatctggttgatatgtactttttttggtggctggttcggtgaaatgcagcttattatggtggcatggacaccattcagctcaactaccctaaaaattcccttccagggaaggtgaaattttttggaagtgccaatttttccggtatagtttctaagtaaaaccctatcgccgacgctgattttgggctgtcgcattgttttgtcatattgtattttcatctttttctgtgcttcttcaattgcctccgctgcacatttccaagcttttctcaaagttgtgactaatttttgagtaaattcgccatcagttttaaaatcaacttgattgtgaacgcgaacgtccaaaatttgatcaatacagaaaatggggtcccgaccaaacattaaaaagaatggggtctctttggtggatgaatggcacgacgtattataacagaatgaggcaaattcaatgtattcatcaaagtctgggttttccttggtgatgtatttagacaaaatgttgtgatatgtacgaaaagttctttcagtaatggcatttccttgngaccaatacggggtggcatatgttttattaatgtantacattgtacaaattctctaa

SEQ ID NO: 38109 - DNA, 819 bp, Heterodera glycines
gggactcaacccaccagcatttcaatcactggcactcaacccaccagcatttcaatcactgggactcaattcatttccaatcactgggactcaacccaccagcatttcaatcactggcactcaacccaccagcatttcaatcactggcactcaacccaccagcatttcaatcactgggactcaacccaccagcatttcaatcactgggactcaattctgcatttcaatcactggcactcaacccaccagcatttcaatcactgggactcaacccaccagcatttcaatcactgggactcaacccaccagcatttcaatcactgggactcaattcatttcaatcactggcactcaacccaccagcatttcaatcactgggactcaatccaccaacatttcaatcactgggactcaacccaacagcatttcaatcactgggactcaacccaccagcatttcaatcactgggactcaatccaccaacatttcaatcactgggactcaacccaccagcattccaatcactgggactcaatccaccagcatttcaatcactgggactcaatccaccagcatttcaatcactgggactcaacccaccagcatttcaatcactgggactcaatccaccagcatatcaatcactgtgactcaacccaacagcatttcaatcactgggactcaacccaccagcatttcaatcactgggactcaatccaccaccatttcaatcactgtgactctacccaacagcatttcaatcactgtgactcaaccccacagcatttcaatcactgggactcaacccaccagcatttc

SEQ ID NO: 38110 - DNA, 956 bp, Heterodera glycines
aattgtgaaaaatatacgaaaattatttagcttttaattattcagtacaatgcttttaagccccgccgtgaggcgggacagttccaaaattttgtaccacattttactgtggaaagtccaagtaccttattggacaacgacgtgtcaatgagcacagtcgcctttggccagttgtggaacggaaaaatgggaatatcagatggggtgcgctcttttctaaaaattcctcttttcgtctaaccatccctcccttttgtgcactatttcgtttcaaaattgaatcatttttttttgtcttttgaaataaattgtgaaaaatatacgaaaattattttcggttttaattatgctgtacaatgcttttaagccccgccgtgcggcggctccccttttgtgcactattttagtttttaaaattggttccggactttttggctttttgaaataaattgtgaaaaatatacgaaaattattttagcttttaattatgcagtacaatgcttttaagccccgccgtgaggcgggacagttccaaaattttgtaccacattttactgtggaaagtccaagtaccttattggacaacgacgtgtcaatgagcacagtcgcctttggccagttgtggaacggaaaaatggaaatatcagatggggtgcgctcttttctaaaaattcctcttttcgtctaaccatccctcccttttgtgcactatttcgtttcaaaattgaatcatttttttttgtcttttgaaataaattgtgaaaaatatacgaaaattattttagcttttaattatgctgtacaatgcttttaagccccgccgtgaggcgggacagttccaaaattttgtaccacattttactgtggaaagtccaagtaccttattggacaactacgtgtcaatgagcacagtcgcatgtggccagttgtggaacggaaaaatgggaatatcagat

SEQ ID NO: 38111 - DNA, 1594 bp, Heterodera glycines
ttgatttcgtaaattattagaagtaatgtttttaaatttaaaatggtgcattattgtttttccataaagaataaacaaaaatgaaataaatttttataattttattttaaaatattttctttttttctcaggttgagcctgactggcgtgcctttatcaccagtaacatggccggcgcacttcgctatactattatgcatccgggcgccggtgtgaagagtgccgaggcacggctgaagggcgtcgccacatttcgccagggcgcgatcggcatgcaactcaaaagtggtgcgtgaaatggcagagcaaactgatcggagcttagtggaagagcaaagtgatccgagctcagaacaaatgatcaaaaagagttggctgggttctatcggctcaagtcccgttttcccagattttcctgatcctgacccaatttttgggtcgatgaccccgccaagaccgggaatttacgacgaatgattagacaaggaatggatttacagttccagttacaaaataagcaaatttcttggggatttgaatgcattttcaaatagtagctttcaaagaaaacaaagattttggaaaagaattcaaaaaataattcaaaaattttatccaacgaatgtttagacagggaatggatttacagttccagttacaaactaaacaaatctttgggcgatttgaatgcattttttcgaatagtaaaatctctgtgcaacagttggctaaccctcaaaataattttcggtgaaaaatcattaaactttgattttaggcgacaaatcggacacaattccattggccaacaaaccctttttggcggagcaacagggcgatcgcatttggggcctaaatcgggagccaattgcggaaaaattgcgggtggaaaatgtgggcgaagctgacaaaacaacgttggtgatcttcttcaatgacaaaactgagaatgagcagttggaccacgatcttgacgacgcacaagtatgagagcaatcaataattagttgaaacagtatttcatgccctcaataccgtatctggggacaaaagggggtgactaattaacacaaatatcagggattaagcctatcctaaatttaaaaaaataacattttaacctcagcagccgaaaatttatgtggatttgtgaaccacgaagcgaaaaaaatcctatccgttaaatattttctcataaattttagattatttaaaatcataattagttagctgattatttttaaaaaatttttcaatatttttcacaggtatttcgtacaccgttggataagcctgaccccgaaagtctcgtcatccacattgaattcgttgtaaaaaaaataatttttaaattaaaaaaaaaataaaattttcaggagcctctacaaatgcctgagccggaaaacttggaggcaaatgggaaacccggcccagaaattgaacagacagcggacgaccttggcaaattgttgaccgaagaacaacaacaacaagaccaagaaattgtggagagaatactgacaaaaattagtcgcatgacaattgttgaggtgggaaaaaatattacattttttgtgccagaaaatattttact

SEQ ID NO: 38112 - DNA, 649 bp, Heterodera glycines
tccatcttcctttttgatactaaagcatcagagtgctcttcctaagttgtaaataaaatttggtgcgctttagagcactttctgaaaaaaatatttatgaaacaaaaaaatcgattttttcaagtgtccgtttggggtactcaaacatttatggggagcaaaaatccaacgcagaattaaagtacaggctatagggaagctactcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcgggtcggggggactggcccgaaaaccaaaaaacccatttttttcagggtccgtttggggtactccaaccattatgggga

SEQ ID NO: 38113 - DNA, 1497 bp, Heterodera glycines
  misc_feature (521)..(521): n is a, c, g, or t
  misc_feature (541)..(541): n is a, c, g, or t
  misc_feature (564)..(564): n is a, c, g, or t
aattctttacctgcaactcgcgcatgtcttccacgttcccacgtaccttcgctttcggccaaaaacttgccgtcgcccttccgtggcacgaccaccacagtggcggatgtttcggcactgccaatttcgttttcggcttgacaaacgtagtagccggcatcctgttcagtgacttcggcgattgaaagcaatgcaaatccgttttggtataagacttgcacacggtcacctgaaaaagatctttcttggttgatctgtgctaaatcactgatcagtcgacacccactcgattggacgggtgttccgttcagaaagaaagcgactttcattgacgggtcgctactgatcggcgtcagttttgtctccagacgaagcggctgccccacaaacagctcttgggagcgcaattcaatgtgaaagttggggcgatctttgcccggtgccaaaacagcccggggacgatccggcaccgtttgatcggacgagggctgggacggcacatgactaagcacttcgatganagccgattggcgtgccttgngggaggagggaaaggataattanaattatatggcaaaaaaaaataattaaattatacaatattttttgataaaaaaaaaatgggagaaaattttattttcataaaagatttctgtagatattgcaaagaaaacgcaaaaattatgctggtaatttgcataaaagaaaaaataaataaatttatttatttacatattcggaaataactaaatattaatattaattaaataaaatatcaataaaaaatattttattgttttattccacccatttgatttttctttttttatcgttaattttatttattttatgtctttttaatataataaataattcattatttttctcagctaacaaataagttgcatattagaaggaaatcgttcccttttctgctttcttcgtccactttaaccataaaatccagtttttctttagaggagctttttaaagaaagaaggaggaaaatgagaatctccaattcaacggagtcgtagctcagtggcagagcaattgactgcagatcaataggtcaccggttcaactccggtcggctcctatccttttttcctaattttctattcacagtaaagccattaaaataaataattttaaatttgttttagatgaaaaatttttgcagaattttcacaaagttttattacttaaaattattcaatgtaatgatattttttgttttaataaaaatgtggcttttttacactatcatttaaataggtaaatattcaaaaaattaatattaatttttattttagtgatttaaatgttcaaaaaattaatattaatttttattttagtgatttaaatgttcaaaaaattaatattaatttttattttagtgatttaaatgttcaaaaaattaatattaatttttattttagtgatttaaatgttcaaagaaattaatattaatttttattttagtgatttaaatgt

SEQ ID NO: 38114 - DNA, 1447 bp, Heterodera glycines
tcccgaaggattcggtctccccataaatctgggcgcatcggttcggggggactgccccgaaaacaaaaaaatctattttttcaagtgtccgtttggggtactcaaacatttatggggagcaaaaatccaacgcagaattaaagtacagactatagggaagctattcccgaaggattcggtctccccataaatctgggcgcatcggttcggggggactgccccgaaaacaaaaataaatcgattttttcaagtgtccgtttggggtactcaaacaattatggggagcaaaaatccaacgcagaattaaagtacaggctatagggaagctactcccgaaggattcggtctccccataaatctgggcgcatcggttcggggggactgccccgaaaacaaaaataaatcgattttttcaagtgtccgtttggggtactcaaacaattatggggagcaaaaatccaacgcagaattaaagtacaggctatagggaagctattccggaaggattcggtctccccattaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcagggggactgccccgaaaacccaaaaaaaaattttttggataaaaattatttaaatgaactgactagataatatttaaaataggttatttctcttcctttcagtatccctgcaaagtttggtgcgcttctgatcagtttctgaaaaaaaagttaagcctaaactttttggcctgtttaaaaaggaattaaaaatttttaaaaattttattcatctccctttttgatagaaaaagcatcagagtgcctaaactaacatgtaaataaaatttggtgcgtttcagaaccctttctgaaaaaatatttaagaattaattttgcaaaaaataaataaaaacgaaagactcagattttcgaaaatttttttgagccagctagctcggcgctcatttcagtgtaagttagtcctttaccggggagtatccctgcaaagtttggtacgcttctgctcaattagcaaaaaatatgagtgatcgaattttcactaaaaaagttaagcctacattttttggcatatttaaaaagcaattaaaaaatttaaaagatgagaattcatgcgagattttctggaaataagctta

SEQ ID NO: 38115 - DNA, 557 bp, Heterodera glycines
atttaggcacgtattggcgctctgttcgctcctatggtaagttcagataaatttgtgatcaaaccctttgatcgcacttcatcaaccattgaacgcgtcgcgtcgttagagttcactaaggctttctccccctccatgaaatttttaataatttttccaaaacatttttcatgttttcaacaatttccatctcccatccgaatcccaatttgctaattaatttattaacatctcccatccgagtcacacctttcagttggtcttcctcaactccttttgggctgtgagtgtttatttggcggttgtgctgctcggcacgctcaacttgatggtgtcctgtctgtggttagtcgagaccaaaggcatcagcttggactccgtccgattggcacaaatgtcagcggaagatgaagcggatgctggcggaatggaagggatgaagcggaatgatgagaggacaccaacgggcaaggatatagagggggcggatcaagcattggtgaagccgtaataggcggggagtggacgacggaggcctccgttttcggggatctcct

SEQ ID NO: 38116 - DNA, 852 bp, Heterodera glycines
  misc_feature (14)..(14): n is a, c, g, or t
ataatattttaacncaatttcggagcagacggaactgtctcccttcaataattataaacagaagcaaaggtataatgaaagtagacattcaatgaatattttataaaatttcacctgtatatttttaaattaggtaattaaaatttatttttgcgaaaatgggataaatttcaatttttttttaattttctttctaatattacatataaaatcctaatatataatagacaaattataatatgaaatataatattaaaatatgcttttattattgataaatgtctttatgaattggcaaaaaaacagaaattcgaatagggccatataatataaatacgtggatatgattgatttttttaaatgggtaaatatgtaggtgtgtaatgaaaatatctttttaaatcaaaaaaaatttaagaatttacaaaaaataagtagggcattgcgagaaatattttttttccgagaatcgagacaagaaaataaggtacaaacacaaagatagaggagcacagataattgacaacatcaaaaaaaaaaaaactaatatgaccatccaaacggtgtaaaatttatcagtttcctaaggattgctttacacaagggaacctcgcgaactgttagttaaaaagtaggtataaatttggtatcattggatagagcagggtcgacttctgctgttgagaatttttaatattagcggtgtgagatcaaaaataaaaaagttatgaggcctcaaaaatcgaaatttggctgagtttcactaaaattggttttcagttggataaattcccattttttggagcacggaatcaaaatccaacataaaaataaataaatttttttttattt

SEQ ID NO: 38117 - DNA, 275 bp, Heterodera glycines
tctttttaaaaatatagaaataaactaaaaacagtttctcccttaccttttacatggttaaaaatttaaaaatttagcctcttaaatatttttaaaaaaatttattatattttttttttgaaaccgacttccgagtttcgacttccgacatttttggggtcggaattccgacttccgaaaatttttggggcctcggaattccgacttctgaaaatttttagtgcctcggaactccatccctggtgtagtgggggggggggggggggtaatgttta

SEQ ID NO: 38118 - DNA, 988 bp, Heterodera glycines
tgatacggtagcccaacatccattgccccaatgtaccctttaattgtcaacgggagctaacaattgatgagtttgtttggtttcttttttaagcaattttccgtcattgctcaccaactgttaggcgtacagcaacggcggcacttgcatccgatgcagctgttcacgggctctctaaccctatttttatttttttctatctcttctctgaaaggagttataacaatttttcacaacagttttgcatttaacagacacattctaaaatttctaattagtatagtagtccaagcctattattattttttttgactagtctctgaatggggttatcccagttttagtatcctttttgaaaaacaaaaattttaataactgatacggtagcccaacatccattgccccaatgtacccttcggtttgtcaacgggagctaacaattgatgagtttgtttggtttcttttttaagcaattttccgtcattgctcaccaactgttaggcgtacagcaacggcggcacttgcatccgatgcagctgttcacgggctctctaaccctatttttattttttttctatctcttctctgaaaggagttataacaatttttcacaacagttttgcatttaacagacacattctaaaatttctaattagtatggtagtccaagcctattattattttttttgactagtctctgaatggggttatcccagttttagtatcctttttgaaaaacaaaaattttaataactgatacggtagcccaacatccattgccccaatgtacccttcggtttgtcaacgggagctaacaattgatgagtttgtttggtttcttttttaagcaattttccgtcattgctcaccaactgttaggcgtacagcaacggcggcacttgcatccgatgcagctgttcacgggctctctaacccctatttttatttttttctatctcttctctgaaaggagttataacaaattttt

SEQ ID NO: 38119 - DNA, 824 bp, Heterodera glycines
tattactacatttagttacaatgattaaaaaagaaaaattcctaattattataattctaatcatttccctgtgtttggccataactctgatcaaatcggcatgctcaacaattgtacacccagcggcggcggaaggtcgatttaattcaattttttccactttataactgcaaaatatgatcggtaagcatatggttaaaccccaaaccgatgcggggaattgcggttggattccaaattggtgtcatgacaactcgtacaaaaggcaactcgtacaataaaccaactcatgcaatggcgtaagctagggcttaggtttatgcctaagccggctaggcttagaggcctaagccggctaggcttaggctgggcctaggcgcttagttttaagctttggctttattttctaaaaattttttgtacgaattgccttttgtacgagttgccactgacccctgcaaaaattcgcaccttgactagagtgttgctccccgtgattttttttttaaatttctccattcatccccgacaaatttgtagcaaatttcatcgctgatctccgaattttctctcaccgagggtcagcagggcttaatcctagttaagacagatcatttcaagtgatctcaattggattttccgaaaaaaaatttctgatcatcttttacaaccggagcgggccaactgcgttccaggcaagtttaaagaagtcataacttttatcacagttgaccaaattttataaatttggacattgttcaaaagctcttaataagttctacctgcattccaaaaatcactaagattcgacatcataaaaaaaa

SEQ ID NO: 38120 - DNA, 721 bp, Heterodera glycines
aattaaaacaattataaaataaaatgtatgatattatttcagtgttcaacaatgaaagtcggctttattcactttaccttgagtttttgaccatcgccgactcaatgaattggctgaatgtaaaactaaaggtattaaatgcaattttaaaattaaaaattggctactttttaagttggatttgttcatttttgtccaatggaccgatgccaaaattgccaattccgccgcgtccatcgcccggcaaaagtgtgccaatgtttggaatcggcacaaatttttgttttacaaactgtacgaccgttggcatgacgaaccgctggacgaaatgccaaactttcaaatttatcaatcgatttttttgaatgaaatgaatttactttttgaaaaatttttgatgaaaagtgaaaaagcaatggacgaggaaattcggaaaataattgaaaaagcacagaaaaaatacgacgaaaaaaaagggacgagaaaagtgaaaggaaaagcgaaagaaagtgacaaaaacggggaaaattatgcgaaatttgaagtcaaattgggcgaaaagaatgttgaaacactgagcaaattggtggaggaaaacgccattttcaaaaaaatattaaaaaacagtaagaaaaagaaaagtggcaagagattactgtagattagagtttagcgttaccagcagtaccagtaattaattacctttggtacggtaccggtt

SEQ ID NO: 38121 - DNA, 181 bp, Heterodera glycines
tttcagctggatttgcagtgacgtatggatggacattttcccatcttttgaccatgcccaacttggcctcaaattggcactgatttcgccacgtttcaacgttttagtggacacgtatttcaatggcaaaagcgaattgacaatttggagaccaatcgcaattcgtaaggacagtgtcaca

SEQ ID NO: 38122 - DNA, 1014 bp, Heterodera glycines
ttggaaatttcttaaagccaccaagagctaagaaaatagataaaaaataaacaaaatcctataggcataaaattttctcagttaaaaaatgtttatgtgggtgatcaatgccggcgggggttctaatccgtgtgttagcacatctttttgactgtaaaagattcgaaaatggcatgaatattttttgacgtagaatttttttttttgcaaaaaagtgagtcgactcaaacagaagtattaccggcggaattcttcaaaaaaaaatttttaaaaattaagacaaaattttaaagaaacatgccaaaagggacgctttcatcatagaggggcccgctttaataagattttttgaaaaaatgcccaaatatgcacataaaaaacgcatataaatcgcgaaaatatgcacaaattacaataccaagattattatttttggttgttttaagaaaaagttatgactgttttctcgaaaaatctgtaattggcagttttacccatgttggcagttttacgaaacgacctagcaccggaggccgaaacgtcgcagactcggcattgcatttgccctcgttggacattttaactgagaaaggatttatgcgcaacttggattttgggaatctttaaattatgtatatctgattgataaacaattgaaggcagtaacagtggtggtggttctgctaaacatcgctttgacaacggacaaaaatatgtggcgctaaaaggctcctccgattattggcacatttgtgtgccggtgtgtgccccgtttgggcgacaaacatgccgatttgtacgtgtaacaaccaagcgggaaaatgcccaatcgcagctttgtctttgccaatgggacggggaaacggtgtgtgccgtacgaagggaataattgacgaagaaacgaatgattggttaaaatcacattatccatgtttttttttgtagggttcatatttttgtgattttgtattagtttaaaatggggaagccccccttttcgaaaaattttttttt

SEQ ID NO: 38123 - DNA, 978 bp, Heterodera glycines
  misc_feature (887)..(887): n is a, c, g, or t
ttgagtagattagatacaaaaattgaaaatttcgatttttgtttcccactcccttctcccaggggtattattttgtaaatagtctttttttccccaataaacttttcataccccatttttcgcaccgtgaatgttatttttattgaattctgaaccggtttgagtagattagactacaaaaaatttaaaatttcgaaatcatgtttcccactcccttctcccaggggtattattttgtaaaaagtctttttttccccaataaacttttcataccccatttttcgcaccgtgaatgttatttttattgaattctgaaccggtttgagtagattagactacaaaaaattgaaaatttcgaaatcatgtttcccactcccttctcccaggggtattattttgtaaaaagtctttttttccccaataaacttttcataccccatttttcgcaccgtgaatgttatttttattgaattctgaaccggtttgagtagattagactacaaaaaatttaaaatttcgaaatcatgtttcccactcccttctcccaggggtattattttgtaaaaagtctttttttccccaataaacttttcataccccatttttcgcaccgtgaatgttatttttattgaattctgaaccggtttgagtatattagactacaaaaaatttaaaatttcgaaatcatgtttcccactcccttctcccaggggtattattttgtaaaaagtctttttttccccaataaacttttcataccccatttttcgcaccgtgaatgttatttttattgaattctgaaccggtttgagtagattagactacaaaaaattgaaaatttcgaaatcatgtttcccactcccttctcccaggggtattattttgtnaaaagtctttttttcccaataaacttttcatacccccatttttcgcacccgtgaatggtattttttattgaatttctgaaaccggttttga

SEQ ID NO: 38124 - DNA, 857 bp, Heterodera glycines
cattggcgagggattagtccaatcattgccattttcttcatacaaagataacagccctgatcagtgggccttaattatcgtcattattctccaaattcccccctaaaagtcacgagggtctccgaagaattaacacccaatccgattcattcttccgccgtggtttggacaccttaacaacggataagcaagccttctcaaacgcaaaataaatgcctgaaaacgcgggtccaaggtaaaagtgctggtgccgaccgcgagcaaagcatcgtcacgaagccgagtccatgcaaccttaaaacggcatactgtaactgtaacagttagagagagaaaaagagagagagagtgacagaggagaggaagagaaagagagtgacaggggagagagagagggagggagggggggggggcgggagggaaaatgggagagaaagagaaagtcccttccgattacagtacactccttcatttttgaatccaaggtcattgagacatatccgtcgattgtcggtgtcgaaacggacactctactatattaatgtcgaaaaaatgctggaaatgaggttacaaaactagcagcaatcaaacccaattaattaactgtaagcataataaatgtcaatgctcagttaattagtccgttcgttctttcccttttcgtccctctctttcaccttcaattctttccgtcgttgtccttttggctttggctgtgcacagtgcaaatacgcgggctgtccttcgcgtaccgaaatgactttggcagcagacggcgccccgtcgtggccatcggttggccatctctccaaacgaaagcattcggaaaaggacagcggaagacggtcgcctggggg

SEQ ID NO: 38125 - DNA, 1076 bp, Heterodera glycines
cttcggcttgagcgaaagaagtgatgccgaactctgatcttctgacaaaacaaatattggtttgtcattcaacttaaaaaattaataattgaatgatttttggcttcgctattcagaaggaaatggacgtcaaactgatagtgaatgttatggagggaatggacaggacaaaaatgttgcaaatttgctaccagtaccaacagcagaaaatgaaggaggaggtttgttcgtccgcgattgtggtggtccccccgcttggagttccacagaaatcagtttcgccccaaatatgggcacataaaccaaaatgttaaccgaagaaggaaaaacgtcacaaaaaaaaaatttaaattcatttttttaactagccaagtttttgtctttcttctttaaggaaacataatttgttttcaacacaaaaagactttactgctgaatgcatgaatgtttataaacagagttcccaagtgtgcttatttctaagatttgtgcttatttcagcattacgtgcttattttttgatttggaagtaaaaaatgcaaaatttgaatgactgttttgacttataattttttttgaagcgaatatttgaattaattcaatattgaaaattaaaagtttattttcagtgaaaatctgttaaaaaagtagagtgccacgggaccgggcgaaacgggtcagttgcgtctggccagttgcgtctgggcggttgcgtcttagtacttatggggccggttgcgtctcaaacattttgttcggaaaaatatttttttttgatttatccgaaggcgcaaatattaataatttttttcttaaaactcatacgtatgaaaaagttacaagcatttttctaattcggagtgaaattgtgcggggtggaaacatagtgcacccatatcagaaaattgtttttgcatttttatacatttcatttgttttaaatcttttaatatagcccgaaaatggaaaacaatcaaataataacgaaacgaaacaacaaaaaactcgaacatgaaggatgcctctatgtcttccatatgttcaatgctgaccgtgacgtaaaattttggcgctgt

SEQ ID NO: 38126 - DNA, 1209 bp, Heterodera glycines
  misc_feature (8)..(8): n is a, c, g, or t
  misc_feature (1202)..(1203): n is a, c, g, or t
tgcactcnttcaaatctcaatctgaagaagaaaaaaagccttcctagtgactaattttggaagagacaccaaccaaaacagcgtcaagggcgcgtaaaatttgtgcgaactgacggaggaggacatcagcgcaattgggtccgtgccgaggccgagctggtcgctccactcggcacagcggtggtgaatttgcatcagacaatgggcgtccaaagcggcgtaacggacctaaaaggaagcgaaaaattcgcagatggacgaaaaaatagggggctttagcccctcaccatcagcccccgcactcgctacgcccttggtcacagatgcgcatgtccctgccaccccccgtcctctcaacactcgcctgtctgcgtcgcaatggtcgccggtcccacactgagcactgctcctgcttgtccaacggtttgcccaacacgcgacggcacagataggcgagcccttggtcggccagcgatttaacagaaacactcgccggcgtctgggactttttcttcgatgctcgacgaatcttgccctgggcatcatgtccaccaaacaattccacttaaatgcgagcgggtttttagtatcttagaaaatttataaaattttattttttcttcttggaaaatagattgtttcggtttaaaaaaattatggaaaaacacgtgtcaggccgtataagtcgaggtgcaaagtcgtcaaccgtgccccgtccccccttcccaagtcaaaatgctgtcgcatgccaaccttccgcgtcgtatggatcgtagcaagtactgctagtgcccggtccctgctgtttctgctccgtgtccatcaccggcagtttgttgttactgctgtttgtcactgcatcgtaacgttgcggtttgatctgccgcgtgtgctccttgagctcctcctcctgctgttcggtgagcggcaacagaaatttgtgcaacggaaagtcgggcaggcgcggcaaagaaagacgattgagctttaaagaataacaaaaagcttctagaaactaaaatccgaggttaaatcattcgaatgaattgaaatatggagggaaacggcacgggaaaaggaggacaatgcattcccacacgagagcagctcgccccccccgtcgatgggtgcactacgtttcctccccgccccccgaaattaaaaaaatctcaaacttagaaattctcccaagaaaatactgnngtgttt

SEQ ID NO: 38127 - DNA, 495 bp, Heterodera glycines
tctagagtctaaattttccgttttcgtccttcaaaaattttcgtttcgtgtttccttttcgtattgaatgctttttttcgtttcgatttcgtgtacgaaaatctttttttttaattttcgtgcagccctggttgcagcatttaaaatatgtgaaaatccttgataaacattttcaattattataaatttactttttcctgccaacattccaacgctggcggaggacaatggcgggaactgctcgaagttgtcgcccgtaattgccgctgctgcagatgaaggccattgaaacaacggttgctgctgctgctgctgtgggttttgttcggtttggacttggaacggcaagttgaacttgaaattttggcactttgagtcccaaaatgcgctttttcaaattattttaatgagtgagactaaattctttggcgctagtttaaaggtggcaactttttgatttactaaaaaccaaagggggagggacccttttgtttt

SEQ ID NO: 38128 - DNA, 744 bp, Heterodera glycines
caaaatttggagagattatatcgattttagcgcgctaggttcgatgaaactttttaaaatataagcctaaactttttggcctgtttaaaaaggaattaaaaatttttaaaaattttattcatctcccttttgatagaaaaagcatcagagagccttatttaacttttaattaacatttggtgcgtttcagagcacgttctaaaaaatatttatgaattaattttgcaaaataataaataattaatgaaaaagtcagaatttcgaaaaattttaaaaacaacaagcgttggcattttttcaggttaacttagtcctttacaatggagaaggcctgcaaaatttggagagattatatcgattttagcgcgctaggttcgatgaaactttttaaaatataagcctaaactttttggcctgtttaaaaaggaattaaaaatttttaaaaattttattcatctcccttttgatagaaaaagcatcagagagccttatttaacttttaattaacatttggtgcgtttcagagcacgttctaaaaaatatttatgaattaattttgcaaaataataaataaataatgaaaactcagaatttcgaaaaattttccaacaacgaagcgttggcactctgccttcaggttaagttagtcctttacaatggagaaggcctgcaaaatttggagagattatatcgattttagcgggtagaggttcgatgaaactttttaaaatatgagcctaaact

SEQ ID NO: 38129 - DNA, 824 bp, Heterodera glycines
ctaaagtgaagtaattcacttgtgttcgcttgtccactcacatagctgcggaggtgttgccagaaattgccgagttgacttgccgtgggatgtgggcaacactctctctgaaaatttgtcaatttcgcactctaaattccttttcagagttaatttagtcatttttgtaattccaggccccctaaaacggactcggtgacttttctatgtccgtcgtggatcaatttgtgcagcaattggcagaatttccatgtgaggacgggatttttctccagctgaatgcgcgagacggcatgccaaaaaatgcgggaagagcgaagtttgtgctgaaaagggcgacgaaaataaaagtgacagcatttcacaaagggttccctcaaatgcaactgaccgtgccaacgacgagtgcccggacatgcttttgcttgaggggactttcgactttggacaacgccttgcaaaatgcgattaactgaaatttgcggcaataaatcaaagaattgagacctccctggggggaaagtccacctgcgacttgacaaatgcctcttcttgcattttgaccctccgctgtcctttcacaactgttgggaggtggcgatgtcccgttatggttgtggctgggaagcagcaatcggaaggagcaaaacggcacgacttttgccgatttgaaaatgccaaaatatttaataaaacgagaggcaaaaactatcaaaatatctcttcaccgcttcatacagtgtcacacaaaaataaaattagcaactagaataaatgcacaataattcaagaaaatattaacattttgctaatcacattttaaa

SEQ ID NO: 38130 - DNA, 781 bp, Heterodera glycines
atattctaaatattcatcattttattttattccgattcttaatcaaaaacattgacccattcttttttagtcaaaatattttaggttaaaaacataaattttttctaatttttcaataaacttccattttacgcgttttgtaaccaaaatatctacatatagtacaaaaattaatatatttttaagcaatttaatctaaaatattagatatgtgaattatttacagaaatagtacaaaaattgtgtctttttaatcatttcaatctaaataaataatttacttgatttttacccatgagtttattaaatgaaagtacgcaaaaatctttgaaataagtatttttaaatttctaagattcgatcttgagaatattttttaagtaactagatataaaagataaaaattacagatgaatagtaataaaatatattattatttatttcgtaaatttcataaattactcaggaaaaacagaaatatatatacatcaaaataaatgaagattacagcaaacgggcgcaaaaaataaagaatggtaacgcaatttgcttgagggcaatggcaatgatgagaaggaacaaatctgccgcggcgccgttttgtattgattttagcaaatgggtcaaagatcgaaaaaaaggaacacattaaggctgccagaagaaaaatatcaaaatcatcatttttcgacgcaaaatatgcatttggagcaaaaattgaagaaatatatccaaataaaaaaaaataataaattgttttttgcgggcgcacttttttttt

SEQ ID NO: 38131 - DNA, 572 bp, Heterodera glycines
  misc_feature (492)..(492): n is a, c, g, or t
aaagagattatgctgacatgacgagagtgaggtctacttgggcgttgaaagttgggttttccgagggggagagattgtttttgagaaagatggatgggatggacgacgttacgccggcacggcgaaaatgaatgggtggggggagggggcgggaatctcgaatctgtccccacctcagctcatccagacggaccagcagcagaggccattaatgattgatgaggtgggccaaacgccgagccgccgtcgttgaaaggcacgcttattaaaagttaacgtagccaccacaaaatgtacaaaaataaatatgaaaaatgaaaaagtgtttaaaaaacatttgaattaattgcttagtaattaattaaaaactccttgtcacctgacaggcgaaaatttaaatttacaaatcggaacaactaattagttgtacaaaatatggaaaccagcttagagctgaaattgataaaaaacaaaaacaaatgttgtgattanaaaagagatggaatattattaattatttattctcattttaatccgttagttttttaaatacaattcaaattgaggatgaa

SEQ ID NO: 38132 - DNA, 904 bp, Heterodera glycines
  misc_feature (19)..(19): n is a, c, g, or t
atatattttctttcagatntaaagctatccattgcctgccggtctcggcacagcaaagcactaatagggtgtttgactcacttcaaaaaataattcattacccaaaagttttttacaaccacttattgccaatctaatttcttgcagatttaaagctatcaattgcctgccggttctcggcacagcaaagcactaatacggtgtttgactcacttcaaaaaataattccttaccaaaagttttttacaaccacttattgccaatttaatttcttgcagattgaaagccatccattgcctgccggttctcggcacagcaaagcactaatagggtgtttgactcacttcaaaaaataattcattacccaaaagttttttacaaccacttattgccaatctaatttcttgcagatttaaagctatccattgcctgccggttctcggcacagcaaagcactaatacggtgtttgattcacttcaaaaaataattccttacctaaaagttttttacaaccacttattgtcaatttaatttcttgcagatttaaagccatccattgcctgccggttctcggcacagcaaagcactaatacggtgtttgactaacttcaaaaaataattcattacccaaaagttttttacaaccacttattgccaatataatttcttgcagatttaaagctatccattgcctgccggttctcggcacagcaaagcactaatagggtgtttgactcacttcaaaaaataattccttacacaagttttttacaaccacttattgccaatttaatttcttgcagatttaaagccattgcctgccggttctcggcacagcaaagcactaatacggtgtttgactcatttcaaaaaataattccataccctaaaagttttttacaa

SEQ ID NO: 38133 - DNA, 441 bp, Heterodera glycines
ctgcgctatcggcatcacagggcccaaaaagtcataaaccttattaaaaaaattggctcaaaatcgcaaaaatttagcatattttggacaaaatctgttaacagatctaaccaaattttccgccgtaccctttctccttaagtctttagaaaagagcgacgtgaaaaaagatgttttggaaaacaaaaaagtaataaaaaattttaaaatttcaagaaaaaaaattaattctatacaaaatttctgataaaaagaaataaaaaaatataaaaacaatacaaatattattatggaaattaataaatattatttccgaaaaaatattaaaaaaattttgactatttggcataaggcaaaaattgaaaaaccccgaccccgaccccgaaccccgaacgatttggcaaccccgaccccgaaccccgacagttggaaccccgacaa

SEQ ID NO: 38134 - DNA, 694 bp, Heterodera glycines
ttccatgccgcctctgaagagtcatggattaagaagccttttttgaagaaaaaatgaaggagacaagttaaaactgtccctttgtccgatcaaatttaattattgtcccaatttcgatcaattaattaatgtgtcatcatttaatttaattaattttgcgggtttcaattcatttgctataatattttttttgatttatttggagcgatggaaatttaacaaaatgaagatgcaaagcaaagctttaaaataatctaataaatttttaaattttgtcataagaatttgctaagtcatcagttataaacaatgagcagaaggctgatcaatgtgatggtttttttttgaaaaattttaaagaaaaaacttaaaaaataggagttttactaaaaattgttctaatgcactttgtgcatccaaacaatggccatccttagtttcttgggccacaagttttttcctccttggtctgcgcctaaattcttggtatcaatcgaaaacttaaagatctcggcaatttataataagcaagacatagagcaaatgctcacaacaagaaaaaatacactaagaaaatataaaattgagcattttacaaagacttattaaatcattgatttgataccaagaatacggggctcaattgtactactaattactctcagtcatggcacgcaaaatcggacatttgatg

SEQ ID NO: 38135 - DNA, 152 bp, Heterodera glycines
tattttaaataaaaaaacattaaaatactttctgaaaaaaaagattctgcttaaccaatgaaataaaaatcaattattggcataatatatgcttttagtttgacaattaaaactttattacaaatgcctgctgaatatgaattttttagcaa

SEQ ID NO: 38136 - DNA, 1076 bp, Heterodera glycines
tggggtatgaaaagtttattggggaaaaaaagactttacaaaataatacccctggagaaggggagtgggaaacatgatttcaaaattttcaattttttctagtctaatctactcaaaacggctcagaattcaataaaaataacattcacggtgcgaaaaatggggtttgacaagtttattggggaaaaaagactttacaaaataatacccctgggagaagggagtgggaaacatgatttcaaaattttcaattttttctagtctaatctactcaaaacggttcagaattcaataaaaataacattcacggtgcgaaaaatggggtatgaaaagtttattggggaaaaaaagactttacaaaataatacccctgggagaagggagtgggaaacatgatttcaaaattttcaattttttctagtctaatctactcaaaacggctcagaattcaataaaaataacattcacggtgcgaaaaatggggtttgacaagtttattggggaaaaaagactttacaaaataatacccctgggagaagggagtgggaaacatgatttcaaaattttcaattttttctagtctaatctactcaaaccggttcagaattcaataaaaataacattcacggtgcgaaaaatggggtttgaaaagtttattttgaaaaaaagactttacaaaataatacccctgggagaagggagtgggaaacatgatttcaaaattttcaattttttttagtctaatctactcaaaacggttcagaattcgataaaaattacattcacggtgcgaaaaatggggtttgaaaagtttactggggaaaaaaagtctctacaaaatacgccgggggaaattttaaaaatttgggtgcaatttgttaacagattttcaacaaaaaaggttggtttttgcgattattaagctcaattggtaggattttcatttaaaaaatgataaaaatgtatcaatttaaaaaaaaactatgagtaatcatattttctctataggaaacccacgagtatcaaaaagaaaattcaaaataatttaatttctgtagagggatgaaccaggggaa

SEQ ID NO: 38137 - DNA, 1034 bp, Heterodera glycines
  misc_feature (46)..(46): n is a, c, g, or t
  misc_feature (51)..(51): n is a, c, g, or t
  misc_feature (56)..(62): n is a, c, g, or t
  misc_feature (64)..(64): n is a, c, g, or t
  misc_feature (71)..(72): n is a, c, g, or t
atgaaggggctctgttagcaaaaataattatcaattcaataggtgngtggntgttnnnnnnnangaggggnnggcctttaaattgcaatgaaaaaactaaattttttaaataaaaaatatttaatttaaaaattatttttctcgcgcaatttttaaaagtatcaaaaaagcaaaaaatgtattcagatgtgagcaccgtcaaaggtgtgtgttgccagtgaatttggacacatttccgcccagttttggcggtgaccaatgctttggcaccccaaaataccttgacgcggtttatggatgcgtccgaggtgaaaaaaaacattgttgaagtgtccgcgctttcatggcttttcaaattttttttgttaatttggcgtggtgttttggcattatgttttttttcagcattttcactcagtttcttctacaaatttttcttcttctctatcttttgtttttcacaatgctttgattttttttgttgcactattaaaatgaagtttaaaattcaagcacatgctttttctacagttttttttttcaaagttttggtatactgtgtttgaatttgtatttaaaaaattacggtatatatttggcgcttctttctttttttttttttgctttggctttttgaccacattcattttcgcacagttgtcaacgtaaacaggcgtgcttggtgaaggcaagtgttgaagtgtttggtgacaagtgtccaggggacagcaaatatttggagacaacataccaatgtgtgccggcaaaaggttgtcgcttcaataactatttgtgtttgaaaaaatttgaattttatttctgtattcggtacatctgttggagtaatacatcattgcttagttttggcatttttgctgcgcgctttttcgtaaaaaaaaaattgcggagcagtggggtccccgccggaaaatgtttttgtttgtagattttcccttgagttttaacagatttcacaaaaaaaactgtatttttgtggatttcggaaaatttcgcaaaattttgggaaatctggt

SEQ ID NO: 38138 - DNA, 926 bp, Heterodera glycines
  misc_feature (916)..(916): n is a, c, g, or t
cccaataaatcgggccgcatcggttcgggggggactgccccgaaaacaaaaaaaatcgattttttccaagtgtccgtttggggtactcaaccaattatggggagcaaaaatccaacgcagaattaaagtacaggctatagggaagctactcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatccagggaggcaagtgtccgtttggggtactcaaaccaanttatggggag

SEQ ID NO: 38139 - DNA, 1271 bp, Heterodera glycines
aggattcttccttcttgggcgcttctttgtcgtcttcacccttcggtttctccatgtacgtcttcgtgaagcactgaaaatttgaaaaaaaatttgttttatatgtaaaatttggagcgaaaaacaacaaaaaaacacttaccattcccgccccgaaggctgcagcgccgacgagaaagtgagaagtcattgtgttgttgttgggcgcactgaagtcgttcgttcgttgattgggtgttgtgtcagcagcaaatgtgcaaatggacaaaaattcgccccttttatatgcattttctgttgcactttttttcagtgggaaatttgaatataaaaaggcgtgaaattgagagaaatttcattctcgtcacattcttaattctattctctgcactattacatctaattgctgctgctcaccgactccatcgacaacgacacgcgatggaagaactcgtggcgctctcccctggaatccgcgtcggccgctggacgatcacaaagaagctgggcgccggagcattcggagccgtctacctgtgcgtgaacgaccaaggagagcaggccgcgctgaagacggagccggtcaacacgccacatccgctgctcgtcatggaggtaggcgggggaggaggggcgaaaaattggcaattcaaagtaaaaattttttttcaccacccaggctcacgtgatgaccaagctggacacccttcgagacggagacgggaagcacttctgccgctgcttggacctcgggcgcgatgagcaacaggaccaacaatcgggacaaatgaagaagttcaactacatcgtcatgtcactcgtcggtcgtggcctggacggagtcgtcaaggatgccggtggccgcctcagccttggaagcgcagtcggcgtctcgatccagatgctcgccgctctcagaggactccacaccgtcggctacctccaccgtgacatcaagccgggcaactcgaccatcggacgtccggaatcaaacgagatccgcctgctctatctgatcgacttcggaatggcgcgcaaatacaccagggacgacgtgagtttgagtgaagcgctttgaaaaaaacaaaaataatttgttccctttccccccttttcaggggagccaacaccgcccgcgcgttgccaccaacttccgcggaagcccccgttacgctgcgatcagcgctcatctcggacgcgaatacagccgcaaggacgacatcgaatcttaggctactgcatgatcgagctcttcaaaggcgcacttccgt

SEQ ID NO: 38140 - DNA, 469 bp, Heterodera glycines
aagtgaactaactaccagataagcttggtaattttctcatctaacttaaagttttagggaaggcaggtatttttcaacccatgacgtagaactcgaaaatttaatttaatcacaggaaatttccgaaattgcggctcaaaaattgaactccgatcggtctgccgggggcatccctttgcttgatattgtcaaaattatcaatgccacaagacaaagcgttgcaggcacagcttatcgtgtacaaatactgttcaaattgagaaaaaaggtgaaaaatatttggaaaaattaaaaagtttttattcaaatttaaaaataaaaagattaacacaaaaatttaaaaaattattcaaaaaaataaatgaactaaataatttacattatttattttaaaataaattattaaagataatttttaattttttattaaaaaaatggagagagcataatttttactttaatttccttc

SEQ ID NO: 38141 - DNA, 988 bp, Heterodera glycines
  misc_feature (72)..(72): n is a, c, g, or t
  misc_feature (89)..(89): n is a, c, g, or t
  misc_feature (111)..(111): n is a, c, g, or t
  misc_feature (144)..(144): n is a, c, g, or t
  misc_feature (172)..(173): n is a, c, g, or t
  misc_feature (175)..(176): n is a, c, g, or t
  misc_feature (181)..(181): n is a, c, g, or t
  misc_feature (267)..(267): n is a, c, g, or t
  misc_feature (271)..(271): n is a, c, g, or t
  misc_feature (279)..(279): n is a, c, g, or t
  misc_feature (399)..(399): n is a, c, g, or t
  misc_feature (402)..(403): n is a, c, g, or t
  misc_feature (418)..(418): n is a, c, g, or t
  misc_feature (420)..(420): n is a, c, g, or t
tttggtacgattatgcttatcaacagtaaaaaaaccttctaagattatttagaatttggttaattggggttntaaccttggatggaggncggtgggggggggtggattttngagggggagggggttggagggggtaagagtggngggggcggtggagggggtaagataattnngnntttgngggggagggggagggggtttggtttgaattaggtttaaaaatgtaagaaaaaaaatattttttatgaataatttgtttgggtgganatgnaaaatatntaataaaatatgtaaataaaagtagaaagttttgtttggaaagataaaaaagaaagtgttttttttagtgattaggatatggagaagtgaggaaaaaatatgtatttagataaaattagnagnngtaatgatgatttantnaaggaaaattggaagttagattttttaaatttttcttaagcaaatttgttcgattttgtggaaaaattttaggaatgtagataggaggggagagggacggcggtgcctataggcgcctccaggggaaaattttaagaaattatatgaattttgttagaatttaggcaaaatttttcagaagttttcctctttttagatgaaaataaggatttactcccaaatcagaacacttagaaacaagaacataaagaaaccctgtattaatcagaaaaaaaaattaattaaaggaaaaaaaaatttatttaaggaaaacgtcaaccggtgttgaactaataacaaagatttctattagcgctgaagcactaaccactaaaccacaaatatttttaaaaatataagcaaaatttactttatttcataaaaatttgtaaaagatgattaaaaaattcaaaattgtataaatttttgcctttaattcaacgaatatgccattcttaggggtgtattttcacccccgcgcccccgcgggggtgaaggtcgcggggtcggtggctgcgggggtctgagt

SEQ ID NO: 38142 - DNA, 921 bp, Heterodera glycines
aagaagaaattggaagaatttgacggcattggcacaatcctcctagggggcggggtggacggagaagaagccgatgataaaactgacaatgaatttgtaaggcaataaaaacttttgaaattaaaaaaatttgtcatgaaaaaagacaataaataccggagcaggttgcaaccgaaaaaattagcaaaaaatttctaacttggaagcaaaaaaaaaaactttcatatgaaaatgttaagaagaaaaatttaaaaaatttttgagcgattttttcaaagtttttcaagaattatttcagaaatttttcaaatttttttcttgaaattttcttgtgaaaaagattttttttgttttttatctaagtttttgaagtgcaccaaatatacatacaaagaaaaacaataaataaacaaacataaatttcaatttcaaaaaaaagagaaaagaaatttgagaatgcagctgaaagcaaccggctggcagcagcagcagcagatgtgtgagaaaatgatggaatttggtggaggggggggggggaaattgaaattttgtggaaaatgaaaattcaaaaatttgcaaagcgcaaattacaatgggaagaaagaagaaggatgagaggaggagcagatgagcacaaaatgaatccaaaattgattaagtgtggggacaaatgatgcgatttccgccggtaacggtaaatgggcactgatttttagttttaagcccctttttaaaaaccaaaagggggcgggggactagagaccggacggaatcgggatcccgcgagataaattcgggatcccaatctcggaatccgtcccgatcgtttttccaaaatcttcgggattgatcgggatcgggatcgggattcggtcgggattctgattcgtgatccctccaaccccatttgtccggtctcta

SEQ ID NO: 38143 - DNA, 700 bp, Heterodera glycines
aagtgggcactcatttaatggcattttaattttataagaattaataattaattttttttatttaattttttatgcatttaaattaagttgaattttagagcttattttggtattttttgttacatagaaatgagtgtgcttagaagggaaattattaaaggaatgggcaagattcaagcgttattacagctcaacagatacaagtagtataaactaacttttattaatattcttgtaacgaaccaagtggataaagtaacaaaatacagtttcgttaattattcacttaaaaacgaaaaaacacaaaacaacacctacaaatttatggaggggaattgctatcttttctaattttcgaagcttaacgtaaataactattccttacgaatataatgtttataattccctctcactacttaaattaaaaaaaattgttaatcagttacagagatttaaggcaaataataaaaactaactgatatttatatagttattcaaaaccaaacactcttacatagaaatgagtgtgcttagaagggaaattattaaaggaatgggcaagattcaagcgttattacagctcaacagatacaagtagtataaactaacttttattaatattcttgtaacgaaccaagtggataaagtaacaaaatacagtttcgttaattattcacttaaaaacgaaaaaacacaaaac

SEQ ID NO: 38144 - DNA, 888 bp, Heterodera glycines
  misc_feature (73)..(73): n is a, c, g, or t
gttgcggaatgaccgagctgatatcgccaataatcttcgattacattttcttggtcacttttttggaatccanccattcaacttccttatcctctaaatataaactgaatcagtgtttgcggaggaccgagctgataagtcccaataatctccaatttacaattttcatgatcacttttgtgatattctcaatatttcaatttcttatatccaaatgtaatctgtataagtttacagtaggaaattgtaatttgggggttattggcgatttcaaatcgatccttccggaacactgatgctgtttatatttagagcgtaatgagctgaaaatgtcagaattcaaaaagtgggggcgcgaaaatagtaaatctgaggttattggcgcttatcaacctgatccgtctgcaacacttaaacagtttatatttaaagcctaattagcagaatgtgaaattctctcatttgttactttatgatcatttttgtctaattcgcaaaattacagctcattcttcgcgaaatataaactgaatcagtgtttgcggaatgaccgagctgataatcgccaataatcttcgattacaattttcttggtcacctttttggaattccaccatttcaactccttatcctctaaatataaactgaatcagtgtttgcggaggaccgagctgataagtcccaataatctccaatttacaattttcatgatcacttttgtgatattctcaatatttcaatttcttatatccaaatgtaatctgtataagtttacagtaggaaattgtaatttgggggttattggcgatttcaaatcgatccttccggaacactgatgctgtttatatttagagcgtaatgagctgaaaatgtcagaattcaaaaagt

SEQ ID NO: 38145 - DNA, 493 bp, Heterodera glycines
acagaacattgtggaaacatacaatggcgaaccggtccatgaatacagttttactcgaccccgaggcgacggcgacgtaagcgtcgttttttggcttgaaattttcaaaattttcgagatttttttggcctagctgaggaatttgatttttcaattttctgacgctagatttaagcgtttggctctacgaaagaattctcactgaaacgtgcccattcagtgagagcttttttgacaggcggtaggcaattttgaaaaacgaaaattaaaaaaaaatttaaattttgaaagttttggcggcggcactgacatggattctgaaggacggagttgcatgttggcacgcattgcattcgcatgggctaaaggtactcggctcgactcgagtggggccaaaaatttagaaaatgcattttttataattaataaactaattaattgattatccatttaactcattaaatttttcaatgaaaccggtcactttggcatg

SEQ ID NO: 38146 - DNA, 1018 bp, Heterodera glycines
  misc_feature (33)..(33): n is a, c, g, or t
  misc_feature (151)..(151): n is a, c, g, or t
  misc_feature (161)..(161): n is a, c, g, or t
agaaagaagtgtaaaatcagtacttttcacgcntataaaattcgggctgaaaaatattggtgtttgtgactagaaaaatagcagatgcatatcaaatgactacagaaaattacagcctccaagaaaataattgctttgcagaagcaatatnttgtagagcncctcaaacacattgtgcttataggaaaggcagaattaaacaataggggcctttttattatgattacaacaaatcagcatggcgtctcgctgatatggtatgtttcagttaaggtttagccgatctacaaatttcggcactgtctattttgtaaaagcgaatcaaattcctttggattccaaagtggaattacagaattgcaacggcaaatacaaaatagacaacgacgctttcattataaagctttaagggaggcaaagtaatacgaatatttcaatttcttacttatcagaatagacaaagataggttacacacgaacatttttatagaaattccggctgaaactaaaatccctcttttggtcttaacttatgaatttttggcccattatggacgaattaagtatagaaggcgtcgcagaaatacattcatattttctcaattcgggtttcaaaaaattaagatttaaaagaagctaaattacagacgtttttcaaattttgggtgtctccgaatagaaagaagttggaaatcagtacttttcacgcctataaaattcgggccgaaaaatattggtgtttgtgactagaaaaatagcagatgcatatcaaatgactacagaaaattacagcctccaagaaaataattgctttgcacaagcaatattttgtagagcccatcaaacacattgtgcttataggaaaggccgaattaaacaataagggcctttttattatgattacaacaaatcagcatggcgtctcgctgatatggtatgtttcagttaaggtttagccgatctacaaatttcggcactgtctattttgtaaaagcgaatcaaattcctttggattcca

SEQ ID NO: 38147 - DNA, 881 bp, Heterodera glycines
  misc_feature (52)..(52): n is a, c, g, or t
tttgaacaaattttagtgcttcaacaggcgtttctccttctaggtcgtgcanggaagaagagaagaggagggcgggccctttcgacgggcgaagccgaccgagagaagggccaacagagacaaacggggccacacgcagcgcgacgagagaggggaaaggcccggaccgaagcaagacggacgacagcgaaagcaaccggcaagaagggcaccacaaaccaagaacgaaagacagagggacgaaggcgaccagacaccgcccaagcgcagaccgcaaacgacgccaaccagcgacccgccggcggacccaggcgcccaggcggggagcaacccggaaacgaaagcccaccggcgccgggggaagcatgcacgcaaagcagaaacccaaaggaacagacggaagggcaccaccaggagaggagccggcggcacaaaccgacacaacacggggaaacccacccggcccggacaccgcaaggaaagacagaaagagagcacacgcaggacgcggcggaaggaggagcacggccgcccccagagcgcggagcgaaaagacaggcgaataccgagaacgagcgagacacgagcccaccaaaaaggcggcacaacgccccggagggcacaacaacagagagggaacaccggcgcgcagccgcacgaaaccgagcaacaacaggccagcgaagcccaaagacgaccggggctgcacgcgcgctacactggcaaaatcagcgtgcttgtccttccccgaaaggggttggtaaaccggtgaaaatttgccgtgattgggatcggacattgcaattattgtccgtgaacgaggaattccttgtaggggcgagccatcaactcgctctgaatacgtcccttgccctttgtac

SEQ ID NO: 38148 - DNA, 941 bp, Heterodera glycines
tgtatgaagaaaggagctcacaaattgcatttctgcgttaattttttcttgaatcacattccaattttagagggttttcgggaacaaatccattttcgcgtttttagtccatgtttcggggttatttattagttctttttaatgcaaaatgtattattaataattaattacatttgctcctatttcaggtggcaagaaaagtggaagtgaggcgtaaacattcaaaaaattgaaaaaaaattaataattaaattttttaaattttttccagacacaattccccccggtgaaaacggtgcgcagagaatgcacaaagatcgcagcttcatgcccatgcgggtatggcagctgtgtgtttgtcaccaggaagcaaatcgttgacgtttgttgtgccggcccttacgagtttaagtgctgccacaatgtgaggaatgccaattttggcgtttttatcacatttgaaatgtgccgggtcaccccaccaagggattatgatggatagaactggattttaatttctcaaacataacccattattattcggagcaatttaaaaatcagccacccatcacatgacgggggatcagtaacgcaaatgttttcctaattacttccggcctctctctggtcccatgcaccgactcaaagtgcatacaaaaaattgtaaaaatattcgctggcatgggaaataattttatggctaaataaattaatttaaatatttttgggttaattttatttttagccattattaatttcgaaatattattactttttaggcgacagcaacgagtggcaccaccgtaacacaattcatttaaatatttaattaagatttattcaaatttaatgaacaaaaaagcaacataagcaagacaaaaattattttcatgtcatttaaaatggttaggatttttaaaaatttttgttaaaaataataa

SEQ ID NO: 38149 - DNA, 949 bp, Heterodera glycines
aaataagtttgcagcggccgcatgtggcgcagaaaccctcattgcaactcggaattggacatctcttttcccagaagtcatacacccaataggggcgataaaaatcacataaatgattatcattatcaatattgttctgggaaatatgtgctaaggcggggataaacaggaaaccggcctgacgccggtttccgctgggctgcaggtcagagctctaacgcctcgtcctcatagcgatgcttggcgtcgagcgcttcctgctcggtttcatgttcactgagcagcgtattcggctcaatgtcgtcggtgcgcacttcaaaacggcgcagatgcaggctcgggtcgccccgaaacacctctacgacgcgggcgctccgtggataagcaggttgatcattttcgcgcatgccgttctcccgtgtgtttcacacagtagcaagtatagcagccgccctcattccgacacgcgcgagccaagatcgcgatcgccgggggagcccgccaacagctcggtcagttcgtcacaggcgcaaatgcggccctcacgcacggtgaagtgcgccagcacccgcacgcggctgcaggaaccatcgcacttttccagctcgaccagatggtgggtcagcaccgcctcgccctgctccgccgccgcgatcacgctcagcgtcatgcggcgggtttgccgcttcagcagcgccatgtgttgctcaaactgctcgaagttcagcgccttgccatccacctgctggcggtagtctgcgctgaaacgggcggcgagctgcgtcggccggtgctccgggctggcgacgacctgctgcagcgtatcgagtaccagatccagtggggtaagttgagtcatcacgtttctcagaaatagggtgaacgacgatcctatcccggtcaggcgaaaggataataaccacatcaagactttcaataacgttaaacg

SEQ ID NO: 38150 - DNA, 1147 bp, Heterodera glycines
  misc_feature (265)..(265): n is a, c, g, or t
ttttgctttccgagaatttgtaaccttttattttctaaagcgcattttcatttcacgtcgtaaaccttcttacacatgacaagtaagtcctgctcgctgggatcttgttttatctttaaggcacttaataattatgtaacttttcttttatgcaaaattaaaatccctattaaattttcagataaatattttattttcttcttttaatatttgccaaagtattaaatttctacaaatttgttagtaattatcagcgtgtaacctntaaaacatgatgttatatttttattaaattattttattaaatttctcatttttattttttttttgaaaaattattattttaaatatttttttgtcaatttattgtataaatagaaatattattttaaattaactcgcagcaactggactagatcatgtttaatgaatttagaattattttttattaatatttattaatatatgaaaaccgattgtttggtaaaacaaaataaattgaattttttccttgccttcccaatcaataaaatagactcgtgtatccgtctggagtatttattataatatcaaatatatcttcacattttgtaattttattttaattatcttttaattcgtttatacgtctgctgtttatagatacaatttttcaaatattctcagtattttttttcataattaatatcattcaaataatatattatttttgctttccgagaatttgtaaaccttttattttctaaagcgcattttcatttcacgtcgtaaaccttcttacacatgacaagtaagtcctgctcgctgggatcttgttttatctttaaggcacttaataattatgtaacttttcttttatgcaaaattaaaatccctattaaattttcatataaatattttattttcttcttttaatatttgccaaagtattaaatttctacaaatttgttagtaattatcagcgtgtaacctttaaaacatgatgttatatttttattaaattattttattaaatttctcatttttattttttttttgaaaaattattattttaaatatttttttgtcaatttattgtataaatagaaatattattttaaattaactcgcagctactggactagatcatgtttaatgaatttagaat

SEQ ID NO: 38151 - DNA, 756 bp, Heterodera glycines
gttgaaaattttgggtttttccatgttcgtaccaactcctccaagaccctttacaactcctagctgaaaacgtgggacagtcaggtctcttcatttgccataaaaatattagaaaaccaaaaatccttaattttttggggtaaaacttggtaataaattacattttttcttggtccctacgtatttccaaagatttttttaaaatcgcagcgaaaattttcatcgatgtacaacaaaatagtcgatgcagaaaaaataattttattttttttaaaaagttggattaatttcaaacattaaaaggaaattaattccgagcttaaaaactttcaattatccaatttcaaacatttttaccaacgtattttgaaaaatccgcttcatggatgtttggcaaatgtattttgaacaatgccgggccgaggacggcacgaagattttccggtgagcattcaacaccattttgtcggcatttttcgtcggcccaacgaagtgcctaaagcaaaaatgaaaaacaaaataaaatgcaaaatttaattaaaattacagctttccaaagttcacattcattgctgatcaacaactgatcgcgttcaaaaaaatagcacaacatttcctgatcaatttgcaaaaaatcagttgatttgaacaatttggctgcattttgacaaatgtaccgcaaacattcgctgacaaaatccttaaatggattaattacagaaaaatatacaaaaaaaatatttggatcttcagaaa

SEQ ID NO: 38152 - DNA, 764 bp, Heterodera glycines
  misc_feature (669)..(669): n is a, c, g, or t
  misc_feature (686)..(686): n is a, c, g, or t
  misc_feature (736)..(736): n is a, c, g, or t
cgaatttttaacaaaatttaaaattttatttatttagcttctgaataaattggcacacaaatagagggacgatgattggaaaagaaaggcgcaccgaacaataaaatgaacaataattgaccaattatcaacgcattaaatatataattcgagaaatatgctgaggattaatacataatatttgctctgtttaaaatttaaaaaactaaaaaaataaacaaaaaaaactttaattcacttttcaactgcttctcgatggcatttgttattgatcgattttaaaatggattttttaccattttaattaatcttccgtctttatttgttgtgctgctttaacaaaatgaatgaactttacccgaacatgtgttacctttttcttttcttttcttaagtgcatttttattagttgaaaatgaactcaacagaaaaatgtgaagcaaatattttcaacaattctatgtcatttgtctgaacaatcaattagtcattaaacgtctaatgcgctaaattttatcaataatttttagaatttgttttcaataaaaacctttttataaataaaccatctttttcgtttatggagtttagggcgggggaggggggagaaataatatatcgggaaagcattcatttaaattttctcttaaaaatatttaagctttttanaccattttgtacaatanaatgtttatcctcctgttggccctgctgactttttttgcgcattttctanattgaatgaatgaaaaaattcactatac

SEQ ID NO: 38153 - DNA, 725 bp, Heterodera glycines
tcaaaaatcctggtcacccccctttggtccccaatgacaaaatcacttttattttaatattttattatataaatgtgataaaaaggtaaaatcaaatatatattatagaggaaaaattttcggattttagtagtatcttacttttacagtaggaagtatcagaagcgagttatgaatttttctccaaaaaatcaaaaatttccagaaattatccaatacccttttcaagccccctccctccggcgagttgccatcaccaccaccgccaccaacgaagtgaattgccctattggtagagtgcttttctcacagtcactcactcaaaaagtctgggaaggttgagagcatttgggtaaatggctcaattcaagaaaaaaatttggggacttatctcccaatcggtcgccaattttcaattctcagcaaattttcaaggaatttccgtccatatacgcaataaaagtgcgtgaaattttggttcaaatcccacagctgactttttcaaatgcaaaattcggtggcaccatcaaacggcaacaggagcagccgaattgtgcgactacgactttcgaccgggcatcggattgaagtgttcgcgcacgtcttgtgccgtgagccgaactcactgtttgccgaacttgccgaccgacagcccatcatcgaatgtgcccaccgagacggcagactagtccgactgctgatcaactgcttgcggcactgtttgg

SEQ ID NO: 38154 - DNA, 1035 bp, Heterodera glycines
aaaaaaggccacgactcaattttcttcttaaaaaatgtgatttttttgaaaaatggattttgacttttttgctcgaatccgggttcgggattagattgggcgaaaagtaagggttaaaattggtgtagatagaattgactagtcaatatcttttaatgatacaaattttgccaagaattgaatgtgttatgggcttgttttggtcaaattttgatgttttctaaaaatccaatttcttgctaaaatcgcttttttatgacttggtagatgggttttcatgctttttcatcattactacgcaatatttaactgtttcacaactgaatttcatgaaatcttttgtggcactaaaccgaactcttacccggcgtccttctccatcgtttgaaatgtcgcggtaatcactttcaagcgccacgttcgactccttcacgcattgtttcaccctctcattgtaccgctgggttttgcttattgtttgttagccaattcaaacacggcgaaacattccatggctttggcaacgttcggacacacttaaacattgccaactgtgagttgtttgtaagttctggggtaaacgatgaacagagacaactgcatggtcgagatgaacgtcccgattccgttgggaaccgtaaaaaggaagaagggataaacattttactttttaaaattcaacgaactttcatgtagaaatcgtcgaccaaaactccgtacaacaaccattggacacagacctggaaaagaactggagtactaaggcacttaaaaacggaggggaaatcgacaaccgccaaatttgccaagcaaagcaaaaagggcaaagattcggtgcttttggtccgcaaaacttggccaacatccaaaagaggggaggcaatagttgctggaaaaggtcatgaaaaattaaattatattacgattatacaatataattgggccgggtctggcgctcgacagactttcatggaccacccgagcccgcgccagctaaattttgaaactaccgggttcaggtcgtccggttaaacg

SEQ ID NO: 38155 - DNA, 681 bp, Heterodera glycines
taggctttttaggcgctaaaaatgaaagcctagaaaataggcactaagaactcgaaaagtagcttaacaacagcccaaaaaaaaacatgtttttcgtgcgtttccggccacggggagctcaggaaaaaaataggttttttgcctaaaaatccgagccctacttattagggttgtaaaaaaaaatggagagcaaattgctacaagtctgcagaaaacaggatttttcaaatttaattgggaagaccaaaaaaaaacggcgtagcctaaagaaatttaacaaaaaaaaaactgaaatttaaaattcgaaatttgttcgacatataattttcacctagcagcttatgatactatctttctatctgtattcataaaaaagcatatagatgtataacattcaccaaaagctaatccggaatttctgaaatggcatattcatatgcattactcaggtgaaacattgacatactatacaattgagagggcatacataacataaaaatatacatagccatatacaaatcagacacaaaactcgcgtgtaataactggctttacatttcggagatgccatatgcgtaaaaatgtgtcttcttcatggcttatacacgtgaaatacatatgcatagtatctgtattgctagcaaattggtattaagcatatgtatacattggaagggatat

SEQ ID NO: 38156 - DNA, 449 bp, Heterodera glycines
ataaagtcaaaataaattcaatttttgtttgattaggcctaatttcatatcagctcgagaatctttgataaaaatgtggctatctcttctcgatcagttttggttttttgttaccgatttggatttcgttctcattttcgagttttccttccctaaagcttttgcgaatggagacaaattttagcggaatatttgcataaaaaggcagagactctctgaacactgtgttactaatgtcactaattaacaattaatcttcttcatttgcatgcttaatagtggtgggctccacctgcaaaatcaattctcacgatccgtaattaatttttctaatgattaatggaaatcaaattaaattggagtgaaggaccaaagaacggaaaattcggctatcctaaagaatgggggtccctaatttaactttttttattttgcgctcaaatcagttc

SEQ ID NO: 38157 - DNA, 773 bp, Heterodera glycines
attaaaatccttttaggccgatgacggagcaagtagtgggacgctcgagcgcctggttcagggtcgcggcccttaggcgcgaggagccgcccggaacgagcgcgcggcgcccacctctggccgccgtagtagaatatacggtgtattggtcaaaatgctaattaattttcacctcaatttacatatctcagcgtttaaggctttcttagttatttttgttcattgaactattgagtcccggcggcatttggacacttcagtcccgggtctgtaactcttcagggagcggttgccgcgaaaaaaattctctcggattatttaagttttatgagtatttttgttagaatatttaaccagcttaaacacagtttaataaatggatgctaattacttttgcattcccaagcaattaacatgtaaaaaagttcaacaaaatttttgtaccccaaattctgagccgaaaatggacgaggcgctaattgaataggaaaattgctattaaaatacaaaataagctgggtccattcacaaaagttctggaatgtacctgacaatgagcttgagctggcaactctcattctgtccaccttgccggccaacgagtccacgtctttggcttcttttgacgatgccgtcaacgccgccgactgagtgcgtttttcttcgcccaaattgttgataattttggtggatgatgagccttcctcgccagcagcagcagcagaagtttaaagaaacatttcagaaattggaatctggtggatgttgcggtg

SEQ ID NO: 38158 - DNA, 1065 bp, Heterodera glycines
attttatttattattacgcgcgttttacccatttaacatattaaattttctgcgccaaaatttcaatcgaattaaatttcatattaacttaattgatcattcgttttctcaatttcaaagcttttgcttcttgcggtctcctttgagttgccatctcttaattaggctccattttctgccaaaatggtcattcgtccgtcctctgttcaaatgcatccgccgctgcacaacaatcgcttccattccaaccaattttcgtttgccgttgccgctgagcagtgccaacaaccgccgatgaacggcggcggcggcacacagccgcccccggcgggaggcgcccttttccaacagccgttccctccggcgccgccccgcgggacggaagccgcggcacagattgaacagcaccaaatgatgctcatccgacaacaccagcaacaacagcagcagcaaatgctgctccatcagctgatgctgaggggcgaagttagccttcccccgcaggggcgtccttctgcccaaccgccgcattctttcccgccaaatccccacaacaattaccaacacattgtgggaggtgaataaaaaagggcctgttggagagagtttcgccgtgcccatttttaatcgagagtaattagcgtaattagcacagactactgagagggggttacgggcaagagtatctgctgcagtattctcgctttttctttcctcttctttttgtgttgtgtctttggcttaattaccgcattgttttagaactgacgccgcccccctctcagccgtccctcggcggactttcgtccccccaggccaacggcaacacgtcgtccgcggcactgttgttgaacgggttcaacccctcgtccaccaccgcttccgtatcctccggctacaattttcattctgtcggcgatctccaccatcccaccaccactgccactactgctgtctctgcctctgaactgctccaacggcagtgccaacaaatgcttttggccagacaggcagcggctgtcctgcagcaacaacagcagcacaagtcgatgtttttgtctgcca

SEQ ID NO: 38159 - DNA, 1046 bp, Heterodera glycines
gataatgagtagggatggtaattatatgcacataaaatcgcaaaatatgcgcataaaatatgcaccaaaaattgcaaaatatgcacataaaaattgaaaaatatgcacataaatttttccaatcgagggtgtaatttctcaaaatttcttcaaatttgttaaacataaagtaaaatcttcaaaaatggctaaatgtggtattaaaaatcattttaggagaaaaaaacacgatacagcttaaaatttactcgttttagcgaaaaatcaacctgaaaagcaaaattttgcttatttttgacataaattaaccattttttgagaaaatttatttattcaatatttttcgtgaaaattttgctaaaaaattatttttttggaaaattttccagtttttgaggtcaaaaaggccaatttgtctgttgggggccgatctattagaggttttttggaaaaacgccaaaatatgcacataaaatatgcacgaaatgccaaaatatgcacaaatatgcacataaatcgcgaaatatgcacaaatatgcaaaatatgcatatggaaatacgtcctagaagcttcaaaccaagctaaaaacatgtttttcgtgcgtttcatgcctcccacagtctaggaaaaaaatatgcatgtgcatataattaccaaccctaataatgaggggcccaaataaatttttaaaattaaatggcacgaaaaaatcaattcaactggtacaaaatatgcgttcaaattcggccaaatggacgattcccacccctccaaaaaatgagtggaaaaatgcaaattaggtgttgtgtctgcggcgatcgaaaatgccctctccttttcttcccttggccattcttctcccggttccccaattctttccaaatggacgccctaatacccgatttaaatgagaccctgaaccgccatacaaacaacgccgacaatgaaacagccacaatttttacgtggcattgaagacctaattagggaacccccgtttgacgcccccggaggaattccttgattttgattctgcggcacaaag

SEQ ID NO: 38160 - DNA, 1155 bp, Heterodera glycines
tgtacagcatattaaaaccgaaaataatttcgtatattttcacaattatttcaaaagacaaaaaaaatgatcaattttgaaacgaaattgtgcacaaaagggagggatggttagacgaaaagaggaatttttagaaaagagcgcaccccatctgatattctcatttttccgttccacaactggccaaaggcgactgtgctcattgacacgtagttgtccaataaggtacttggactttccacagtaaaatgtggtacaaaattttggaactgtcccgcctcacggcggggcttaaaagcattgtacagcataattaaaagctaaaataattttcgtatatttttcacaatttatttcaaaagacaaaaaaaaatgattcaattttgaaacgaaatagtgcacaaaagggagggatggttagacgaaaagaggaatttttagaaaagagcgcaccccatctgatatttccattttccgttccacaactggccaaaggcgactgtgctcattgacacgtagttgtccaataaggtacttggactttccacagtaaaatgtggtacaaaattttggaactgtcccgcctcacggcggggcttaaaagcattgtacagcataattaaaagctaaaataattttcgtatatttttcacaatttatttcaaaagacaaaaaaaaatgattcaattttgaaacgaaatagtgcacaaaagggagggatggttagacgaaaagaggaatttttagaaaagagcgcaccccatctgatatttccattttccgttccacaacaggccaaaggcgactgtgctcattgacacgtagttgtccaataaggtacttggactttccacagtaaaatgtagtacaaaattttggaactgtcccgcctcacggcggggcttaaaagcattgtacagcgtaattaaaagctaaaataattttcgtatatttttcacaatttatttcaaaaagccaaaaagtccggaaccaattttaaaaactaaaatagtgcacaaaaggggagccgccgcacggcggggcttaaaagcattgtacagcataattaaaaccgaaaataattttgtatatttttcacaatttatttcaaaagacaaaaaaaaatgattcaatttgaaacgaaatagtgcacaa

SEQ ID NO: 38161 - DNA, 1380 bp, Heterodera glycines
  misc_feature (1314)..(1314): n is a, c, g, or t
  misc_feature (1322)..(1322): n is a, c, g, or t
  misc_feature (1328)..(1328): n is a, c, g, or t
  misc_feature (1344)..(1344): n is a, c, g, or t
aatagccaaaaagttacaaaaaacgtcagaaaagtagtctttctaatgcaaaaaggtcctgaaaaattaggcaaaactaattataatcaaaatcccttttttaaacatttattgatttgcaaacaatttaaaacgattaattttaacgaaaaagagacacgtttcagaagtgttaccccgccaggttttttttcagtcctgctatttgaatcctaatggtataagaagtttcagtaccgtctcgaagatatacttactttcgcaattttcttcgcgaaaattcaaattttgccttaaaaagtgaaaaaagtcataaaaacgttcaaaaaaatcataaaaatcgcaaaaggaataaaaaagtttaaaaaaaagtcacaaaaaatgaatgttagaagcttcaaacaaagtgtagaaccttttttaagtcagcaaaaacaaagttatttgactataattcccatccctaattggtgatattgaatctcattaaagtcccattaaattctttttcaccacaatatataagtgattgattgattgcgtaatgcttttttttaattctccatggcataaattaaaaaaggcattttcttttcaaagaaattttagctcaaattgtagtatttatgcctcagaaataatttaattttcgcactaagcgtgctgtttcttgttttttgaaaaattcacggcccaaaaacagaaaagtaaacgaattttttaattttttttatataattaaatttaattttttagcttggaatatcgcacggcatttcaaaaagaatttgcacttttgttgaaattattttgcgagagttcttcttattctgcggttgcccacaacagcagtaaagaaataaaaagaaattcaactttaactaatttaaagagatctttttaatgtataggcacatatttttaaatttttctataatgcccaattcatattttttgataatttcatttttcctaataaatcatcatttgattggcataattccaattgaattttaaaaaagtgatacaactaggactaacattctgcaaaatttccaaatttttcgtgccattttttcaaaaaatccgcatttttttgtaaaacttgaaaatttcacgtaaaaattgggtaaattttttcaaaaaaaaaatattcgaatgtttgtaaagtgctttgaatatatgaaatcttttaaggttttgaagaatgttttgcatcccttatgataataataataattttaatattgaattttattgaagctttaagatttatttaattttaacactttaaaaaaaagttcttaaaattanagacttgntaaaangtaagaatactgccgnggatgaaaatgtatataattattttaatctactcct

SEQ ID NO: 38162 - DNA, 790 bp, Heterodera glycines
ctgagtagcgaaaaagagggaggaagaagcgcagaaccgtacacgaaaagtgcgagggaaaagcgaggacaacactaattggggacagcaacaaatgagaggcatttgggaataaatccatttaaaaccaacccgagaccatttctcgccgaacgcatcttccaaagtggcgagaatggaaagtgcgagaagatactgtaagggggggggggtgaaacggtaatacagtaagacaaaagcgggaaaaagagaaaaagacgaacaaaaacattgagaagaacgaaggcgcagagaaacaaaaagaggccggagagaatcttggcatgaggcagaaagccaaggaagacgagcaactggtaaaactgattctcacctgaacgaaaaataattgccaattttaaaatggcaaacaccgtaaccgaaagagaggaaaaggggtactggaacagaaaaaatcacagaccctggtcaatcagttggtcgggactgagtccgcttttggcactgacatggccgacgagcgcaacaacagtggccacttggaggacactgatcagcgcgtgggtaaacaccaaaacgaaagagtctctgcacattttaaagggtattctcgagatttagatgcatttttaagtgagggcactcacttcaccaaattgttggaccgtttgttgtacgatccgacggtgatcaaagcgccgaagccgacaccactggccaaaatggcctgctcaacggccgttttccaaaccttagcacagcgaaagtaatgcatttgcctcgacaatta

SEQ ID NO: 38163 - DNA, 715 bp, Heterodera glycines
tttatgctaaaattttgtttttttttgtcccaaaattctcccttatggcaaatttcattaaaacttcttatattttcactaattactcgcactttttgtgaaaatctaactaaattttcaaaattttcctacggcggcctttgtggcaccgccggatccctttgatcctccgtccccgccacggccggtcgtaccacgtacagtagggggtctggttagcctgcctcttgttttttaactgtattattacataaggcaaaattggaaaaaccgaatcccgactgatttggtctaccccaaccccgctccgacccagttgaccccgactaatccggacttttgtcaccccgagtgtcggggcatgccctacccttttctaaaggaaatgcatttaattatttatttgtaatttatattataattttaaaaagaactgactgtttatcagtgcatttttctatagtcatctgatgaaaaaatggcagaaactcaatttcagcaggtaaatattcggcttcatatactttcattaacaaatccatcgcaaaatgtgaccaaatgcaaaaattgccttttacagaaatttgaataatttcggtaatttctccttttgtctttttcaaatttacatgcatttctatgcttttggtaaattcatcttttgttccatttacattttctgacatttcaatgctttcggaattttttaaatttt

SEQ ID NO: 38164 - DNA, 1147 bp, Heterodera glycines
  misc_feature (91)..(91): n is a, c, g, or t
  misc_feature (103)..(104): n is a, c, g, or t
  misc_feature (1031)..(1032): n is a, c, g, or t
  misc_feature (1118)..(1118): n is a, c, g, or t
gatgctttttcttcaaaaagggagatgaataaatttttaaaatttttatttcctttttaacagcccaaaaagtttaggcttatatttaaanagttcatcgacnnctagcgcactaaaatcgatataatctctccaaattttgcaggccttctccattgtaaaggactaacttaacttgaaaaaatgccaacgcttgttgtttttaaaatttttcgaaattctgactttttcattaattatttattttttgcaaaattaattcataagtattttttcagaaagtgctctgaaacgcaccaaatgttaattaaaagttaaataaggctctctgatgctttttctatcaaaagggagatgaataaaaattttaaaaatttttaattcctttttaaacaggccaaaaagtttaggcttatattttaaaaagtttcatcgaacctagcgcactaaaatcgatataatctctccaaattttgcaggccttctccattgtaaaggactaacttaacctgaaaaaatgccaacgcttgttgtttttaaaatttttcgaaattctgactttttcattaattatttattattttgcaaaattaattcataaatattttttcagaaagtgctctgaaacgcaccaaatgttaattaaaagttaaataaggctctctgatgctttttctatcaaaagggagatgaataaatattttaaaaatttttaattcctttttaaacaggccaaaaagtttaggcttatattttaaaaagtttcatcgaacctagcgcactaaaatcgatataatctctccaaattttgcaggccttctccattgtaaaggactaacttaacctgaaaaaatgccaacgcttgttgtttttaaaatttttcgaaattctgactttttcattaattatttattttttgcaaaattaattcataagtattttttcagaaagtgctctgaaacgcaccaaatgttaattaaaagttaaataaggctctctgatgctttttctatcaaaagggagatgaatannatttttaaaaatttttaattcctttttaacaggccaaaaagtttaggcttatattttaaaaagtttcatcgaacctagcgcactanaatcgatataatctctcccaaattttgca

SEQ ID NO: 38165 - DNA, 823 bp, Heterodera glycines
tgccattgacatttgccctttcccggcattggatttctttgtgcccacttttgcttcagcttcgtcttgtcaatgtctttgggctgttccacggaattctcttcgcagaattccctcactttgtccacccatttcgcgtggtccgcgggcgacagcggcggcggtgcctttgtcttccgtctcctctcaactcgcgcccgtgccaaaatccgcgtgtcctccggcagcaccgtccgcagaatgtgtttgactcgggcactttggtcacactcaccgtgcgcacttcggaaggactttttgagctgttccctagccaaacgatattgttaattagttggtaattagtcgaaagaaatcactaattaatgttgtaattaaaacaatcattttattttttgtgccgttttggctaccatttctctctccgttccgccacacttcgcccggacaatcgcatcgatgggtcggcccaattcacttcgctgtccatgttttggtaacgggggaccaatgcgacgaggacgggcattcggggaaggtggtcacaaaggtactctgaggaaggggaggcaaatcagtaggaatgtaaaaacccatttaaggaaaaaagaaatttgactcgtttcccaaaactattacaaaataaaatttttatttgaaattgtaaatttaaagaaacgattcattttaaaacaacaaaaaaatcaaaagtcaaaattatgattaatttatttaattttcaatttgaataaaatgattagattggctgattggactcataaattgcgcattgtaccgaattactttaaggaaaatgacaaaa

SEQ ID NO: 38166 - DNA, 187 bp, Heterodera glycines
ttccaatgcttttcctcccccctccctcattttccctcattgcaatgcttttcctcccccctccctcattttcccttagtgcaatgcttttcctcccccctccctcatttcccttattccaatgcattttcctcccccctccctcatttcccatattccaatgcttttcatccccctttcctcattt

SEQ ID NO: 38167 - DNA, 349 bp, Heterodera glycines
aattttgttgatcactacccgaccggggtccccgaccccgacaattgagctcaccccgacccgacccccgacatgtggcccccgaggtccgcggtgtgttaccctcccccctcagggattgaattctttgtccaagtagtattttgtgatgcctcgatatgaggagatgttaaagcgtttggttgaattacaaatataatatattttcaaagctggtcggacataaacaattttatgcgccatgaacatatcaaacagatttctcctttgctcacgtagttcagtagttgcaagtattctaatcgagtacgctatggaattagcgggacgctacatttaaaaaatactc

SEQ ID NO: 38168 - DNA, 1103 bp, Heterodera glycines
atttctcagagatttttaaatttatcttatatccaagaaaaatgactatctcttattttgagaaattttatacgttacaaatgctctcgagcatgataggaagggcggtgcgcaatcgccattttatttctcagagaatttttaaatttatcttatatccaagaaaaatgactatctcttattttgagaaattttatacgttacaaatgctctcgagcatgataggaggggcggtgcgcaatcgccatttaatttctcagagaatttttaaatttatcttatatccaagaaaaatgactatctcttattttgagaaattttatacgttacaaaagcgctcgagcgtgagagggagggcggtgcgcaatcgccatttaatttctcagagaatttttaaatttatcttatatccaagaaaaatgactatctcttattttgagaaattttatacgttacaaatgctctcgagcatgataggaggggcggtgcgcaatcggcatttaatttctcggagaatttttaaatttatcttatatccaagaaaaatgactatctcttattttgagaaattttatacgttacaaaagcgctcgagcgtgagagggagggcggtgcgcaatcgccatttaatttctcagagaatttttaaatttatcttatatccaagaaaaatgactatctcttattttgagaaattttatacgttacaaatgctctcagcatgataggaggggcggtgcgcaatcgccatttaatttctcagagaatttttaaatttatcttatatccaagaaaatgactatctcttattttgagaaattttatacgttacaaaagcgctcgagcgtgagagggagggcggtgcgcaatcgccatttaatttctcagagaatttttaaatttatcttatatccaagaaattgactatctcttattttgagaaattttatacgttacaaatgctctcgagcttgataggaaggcggtgcgcaatcgccatttaatttctcagagaatttttaaatttatcttatatccaagaaaaatgactatctcttatttagagaaattttatacgttacaaatgctctcgagcatgatag

SEQ ID NO: 38169 - DNA, 1032 bp, Heterodera glycines
attcagaaaacggctgccaatttgaaaggtcacttcctaaatcccccttttgggtccgaactaatcttaacgcccttaaatgccttcgcatgagtttcagaatattaaagttaaaaacagaccaaactttgtcgaacagttcaacaaatgcaatgtgttctgtcagcagagtgaagctgaagaaaaggcgtcgcgaccgattgagcgcgtcacggaaaatgcgttcggttggtgccgtgacattgccgttgttgttgcattgttgcaggaacagtgccgaagaggacggcgcatttagcacatcgtattgggcagagggggtacaaaggacgtcgtaatgggccgaaaaagtggaggcaattaacaaaagcaatggcaaagacacttttaggggtaaacaacaaccattggcgtggtttgttcatccgatgtgacttcgcaaatggggccaacgacctcggaacagtgcgaatgtctgttgccggcggagaggcggtcgtattggggccgtgaaggaggagaggaaggcgtagtgagcacttcgtagtgggactaataattaattggaattgcaaaatcagtggggcagtgagacgcaaccaaattgtgtgatggcgacaaaggaagcggcgatttgggaagtggtggcaccgttcgtgggaaggcatcactttctgttgaacattgtgccgcattttgcctcggcgttcgaggcggaagcggcggaggcgcaagcgaatgggacgggtcgaaagcgtcgccattttgcggcgaagacggagaagggcaatgctgaaaatgaaaaaaggcttttacaagatatattttgattagcctacctcttcgctttcccctccgcttgtcattccgtcggttttcctcgtccctttcctttcgccattcgtttgttgcgcggagtgttggcgcatcggtggcaatgaatcgtccaagcctttcccgagttgcgtttggctccctgcaaaaagtctctctgtttcctctctcatacgcttagtcttaagcacagacttt

SEQ ID NO: 38170 - DNA, 907 bp, Heterodera glycines
atcgtaagattgtttgatagggccagacaagagaagccttttgattggtaccaagtttgcagtaaaaaaatgacaaaaaacatatagccattttttggtcaagaattttttttgtttgcgtttcaaatatcgtaagattgtttgatagggccagacaagagaaggcaactgttggtaccaagtttgcggtaaaaaaatgagaaaaaagagatagctattttttggtcaagaattttttttgtttgcgtttcaaatatcgtaagattgtttgatagggccagacaagagaaggcaactgttggtaccaagtttgcggtaaaaaaatgagaaaaaagagatagctattttttggtcaagaattttttttgtttgcgtttcaaatatcgtaagattgtttgatagggccagacaagagaaggcaactgttggtaccaagtttgcggtaaaaaaatgagaaaaaagagatagctattttttggtcaagaattttttttgtttgcgtttcaaatatcgtaagattgtttgatagggccagacaagagaaggcaactgttggtaccaagtttgcggtaaaaaaatgagaaaaaagagatagctattttttggtcaagaattttttttgtttgcgtttcaaatatcgtaagattgtttgatagggccagacaagagaaggcaactgttggtaccaagtttgcggtaaaaaaatgagaaaaaagagatagccattttttggtcaagaattttttttgtttgcgtttcaaatatcgtaagattgtttgatagggccagacaagagaatgcaactgttggtaccaagtttgcggtaaaaaaatgagaagaaagagatagctattttttggtcaagaattgtttttgtttgcgtttcaaatatcgtaagattgtatga

SEQ ID NO: 38171 - DNA, 490 bp, Heterodera glycines
agtagggttgtgaattatatgcatataaaatcttaaaatatgcgcatgaaatatgcactaaaaattgtaaaatatgcacataaaaagtgaaaaatatgcacataaatttttccaaattgaaggtataatttcttaaaatttcttcaaattcgctaaatgtaaagtaaacctttcaaaagtggccaattatggtattaaaaatcattttagataaaaaaaacattataaagctaagattgacgaatttttagcgaaaaatcaaaccaaaaagcgaaattttcgcttttttttatttttgacataaattttcaaatttttaagaaaaatttaatttttgcaatattttttagaaaatttggctaaaaaatgatttttcggataattttccaggctttagaggtaaaaaaggctaatttagctgatgggggacgttctaatagaggttttttgaaaaaatgctcaaaaatgccaaaatatgcacaaatatgca

SEQ ID NO: 38172 - DNA, 878 bp, Heterodera glycines
agataaagaattgataaaaaattatattaaagcatatccttctagatgtttttattaattttttagaattgtttaaattcattacagttaaatttttggtaaatttcatataaataaattttttatttttaaacagatcttaattacttattgtagttgatttttcctggcaattacttgtttttctgctctgcgtttttatttaaattatttttttagtaatattaatttttagaaagtaattctgaattacaaaaataacgatatgatacatggtgtgatcgacccaggagagccatataatttggttttgcggtaatatggcctcctaaatgcttttttagtatttgtgattttataatttggttgtattttataggcaaatataatttttgtatttccgacctatattggtttctctttagtgcgtaaccatttatataaacaatttgtttatgccataatataaaaaattattcaactaatgtaactaaggttttatcattatttttatattatttaatttgttttttatcttctttgcaatattttttgtaaagctcaacattctgcagattatttactattttataattaattttagataataggtttaagtagagttggtcggtaatcggtaattgtaaaaaaaccggtaccggtactgaccggtactgcaagaaccggtaccggtactaaccttttccaccggtaccgctaaaaaccggtaattttgtaaagttaaaaatttttgaacaaaatttttaattttcgcgcgagtgactgtttttaaccaagtttttttttcaaattcagggaaagaaaactaaaaccagatttaaactctaaaattaaagattttttggaaaacaaggggg

SEQ ID NO: 38173 - DNA, 1024 bp, Heterodera glycines
  misc_feature (53)..(53): n is a, c, g, or t
tggcttgctgtttacagttggctaagtcttctttgcaagaagcagcacacttnttgtttgggccaacgacccaaaccattcgaatagcaatcgattgggctgactagactcaatatttgcaggaatagcaatggcaggtctatcttaaaggcctgacgagttatgtttcgacaaacatcctgtacaccataaatcgattttcaaatttagtcgaactatataaatttttcaaaaaatgattcatcttttttatggttagcgcatatgtctctagctttatagaaacggtccccgaatctgcgaggaactacttttttgagaatttctatagattattattctgcatgaatccttcgcttaaattcccatttatctcataaagtcagattaaattaattaccccgatttgttttagaattggtccaaacacgcttgctaatagcttttcttttcgaaaagagaggcgaggaaaaataaaggttgcatccaaatgtaatttttttttacattgaagcatttggatggcttgctgtttacagttggctaattcttctttgcaagaagcagcacaacttttgtttgggccaacgaccccaaaccattcgaatagcaatcgattgggctgactagactccatatttgcaggaatagcaatggcaggtctatcttaaaggcctgacgagttatgtttcgacaaacatcctgtacaccataaatcgatttgcaaatttagtcgaactatataaatttttcaaaaaatgattcatcttttttatggttagcgcatatgtctctagctttatagaaacggtgcccgaatctgcgaggaactacttttttgagaatttctatagattattattttgcatgaatccttcgcttaaattcccatttatcttataaagtcagattaaattaattaccccgatttgttttagaattggtcaaacacgcttgctaatagcttttcttttcaaaagagaggcgaggaaaaataaaaggtgcatccaaatgtaattttttt

SEQ ID NO: 38174 - DNA, 1103 bp, Heterodera glycines
  misc_feature (1078)..(1078): n is a, c, g, or t
aaaatgccagcagacaaaccgaccgttatttgccccctttcgaaacgtaagcagttgatgacacaagcaaaacgcggctcatttcgctgttcggcaaaagcggtcaactcactgctcagcaaagtgcgactaaataacagcaaatgttggattgtaaaacaatgagactttttcatttttttcttttggtagatttccaaaattcccttgcaaaaaatggcgaaaacccacccggaaatgccgtaattgctgttgtcctcggcagtgttgttgtcattgtcaacgaatggaattgcgaacagcagcggcagcgtcagcttcatcagctggctgtagcagtagttgaactggcggaatcgttcatcgctgacactgctcgccatgaacagtgtttcgacgagtttgaagcacagacgagagccggggtggaacagaaaacgaatgccgggctgacaaaatgagggaaaattaagtgacggaaagattgggtaggctatggcctggctattttttctttggttttaattaactaggccctattttttcaaattttgtcatgctctttttggaacttaaaacaaacagacgaacggtcattcatttacacatacaaatgcgcacctgacagttcaaacagttccttgtcgcccggatcgtctccagcaaacagctgacacaatgctcctcctcctgcgcgttctgttggctgttgtgttgcgtgtcctcctccgagtcggctgctgctgctgcggcggcgctattagaacgaatggtgtccaaccggcgaagcaatttgcccatcagcgacgtcaacagttggaagccgccctcgttgccaaactgtgccaattgtaagaaatggaattgattgtttttaaattttcggaaaaattaaaaaaggtactgagtgaataggggtttcattgaattgcaaatgttgtagattacctcattaatccacgggacattgttgttggtcatggtgactcgcaatgattccagcaactttttgcggtcctccttgcgttccagcgacttctttatccggtgacggtattgggcagctagactgaaaaanttgtttacgcttgaattcataatga

SEQ ID NO: 38175 - DNA, 1253 bp, Heterodera glycines
  misc_feature (1237)..(1237): n is a, c, g, or t
aaaaagtttggaaattttggttttgtgaatttttctgaccatatctttcttgaatcttaacaaaattttttcgcaattttttcagattaatagaggacacttaggtctatcgaacgatattaaaaatgttggattttgttggcaaagaaaaaagttatagccaaaaacttgcgctcgtactaaaacggcccgtactaaaccgaccccgaccctttttaattttatccttttttgccattcggcgtaaaattgtttgcattagttcaataaatgttattttttatgtatttcttattaatcggggtggggggaggaggaatattgacaatcctattttaaaaagttcggttttaatttcaaaaatatttttttattgcgctaaaaggttaattagatttcccttttctaaagacttttttgaaaatattttgacaaaatttggcatttccttttttagtgtttggcctttttaagaaaattaaaaaattgttttttaaaggtcagacagactccaaaaacatcgatcacacattcatataattaacgcgtgtttgggctaaagcggattggggataataaattaatgccaaagaaaatattgtatcaaaacaatttttagaggacaggaaagacaatatttttaaggtgttctggccataactgctgatttttaagaccttattttggtggagagaaataaaataataaatattttcgggatagcggaaatgttcgacaaataattcggcacgagttttagtgtgctaaaaggggccaaacaattaattagttaaaggtgtaagagccaatggcgctgaaaaaagccccgaataaatttaaagtatgcaaattagtcgaaaatgttttaattgttatttatttggtcgacccaaataaatttttttgtatttttaaaaatggaaatttctgtcaattttttggttgagaatttcagttcatgaaaaaaacgatttttagggtgaatttttcattgattgaatttttttaagaaaacacgaggaagctaagaacaaaaaaattaaaaacccttatttgatttttcgagaaatgacaaaagactaaatgaaatttgatttatttttttagaaatttgtggaaggaattaaagtgatataattaggctaaatttagtgccaattcaatgatgtgatggcattatttaaaccctcgtattattttaatggggcctccttccttctttttgagttgaggccanaagaataaaaatggca

SEQ ID NO: 38176 - DNA, 1062 bp, Heterodera glycines
  misc_feature (68)..(68): n is a, c, g, or t
  misc_feature (96)..(96): n is a, c, g, or t
  misc_feature (98)..(99): n is a, c, g, or t
  misc_feature (121)..(121): n is a, c, g, or t
  misc_feature (125)..(125): n is a, c, g, or t
  misc_feature (132)..(132): n is a, c, g, or t
  misc_feature (135)..(135): n is a, c, g, or t
  misc_feature (137)..(137): n is a, c, g, or t
  misc_feature (146)..(146): n is a, c, g, or t
  misc_feature (148)..(148): n is a, c, g, or t
acattctcgatcatttcgggcgatccatacctttgcttaactacgtatccaatttagaatttttaatnaaagtattccttaaaggatttaaatatncnntaatatgattttgtgtaagatnaaanatttttnaantntaataaagnantttttttgtttgaaattgcccaaaaaagccgttttaccaaaataatgtcctgttgacaaatattatcaatcaaaaatcaccattacctctctcctcctccgttcctaaaagttatttttcatacaaatttcaggaaaactatcgccttctggtcgacgaacataagaattgtccggccgaaattcaaagtgagtttagttgcatttttgaattttcttatggttggagagcaaaaattgcaaatttaaatttagctggtctaattaatggtaaaaaaataaataaaattcacttaaattgtaacatttgtctctaagtttctgtttttttccccaaatcctttctttgtttattattttgatacgttttctcttatgtcgaatttccaccagaaaaaagctgcttcacagaagggggcattggacagaaaaatgaattgaaaagttagccgaaaattatgaaaatcggatgcaatgtttccaatcggaatttgaatggtttccttcaagttccaacttttttctcatttttttgattggttacttccattgggtgccaatgccgtgacaaaaaattgttcgaatttcgaattgatttcccgccccctcctaacataagaagggtctgtctctgtgaagcatcttgtttttgtcatttgaggctgtaagtgcgcacacgatggtcccaccggtggtaacaccccaaaatggtcattggacagcgcaggagcgaaagttctgagggaaattgtgcaccaacttgagctggaccgtccccagcttgggcttgggttggaggaaaaaattggcgtaattcggatggtgtttgaacgggttggctatgactttccggagagtcgggccgccgaaatcatcggccgagcaaaccgcgaaggtggagtcggggccgccatt

SEQ ID NO: 38177 - DNA, 1246 bp, Heterodera glycines
aacaacgggttcagggggttaccggtttcctctaaaaaaaaataaaaaggaataaaaaataataggaattttgcattctcattatgagttatatcaggcttcaaatgagtctgacttgtgtagaagagtttacaggactcgtaagtgaagaaagaaaggccagcataaggcatcacaccgagcagagtggggaaaatgccacggtaaaaagtgaggaagccatgggcacggcactccttgaggaaaacggcacgtaaattttggtactcttctttggtggacacggagagacgcgcctttaaagtgcaaaaaaaaaaattaaattgaaaaaggaaagacaactttggcagtgtccaatgggtaagtaaatacaacggcagtgacaccggccaaagtcccagccaaaaagcgccggtagggagttgggctgaactaacaaagaaaaatggaaatggcaaaacattggtggacacaaaaagggggtttcctgttctgggaaaccaaaatttaaaaaataaaaaaaccaacaaaagaccgcgcagaaacaataataatttggaggcaaaaatgccaaaaatgaaccaagattaaaattgtcttttttaatttgtcgaaaattttttatttttgcacgggccttttgttggcttttttatattttaaattgtgacccaaaacagtaaagtatccaaaaaagtacaattatcagccaaatttctgctaaaaaaaattggatttaaaaaagcacacccacctatttttatccacattcagcatgtgtttgaattcctcatgtgccgcgaattgaacggcggcgtacggcacaacacgcgcgagagaagcggaattgccgcgaaaaagggctacaaatccttgttcccggtaggtcaaaatcacaaatcgaagtgccgctttgaaagaataacgacgagaaggcgacactgaaacacagacgaaacattattgaaagaaatgtggaattttggaaaaatttgttgttggacccaccttggaaattaatttttgtcctatccaaaggggcgatcgccgttttagcaaatgctcctaaacacacaccattattagcatattaatgaaaaaagtgagaaagagaggacctgcaattgcgccggatgcaagtgaatggaaaactgaactgaatgaacgggttggacttgagccgtcggaaacggaagcggacgaccgggcggtgggtcacttcaaattcaaatggaactcacaacga

SEQ ID NO: 38178 - DNA, 1107 bp, Heterodera glycines
tttttatagatttttaaatgtttggatttttttttgtcttctctagacttcatcgaacctggctctttttaaacatgccctaaagtttaggcttaactttttttaattaaactgatcagaagcgcaccagattttgcaagggcatcaaaaagacaaggaaaagcaccgctatgatgctaacgccagtaactcttaatttaaaaatttttattaatttttaaaacttcactattttatttttttaatagatttttaaatgtttggattttttttggcttaccaaaacttcatcgaacctggttctttctattctctttcaaatcgccccaaattttttttacagcttaactaggccctattaagcttatttccagaaaatctcgcatgaattctcatttttaaattttttatagatttttaaatgtttggattttttttggcttaccaaaacttcatcgaacctggttctttctattctctttcaaatcgccccaaattttttttacagcttaactaggccctattaagcttatttccagaaaatctcgcatgaattctcatttttaaattttttatagatttttaaatgtttgcattttttttggcttaccaaaacttcatcgaacctggttctttctattctctttcaaatcgccccaaattttttttacagcttaactaggccctattaagcttatttccagaaaatctcgcatgaattctcatttttaaattttttatagatttttaaatgtttggatttttttgggttaccaaaacttcatcgaacctggttctttctattctctttcaaatcgccccaaattttttttacagcttaactaggccctattaggcttatttccagaaaatctcgcatgaattcctcttttttaaattttttttagatttttaaatgtttggattttttttgggttacccaaaacttcatccgaacctggtttttttctattctcttttcaaaacgcccccaaatttttttttaaccagtttaaataagggcctaattaagcttattttccaaaaaaatccccccaaggaaattcccctttttttaaatttttttaaaaaattttttaaagggtt

SEQ ID NO: 38179 - DNA, 1031 bp, Heterodera glycines
ttattaaattttaaaaattttttaattgctttttaaacattccaaaaaatgtaggcttaacttttttagtgtaaattcgatcactcatattttttgctaattgagcagaagcgtaccaaactttgcagggatactccccggtaaaggactaacttacactgaaatgagcgccgagctagctggctcaaaaaaattttcgaaaatctgagtctttcgtttttatttattttttgcaaaattaattcttaaatattttttcagaaagggttctgaaacgcaccaaattttatttacatgttagtttaggcactctgatgctttttctatcaaaaagggagatgaataaaatttttaaaaatttttaattcctttttaaacaggccaaaaagtttaggcttaacttttttttcagaaactgatcagaagcgcaccaaactttgcagggatactgaaaggaagagaaataacctattttaaatattatctagtcagttcatttaaataatttttatccaaaaaatttttttttgggttttcggggcagtccccctgaaccgatgcgcccagatttataaggagtccgaatccttcgggaatagcttcgatatacctctactttatttttaccttggatttttgctccccataattgtttgagtaccccaaacggacacttgaaaaaatcgatttttttatttcataaatattttttcagaaaatgctctgaaacgcaccaaattttatttacatgttagtttaggcactctgatgctttttctatcgaaaagggagatgaataaaatttttaaaaatttttaattcctttttaaacaggccaaaaagtttaggcttaacttttttttcagaaactgatcagaagcgccccaaactttgcagggatactgaaaggaaaagaattacctgttttatcacattagcttgtcatcagtttttataaaaattttcaaaattctgagtctcctattattttttttttttttccaaattttgaaggcggggggggggggggg

SEQ ID NO: 38180 - DNA, 1005 bp, Heterodera glycines
  misc_feature (918)..(918): n is a, c, g, or t
  misc_feature (955)..(955): n is a, c, g, or t
  misc_feature (957)..(957): n is a, c, g, or t
aatttggcattgtaaataaaacgccaaatctcacacctttcactgtttttcaacttgatgcattgagaggagggggccaaagccccaattcgcccctttctcctgccaaatcgcccttctattcaattagcactgtgtcagctttcaaagtcatctccaactgctcacattcggtggaataattgcatttaaacgcggtattctttcacagttttctttttgaacttttgcatttctaacggataaaacataaagccttaacttttttttgttgttggaatttattagcacggatttcgtgttttttaactaaattctgcagttttttcagaactttcatcccctgtctttaaactatgaattttcgatgaattatttatcagttttgttggttttaatcattcccttttctcagatgccttcggctaacctttcggaccattcgcggctgttaaagggcggccgcgggttggcccaccacaaattgggccccggcgtggtggccttgcactcgtccgccttccaggagatggacgagtacgcgccctatcgcatcgtcttccttttgctgtttattgtttcttccgtggcgctgtgggcgtcctacaaaatcatttggtacgctccattaattacgaatcatcgtcatttacataaatccgtttaatgagacgccatttcaaagatccaaaatatgggcaaaaaaagatacatgtaaattcttttgccttgaaattgctcagaagacacaatattaagtgtagttagtctttttcgaaaaatgggaaagtgagcagggagcggcgctgccggggaaaaatgggaaattgtggccctattttacaaaacagtttaccaaaacatatataatattttcagtcaaatcttgaaaaactaatggtataaatttttgggagnttcggtggtgccgacaagcgacgcctgaaaaaaattngnggttttaaatgaaaatggtaaaaaacagtcaaaaatttttggtttttt

SEQ ID NO: 38181 - DNA, 710 bp, Heterodera glycines
  misc_feature (16)..(16): n is a, c, g, or t
ggacgcgcatggctcncacgcggtcgtcaaagtattcttccagcagcgcgtggcgacagctgatgaaagacaaaaaggatgtaagaatgacgaaaagtaaaacaattttgaaggtttccattattttactgttttcccattcgtccggaaattttttacaaaaaaaaatccagcaaatttttataaagctaataatcctgcctaaattttcaatttttcaaaaaaaaattaaattaaaaaattcgaatatttttttggagtttccgtttcctcactaaaaattttacatagaattttttttttttgaaatccagcaaatttttataataattcttcttattttctgcttttcacaaaagacaataaaaaaagtttcgaacaattttttttaaattttctatttcatcaaaaaaattttctacattttcttgaacttgcaattcggaggaatggtaagtggggggggggggggggtacgaagcgggagacaaattgcaccaatttgctcgctgttttttgtcacctgctgccctccaaatattcgatcattttgttgaatccgcgctcaatttcctttttgcgctgctccaccaattcttttgggcacattttttgtctgcaaataaaaagaaattaaataagtaaatacgtgtgatctgttggtgttgacgaaaaggtaattttttgaaatacaattttaaaaattcaat

SEQ ID NO: 38182 - DNA, 1116 bp, Heterodera glycines
tttttaatttctcacatggtacaaattcaattttgggtcaatgttcgcaatttcttttgatgtcccactcattttgaaatgtccattattgtcggttttggattgtgccatcaaatcatcaattgtaaaatctatcaaaaaaaaaatttgaaaattattaatttcttaaattattttaaatatttacggtcattgtcgtacagctttacttttgtcccgacacttggctttccttggcatttgaggtgtccagaaactgttacagattgttttgtgccaaagggatttgccagtgccatttgcaaaagcatggttaaaacaagaaattttgaacacattttcactgaaatttaattacattaaaaaaagttataattatttctttatatttaaaataaaataaataaatagaaataaaataattaatatttccaagattaaatgcgttcttttttgtaaaatttctttatcttttgaaaattttatttcaatctttgaaaatatctaattttatttctcattaaattgccataaaaatataaattttattaaaatttaaaaatggttacttgaaacctttttataaaaatattttataaataaatttaatattttaaatcaacaaatgtaaaactaacgtcattttttatgcttttaataccatgcacaaattgttttgttttcttcaaaagaatgaataagcggtataagaaatgctttcatataattgaaaaactttttatttaatcataaatgtatgattcattaaaacctagcattccaattcctttacaaaaaaaaaaaaattttttttgtttcgaaacatatcattctatgtaaataaaatatgtataaaaaatgctaaaatatgtatgaaatatgtacaaaaacccccaagtatgtactaaaatatgtaaataaaattttttaaacggttattttttggatgaaaatttttcataaaaagtgaaacagaggcataaaatgccataaaaatgaccaaaataggcttagaatcacattgtagtatttcaaaaattaatttttgatatatcattttttgaaaaaaattccattttttagggatacattttcaaaattttttttttaattttt

SEQ ID NO: 38183 - DNA, 1053 bp, Heterodera glycines
tatcaaaaaaaaattaaatataattttttatttattatctccctaaaatattttaaattaattaaaatcattgaaaataacgtaaaaatgcacagaaaaataatgttacaccgtccggatccgaacctgccccctcccccctcaaaatgatgcctcagaatccccaatcacacagggattctgaggtcttgacgatgtcaaaagtaaaatctgatcacgtattcgtgatcagcgtcataaaatagccctaatgacatgtttttggaagatttttggtgaaaaaaatttttcaatcaaaaatcctgtcacccccctttggtcccgaatcccaaaatcacttttatttttgtaacatctctcaaaaaagtgataaaaatgccaaataaaatttatataatagagcaaaaaattgcggatttttttagtattttacttttacagtatgacttttcagaaccgagttatgaatttttttctgaaaaatcgaaaatttccagaaattctggaataactttttttcttttgaacattataaaaccaaataaatctcataaaattctccttatttttctctatttttaaggctttattcctgtaaaattgatcaacccttcgatttgttatgaattttcaaatatttggccaaaatcccgagggccaaaaaattgccaaaaaataaagaatttttaaaaaattccaaaaatcatgaaacgaaaaacaaaggtcaaattcgagctcagcaccttaatttaccccagaaaaatatttttcacaccctttttcgaccccaaaaaaatttttgaaaatttctagggggcctagctcgaaaatttttgaaattttccgggcatatagcacacctttcgatagagcttaaaaagctctacaattttgctctaaggcattttttggctaaaaccaactactgacgagttatgggcccaggactcaaatgtcccgctcaggccaaaaattttttctatttccgggaaaaaatcgaaaattttccgaaaaaaataccagtcgatagagctcgaaaaactatgtttttgg

SEQ ID NO: 38184 - DNA, 1487 bp, Heterodera glycines
cagatcaccgacgaggaactcaaacaactctgcaacctcctcacggacgtcttccggatgcagcagacgctcgtcaggatccgcccgccggtcgtcgtcgtcggagacatccacgggactgacaacagttgacccccaaaaacaaatttcagatcaagtacccatcgaacttcatgctgctgcgcgggaaccacgaatgctccaacatcaacaaagcgtaagtattgtttttttttcattttaatcttcaatcttttttcccctttcagttatggcttctacgaggagatcgaccgccgttacccgcgaccgggcgctcgtcgactcttcgacctcttcaatcaagtcttcgcctggatgccattcatcggactgatcggcgagaagatcctctgtaagtttttttcccaccatttttcgataaatcactgatccacttttttcaggcatgcacggcggcatctccgacaagatgcgcagcctggatcaactcagcaccctgcgtcgaccacacacaaggccaccactccgttcgctcgaaattgatctactttgggccgatccagcgcaaggcatacgaggcgtcgtcccgagtaccagaggagcgggcatcctgttcggcgaggacctggtcgcccaaatacgcactcggcttggcatcgactacatcattcgggcgcatcaagtaagtttgtgttttcaatttccttttccataatttcttcactttcagcttgtccttgacggagtggaatatttcgccagtcgccgcctgatcaccgtgttttcggcacagcgctattctgggcggacaacacgggagcaacgctgacaatcgcgccggatttgacccacacaattacacgcttcccgccggcctgaagacgagaaggactgaactcacaaactgaaccgaaggatggtggaactgcctgaacgatgcacgttgagaaatcggatcatctgatttttttgtatgtaaatcccatttcacttgatgaactccctcaaactgttgtcatttcaattggttaatctcattttataaatggtttatttttctagataaaattagaaaaaatgaaggtcagcttcaatcagtcttttcaaaattcacattttcttaaaatttagctctcacaacttttttctgaggtgtcaaattgcttagaattcgcttagaaaaaattctccttttcaaaatcttttttagatatcaaatttgttcggtttagttgggaatcaagcgaattatggttggtcaaaagaaactgcaaaatggcaataatcagtgtaatttttgaattagcgtgcaaaaaactacgccaattacttatttggcgtatttaaattgcattcgcatagtgcccgataaataaatttttgttttttaataaaacaatccttatttcccaaaaagtttatttgttaattagaaatgtcgtctgatcagccgtcatcatcagcatcttcatcaacccatcaga

SEQ ID NO: 38185 - DNA, 788 bp, Heterodera glycines
aatagcgaaaaataacacttatgttaatgaacgtaaaaacttcacttggagcacgtaaatgatggtgaacggaagccaacaacagatgaaacagccgacaacaactaaaaagtaaatttgtaagcagcgttatttggcaaattggtccacagcgaatggcctaaattgaccgccccccccccctcccggcttttgttgtggtgcccacctgcgattgtgcgtgccacgcgcatttccgtgcgtaacgaattcttggcgaactgaatggtcgggtatagcaaaagccgctcgctttggcgtcggttaattgtggtggtggtcgaatgttttgtacagccaccgcctccgccggcaaaaagagaagtgatcaccgccggaaaccaaaccgcgcggtccaccgtccgctcgatggccgaacgctgctgctggagcgcggcgatgcaacgcaacttttgctcgtgctcaagcagcaggtgcatattgtgggccaacgcggcgcagccgcgggcgttctcatccgtcggcgccgaactggcggaagaccacaaaagcattgacggacagaagtgggtgctgccatgcttctgctgcagctgggccatttctgtgattggcgaatttttcaataattgtaattagcttcttcttttcttcgtttatccttgagaaatgtcgactttcctcgaggactgtgtctaattttgccttagttttctcctccatacactaatcgctttaattttgctaataaatggatttctttttcggaattctgcacaattcggtgc

SEQ ID NO: 38186 - DNA, 1167 bp, Heterodera glycines
gcagctggggtgaatattttttgttttattttaaactccctttcatattttagcaagtggctgattatttaaatagcctaactgtcgactgtgaatcacacaatttttgggcaaatcaaattcaaacagccaaatatccattacttattccattagtcaaaaaatatcattcggctccatgtacatcagccgagagtgaacggatgttttctgcggctaaacttattgtgacagatttgagaaaaaatttagcaggagaaacgttgaaagaactcctttttcttcaacagaatttgcctctttatggatttaaattcgaaatttaattgaattttactatctggataaattttttggattaaaaaattgaaaaacttcgtgcttcgagcttcgaaacttcgcggtttttgggcttcgaacttcgaacttcgtgcttcgaaaaaaattgggcttcgccttcggcttcgagtgccgagccgagcttcgcccgtccctgatggggacacgggaaatgggctaaggacccgtgaaaacgaatgccctggtagacgcgaattgcaatggcattttttgaaatttcaggggaggagggaaaagggagaaacgatattcttctatttcacaacaaacccaattgatgaaggcacgcagagcctgcaaaatgggagaaggcataattttatggaataatttaaagcgatttgatcagtgattggaattaattcgctttttagtcctatttaaaaattttatttttcatattctcaagtccaagtttcagccttttcctcaaaataaaaaaatttaggccttcaaattagagcaccagtgctcgatatccttaagaaagattttgaattttctaacttacatcttttctcatctgtttgggcttaattttttttacacttaaagatttgtgaaacgatttttccaaggaatgactgcccctaaaaaattgggtaattattctcgcttaaaagctcgattatcgagtggattttttcggcttttcacatcaataatattgtccacgggaatgacgaacaaaactgaccatccgttgggcgggcaaaatcagttccatgacaaatgtgcagacaactaccaaagtaccaccaatggacaagccgaccatgaagcgggtggccaacaaaaattgccatg

SEQ ID NO: 38187 - DNA, 954 bp, Heterodera glycines
agtacaggctatagggaagctattcccgaaggattcccccaccccccataaatctgggcgcatcggttcggggggactgcctcgaaaacaaaaaaatcgattttttcaagtgtccgtttggggtactcaaacaattattaaaaatttttagatttttattcatctccctttttgatagtgaaagcatctgagtgcctaaaataacttgtaaataaaatttggtgcgtttcagagcagtttgtgaaaaaatatttatgaattaattttgctaaaaaaataaaatagtgaagctttaaaaattaataaaaaattttaaattcagaattactggagttagcatcatagcagtgcttttccttgtctttttgatgccctcgcaaaatctggttcgcttctgatcagtttataaaaaaaaagttaagcctaaaatttttcgcaaatttaaaaagcaattaaaaatttttagattttttattcatctccctttttgatagtgaaagcatcagagagccttatttaacttttaattaacatttggtgcgtttcagagcacgttctaaaaaatatttatgaattaattttgcaaaataataaataattaatgaaaaagtcagaatttcgaaaaattttaaaaacaacaagcgttggcattttttcaggttaagttagtcctttacaatggagaaggacctgcaaatttggagagattatatcgattttagtgcgctaggttcgatgaaactttttaaaatataagcctaaactttttggcctgtttaaaaaggaattaaaaatttttaaaatatttattcatctccctttttgatagtgaaagcatcagagagccttatttaacttttaattaacatttggtgcgtttcagagcacgttctaaaaatatttatgaattaattttgcaaaataataaataattaatgaaaaagtcagaatttc

SEQ ID NO: 38188 - DNA, 957 bp, Heterodera glycines
  misc_feature (11)..(12): n is a, c, g, or t
  misc_feature (835)..(835): n is a, c, g, or t
  misc_feature (924)..(924): n is a, c, g, or t
tctagagtatnnttcttgaccaaaaaactcaaagcaggttggttcttggctagaaacacattgaacgtggcgaaaaaacgtatgaatgtgcagttttggagggaaggccgtttcagtcggaaaaattattcgaataattaaatttaattattttaatatatttttttattaattagtcaaaataaacaattattaatgtgtaataaaaccaaaactacattcaattgcacatgcaagaataattattaattaattaataatttgtaacccaccaaattgttgtcccccaattgtcactgttccgatccaatcaccgccacgttgagcagttgccattttcttcaattcgtcatggcccactttgttgagcccatcaagcgtctgagctgcatttggcgatcccatcatttcgagaaaaaacgaaactttgtacttaaaatggtttcaataacaaatttaaagggtgccctgcttatgtgcttaaaataaaattgccttcggtttaagcagctctttcttgagctcatcgtttgcgttttttaagcgctgaaatttcgctgtcatctcagcaatattagagccgtttttgtcaggatggtatttccgtgcaagtttcttgtacgccttgcggagtgtcttgcggttaaagacgggaccaatctcggccatgagctctctggtttcctcggcaaaagttgcttcgctgttttggttagtcatttcctaaataacttacaattagcaaatgcttaaaggcacgaaaaataaaaaagttaataaaagtaaaatttgaagtgattttaatatgaaatttaaaaaaaaataagtttcttanaatttgtaagaagccaacttattactgtatttgtgttaagaattttctgaaatcctgaaatatacttataaaggaaaaaaacgtttggngtattaggaaaaaattttcatcaaaatattatg

SEQ ID NO: 38189 - DNA, 1388 bp, Heterodera glycines
aaagggatccaatttatttaataaatattggcaatttctttattaaaacaaaaaactacaacattctcacaacctttttttcagaaaatagatgactcgaggccgggcctcagtttttataattgagtttatatttattaataatcgttttataaggcagatgattcaaacggtagttgtgatggattgtttggagaattaggtggctcaatatcaattttattttgttttccttttgcatttaaaatcatttattgctaattgttttggttaattgacaattcatcttctggcaattgtgatgcatgaccatcggcatctttttaaaatttctttttcggagacaaaaaaaaagagtttgtgttccctcgtgcgcattttttttttctagctatgtgatcgactcccatcactttatctcttgctctcgggctgggtgggggttagagggctgggaaaagccaaattgaaacattttcgcctccggcacgacgcggggagcgcaatatgccggaggcgctcaatttacgcctcgtcgtgctttcgctaaaaggtcaacaatttggtttggcattacttcctctccctcctcctccttttgttcttccttcatttttgctgctccaatttccggcatggcacacactatgattttctctttttcccacaaagggtttctttcgtagaggcgaaatttagtgaattcaaaggcgccgacaaaaatgacaaaaatggcacatttcaccaaactttttttttgcgtcattgaagaagaacgattcaaaaaatgtatccaaatatgaaaattacatttattaattttcccgcccctatcataattaaatttacaattaaaattacattttcccacttctgaagagtgtgagtttcattgcttgcccattggaaaatccctaaaaaatgcttcaaattgatcaattttggcttaattaacggcctttcgtttgttgtgactcgttctttgctgggcactcattttattaaattaaattttggattacatgcttttgtaagtttaagacgagacgatatgtaatccaacaagatttttgtaccgatttttgatttgctttttacttaattaattgaaaagcgcgtgcgcacacaatgaaatctgtgccggcttaaataaataatgacaaagcattaaattaaatgccaagtgatcgatgctatagtcatcgtaagaggggctgctgctgtacaaaaaagtggaaaggtcatggaaatgttataggaaatgaaattccctgcgcttcggcatggcgagcagttcgttccccccccctcgaaattttaaaattttaaacagatatttttaagataaatttttgtaaatttttattagaaattcaagaaaaaattga

SEQ ID NO: 38190 - DNA, 773 bp, Heterodera glycines
tcagtgccattcctccattttttctgttcctgacccactagcaattcttctaattagtcgcatcgtttccccattccttctgatcagctatctctccctcattttcctttaagcaaattgggacttttgatcagtaccatttttctttcatcaaattgcgcgcaattcttctgaatcacacctcccatgttcctttgatcaaattgtcccaatttattctgatcggattttgtttcggccatttcttttgttcgacttccccattttcagtgatcaacacacattcttttttgatcagtgccattccctcatttctttttgatcatttggcacacattctcttttgatcatgccattttcccatttctttttgatcatttggcgcacattctcttttgatcagtgccattccctcatttctttttgttcatttggcacacattctcttttgatcagtggcattccccatttctttttggtcatttggcacacattctctttcgatcagtggcattcccccatttctttttgatcatttggcacacattctctttttgatcagtgccattccctcaattctttttgatcatttggcgcacattctcttttgatcagtgccattccccatttctttttgttcatttggcacacattctctttcgatcagtgccattcccccatttctttttgatcatttggcacacattctctttttgatcagtgccattccctcatttctttttgatcatttggggcacattctcttttgatca

SEQ ID NO: 38191 - DNA, 901 bp, Heterodera glycines
tttcaaaaaaacaacattttaaaaatttcaactaatgcttcctgtttgttgtttttcgctctgtgatttttcgaattgctaagcccgcttttcctcctcctccccctctgtgatgaatagaggagaattactggcggatttttgaatgcatcgcgcgaattggcgttttgtttaattgtcgcgcggcggcggcggtggggaaaagcattgactgagaataatataatagataattcacgcactattcatccattgaatttggagtgaaagcaaaagcaatgcgcattaatttatttgccattgtgatcaatgggcatcagaaaacaatttatggggggggggtcaatttttgaggggaaaatgaggggaaaatgaggaaaaaatgaagaggttggagagcttaataaaaaaactgaggaatagaaagaccggtggatggaagggaaacgcccagttcggcgcagttggtaatgacttttttcattataaaccaaattaaatttttgatatgatgcgatagttattaaggttcacaattagtaagctaaatttcaaaaaatttcatcaatttacaaaaaaaatatggtgaaaaaattgactttttcatagctttttcagcgctacatgccataactttttttttacaaatagcacaaattgtgctatcaaatggtgcccagatttgctacgtgaactggcaaagaaaaatgttgtggcatttcaaagttggcggcgccgaaacagtcggcaccgaactgataccgtaggcaaaaatgttggtgatttggggaccagggggccggtttgcattttgcattccctaacttttagtcaacccaaaattttataaaaagtgataaattagaaaaaaaaattcataagtaaaaagtttaatctcata

SEQ ID NO: 38192 - DNA, 1056 bp, Heterodera glycines
  misc_feature (966)..(966): n is a, c, g, or t
attatttctatgaaaatttttatcgcattttcacagccttacagacttttcgtccccagacatatcattttcccggatgctcataataatgccgtggctttgatggggcttatacatttgataaccgcggcattgaattttctagggttatacttaaattcgcattcggtgatcgtcagagagtttagtttaattccggtaccgagattagcgagagcaattatatttacgattatcggtctttgcatttttgatacaatgtaccaatcaaatggtcctttcactccctttatataccccttctataaatagcaacccaaaataaaattaaattgaaaaatgaactgcccacataaaattaagtgttgtcattactgtccctgtcattacgagatttgtagcaggtgtaaaaagcacagtcgcatttcggtacatcattttttgataatttctggatatgccccaaatgcgcgaaatatgttccctatgaaaatataaatagatcaaataaataagaggcattaaaaatgtttcgcggtccgttcactctaattctctcgggggctaccgggagtggtaagacccgttggctattacggtttttaaaacatcataagattctaattgaaccaccgcctaagaaaattctttattgttatggtgagatgaatgatagtattttagggttaatcggggagggtgttgagacttttaacgggattccggacatgaataagattaaagaacaggaaaaaccccttttgttaatacttgacgatttaatgcttaatatccagaatactttcctcgatctactctttatcaggggctcccataattggaacgtaagcgtaatttttgtaacccagagtctctatggtcgggacattaaaaccggcagaaccaacgcacattatctgggtttaatgcgcaacccttccggacaattacatgtgagaacattgnggtcacaactgttcccaaaagactgaaatatttcatggatgcatatcatgatgcgaccataacccaattagttatctcatgattaacatg

SEQ ID NO: 38193 - DNA, 595 bp, Heterodera glycines
atatggactaaaaagattgaaaagggccaaatatggaccttccactgccaaaatatatgatttaaaccttcaaaaaattcaaagaacatgtttatattcgaaatttgcttaaatagacttaaaaaatacacaaaaaaaactgccaaaaaatggattaaacattaaaaatgccaatttttgtttattaaattgtagcttcacaattgcaaaccaaatgtgcagaaaatatgaatatccatttaatttatagccctaattattagtttaataatttacaataatttatttgtttacttggcatttcatttttctctgcaaatgtttttgtggttagttgttggttttcaacttcagctgctggtggattatatgctcccacaaatggcaccgttggaggtccatttttcaaaaagtgagttgctgacaattttgaaaaagcaaaatttataaatacaaaacatatgattttaaattaaaatatattatttataaataagattgtattatttataaaagaaaatatattaaaagtcgtttttgagacggtttttcgaaacatcattttcaatagatattaaaatttgacatcatgaaa

SEQ ID NO: 38194 - DNA, 1013 bp, Heterodera glycines
  misc_feature (954)..(954): n is a, c, g, or t
atataacgaaaataatttacaccgtccggatccgaatttcccccctcccccctcaaaatgatgcctcagaatccccaatctcacagggattctgaggtctaaacgatgtcaaaagtaaaatctgatcatgtattcgtgatcagcgtcataaaatagccctaatgacatgtttttgaaagatttttggtgaaaaatttttccactcaaaaatcctggtcacccccctttggactggaatcccaaaatcacttttatttttataacatttttcaaaaaagtgataaaaatgtgaaataaaatttataaaatagagctaaaaattgcggatttttgtagcattttacttttcctgaatatcttttcagaagcgagttatgaatttttttctgaaaaatcgaaaatttccagaaattctggaataactttttttcttttgaacattataaaaccaaataaacctcataaaattctcccgattttttgctatttttaaagctttaattcacttaaattgaccagtcctccattgagttatgaattttcaaatattaggccaaaatcccgagggccaaaaaattgccaaaaaataaagaatttttaaaatatttcaaaaaatctgaaacttaaaataaacatcatattcgtactcagcaccttattttaccccagaaaaatatttttcaccctctttttcaacccaaaaaaaaattttgaaaatttctagggggcctagctcgaaaatttttgaaaatttcccttcatatagtataccattagatagagcttaaaaagttctacaattttgctctaaggcattttttggctaaaaccgacccctgacgagttatgggcccgggactcaaatgtcccgcttaggccaaaaattttttctatttccggaaaaaatcgaaattttttcaaaaaaataccattcgatagagctcgaaaactatngttttggagtggtcttcgttttcccggggaaattccgtaaaaaatcataaaattcaaaa

SEQ ID NO: 38195 - DNA, 676 bp, Heterodera glycines
aaaatcgtcctaataattatttaatttgccccatctctcttaattcgtcgccgtttcttccagtaagttcttaccgtccatctcctccggcttaggcagtcccataaggtaaagcacagtcggggccacgtcgcacaatgcccgcgcccggggcacaccctccgcagtggtgggcggcgcacttttgaaggagtgtgcagcggaagagcaggtgaacggaactgaaaaatgcaaaaaaaaatgaacgagtgttcaaaattaatgcttttcgagaactgacctttgttgcgcgtgtgtgccgtgtgtgggccgccatcatccgctttcatttgctccgcatttccatggtccgcggtcaccaacagcacataaccgtgatttctgcatgcctccaaaatgcgtccaattgccacatctttaataattaggggaaattaaatctaaaaatgagaaacaaaagtgtggatttgtaccagtcgcttcacacgccttcaccgtcggctcatatttaccggtgtgaccaaccatgtcgggtgatgcaaaattgcacatgatgaacgggtgcttgcctaattcaatttgtttgaccacctaaaagtagaggaaaattgaaatgccaaaaacatttttggaaacaatttcgttttttactctctaaaaattgtggtgccccccc

SEQ ID NO: 38196 - DNA, 671 bp, Heterodera glycines
ctgaacgaggcacgcatcaaacagaatggactgaaccctctacaccaaatgatcgacatgggacagagcaaactgaacctgtctttccaacacactaagcaaaccatcgacgaggcaattccattggaagcaattttagaattaaaattgacattgtcttttttcgttttttaaggcgtgcagttttctgatccaaacagtgcacgaggcgcagaagggactgtacactcagttggagagcatttacggatacaaacaggtgaaagggacgagagggagaaggagggggaaagtgccaacagcgaataacccacccattcagttgcaactgacaatgatcgagaaggaagtgcagaaagtgaccaaaaagatgtcgcaaaccatcgaattcacgcaacgtctgctgaaatattcgtcacctacggaggtcaaaagggcgcgctttcccccgtccgcgtcttaccacccaatttgcaggtcatcgtgttcaagccgttgttggactcgcgcctccagggcttcctcaccttcaatgctgactccaataatttgcgcgatgcatgcgaaatccgttcatcttcgcttgacttacaactcgcgcgtcaaaccatccaacaggtccataaccgggcttctccctctttgttcatccctctatgtcccttctcttc

SEQ ID NO: 38197 - DNA, 905 bp, Heterodera glycines
  misc_feature (807)..(808): n is a, c, g, or t
gctaattgagcagaagcgtaccaaactttgccccccactccccggtaaaggactaacttacactgaaatgagcgccgagctagctggctcaaaaaaattttcgaaaatctgagtctttcgtttttatttattttttgcaaaattaattcttaaatattttttcagaaagggttctgaaacgcaccaaattttatttacatgttagtttaggcactctgatgctttttctatcaaaaagggagatgaataaaatttttaaaaatttttaattcctttttaaacaggccaaaaagtttaggcttaacttttttttcagaaactgatcagaagcgcaccaaactttgcagggatactgaaaggaagagaaataacctattttaaatattatctagtcagttcatttaaataatttttatccaaaaaatttttttttgggttttcggggcagtccccctgaaccgatgcgcccagatttatggggagaccgaatccttcgggaatagcttccctatagtctgtactttaattctgcgttggagttttgctccccataaatgtttgagtaccccaaacggacacttgaaaaaatcgatttttttgttttcggggcagtccccccgaaccgatgcgcccagatttatgtggagaccgaatccttcgggaatagcttccctatagcctgtactttgattctgcgttggatttttgctccccataattgtttgagtaccccaaacggacacttgaaaaaatcgatttttttgttttcggggcagtccccccgaaccgatgcgcccagatttatgnngagaccgaatccttcgggattagcttccctatagtctgtactttaattctgcgttggatttttgctccccataattgtttgagtacccaaacggaca

SEQ ID NO: 38198 - DNA, 502 bp, Heterodera glycines
gcattaaccaaatatataaaaggaaatgagaaatggctcacaccgggtgcgcgaggggggggggtccttttcgaaaatccttagaattctcctttatggccatttcgaactcacaaatgatctgaagccgtgtttgaaccgcgtcagtaagatatgtgcttttccagcgatcaacattatcagaagcagtcaaacgaacagaaggaattgcgcggtaaacaagaaagcagaagggggaatgttgccgtaaggaaagtgattaagtgggaagggagtgattgagggagtggggggggggcaatcgcaggacacccacagcccatcgattgattggaccgtgcttagggaaaggacaactgtccttttaagtatacaaatcatcgcaagaacataagagatcagacaagaagtaggcgggtgattgatgggctagaaaaaggggagaacgcaattggcccattggatgaatggcaccgaagtgttgggattttattgctaaagg

SEQ ID NO: 38199 - DNA, 871 bp, Heterodera glycines
tttactacaggatagcttacacagaaaactctctacctgagaagtttcatgcaatataaactcattccagcggccttaaatcactgccttctgccgatcttaatatcgcacgaatttctttcataaccattttttgaaagctactttcctctcacaaaaaacacattttttcatgcgaaaaagcattatttttcggaaagacattctccaataatataatacactaccgcaggtgcgactcaacccaccagcatttcaatcactgggactcaacccaacagcatttcaatcactgggactcaaaccaccagcatttcaatcactgggactcaaaccaccagcatttcaatcactgggactcaacccaccagcattccaatcactgggactcaacccaccagcatttcaatcactgggactcaacccaacagcatttcaatcactgggactcaacccaccagcatttcaatcactgggactcaacccaccagcatttcaatcactgggactcaacccaccagcatttcaatcactgggactcaacccaccagcatttcaatcactgggactcaacccaccagcatttcaatcactgggactcaacccaccagcatttcaatcactgggactcaacccaccagcatttcaatcactgggactcaacccaccagcatttcaatcactgggactcaacccaccagcatttcaatcactgggactcaacccaccagcatttcaatcactgggactcaacccaccagcatttcaatcactgggactcaacccaccagcatttcaatcactgggactcaacccaccagcatttcaatcactgggactcaacccaccagcatttcaatcactgggactc

SEQ ID NO: 38200 - DNA, 564 bp, Heterodera glycines
agtaaaggtgtacgattggcaaatggcatttacgtgctctccctggacattgtgttgaccaagcgttgctatgtgctccctttgaacggcactcagttgggcaaaccgatttgtccgttggaaaaaaatttgccattggaggagatcagtgggataaaggtgaaacggatggacgagagtcggagttatcgtggtcaaataggtcgggaccaggaatcgggtttgatcaactcttaatttataaaccagaagaaatttattggttaaaaatatttaacgaataagtaacaattgtttctctatttttttcgtcagctttttctatgtggaatatttatatgatggttcggcggtgccagaggcgccgccgggaaaattttgaaaatttccttttcgtctataaacaaatttttacaaaaatttttggtcaagttttgaaaacattacgacatacatttgctaactttcctctttaggtgcatggacaaatgttgcttgttggagacccgctagtgaagcaatatgatgacgagataaaattcattaaagaagaggtagatctaa

SEQ ID NO: 38201 - DNA, 204 bp, Heterodera glycines
tttcaatcagtggggactcaacccaccaacattccaatccttctgactcaacccaccagcatttcaatcagtgggactcaacccaccaacattccaatcaaagggactcaacccaccagcatttcaatcagtgggactcaactctccagcattcaatcactgggactcaacccaccagcatttcaatcagtgggactcaaccca

SEQ ID NO: 38202 - DNA, 939 bp, Heterodera glycines
  misc_feature (749)..(749): n is a, c, g, or t
tcccatatgctgtgatttattatatgcatatttgctcccccaagataaatttttttagtgagattatgaatttttacatttaattttatttaaacaattaaatgacattttgccaatcatttcgtcaaataacattgagaaattctcgctaactagactaaagtctaaaattgggttttagcattataaattgttgttaaaaataaaaagacatatataatgatgattttgtccgacgattttggttgaattggcgaaaagtccaattttgcctttctcagctgacaaatgtcaatttggcaaaatgtatgtacacgatataaattgaatattttgccgaaaagagcggcgttctcagtatctaatgctgaccggttcaggaattattagcccaagaccaaaagttcgaaaaaaaacaattttaaaaatttaaacaaaaaaaaattcatcgaattccataaaaattgagcccgtttttctgccgcggattaattcatttttcgttcttttcattaaaaaaattagcaaaatttcctagccatctaaggcaattattgctggaatgacgctaattggagtaaatttaatttcgggaaaaaccattcaggcgcgagttggggagcgattattaatttgaatttttttggttccctatgagccgctgctcttggttgtttgtttttttttttgattcgatttggtatcatatttatcaatccaaaaacgcaccaaacaaaaactcgttagtntttttcgcggtttttgagtcaatttaaaggaataaagggaattttgagctcgggcggtgccgataggtgacgctgggaaaaatttgaagatttgagtgcactttgttaacagatttagttttgaatgagaagatgttgtgaaaaatttaaaaaattttatccctccatcactgtgaaatttttgggtgaa

SEQ ID NO: 38203 - DNA, 988 bp, Heterodera glycines
gaatttaagtcacgaaaaatctcaaaaaagtcgacatcccccaacatgaaaaatcgccaaaaagtcacgaaaaagtcatacttatgccaaaagtcacaaaaatgcaaaaaagtcatgaaaaaataaccaaaaagtcacctaaaaatgccaaacaagcacgaaataaatcctttaaggccatttaaggtcagcaaaaaaaaaagtcatttgacttaaattcccatccctattaatggaattaattcaaaatagtgaatttaacactcattccgtttaagcatcatttaatttagcttttgcatgtgcattaaatattgatttaaggccatggccttcccctgattcatagccttacagatcaactgtatggctaattagaaattttaaaacaaactttttctattaataatttatttttcaaaacacggaggcaaaaatatacaaataaaaaaaccactaaataaataattaggacgacaacacgcaccgttaattagcctgataaattagctaacgcttgcccaattttgttggtgttaattgatctaatcaaaattctctgctatcacaaatctctcgtgtgtttgtctgtgcgattcgcattgagttccgctccatcttcacacttttctcgaccacggttcttcccccggcgctctgtgctgtgatcgttcagctcacattcggctgactgatcactttttccattaattaatcattttcatttcattcactaatcaattttcttttttcaattcaaaccgaataccaaaaaaaaacaattttaaaaatatttttatgccctgaaaattctgagaatctaattaagcgataaacggtaattcttttgttaaccaaaaagtaatttgattttttcctgtaattgaataaagataattaaattgcttttttacttttttatgggccccattaacttttttatttgttttttaataatgtcataagatttttcatgataaattcatta

SEQ ID NO: 38204 - DNA, 799 bp, Heterodera glycines
  misc_feature (779)..(779): n is a, c, g, or t
ttaaacaaattcaacctgaaaatttttgtattttttgccccttaatagtgcatgtcaaaggctttcgaatgataccaagatttttgggtttagttgaaaataaaaaaaaatatttgggttggtaaaaaaatgtaaaaattatttttaaatgcatgccaaaaggtctcgcgcgggatttacggggtccaagtccgcaaccctgaccatacatgaagtggggagggtggggtccaaaaaaatttggctaattttctttacaacgggtgacttaggtcaaggaccataggacggggatgattgagacaagggcgggaagttccaaatttttctccggctttttttctagtcacactgcttttctttgtcgtgctttttaaaaaagtccggaaagatttttggaaatttacaatttattaacaaatcttgcccaaaacggcggcgcctatcggcaccgctggaccctaaaaacatgtttttttcttaaaaatttcgctcaaaatcgcaaaaattgttatttggtgaaaatcagttaacaaattgcaatctaatttttcaacattttcccggcggcgcctacctgcatcgccggcgccctaatgccaaaagtttattaagatttttccgactttttgcgacttttgttgacgaaagtcccccgaccatattttatctaagatgctgaaaaatttttaaatgttagagatgaaattttttaaaaatcgaaaaaagtgaaaatttaattttaaatgcatttattcttcgacccttagctaattaantatgtaatttcattcccgaa

SEQ ID NO: 38205 - DNA, 1080 bp, Heterodera glycines
aatttgtcctggcgaagttttgaagaagaaaaaatcagacagagataccaccttggacgattgaataattaaatcacacacactcataatcggcattaatggagcgccaaaaatgctattttttaatttgcttttttaaaatttctaatccgggcacaaacgccgaaaattaccaggaattaagcagaatttatcggttttttcgggtcagttgtacaaacaaagcccaaatttgggatttaaacaaatgcttggtcgggtcaaattaaccatttttgttagtgaaatggaaaaaacaaaccttgattttcgctgtccgattggccgcgttcactgccgcccgtgcagcagcgaaccgagaatttcgcgctgaattcgccgatgggtcatctaacaataaccaaaaaaagtaattagaaatttaaattcatttaatgttgcccttaaaaataatttttgcaaaactttcttagaaatcaaaaaatccgacagttttcttcgaccaattctgatttaagattaaacaaacaagagttgtgaaaaatggtttaagaaaaaagcgacaacaaacttttgtccactgaagctgaagtctccacaacattgggcacccggcaaaacggtgttatcctagacaaagaaaaaattaatacaaaattgaaaaaaactgcaacttttacaagaaaatggggcggaaaactcccaaaaaatgaaggcaccatgcctagtaaaaagattggacaacaaacaatttttgagtcgaccaaatgaaaaattcttggaaccaattcgataacactttaatattcactattattcagcagcaattttcataaaatttccttcgctacaaaaattacgacccaaaaccatttaaattttgttattgtcagaataaagcgtttaatttactcaatatttttcgcatcaattatttaatggcatttattttggggaaatcgaattcaatttccgacccatcactgatatttcatttcatggaaataatccgaaaaagtgccgaaccccggcaaatgccaagtgcccatggtaaacttcaaaagcaaaccgtgaacagaa

SEQ ID NO: 38206 - DNA, 797 bp, Heterodera glycines
ataaattaattaattataaatatttcaatttaagtgacctccccccgtgaacattaaaagagttattaataggatgaagatcctcgaacccgaccagcaggacaggaacctgtacaggattttctcggatctgatccgtatgctgtatgttttttgttaaattcaacaagaccagcgacctgtttagataatatttttcatcataattcagataaatccagagaaaaatatgaaaaatcccttaacaaataaggaacgaaactaagcattcttaatgttgaaatcactaagttttcttatttctctacaaaatttccaaatttgttaattttcaataaatttaaagcaataaaagaaacttttgtgagcttttttgctcacaaaattttaaaaattaactaaaaaatctttttggcggatttaagaaacgccttatcactgccctcattgaataagcttttttagaccgaagaagactctctgcaattctttgaggaacaagaacggcaaattgcgctgcaaattgcacaggaaaatggagagaatgagcagcagaaagaagcggaagatgatgctgaggatggacaggcggaagaacagcaattggaagaggacgaagaagaggtgatttgggaaaaggggcagaaagaaaagcgaaccaccgtacatcggcaagggatactgtaacaacagtggcagggaaaagcaccaaaagacagaaaaaagaaaagtgccaatttttaccaaattaatgaaaagaattctcattttgacgtatcgcctgattgggttccccc

SEQ ID NO: 38207 - DNA, 743 bp, Heterodera glycines
  misc_feature (693)..(693): n is a, c, g, or t
atttagctgggataaagcgcttcgcgcttcttgagcttcgctacctagataagctattgggttgtgaagtaatttggaatttttaaaaaattttcagggatttttaggccggtttgcggcccaaataaaaaattataaaaaaaagatcaaccaagaaattatgaatattgaaatttatataaagtaattaagagagttcaattatcataaacagaatgctaatagtttaattaaatatttattttatttaaaaagagtgcaattataattagttaaaaaatttctctcataaagaaaaaaatgcatgcttaaaactagggccgcgatttcatgttcacattattcgttttaattgcatttttaattttcaaatttggtcaaagtgaaatagaaaataaaaaattgctacaaaaaacttttgatgaaatatctggagaaaatgggaagaaattggagaagaaaaacaaatgatgaacaaaaagttcgaaattgtttaaaaattcatcgaaatgacaaatgaatacaaagaaaaaagcaaatattcaagaaaagaatggaaccaaaattattacgaaattggcgagaaaattggagttagccgatagaacaattaccaaatgtaagaaacaatttggaattagcaagaaaataatcagggaaaaagaaaaaaaggaaaaaataaattttattggngaaattaaaacgaaaatccaaaaataattcccatcacacaaaaatgacga

SEQ ID NO: 38208 - DNA, 947 bp, Heterodera glycines
  misc_feature (698)..(698): n is a, c, g, or t
  misc_feature (816)..(816): n is a, c, g, or t
  misc_feature (846)..(847): n is a, c, g, or t
ttatttttataaaatactttttcagaaggctctcccaggtttttttctgaaaaatcgaatttttccagaaatcctggaataacttttttattttggaagatagaaattccaaataaatctcataaaattctcccaatttttctctatttttaaagcattattccactaaatttgaccaaaaacgaagagatttatgaattttcgaaatttcataggattttccggggctcaaattttgacgatttttcaaaaaattttaaccaccttccaaaaagtctgaaacacaaaataaagcgtatatacgtattcagcacctcaaattatgccataaaaatgcattttggctaatttaggagcaaaaaaatttttcatgaaatgcaaaaccatggggtcccccctatggttttgagtttcaaaatcacaattaattttataactttttttaaactcatggtaaaaacatgagataaagcacattagatagagcttaaaattctctacaaaaatgctcttagacaaatttccgctaagatcaacgcctgacgagttataagccttaaacggaaatggggagctcaattccggaaaatttttctatttccggaaaattttgaaattttttcaaaaatgccaccaatcgatagagctcgaaaaacggttgcttgaaagtggtctccgttttcctggggaaaatctgncaaaaataaataaattcaaaaacgaaaaattttcgagggggcctagctcgaaaaattttgaaaatttttcaaatctgaaaacgccatcggatgcagctttaaaactacacaaatgctncagcggcgccaaccccgctccgcttaaccnncccagtgagtattcacgaaaagccaaaacccggcatttttgagcgcgttcagtcgccaatttctgcaggctcggcatttgatctgatcaaaaagtgatca

SEQ ID NO: 38209 - DNA, 948 bp, Heterodera glycines
  misc_feature (31)..(31): n is a, c, g, or t
  misc_feature (98)..(98): n is a, c, g, or t
  misc_feature (123)..(123): n is a, c, g, or t
ttttctgctcaacgctcaaatgactccaccncacatttcggaataatagcgacgaccctaatttttctggatttctttctgggcgagttggctctganaatttgaaaaaacgtctatctcttnttctgctcaacactcaaatgaactccaaccacattttcggaataatagcgacgaccctaatttttctggattttctttctgggcgagtttggctctgaaaattttgaaaaaacgtctatctctttttctgctcaacgctcaaatgaactccaaccacattttcggaataatagcgacgaccctaatttttctggattttctttctgggcgagtttggctctgaaaattttgaaaaaacgtctatctctttttctgctcaacgctcaaatgaactccaaccacattttcggaataatagcgacgaccctaatttttctggattttctttctgggcgagtttggctctgaaaattttgaaaaaacgtctatctctttttctgctcaacactcaaatgaactccaaccacattttcggaataatagcgacgaccctaatttttctggattttctttctgggcgagtttggctctgaaaattttgaaaaaacgtctatctctttttctgctcaacactcaaatgaactccaaccacattttcggaataatagcgacgaccctaatttttctggattttctttctgggcgagtttggctctgaaaattttgaaaaaacgtctatctctttttctgctcaacgctcaaatgaactccaaccacattttcggaataatagcgacgaccctaatttttctggattttctttctgggcgagtttggctctgaaaattttgaaaaaacgtctatctctttttctgctcaacactcaaatgaactccaaccacattttcggaataatagcgacgaccctaatttttctggattttc

SEQ ID NO: 38210 - DNA, 99 bp, Heterodera glycines
ccagcggtccttgaaggcgagattcgtcgccgcaccgctttcgatgtacaggctgcccttcttgtcatcgcgggtgtagcggccaccggcggtcaggtg

SEQ ID NO: 38211 - DNA, 981 bp, Heterodera glycines
tattttggaaaaactattttttaatgattttaattacccctttttaaattaagttccaccaacattggacccgatgaggttggacattggcaacatttatgattggttcacaaatccacttccatatcaggtcatttgaattttaaaaattatcattccgtaatctgatatgtagatcctgaactgagatttcgatattgagacaggatttttaaattttatgaaaatttttggtaatcatcgcaaaaaatttttcaaaaagtttgcaatcttggctttgatttattttgaataaaaacggcaacagtatgccaaaaatgcaagttttgtcaactgatcgactaccgccttttttggcattttcaaaaccgggatttttcgttattggttatatcgaattttattcatatttgacatgctatgaaaataatatggaaatttgagatgagaaatttttcaagtttttcattgagaatttttgatcttgagcgcaaatcccgaatcagtaccgaattcctgttcaggcttgaattatgtaatagttaaaaaatcgagatgcacaccgctgatgggcaataaaatgtttttaaaacctaattcatttcaataatgagaaaaaaatatcattaaataaaaaaaattaagtctatattttttattatgtttcaaatttaatacaaaaattgtttgaaatttttataccttttatgaatattttttatttttaattaatttgttcaccaaaattgcttgatttttttatagtgagacgaacaacttttatttttctaagatattttaaattaatattaggttatgccaatctcgtggtacccacggaatttcacgaaccctgaccttaactacttggatcaatatgttcggatcagtgacgacacattgtacgctgttcaacttggcttatatgtggtcggatacaaagagtttcaagatgaccaggtgagcctaattacttaataa

SEQ ID NO: 38212 - DNA, 908 bp, Heterodera glycines
tgttcagaacaaaacgattcctactgatgtcataattcctacccaagctagacgaatctcacggtaggattgaatccatccttccgttcccatttcctttgtggcttcgaggatcacacgttcctcttctgtcaaatttttgatttcggctttcaattttatcatacccaattcatcaacaatgctcaaatttttctcacttaatttagaaaagtagtcatccaattttttctggtacgaatcgttatcgtcagttggcgttctcaacgcgatattgcttgtttcagcatgcttttcgcgtgccagaaggccttgcgtcacggtgttgagaccaaccaatggtccagtatctgtcattagggcctgtaggagcagctcttcgtcacggacgcccagtttttctttcgtttttcgcctaatgtactcttctctggcccagcggcgagccttatttgttgcaagcatgaaagaattctgtgttgagcgtaccttttttgccaagggatcacttccctcacccaggagcctgtataaatttttgctaagctcgtgggggttggtgacatttgatgatggaagctcaatccgcaccatattccctgtctgccactcaatctgaacaaattgttgctccacagtacctatggagggccaagagtggggatacacaataacggcaagacccacctcccattccgaattgaattgcaacttgcgaggtaaacgcactcggaaagaatttgtcctattcccttctatattggtgttagacggaaggacaacataaaaagaatttgaaggcattttttttttgttaaatttattaaaaactgctttttatatagatttctcgctaattgagtttgcgggaatccaactattgaagcgagtatcgtgacctttccatt

SEQ ID NO: 38213 - DNA, 566 bp, Heterodera glycines
  misc_feature (448)..(448): n is a, c, g, or t
ctggaaaaagcggattttcttaaaaatctctgagtgccctcctaattctaaaatttggcaaggtgctagaccttataccacagtattttaatgcaaaatttcaaactcttctgaaatcaatgagctgagttagaaaattacgcttggcgatttgtgcaagtttttcttcactaaaattcacgtccctaattattatattcgaacaattctttatcaacattatattaattagagaaatgttttttctacttttttatttatttttattttcggttccgaaaacaaatgcagaggtaagtaaaatttttacatacattttgagccaataatgttcttaatcctataaaaattaaatttttttcagaacattgagactttggtttgaattgtaggattagaaaatgaaatattataataaatactaattttttaactcctaatttattanattgtggcaaaaaaatttcgaaaaacactaacaatttattttgcgggttttccgtacctagccatttgaatagctaggaactagtaatgaatgaatttttttgagattccttcctagc

SEQ ID NO: 38214 - DNA, 646 bp, Heterodera glycines
gcacacctttttcacccaaaatgtttagcttattacctccttattagtccgtctcctttagcgatagataaataatgacttaaaatggattatgatgatgatgattaatttatatatatatatattgtttgtatggatttatttttttaaatagtttattattaaaaacaaaacaaaaaaaagtaaaattataaaaattaatcaaatttttgagggattaatgggattttgtttttgcctttgtttgtttgcgatagtggattaaaaataggaaacaaaaatactaaatgcttgggattaaatagtattttatagcaaaaaaaacaaggcacaaattttatttttacccttttttatacaaattttgcaaaattttgtatcaaaaagcacgcaatttagacgttaatgatgatgataattaataaggacaaatgattatttctatttttggtcagcagtgaaaatgaatttttggtttaaaattcattgaattattaaatgtataaaatctaagattagaataaattcctttgctccgtttttacagactgaaattggcaaatggcacaatattggcaataatttgcataacaaaatggcacaaaatttcccagtcacaaaataggctggcactttcacaattgag

SEQ ID NO: 38215 - DNA, 877 bp, Heterodera glycines
tcttatagcttaaaatgaattaaatatgatatgattcctcccccatatattttattattgttatatgttttccttttatttttttctaaatattaattttttcctataaaatgaaatgaaaattaaaaatttaatttggtttaccaattacatttaagaattaactccttcagagtgattagttcgcaccataattatttaatttcgaaaatatttaaaattttcaatttataaaaaattttaaattttcgttttggtttatattttttgacttaaaagtttatttttatttatttatttacttctcagtatatatttttttttaatatttattttcatatatatgttttttactaaaacgtatacaattattttaaataatttatttaatattttttgcacttatttcgatttttttcaatttttttcctaatctaaaagtagttatttctttaatattaatttaactttattctaggtaatttatagatcaatttgttaaaaccattaattgtcatatcaattatttatttattttttttcgtgggatttaacaaattcactttaaaacattcttttgttttgcattttgatttattttaaaattttctttttattatcataaatttaacctaaaccttatttttatagattatcaaattttcatattttagatctatttaatttttatgttcctatttaattatcatattttaaatgattaatttgttttattttgattttaaagttgttaattaatgacaggattaagaatttaagaaaagaattaaatttattgcttatttttttgtctctttttgctattttaatcccatgctatttgaaagggctccttttttgaaatcattcatcaaac

SEQ ID NO: 38216 - DNA, 1005 bp, Heterodera glycines
  misc_feature (78)..(78): n is a, c, g, or t
  misc_feature (86)..(87): n is a, c, g, or t
gatgaaaaggaggaaaaccaatcaaaaaaaatgaaaaacagcggaaggcatttggccatttcgccaaataaatgagcnaacaaacnnggattttttgaaaattttttgtcatcctacggtaataaaggtacagagtatatagagaataggtatgtaacggaattttgatactgagttggcaatttaactggaactcaataaagccacatatagcggcgagtaagccataaacaaagtgcggcgagttggccgcggtgagttaagcgccgcggcgataaatttgcgacgaattgtccgcgccaagttgggcggtttctaggaaaaatctgaaaaaagctaaaagcgctgaaacccataaaattttgagcctttttcaaattttggatagtggtaaattttatgcttaacgaattcgtatagttttaaataaattttttgatgccgcaaggtaaatttcaaattaaaacttaaatcaaattttgggatgttaacctgcttaaaaatttggagattaattacctcacagttaaatgttttttaaaaaaattcatcaaattcaagctaaataatttgaataaacccaagataaataaaatatttttagaaaaattccgacggcgccgaaaaaagcgccgcgatgaactgcttggaacgattatttcaattctgattatgttaggccttatgatagccctacgatgggttatcctgtttatcttatctcgtagccagcagctgaatgccgcaaatgcgagatgggcactaagacttccagcccaaattggagaagctcgtgaattttaatttattaaaatttttaaattttaaattgtctttgggaggggaaggataaagaaaggtaaatccaccttcctttaaaaaaattgacgtagatatttatttaatcttaaaatacgcttcgtcttcacaaactttagatgcgattttaaaattttggcaatttttttcggatttaagttattgtggagaggcataagaaaaatg

SEQ ID NO: 38217 - DNA, 845 bp, Heterodera glycines
  misc_feature (744)..(744): n is a, c, g, or t
gtttttgtgctataaatttcaaataaatctcattccccaccggcgattttttgctatttttaaagctttaattcgcctaaatagacctgatctgaactgagttatgaattttcaaatattaggccaaaatcccgagggccaaaaaataaagaatttttaaaaaattccaaaaattttgaaacgaaaaataaacatcatattcgtgctcagcacctcaaaatagcccagaaaaatatttttgacccccattttcaacccaaaaaaaatttccgaaaatttctagggggcctagctcgaaaatttttgaaaatttccggccatatggcacaccattcgatagagcttaaaaaactctacaattttgccctaatgcgttttttcgataaaaccaacccctaacgagttatgggcccgggactcaaatgtcccgctcaggccaaaaattttttctatttccggaaaaaatcgaaatttttccaaaaaaattaccagtcgatagagctcaaaaaatgatgttttggaagtggtctccgtttttcctgaaaaattcgttaaaaattcctaaaattcaaaaaccaaaaaaccgttttttaggcctagcttgaaaatttttcaaaaatttcgaaattttaaaacttggttggatagcctttcaaattctacacatttttgctcagaaacaatttttcggtcaaagcaacccctggcgagttattcgcctggtactgaagtgtacacttttgngtaaaaaaaattagccaaggctacagccttgggcgccccacgtagggcttaggttttgctggcaaagttgtcggggatagtctgacttaaaatctaccagc

SEQ ID NO: 38218 - DNA, 793 bp, Heterodera glycines
tttttatacaataactagcgggatcagcgccttcggcgcatcccccgctaggcagtacgattgtgttatagaattatgaatgataaaatcgactggctcggccgcttcgctgcctcgcataattttcttggctttttctcaaatctctgggactcaacccaccagcaatcaatctctggggctcaattctccggcattccaaacactgggactcaacccaccaactttcaatgacatccaatcgctgggactcaacccaccagcatttcaatctctgggactcaaatctccggcattccaaacactgggactcaacccaccaactttcaatgacattccaatcgctgggactcagcccaccagcatttcaatctctgggactcaaatctccggcattccaaacactgggactcaaacctccggcattccaaacactgggactcaattcttaggcattccaaacactgggactcaacccaccagctttcaatgacattccaatctctgggactcaacccattagcatttcaatctctggaactcaaatctccggcattccaaacactgggactcaacccaccaactttcaatgacattccaatcgctgggactcaacccaccagcatttcaatctttgggactcaaatctccggcattccaaacactgggactcaacccaactttcaatgacattccaatcgctgggactcaacccaccagcatttcaatctctgggactcaaatctccggcattccaaacactgggactcaacccaccaactttcaatgacat

SEQ ID NO: 38219 - DNA, 802 bp, Heterodera glycines
tttggaatttttggcaaatgctaccgtattcccccccccgggccttcccccaccgcctgctaaattactgtaagccctaaaaatgagctttcttttgaggggctaaaaaatggaaaagtctttgcctatggctttttgaaaatgtggtatctaagtacagttgttagagggataaatggaaaattcaggctgaagagactgctcgaaaacatggaatgtttttttaaaatttaacaatttttaaaaagtgccaaaaacggaatttttcaattttccaacttaatttttaatcctaaactattaatctgttgattttttgtgctgatgataatgatctcttgtccctattttaataataattataaaattgattttgtaaaagtaattaaaaaaattttgcctattaaaacggcaaaaaatgaactgtcagcttgtacatttcgcccgtcttttgaagcataattaatgagtagcttttcgtttcgccgtcacgccgtgaacgccgccgcggccgacattgttttgcgcaactaataaatttttttgtttgttttctctattggtgtgcaaaatttcaaaaaaaaaaaatggttactatcaaaaattatggccaaaacatttaatatttattttaattattttggccctaaattaattatttttaatttgcatgctaatcgagagaacacttaagattatccaatgaagaggtcttttttgtctccattttccaaaaatatggtaaaataggggtccggcggtgccactaggcgcctttttggatttcggggggggggggggg

SEQ ID NO: 38220 - DNA, 839 bp, Heterodera glycines
tcactaatgaaaataatgttaactttatatgaatcaccaccccctgtacatcaatatgagtcgaagaatgccaaccttctttatgactatatttatgagtttaataaaaaaatatttctaaaaatccgtcatggtcttttaaaagacaaataatttgtttttttaaaccaaaataaaaaggttataagggcaatttgaggtgcttagtacgaatctgacctttttgtacaatttcgaactcctaacccgaattcgaatatttttcgattatgcatttaagggtgtgtttttttttgccttttgcccaaattaatttttaaaattataatattttacatttattcaagttttttaatataatgataaaatcttggagattggcaccgcgtttgaagcttctcgatatgtgtattgttcatagatgagagcttgcaatacttcggttttcaaaatagcaatttcgacactgttatcaaaactttacatttcatggtcataatttatttattttattgcttgtttctgtattccataaaataattatattttttaatttagtttagataaatttattaagagcttataaaataaattatgttgacaaaaatcttttgtcaaaagtatagttttaaatttattcttttttacgaatttaagatttctttttactcgttaaatatatttttaaatttaaaatacttcatctctatgatagtagaaaattaccaatttcataggaaaattattcataagttatttacatttttttagagccgcttgatacataactagatcgagattcaaattagtacattttatttgataaactttctctgttt

SEQ ID NO: 38221 - DNA, 555 bp, Heterodera glycines
tttcgaatcgctaaaagagtaaagcagaaaaaaagaacccaccccttgcctatatagtatgtagccctagagctcgacatccttaaaaaagcccgtacctgtatttcaaaaatggactgtatctgtatttctgtacacggcgattcaattttgtgcttcaagtacaagatttagtgattcaacatgtcgccaaaaatgtcatcgcggcaaaaaaaaaatctttttttttgtattttctgcgccaaaggtactcactcggccgcttcgcggcctcgtaagaaatgcactagtgtcgggcattttgacattataatgccatttcggcatcggtctgacaaagctgcgcatgactttgggaaattcctcaggaattaatttttgttttctaaagaaaagcaccactgtcagcattttgacattaagatgccattaaggcaccgttgtagcaatgatggacgtggtccttggaaattcctcaggaattaatccctgaatttcttctattttcttatcactcacaaatcactgggggaaaattaagatgatactgatgat

SEQ ID NO: 38222 - DNA, 533 bp, Heterodera glycines
attttacatggaattttagagttgagcgggaccgggctctttgggcaaaaccgggacctaatcggattgaaaaaccgggaatttcccggtcaaaaccgggaccttggtactcagttgttcgtattttggtcccggtcacgctcaactatagttcattttctttgtttgtgataatggataactgagtcccgattaaaaatggacacttcagtaccttggattttttggaaatctttcaggaaatcgctaaatttatcctaatgatttacacagacaaaaaaggttgattgatcatttcaacaacaaaaaaggaacaattttcttgagcacgtcaacaattaaatcattcaaattgatcggtctcttctcaacaattcatttcattcacttctgctgatcactcgggtcgggagttgtgtcgagaagcctaaaaatagaaacacattaaatcctaaataatttattcattcactgacccgtcgccgacctttatcgcaaaactttcatgtaaatttcgttccactgatcagaat

SEQ ID NO: 38223 - DNA, 875 bp, Heterodera glycines
  misc_feature (247)..(247): n is a, c, g, or t
  misc_feature (252)..(252): n is a, c, g, or t
  misc_feature (449)..(449): n is a, c, g, or t
  misc_feature (521)..(521): n is a, c, g, or t
  misc_feature (543)..(543): n is a, c, g, or t
  misc_feature (700)..(700): n is a, c, g, or t
ggggggggggggggggggggggggggggggaaggggggggggggacgggggggggggggggggagaggggggggggggaggggggggagagggggggggggaagggggagggggggggaggggaggggggggggacgggggggggggggggggggaagaggggggggggacggggggagggggggggggggaggggggggggcgggggggagggacggggggggggagggggggggggggggcgggncccgnggggggggagggggggggagagggggggagggggagggggggggggaggaggggggggagcggggaggagggggggggggggcggggggggggggggggggggggagaggggggggggggggagaaggggggggggggggcgagagggcacagggggcagggggggaaggaggaggggggggagggggagggggggnggaggggggggaggggaggggaggggggggggggagaggggggagagaaagagagaggaggagagggagggnggagaggggggggggggggganggggggggggggggggggaaagggaagaggcaagggaaggggggggggggggggggggggggggggggtgggggggaggggggggggggcgggggggggggggggagggggggcgggggggggggggggggggggggggaggggggggggagggggnggggggggagagaggggggagagggggaagggaggggggggcggggggggggcagggggggaggggcggaggagggcggggggggggggggggggggggggggggggaggggggggcgaggagcaaggggggggggggggggggggggggggggggggggggggggggggggggg

SEQ ID NO: 38224 - DNA, 866 bp, Heterodera glycines
ttgggtctagaattttcctcttccatttttttcttaactccccatgtttttctcccaacagaaaaacggtccccctcctccttctccacggcacttaactccggcgatttgatgtcagacaacaacgaagcggcaatggcactttcctcgctgatcgaattgggtaaaaatcggcaacaaactcagcgagacgaggctgaaaatggcattgacaatgagtaggcaaagattggcttacaattagcgtttaattgtcatttatcttttcttaattaattgcagcgattgccgtttcgatgggtccgtcgccgtttcgtcgccttcggtcatttcgtcgacttttgcggcaacaccagcgaactgttctgccgaaacattccaatcgcacgccaacggcacacacaatgtgacgacaatcaaaacggaggacaacgaatcgggcgacgaattgccaccgcaaggcaatgcgaaaaaacaaacgaacgaaggcattttaaatgccaagcaaaaaattcgaattcgaataccttttattttaaattatgaccattttaatttttaaattgcgctttgttcagatgattccgcgtcggatgcgcccgttcacgaaattcgctgtggtctgttgaacgcgcggctgcacatgcaacgctttacctgcccgggcattcatcggaagtgcgttgagttcgaaggtcgaccttttttaaaatttatgtattttttggaggggaaatgagcaataaaaagagatgggttttactatttattggtcaatttggctgatttatgctttcttttttggtgatgttttgagtgaaattgcaggaaaactgatcagtccgcgacaatcaccatcaaagcgg

SEQ ID NO: 38225 - DNA, 865 bp, Heterodera glycines
gcattactatatgcggttgagccctacaaatggtcggttggaaaatggctccattactaagaatagatagtctcagaaagatggctaactcttttatctacagcctcaaacgagagggttttccccgaaaacgcattactatatgcggttgagccctacaaatggtcggttggaaaatggctccattactaagaatagatattctcagaaaaatggctaactcttttttctacagcctcaaacgagagggttttccccgaaaacgcattactatatgcggttgagccctacaaatggtcggttggaaaatggctttgagccctacaaatggtcggttggaaaatggctccattactaagaatagatagtctcagaaaaatggctaactcttttttctacagcctccaacgagagggttttccccgaaaacgcattactatatgcggttgagccctacaaatggtcggttggaaaatggctccattactaagaatagatattctcagaaaaatggctaactcttttttctacagcctccaacgagagggttttccccgaaaacgcattactatatgcggttgagccctacaaatggtcggttggaaaatggctccattactaagaatagatagtctcagaaaaatggctatctcttttttctacagcctccagcgagagggttttccccgaaaacgcattactatatgcggttgagccctacaaatggtcggttggaaaatggctccattactaagaatagatagtctcagaaaaatggctaactcttttttctacagcctcaaacgagagggttttccccgaaaacgcaagtactatatgcggttgagccctacaaatggtcggt

SEQ ID NO: 38226 - DNA, 996 bp, Heterodera glycines
  misc_feature (67)..(67): n is a, c, g, or t
  misc_feature (96)..(96): n is a, c, g, or t
  misc_feature (100)..(103): n is a, c, g, or t
  misc_feature (105)..(105): n is a, c, g, or t
  misc_feature (114)..(114): n is a, c, g, or t
  misc_feature (117)..(117): n is a, c, g, or t
  misc_feature (120)..(122): n is a, c, g, or t
  misc_feature (124)..(125): n is a, c, g, or t
  misc_feature (128)..(135): n is a, c, g, or t
  misc_feature (137)..(138): n is a, c, g, or t
  misc_feature (141)..(145): n is a, c, g, or t
  misc_feature (150)..(150): n is a, c, g, or t
  misc_feature (993)..(993): n is a, c, g, or t
agcctaataaattgcgtagtgaaattttaaactctttctcacatagattatgtttaaataatttaantttttgattgtgccttgaaaagaaagaanaaannnngnggagaaagngangannnanngannnnnnnngnnaannnnngttgntttgtttggtcatcaatgttcttctgcttaaatcaaaaataaataatttaatcacaaatttttggccatttaatttattaaatattgaaaattcggaagactttaataaattattatatatttttaatattttatgcgctttattctgtgtaaagccaaagaataattagtgcttagtttcgtttcttcgataaaattgttattgtttttaatgcttcttccttcccattccaataatttttcaaaacaatccctcacggggaaaagagacatttcccaaattactaatcgtttatctcataaataatacatataaaagaataaatttaaacaaattttcacattttaaggaaggagcaccaaaattcgtcataattccgagtttaatttatttgagtaattattcactaattaatggccaattttctctacggttttaaataacaaaaataaaaaattaattaatgctttattttgacgtcaaatcgattatcgttttgtgttcccgggagaaagaatttatttatttattttcgcccgttttcaaaagtcgtaattcaattttatgcatttcaatgctttcacatggcaaaaatggggctaaaaatagcaaatttaaaaagtaataattatttaattacatcactaaaatattataaaaatagtaattctattttgagaaaaatgatttttgctttcattttttcttttatttcttccaaattcaacaccttcgcttttgccttattttggtgttttctcgttaataaagtaagtacctttttaatttaaaaaattaaaaagaagttttaaatttttatttttatttttattttctccctnttt

SEQ ID NO: 38227 - DNA, 920 bp, Heterodera glycines
  misc_feature (85)..(85): n is a, c, g, or t
  misc_feature (832)..(832): n is a, c, g, or t
  misc_feature (874)..(874): n is a, c, g, or t
ttttgtagtctaatctactcaaaacggttcagaattctctccctataaaattcactgtgcgaaaatggggtatgaaaagcttatntgggggaaaaaagactacaaaataatacccctgggagaagggagtgggaaacataatttcaaaattttcaattttttgtactctaagctactcaaaccggttcagaattcaataaaaataacattcacggtgcgaaaaatggggtatgaaaagtttattggggaaaaaaagacttttttacaaaataatacccctgggagaagggagtgggaaacatgatttcgaaattttaaattttttgtactctaagctactcaaaacggttcagaattcaataaaaataacattcacggtgcgaaaaatggggtatgaaaagtttattggggaaaaaaagacttttttacaaaataatacccctgggagaagggagtgggaaacatgatttcgaaatttttattttttgtagtctaatctactcaaaacggttcagaattcaataaaaataacattcacggtgcgaaaaatggggtatgaaaagtttattggggaaaaaaagacttttttacaaaataatacccctgggagaagggagtgggaaacatgatttcaaaatttttaattttttgtagtctaatctactcaaaacggttcagaattcaataaaaataacattcacggtgcgaaaaatggggtatgaaaattttattgggggaaaaaagactacaaaataatacccctgggagaagggagtgtgaaacataatttcaaaattttcaattttttgtactctaagctactcaaaccggntcagaattcaataaaaataacattcacggtgcgaaaaatggngtatgaaaagtttattgggggaaaaaagactttacaaaataatacc

SEQ ID NO: 38228 - DNA, 894 bp, Heterodera glycines
tatttgaaattttttgaaagtttttatgtattgataataaatcattcaaaattgcttttatcaataaattttagaaaaagactcaaaaatcgcaaatttggcattttttcatttgaattggatatttttggtctttcaaaagctcgcctcctttttgtcgtccttcccaaccaaaaactcaacatccgtatactctcttttcttaaacactttctccatttggtccgtcagcgaattgacaatttgtccatggcttatgccttaaatattttaaatcttttattaattgggagacatatatataatgagtagggatgcgatttttaggcaaatgcctaaaatttttgcgcacttaatacgcacagataagcacgaaaaaagccctttccgcatggtttggggtgtctacgatgacttttataatgcctaactttgcctatttcggggtttttgtgcctaaagtgcctattttagggtttttgaaaaaatccttaacaaaaatgcaataaaaacaaaaaatacacccctaagaaatgtaaaatttttcaaaaaaattatccctaaatttaatatttttttcaataaaaattttttggtttaaaaatttgtacatattcgaaaaaaaaactttaaaacatttaataatttcatttacaattgaaatatttaaagttttaacgtgttttgttacctaaaaagcgttaataaaaaattttatttgcctatttttgtgcctatttaatgcctattttcgcgtttttttgtgcctaaaaatcgcatccctaataatgaggtcaggattaaaccgaaaaaaataataaaggaatgcaaatacgcgaaatctaaatgcgaatttttttagccttaggttacggcaatggtactattttgccc

SEQ ID NO: 38229 - DNA, 1109 bp, Heterodera glycines
  misc_feature (998)..(998): n is a, c, g, or t
  misc_feature (1052)..(1052): n is a, c, g, or t
  misc_feature (1095)..(1095): n is a, c, g, or t
attatttttcaacctcctcagaaaggggtacatactcctgagaccggcagtttaatggagactggcacataaaaagagcaaatacggtacttccaaaaactttgatatgattaaatcttacaaaaaacttcataaaaaatttcaatgaaaaattatcagaaaaaattagaattttctacagaaacattgttgtatttaaaataaaatttacttaatataaattaaatcattgactaatttactttgacgattattatttaaaaatcaatatttccattttttctataaatcatttttttaaagtgggattgaaacttttcataaatatttacaaaaaatcaaattaaactggccaatgatttgtcaattttttaagatttttgcactttttgtgaatcaacctagccccttcatgccacgaacacataaagcgtctttctgttgactattttaaaaaaaatccaaattgatgtcactggaattttcgcaattttattttcaatttccaaataaataaatagaaatcactgtgtaaaaaataaattttttttttgaataatttttccttttgaaaatggcatttaaacttcaataatcagaagccatcgtccttctcgacttccaaattttcgaattccatcgtttgcttctccgcattgtactcatatttgccggtttgtccactgaactgtcccactctgtgctcccccaaatcgacgtgcacgcggcgaagctcagcgacattgtgctgaacatttaacactcattaagagtgaaagttgaacaattacatttatcaaattgctttttcgtccaattaatggaattatggatgaccctttgtcgtgaatcacacttcgaaattgttcgggattgattctttgtgatgacaatttgacaggcaataattagggatgtgcgagaaatgatttttaccgagaatcgagaaccgagacccgggaatgaccccgggaaacgaccgagaccccaaaaaaccngagaaattctccgactcggatcgggaaccgagaaatctaaatttttttagccgntttttacaaaaaatactattttttgcattttggtcacattttncaaaatatggtaaa

SEQ ID NO: 38230 - DNA, 719 bp, Heterodera glycines
  misc_feature (97)..(97): n is a, c, g, or t
  misc_feature (549)..(549): n is a, c, g, or t
caattctttcttcgctttttaagacattaataagccccacacagtttatttatatcttgacacatttttaccgtctttaagggggatgttctttggnaaattgtcttctcagtgccaaatgaaaggcttcttgtgcgttgttcgtacgtgctagatttccaatgattgaatcgtgatggttccatgaagttggcacaaacttttttgttatacagtttttacctttaaatgttccgtccgcggaccaatgccgataggtcctaagtcgtcgcctaccctcttgagagcagaagataaaaaaaacactgccatcaggttcgtcttctctggaatcaaatattaggaactgctggccactgtggtccaaagcaaattgcccagcaatttcaattgcttgcaagtttatagcatcaacatttcttctttctggcagttctcgctgtctttcgatggtacgtcgaaggcctgatgttgaaggaagtgacatgcgtgcttcctcacttagctgttccctttcagctgcaattatgtttctggcgccctcattgngttgcattcgcgcaattaatttaatcgattcttttgcaacccgcacttcttgagctgcctggctgggaagatgattatgttggcttacaacattaagtaattctgatccaatatcagagtgcgctctgccattacagggttttttcgtgcacgcccaaaattgcttttga

SEQ ID NO: 38231 - DNA, 489 bp, Heterodera glycines
gaaacaattaaataaatttaaaaaaaaaattgcttatcgctaatattttaacttttaaataaggttgggccccgacccctttgaagggcaaaaagtcgagggtaggggaacgcggggggcagacgtcgggtcgggggaatatgtctcaaaaacgtctcggatcgggtcggagggcacggggtcggggcccaacactatttcaataatacaatttataattttgtataatttaagcatttaatttcaatttcttttattttaatataaatttaagtttttgtccatatccaattatataaacaataagacgacgggatcgggagtctgtgaccgatccttagatacgactttttttaaataaaggttgccccaacaaaatcggcctttcagtcccgcttttcctatcccggactgattccaaccaccaaactcctttagacttttcaaaatttcgggctcttatccaaaaacctaaaatatttatttatc

SEQ ID NO: 38232 - DNA, 729 bp, Heterodera glycines
  misc_feature (93)..(93): n is a, c, g, or t
  misc_feature (107)..(107): n is a, c, g, or t
  misc_feature (109)..(109): n is a, c, g, or t
  misc_feature (117)..(117): n is a, c, g, or t
cagcccaagttttcggactataacttttttatcgtccctcctaggactaatcttggtattattcgaaaggttaacaattttagaagatatttntaaggtattggttngngattaganaattaggaaaaaagttataagatgaaattgcaaaaaagtcgaaaattttgaggttttttccccaataccatttttagaagctaaaatttttgtttgttttttgtaaggctaatagagcttgtgaagggctttcgaatgataccaaaattgttagatttggtcaacaagaaaaaaagttataataaaaaaactgaggctggcgccaaaacggcggcgccaaaacgacccgttccccatattaacacacacgctcatcagtagggcgaggatttttagttttttaaattattttttctgtggctttatttagacgataaatgcacgaaaaacacatttttagctcggaaatcttcgttttaacgccactattcatcactaggaatcactattttggagttttgcctctaaaaaaactttttcggaagttggccactaaaatagttttttgccactattttggcgtttcgtcactatttttgccactattttggcatttttttgaaaatttcacaaaaaatgcaataaaaatgaaaaatataccccaagaatcaacctaaaaaattcaaaaaatacacccataagaatcgaacaaaaattttcaaaattacaccc

SEQ ID NO: 38233 - DNA, 822 bp, Heterodera glycines
ggggactctagagcgatggcaggggggggattgggtcgtttggccgactctcaaggaggcgtacgactcataaaaacaaacgaacaaatttctttctttgatttttcctttttcagggatcatctccctgtccgacattctctctcacctcgtcctcgaaccgccgtcgtctcccggcggaggcggtggcaccgaaagatcgtcacgagtagtttccgcagcggaaacatccaacgagggaccggcaacgcagtcgccggcagcggtggacgaggcggccaaggaaatgatggatttcagcctgggctgatcagcagaggagacggagacacagcaccatcgacagcgagcagtacacccacacaaacaaactcaattttgctcaatttcttttgttgttgcaattcccttacaatcagtcgctgttcctctgactttgatttgagtgtcgtccatccgtcgattgactctttgccccccgcccaatttgacctccgtccgttttgctcttttctcattagtttgttgactttctgctgactcttcgttttcaacgtgtcccccccccccccccctcaaaatcacaatgaatgtaatgtattgatttgttgcgggtcaaaaaatccttccccttttccttccttctccgaatgagctctctcatcatcactattattatattattattattaatgtatcatttgctgctgctgctgactttgcattgattgcatcatcacatctctcccaagttgttagtgtccatccgtttttacatatttttttattttgtttgaatttgtttgtttgtttttgttaatt

SEQ ID NO: 38234 - DNA, 930 bp, Heterodera glycines
aaacgaagaccacttccaaaacatagtttttcgagctccaccgaatggtattttttttgaaaaaatttcgatttttttccggaaatagaaaaaatttttggcctaagcgggacatttgagtcccgggcccataactcgtcaggggtcggttttagccaaaaaatgccttagagcaaaattgtagagctttttaagctctatcgaacggtgtactacatgatgtaaaattttcaaaaattttcgagctaggccccctagatatttttttttttttttttggggtcgaaaaagggtgtgaaaaatatttttctggggtaaaataaggtgctgagtacgaatatgatgtctattttaagtttcagaattttgggaattttttaaaaattctttattttttggcaattttttggccctcgggattttggcctaatattttaatattcataactaacctcagggtaagtctattttgatacaacaaagctttaaaaatagagaaaaatcaggagaattttatgggatttatttaggttttctaacatcaatatgaaaaaagttattccagaaattctggaaattttagatttttcagaaaaaaattcgtaactgccttctgaaaagaaatttgagaaaagtaaaatactacaaaaatccacaatttttttctctataatataaattttattttacatttttatcacatttttaaaaaaagatataaaaaataaaagtgattttgtgattcgggtccaaaggggggagcacatggtgtttgagtggaatgagttttctcacatgaaatcttccaaaaatatgcctttaggtatgatttggcccgctgatcacaaatacgtgatcacattttacttttgacatcgtccgacctcagactccctgtgtgattggagagtctgaggcctcattttgagg

SEQ ID NO: 38235 - DNA, 585 bp, Heterodera glycines
aaaattttttccattaccgcaagagctacggtaattgtgaattaattctcagaaaaatggctatctctttttaggacaatattctatctcgtaaccccgatgctaatctgttccgcagagcctcttcaaaattttttccattaccgcaagagctgcggaaattgtgaattaattctcagaaaaatggctatctctttttaggacaatattctccgtaaccccgatgctaatctgttccgcagagcctcttcaaaattttttccattaccgtaagagctgcggtaattgtgaattaattctcagaaaaatggctatctctttttaggacaatattctatctcgtaaccccgatgctaatctgttccgcagagcctcttcaaaattttttccattaccgcaagagctgcggtaattgtgaattaattctcagaaaaatggctatctctttttaggacaatattctccgtaaccccgatgctaatccgttccgcagagcctcttcaaaaggtttccattaccgcaagagctgcggtaattgcgccgggggggcagaaaaatggctatctctttttaggacaatattct

SEQ ID NO: 38236 - DNA, 657 bp, Heterodera glycines
ttgtacctactaatatcttttgaactctcctactttctcttttaacttttctgatcactgtggtacctcttctgatcactgttgtacctcttctaatcactcttctaatcactgttgaacctcttctaatcactgttgtacctcttttagacgaagcgtcctaatttccctacaaagtttgaaaacgggcgcgaagcgcccgtcctgaggccgcgaagcggccgaatatcccccaaaaaaaattaaaaaacgggcgcgaagcgcccgtcatgaggccgccaagcggccaaatgttctcaaaaaattaaaagacgggcgcgaagcgccagttcttaggccgcgaagcggccgaatgtccccaaaaaaattaaaaaacgggcgcgaagcgcccgtcctgaggccgcgaagcggccgaatattccccataaaatttaaaaacgggcgcgaagcgcccgtcctgaggccgcgaagcggccgaatgtcccccaaaaatttaaaaaaacgggcgcgacgcgcccgtcctgaggtcgcgaagcggccgaatgccccacaaaaaattaaaaaactggcgcaaagcgcccgtcctgaggccgcgaagcggccgaatgtcccccgcaaaattaaaaaacgggcgcaaagcgcccgtcatgaggccgc

SEQ ID NO: 38237 - DNA, 649 bp, Heterodera glycines
ctttttgaaattcatattgctgttattttgttcaactcccccattttttccaagtgaatttgacccaatgaagggagagtggatcagctggggggtcggtgcctattgggtggtgtggtgggaggtttttttctaggcttagatcacatgccattttcggcactctgataattttagcgttcataatgggatgtataaaggcgattgtagaaggaattggatgcgctaaaattgtttgagaagctttttgagcgtaattacgatttttacttagaccattttttctaggcttagatcacatgcgattttcggcactctgataattttagcgctcataatgggatgtataaaggcgattgtagaaggaattggaagcgctaaaattgtttgagaagctttttgagcgtaattacgatttttacttagaccattttttctaggcttagatcacatgcgattttcggcactctgataattttagcgctcataatgggatgtataaaggcgattgtagaaggaattggaagcgctaaaattgtttgagaagctttttgagcgtaattacgatttttacttagaccattttttctaggcttagatcacatgcgattttcggcactctgataattttaagcgctcatgatgggat

SEQ ID NO: 38238 - DNA, 513 bp, Heterodera glycines
acaacataaaattattacttctaatgccataaaacaatccctaaacagcttaaaaaattgagggtcacattaacattaaacccttttggcgttctgttaattgttttccaaattcagatgctgcaacgatgggtgccaaatccgaaagaagtcaactgcgtgccagccaatttcatggagccgtaacggaatgattggatcggcgtggtgggcgtaatttgcacttgattaaatcgattgatcacttgtaaattagtttaattaagtgtaatttcaattattttgcttctattttaggtttgatcacatttgcaacacatttatttttttcgtttttatttgattgtgtctgcaggcagggccgaaacacgttttagcattttccttagcattctgacagggtctgtactgatgaggcccgccctgtcacaatgcgattgcttttcaaatttagaagcaaagattactctatttgaaaaataaaagtgaattaatataaaaatgtatattttt

SEQ ID NO: 38239 - DNA, 790 bp, Heterodera glycines
  misc_feature (16)..(16): n is a, c, g, or t
ctatatgcaatttttntgcggttcaaggaaaatgggaaactcccctgaagttgagagtaattgggaaatttcttggatttttttttttgaaaattcccgtaggggttgaaaaaattatgaaaaagtctacctgaatacttggagtataatcaccgggcccttctgatgaaatgcttatgagaatggcgatcacagtgttaatgcactaaaattaaaaaataaattattggttagccctagctttggagggggaggtaccgtctgggtggcgatttttttttttttttgcttttcggcctctaacaaaaaaaaactcaagaaaggaggggtccggcagacgctgccaggaaaaaatttgagaattttggtcaaaattctgaacggatttgtactaaaaactctggctaccctcttgcattatgtgtggtatgtctctaaaaaatttaaattttttggaaaaaaccagggccctaaacacagacatcggtttcgtcattgaatgcttgcaccgccgccaaataaccaatgcgtttttcgctgtaacgcgtgctcgacatcacttcaatgatgttaaatgttgtccaggaaatgtcgtagccgagcacttacagctaaatttggagaggaaaaaaatagtataatacagggcacgcgaaacggaaaattcaagaaaattaaatgaaaccaattttgaataaatgaaaaatgttgctttattgcataggataaaaatgatcaattcttttttattttttaaacaaagaacttcacactccaactggcagggcag

SEQ ID NO: 38240 - DNA, 548 bp, Heterodera glycines
ttattccactaaatttgatcaaaaacgaagagagttcccccccggaaatttcacttgattttccggggctcaaatttcgttgatttttcaaaaaattttaaacacctaccaaaacgtctgaaacccaaaataaagtatatattcgagttcagcaccagaaattaggccagaaaaatgcattttggctaatttaggagcaaaaaaaattttcatgaaatgcaaaaccatggggtcccccctttggttttgcatttaaaaattcatttttgttttataactttttttaaattcatgataaaaacatgagataaagcacattagattgggcttaaaattctctacaaaaaagctcttagacgattttttgataaattcaactcctgacgagttattgcgccagaactgaaattgaggcctagcaaccaaaaattttctatttccaaaaaatttttgaaaaatttttctgaatatgacaccaatcgatagagcatgaaaaacggttgcttgagagtggtctccgtttccccggaaaaatctgcaaaaatact

SEQ ID NO: 38241 - DNA, 935 bp, Heterodera glycines
catcggttcggtgggactgccccgaaaacaaaaatacccccacacggttaagtgtccgtttggggtactcaaacaattatcttggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggctcggggggactgccccgaaaacaaaaaaatcgattttttcaagtgtccgtttggggtactcaaacaattatggggagtaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaataaatcgattttttcaagtgtccgtttggggtactcaaacaattatggggagcaaaaatccaacgcagaattaaagtacaggctatagtgaagctattccggaaggattcggtctccccataaatctgggcgcatcgggtcagggggactgccccgaaaacaaaaaaatcgattttttcaagtgtccgtttggggtactcaaacaattatggggagcaaaaatcaacgcagaattaaagtac

SEQ ID NO: 38242 - DNA, 1209 bp, Heterodera glycines
  misc_feature (1163)..(1163): n is a, c, g, or t
  misc_feature (1193)..(1193): n is a, c, g, or t
atcctggacagtgcttgactgctcccggtgattctgcatatttaaatggggggaaagaatttttgaaagaataattcaaaactcactttagatgggtatggagcaaaagttgtcgcattaatctttgccttttctgtccggtcgaacgtttgccaaaccaagcggggaattgaatctgagcagtcaaataaccgtccatccgagcggagggaagcgcagaagaaaacattgcctagcaaatggaaaaagtttatgaaatataaaataataaatgtttttggcctctgcaaaattgaaaatggttaaattgccattttcctatcataaaaagacgaaaatagaaagacaaaataaaaaatcacatgttccggcataaggttccaatttccatgggctcgaatttgcttgtcgattatgtctccaaatgcaattgcatctgcggcgcgtccaattgcattcaaatggtccaaattcctaagcaaaaacaatgaatttaattagaggacattgttaagaaaaccccatccgtgatccgcgaacattcacataattttcttgtacgaaaagtggaattagtgaataatcggtgaagtacagctcattcttctgcataaccgaagtctccgcactcaaaatctgacgggcagcttcgaacacattctgaaagacacataaatattatttttaaaggaaatgctcatttttgaatgcattaataagtaaatgacacttccagggtagaatttaagaaaaattaattaataaggctgggatgttaagataagcaaaaaccgtaaagtaggtatttaaataagtataacaaaaaagttattacgagtaaataggtaattaaaatttattagtaacgatttttaggtagcataacctaaaaaatttaattttgattatttttcatttgtaaatgaattgttaaaaattttaaagttactttttcgaataagatcaatttttaaaccaaaatttttatcaaaaaaatattttatattttagtgaatcaatcaattttttatttacctaaaaatcccagccctattaattaaaaataaataattcatagtattctttaccacagtgacatcctttttctgcatttttttcgaagtgcccaaaccagcggaaaattgaagcgcattaatacactnggcgaatgtcctgatgagaagcttcgatgnatctatcgaggctatc

SEQ ID NO: 38243 - DNA, 739 bp, Heterodera glycines
gggacaaaaagccattttgtaaaaataccgtattattaaaaaattaaatttaattttttagttttactagaaattctaaacttggaattttttcagcagcaaaaaaacattgtttcaaggccgagttcggagattagcttctttccaatttcagtttaactgttgtttccctgtttttgtgttaaatttgcgctgcttaatttgttacgtaatgccaaaaatggcaaaaaaacgttgggtgaggccggcacgaaagacaaaacttggtcatttgtgtgtgtgctttccgcgatgttcctgtgccattttagttgcttttgaaacgcccaagggaaaaataaaacacaaatttatgatggcatgatgggtgaaggcggcttgcggcacaaggcacggaggagcatttttggcacaatgccttcgtcatcggttcacccgcccctctccggaatcgaagtgactaagcgccccaaaagtgacgcttttaacgtcattaaagccttttttgccgtgccgtggtccagtcacgtaagaattgcctttcttccaccaccctcacatccgtgccaaaaaacgatgaacggtgggtgccctctttgctccatcggaggggggggggtgctgccgaaaagcgttaaatggccccggagggaggggtagggaaaggtcgcagttaattgggaaaatgcgtaaaatgccgtaggcttttttttgtgtgggactctagaggtcccccggg

SEQ ID NO: 38244 - DNA, 1335 bp, Heterodera glycines
tgattgatgaaccaagcgcactttttttggctttacttcctaagttttaaccttgatgatctgactttgctctcaaactccacatttgcatgtacattttccatttggcttttcttttaacaaatcttttcattcttttatctattccttgcggtgtgccattttgtccattgataaaattttactttccactgccattcattctttttttccccttattgttcgattccgtgtgaaaagtaatgtaatagcagctcaacacttatatttttcctgtcggacggaaaccattccaaaaacgggttttccattttgcgagcgttgggcagggacgtgattaagtatgtgtaaacatcaacagaaacacccaccaaacgaccattgggggtggaagtacaacaaagtctcccccgcccctaatcgtccaaattgcctcaattgtccccatttgctgttgctttttgttgtcctttcccccggggcatttccaaaattctgtcccccaaatgaattggttttgctgcccctccgcaccttcttaagatgcttatcagcagcatcacacaacactttgttctgattttgctgtttgtcgggtgaggacggcgcgcgaattgtcgcaatttatttgtagagcaatgatttgctggtgctctctctctttctcgctctctctctctctctctctcgctctctctctctctctctctctctcgctctctttctcgctctctctctctctcgctctccctctctctctctctctcgtcgcccaatgaaaagggacatgaacacaaatttgcataggatttggttcatcatatcacaattagcgacagcaaaacagaaacgggacctttactttgtcttattttaacacacatccgtcgcttttgaatacctaattcaattatttattttacttttagttacattgtactgctcaaacttcatcatggcacccctgctccgtcttcacgccttccaaccgaaactgctgacccgctaaggctgaggtgttaacaaatttattcgtcgtccaaattttatttatttttttttttttaatttttatttgcattttgtttgttgtttgtataaaattaaaatgcgcccccccccccccgtttttaggaaaacttgttcaaatcgcactcggttgacggcgggtgagtcgatggatgactatgtgctgtttgactgtgtgtttggcattccgttgtttgacgaggcgttgaacaagacaatttgccaacgcatcatgcacaagcagctgtgctcaacggacaacctatatggaacaacaaattttattaaattttggatttcattaat

SEQ ID NO: 38245 - DNA, 770 bp, Heterodera glycines
cccctgggcctgcagaaaatggcaactgaagcgtgctcaaaaagtacacttcagtaccaggcgaatagcgcgtcggcgtttgatctgagggaaaggtgcccagcagacttattgtagagttttggaagctcgattttctgaaatttaaaaatttcgaaaattttcaaaatttttcgagctaggcctaaaaaacggtttttgggtttttgaattttaagaatttttaacgaattttcccagaaaaacggagggcacttccaaaacatagtttttcgagctctatcgactggtatttttttcggaaaaatttcgattttttcccggaaatagaaaaaatttttggcctcagcgggacatttgagtcccgggcccataactcgtcaggggttggttttagccaaaaatcgtcttagaacatttttgtagagaattttaaatgctatcgaatggtgtgcttcatgactggaaaatttcaaaaattttcgagctaggccccctcgaaaatttccggaattctttttgggtcaaaaatgggggtgaaaaatatttttctggggtattttgaggtgctgagcacgaatttgaccttggtttttcgtttcatgatttttggaattttttaaaaattttttattttttggcaattttttggccctagggattttggcctaatatttgaaaattcataacaaatcgaagggttgatcaattttacagtaataaagccttaaaaatagagaaaaatcctgagaatttttatggactttatt

SEQ ID NO: 38246 - DNA, 1400 bp, Heterodera glycines
  misc_feature (111)..(111): n is a, c, g, or t
  misc_feature (1306)..(1306): n is a, c, g, or t
tctgtgccggccaaaaccaaatcgcgtcgttcgctgtccgcgccgcgtgcggcgaccagcgcaactgaaaaatgggtttttcagattcaaaatgcattttctgctgacttngcaatgcgctgcgagcatcagcctcgtgtaggaaaacgtaattaaactaaaggaaaatgtgaagaatgatacggtagcacttgttactgtagggaaaagaaaggttacggtataaacgataaaccaaagtaaagcattggataagtgtcattagcaagtttaaattaccgactaaataaatcatcaattggtctcaatgagcacctttttctattaattaattctttggaagagtttaattttcggattgcttcaaattttgtccaattacggtactacagtactaccaagtgcgtgttgacgttgccctcgcgcgcgtacttctccaaattgagccgtgccatgttcacgaacgggccgtccttctgggcaaccattgatgcctgtgattaagttgctgttaatttgatttaagttttgctgcgtttccaaactgtgccaagtcgcgcttgtcgcgcggtgaccgcggagattggccgcgaagtgcgcgaggtacgcgacgtacgcagcatgcgctccatgctgttttgggtgcccgtcttcaaacggctttcgggccgttgcatcccttggaagggttaacgaatgaatggcattggcacccatttggaataaatggacaaattcataataaataattcaaaaattcgaaaaaatatgcaaagtttaccagaaagtggacgtcccgaggcagtcctagaagaaagaaatacaataaacaaattcattgaagattgtaccgtccagttttctcatttcaaaaaagctgagtagtacggtcccgaggacaacggactgaccttggccgaactgcgggactcggccctccggcactcgtgccagtcagaggcctgtaaaatgacgagtttcgctgcttgcatttactttagttcgcattttttgccttgaaagcgatgtgccagggcgtgccgcagtggccaccgccgtgcccaagtccatgtacgcgtccgccagcccggcctcgtcgttctccaactcgtccacgaacacttcttccgcgaagcaggccaatttcaagctccaagcggccttttatgtgaacatttttgtatatcaaaaataatggattaaggagaattccggaaaaaagaactttttaccaaattctttttcaattttaccattttaattaattttccaattgcttttcgtcccattctctcccccccccccncccccgcttttcacctggtccaatgggttcttctccagcacacgtgcacattctcgatgcgcctcctcaattttgttgattcgaaataaagcag

SEQ ID NO: 38247 - DNA, 1184 bp, Heterodera glycines
tttataataataatataattgataatataaatcaattttttccttcctatattatacattttacgcatatccgagtgttgtatgacaccattagcaggtgggcaattattgaattacacaaaaaacaaatgataacatttttaatttattgaaaaaaatatttctcttaaaaatggattattaaaaaatagaaccccatggtaagaaacttagctaaattctttgaaaataattaataggttaataaaaataggcttgtaatgagcagcttaaaaaccgagaccgggacttgccgggatcagaaagccgaaacgagaggacctggattttcaatcgggatatcgggattttcacgttagcgtacccaaatattaccgtatccaaaattgtttgccttatatttattcatacgatgtgacacaaatatagaacacaaaaataggttatatgtgtaagtgtataaattagagtagagcgggaccgggaattttgggcttaaccgggaccgggaccttttcggggtgaaaaaccgggaatttttggctgggaaaaccgggaaaaaacccgggactggtcccggtcaaaaccgggacctcggtactcagttgtactcagttgtccgtgttttggtcccggtcccgctctactctagtataaataattgaaaaaaataaattttatttttattttaaaaaacggatttttcgtttgtccgtccgttgagcctcaataaatccgcgaacgatccgcccaaaaaattgctccaacaaaataaattaattcaaagtccttcaagaaatgtattcgttgtcatcaatgtccatgatattgggcatttcctgaaaaaattttcggtaaattttaaaatttttggggatttttttccggcgacttttgtacgcgccaagcgcgacggcggaatcatcacttttgccggcgacagctccacagaacagcatttttctatgaattgtttaagaaattgaaaaaataaaatccttaaaatggaaattttttttaattagaaaggaattcaaaaatttctcggaaatctaattaataatcgataattttaatttaaatcccgcgaactaggtgttgggattttgccaataggcgccagaaactaaggagattttttgtttcccattaataccagggatgtgtgtcgacgccctcaaaaa

SEQ ID NO: 38248 - DNA, 679 bp, Heterodera glycines
aatttttatttatctactagcggggtcagcgccttcggcgcatcccccgctaggtagtacgattgtattataggattatgaatgataaaatcgactggctcggccgcttcgcggcctcgcatccttttcttggctttttcttcaatcgccgggactcaacccaccagcattccaatcactgggactcaattctcctgcatttcaatcactgggactcaacccaccagcatttcaatcactgggactcaattctcctgcatttcaatcactgggactcaacccaccagcatttcaatcactgggactcaattctcctgcatttcaatcactgggactcaacccaccagcattccaatcactgggactcaacccaccagcattccaatcactgggactcaatttcctgcatttcaatcactgggactcaacccaccagcattccaatcactgggactcaacccaccagcatttcaatcactgggactcaacccaacagcattctaatcactgggactcaattctcctgcatttcaatcactgggactcaacccaccagcatttcaatcactgggactcaacccaacagcattctaatcactgggactcaattctcctgcattccaatcactgggactcaacccaccagcatttcaatcactgggactcaacccaccagcat

SEQ ID NO: 38249 - DNA, 852 bp, Heterodera glycines
ataaaaataacattcacggtgcgaaaaatggggtttgccttgtatattaggggaaaaaagactttacaaaataatacccccgtgagaagggagtgggaaacatgatttcaaaattttcaattttttatagtctaatctactcaaaacggttcagaattcaataaaaataacattcacggtgcgaaaaatggggtttgacaagtttattggggaaaaaaagactttacaaaataatacccctgggagaagggagtgggaaacatgatttcaaaattttcaattttttctagtctaatctactcaaaccggttcagaattcaataaaaataacattcacggtgcgaaaaatggggtttgaaaagtttattttgaaaaaaagactttacaaaataatacccctgggagaagggagtgggaaacatgatttaaaaattttcaattttttctagtctaatctactcaaaacggttcagaattcgataaaaataacattcacggtgcgaaaaatggggtttgaaaagtttattggggaaaaaaagactacaaaataatacccctgggagaagggagtgggaaacatgatttcaaaattttcaattttttctagtctaatctactcaaaccggttcagaattcaataaaaataacattcacggtgcgaaaaatggggtatgaaaagtttattggggaaaaaaagactttacaaaataatacccctgggagaagggagtgggaaacatgatttcaaaattttcaattttttctagtctaatctactcaaaacggctcagaattaataaaaataacattcacggggcgaaaaatggggtttgacaagtttattgggggaaa

SEQ ID NO: 38250 - DNA, 841 bp, Heterodera glycines
gaaaatcatcccatcagcatttcaatctctgagactcaattctcaggctttccaaacattgggactcaacccaccaactttcaatgacattccaatcactgaaaatcaacccaccagcatttcaatctctgggactcaacccaccagcatttcaatctctgggactcaaccctccagcattccaaacaattgactcaaatctccggcattctaaacattgggactcaacccaccaactttcaatgacattccaatcactgaaaatcaacccaccagcatttcaatctctgggactcaacccaccagcatttcaatctctgggactcaaccctccagcattccaaacaattgactcaaatctccggcattctaaacattgggactcaacccaccaactttcaatgacattccaatctctggaactcaactcaccagcattttaatctctaagactcaattatcagactttccaatcgctggaactcaacccaccagcatttcaatctctggaactcaacccaccagcatttcaatctctgggactcaaccctccagcattccaaacaattgactcaaatctccggcattccaaacattgggactcaacccaccaactttcaatgacattccaatcactgaaaatcaacccaccagcatttcaatctctgggactcaacccaccagcatttcaatctctgggactcaaccctccagcattccaaacaattgactcaaatctccggcattccaaacattgggactcaacccaccaactttcaatgacattccaatcactgaaaaatcaaccccaccagcatttcaatctctgggactcaaccca

SEQ ID NO: 38251 - DNA, 947 bp, Heterodera glycines
attcccgtgtatgatgatgatgatgccgatggtccctttcatgcctttttacccgtaccctccaccaccaccaaaaaattgattctcatttgtttttgttttgttgttgcacatttactcgatcaaatttaattttgcttattttttctctcatcaataaacaattgtgaatataacgcgcaaatattaatacaatggagtgaaaaatttttttgtagaggggaggggggatactgtagggtgagcagcaccacacgtacacagccaatgaaagttgttttagtgctgcatgtaaaatgtggtgctcactctacagtagggacatttatcagggctgggtgaaatttttaaatgaataagcaagcattgtcggcatagtcccacgtgcccacaggccccaaagaattgcgccacccctacactacacaaacacatcccctctatattcggatacaacaaagtgtcggggaactgggcagatgccaatgggtccccccaacgaaaaacggctttcgtttcgctaccagattgaagtgcggcttcctttgggttgcgcgcggccgttgcatttagctgctgttctctgctcaatggcccaaattcaagcgtcatgcgcccatgacacagccccattttggccagatgaaatatgttggttgagagtgggcgtgcctcctgggcaaagtttggagtaggcgtggcatcccttttccggatataaaagtgaaacccatccacatctgactttcattttctcctgcaatggttctcgtaagcgtattttgcagccagctgctcaaatgccctgtcaaattgttgcgagaccggctcaaccaccccgaggaccgggcgcttgtgttgaaacaccttatttggcgcaaatgcgcaccacctacaatgaccgtaacgggttgaccaaaactttcttcttgttgggatttcggcac

SEQ ID NO: 38252 - DNA, 447 bp, Heterodera glycines
cggagcggggaggagctcaattgtcgggggtcggggaccccgatcggggaatgaacaaattttattttaacccaaaaagacaaatttttctttttcaatactcgtagatcttccttttttcattttaatcatctaatttcgttagcgccaataagagtgagtccaagctggcgcctttaaactggtgctaccatttgttcgtatttgttctgattttggggtagcgacatttcttaaatatacttataattttgaaattttatgacataatgccactattttatcaagaaattttaaggtctgacgcaaaatttttttgatttcgaatgtatcgaaatttataattttgcattttcctccccaaaattatcaaaattgataataggagactaaaaaataatatttttttgatcgaataagttgtaaaaataactgatttgaaaaatg

SEQ ID NO: 38253 - DNA, 497 bp, Heterodera glycines
tttggaggcatatgtaccaaaattgcagccccaccaatatacgaataaaaaaatgattttccattgaattaaaatgaagtagccaaaaagaaaaacaggaagaaacaaatggaataaatagaaaaacaaaacgattgtatgaaaatgagacgaatcattgtgaaaatatttgaatttgggaaaattttgaaaaagacgtatgacaataatgagatttttcgcttagaattgtttgaggaaatttgaggatggttcaaatataaaaaatcgaaaaactcttcttcgctttgtccttttttgtccaacaatggcaaaatgtccaactcagtagaccaagtcgaaaaggtcgtccaccgaatcatcagcctaaaaaagataataggaaaagtgaaaatgttttgttgcttttacctgctcaatactctgttcttttgggagtccgttgttgtgtccattttgaaggtcattccggaggaggcggaggcgggggaggaggg

SEQ ID NO: 38254 - DNA, 580 bp, Heterodera glycines
cgaaaaccccaaaattaccatttttaaaatgtttttaacaatcgaatttaatttttttttaacaaaaatattaaaaacataaaaatctttcacaattgacattttattaaaatatgtttaagaagaaagaaaaaaaagtcaaaaacgcaattaaaagtgtccaaaaatttcaaaaaattttctcgaaaaaaccaaccttaacacccaaccgcttcttctccagctcattgttgccctgagaatttcacaaattaattaatccgcagtttaaatttgggatttaaaattttcaaattaaaatacggaccaaaaatgagccaaactcggaggcataagcatgctcgaacaggaaaatcaggaagcgctcgttgaactccatgcaggtcggatactggcgcatcagctgcaattttgggaggagaagggaattaaaatgcaaaaaaaaaatgtttttttaaaaatttaattttggggaaaaaatattttgaatggggacaaatacgcctgccatttggaaaaaaatggaaaaattattaaaaaaaaagttaactaatatttaaaaatagtaataattattttg

SEQ ID NO: 38255 - DNA, 740 bp, Heterodera glycines
gggttggtgatggtggtggacaggggcgagtagcacctcagcacggaaatgaacagcgcgttctgcttcaggctggcccaccgggaacagatcatgcccatggcggcaaagtcagctgcaaaggaaatgccctggaaaagtgggaaaagagtgattgaagaattgcggagaaattcagacaataattgggggagggggaaatttggtcggtaccgtatccttaatactgtgagtcggacatagctatcaattcgattaaatttcgagaaatttttagccgcccaaatgggatggctttccattcggttcccaaatttattctttttgcctgcacaaagcgaagtgccaaaaacaggttgaaactgaacgatgtcgcaattggaatcagcgcagtggcaatggcagatgccaatccggcaccgaacagcacgaaacgggcgccgaaacgggtgtacagccaggagaaggggaaagtgccgagcattgagccaaccgcaacggcccacctgaaaagtgccaaggcatgctcataagtgtgaaatcattcttctgctgcttacatcaattggtttttctgctgcggagtgtaagcgacggagtgttgctgaaaatggtcatttatttttaaaaataaaaatgcattttttgattatttccgccacttcggcaccgcttagatcggtgccattggtccgcaccgaacccatgcaaatcaatgtgaatttcagtgccaacatgtt

SEQ ID NO: 38256 - DNA, 818 bp, Heterodera glycines
aaatcaaaacaattattatgaaaataaaaagcaggaatttattaaacgaattgatgagattaaaagaatgtccaaaaaaagaaaacagaagcaatttgcggaagaattgggcattggtgaaaagacattctaccgatggaaaaaggaatttggcattgaaatggacaaaagtaaattattttatttttaattcttttttaattatattatttaggtggaaatgcgtattcgaatgtagaaaaaatgagtaaaatgaatatttattacaaaatgaagaaagacaattcctccttaagtgacacagaaattgcgcggtcattgaaaatctctttacccaccctaagcaaatggaaaaaacaaaaattatcgtaaattttcataatttctttttagtcttaatgacctaatattgtttcatatttgtaattattagagccccgatttttatgtgctaaaaatcctgaaatatgtatttttccgataaattttttgttatatattgaaagctccagcagagaacttcgaattccaatgaccaattaagaattcgattgtaaataaagaaattttgaaaatttgttagaaatgacaaaaaaaatagatttttagaggtgtatttttcaattttcttgtatttttattacaaatttttctcaagaatgccaaaatatgtgccaaaccccgaaatacgatttttgggcttctctcgtcataactaagccgcagaaaaaatactatctcttcattttaattatgtaaaaaaaaacatttacttctctccgtataacttttttttatgcatacaattttccccaatt

SEQ ID NO: 38257 - DNA, 720 bp, Heterodera glycines
tggggttccaactgttcgcggggtgccacgcatgcccattcgccaagccctcgggtttccaactgttcacgggtgcaacacatgcccattccaactgagcacgggtgccacacatgcccattccaactgctcacgggtgccacgcatgcccattccaactgctcacgggtgccacgcatgcccatttggcaagcatacccattccaactgctcacgggcgccatgcatgcccattcgccaagccctcgggttccaactgttcacgggtgccacgcatgcccattccaactgctcacgggtgccacgcatgcccattccaactgctcacgggtgccacgcatgcccattcgccaagccctcgggttccaactgagcacgggtgccacgcatgcccattccaactgagcacgggtgccacgcatgcccattcgccaagccctcgctttccgactgctcacgggtgccacgcatacccattccaactgctcacgggtgccacgcatgcccattcgccaagccctcgggttccaactgttcacgggtgccacgcatgcccattcgccaagcctccggttccaactgctcacgggtgccacgcatgcccattcgccaagccctcgggttccaactgttcacgggtgccacgcatgcccattcgccaagcctcggggtccaactgttcacgggtgccacgcatgcccattccccaagccctcgggt

SEQ ID NO: 38258 - DNA, 315 bp, Heterodera glycines
  misc_feature (4)..(4): n is a, c, g, or t
tcgnccactcttttctctccccccccccaccccttcgctttttagcattattcgcattagcgattcagccaaagtagagagaaaaactgaggggaggcaaaaaatgagtgaggagtgaatggatttgatgggagagaggggaaatcgacgggggaagtgaaatggacggagtgggtgagtgaatgaaccgaataaaatgaagtggcggcggcgggggcacaaaaaactgccccaatattcattcataaaagaacgaccaaaggggggggggcgaggaatggccaccgaatcagtcagaggggggggggggggggg

SEQ ID NO: 38259 - DNA, 1116 bp, Heterodera glycines
accaaaaatcattagggtgcataaatgtttgatttggaactcacttcagccgattcttagtgggctgaaattttgaatttgctctattgcctgggcgttgcaaaattatagcgcaccctctacaaccaagtcccatgggggtgttaaaattttgatcactcagatcaccctgaaggagtgatctgatcacctcgaaactaaaaaccattctgaaaagactgaagggaaattcgtctaaaatttcttcaaatttatgtaaatataaatgtgcagcctaattaatcattcattatcaacagcagagatggcaaaatgattgagtgaaaagaaaaggcacttccgctgggttttgacttcgtctttccttcctttcattggtaatttgatctgttccccctcattcgtagtcttcctcctcctcctctccgtcctccgcttcgtccgcgttcactttttccaaactccgtctcaattccttcagtctgatcaaaacactgagttggccgagccgcgggttgtcctcttgcaagtgattcagccaagaagaagcgaagtcgttggaattcaccccaaaaatggccatcgcgagaatggtttggtcggactgttggtgcaaattcgtgcggtaatcggaatggccttcccacagccttttgtgaagctcatcctcggtgaagattttgtgagaagaaacacactaaaaaagaaaataaaagttaaacgtccgaattccgccaataaaaataataataattcgctttgaccaattcggttatttcctcgtcccgctcaaccgatgcagcactgctcaaaacgacgtaattcaactgacaatgagaaaaaattattgatggaaaaaatattgaaaaaatcaggaaaataaataatgtataaaataagagagaaaatgaaaaatgagacttaatttaaaaatgcagagtgaggctgtttaatgcgaccaacatactaacagttgctaaaacagaaaccgagattttcaaatcatccgggccgggttgacatattcaaaagcagctggtttccgggtccggcctgctggtcaaacccaatttccaaattgccgtgaccggaaccagttcaaggttgataaaaatt

SEQ ID NO: 38260 - DNA, 1011 bp, Heterodera glycines
tttccgttttgtgttggatttcaacaacttcgtcgtgggactgttttttcggccaattcctccccagccttggaaaaaacaatggtcctcaattgatcattccttttcgggtgctttcactttgctgccgattccattttttttgggattttccctttaccgccatttttcaaatccaacattcaacggattccataatgccggcaattgggagttactactagccgtaaagctgagccggcggccatgagttttagccttcacattcgaaaatgcgtttgcaacaaccaaaagtgcagtaaaaagaccagcaaaaattgtcgaaacatcgcctaactcaatcggtttctgcgacgaattgcgtttcttttggccatcttttgtcgattttacgggcgaggagttatgggaatttttctcctcccgggaaattttcggtccaagtcattgagtcctcttttgaaaatttatactgggtttatttcgttcaaagccgcattctttccaactaaatttggcattacaatttcgcgctatatggccaattttacggcagttataacataagattttgttcgtccgtcggacataaaattttttccaatcggttgtcgcattttccgcgttaattggtttgtggctgcgtgccaaatatgcatttttgtcctcttcaattgactttgcagctttttgcgttgcttccgcacgcaccgccaacgcgaccaaactgtcatagctcagacccggacaacgagccatttccaacgcaatcgaaattttggcattttccaaagaccgaacgaaatgtttggccgcatagtcgctgtacaaatgcaatggcatgcaaggatatccacattgcacaagttggtaaagtcgttctgcaaattcttccaaattttcgtctggtcgccgttttggtccatcccacaattcgttgaatgcttgaattgcgggacaaaatcccattcgtccaaacgtgactccatttcgcttcgtattgcatcaaat

SEQ ID NO: 38261 - DNA, 758 bp, Heterodera glycines
atgaaaccgttgattgttttttaacaaaagtttgtcatcattttctatttttctgatttttttattttagaatttgttgtgttggtcagtgcatatttttggcgagaattttaaagaacgttgaaaagatgccggatgtatattaataaaatcataaaataaaaaatttttataaataaattgcatttttaaattttgtggcagttttacgaaacgcgctggcggttttacaaaacgcgctggcggttttacaaaacgcgcatgggtggcagttttttaaaaatacccatttggcagttttacgaaacgcaccagcacgctttataactagcgcaaaatttgcttaacaggcccaaataattgtcatattcgtgatcagcgacctttaaaacccccgggtaattggtttcaggactttttagacaaaaaaaatttgaccaaaaaaaagttgaaaaaattttcaaaacctgtcacttttcatatagcgacgaaatttcttactaaaactttaatttatggcctactgtcctgaaatctcagaaatttttcccagatgcgaacgttatccaaaaaattctgtctgctcactcaaaacttaaaatgctggaaatttttttgaaaatcttggtcttcttgcagaatgtaaattttgacatgggcacgtgaatttttaaaaaaaagaattggaacaaaaaataggaaatttttccaagagtgacatcttatgctacggtattttgtgacaaatctcggaaaaa

SEQ ID NO: 38262 - DNA, 778 bp, Heterodera glycines
agaaaaaaatgggtttaagtaaaattcgtaaattccgctcaaaaaacttctcaaccaattttagcgcatccaaattccttctacaatcgcctttatacatcccattatgagcgttaaaattatcagagtgcggaaaatcgcatgtgatctaagcctagaaaaaatggtgtaagtaaaaatcgtaattacgctcaaaaagctcctcaaacaattttagcgcttccaattccttctacaatcgcctttatacatcccattatgagcgctaaaattatcagagtgccgaaaatcgcatgtgatctaagcctagcaaaaaatggtgtaagtaaaaatcgtaattacgctcaaaaagctcctcaaacaattttagcgcttccaattccttctacaatcgcctttatacatcccattatgaacgctaaaattatcagagtgccgaaaatcgcatgtgatctacgcctagaaaaaaatggtgtaagtaaaaatcgtaactacgctcaaaaagcttctcaaccaattttagcgcatccaattccttctacaatcgcctttatacatcccattatgagcgctaaaattatcagagtgccgaaaatcgcatgtgatctaagcctagcaaaaaatggtgtaagtaaaaatcgtaattacgctcaaaaagctcctcaaacaattttagcgcttccaagaccaaccacaagcgccaggatacatcccacgaagagcgccacaagcatcagagaggcgaaaaacgcatgccaccaaagccgagaaaaaaacg

SEQ ID NO: 38263 - DNA, 689 bp, Heterodera glycines
gcatttgtatgggtataaaatttatcaaaaaaagagatagccatttttctgggatagcttataaatttaaaaattccctcagaaataaaaggtcgattgcgccccgccctccctatcatgctcgagagcttttgtatgggtataaaatttatcaaaaaagggattagccattttttgggatagacctttaaatataaaaatcctccaagaattaaagtggtgatgcgccccacccttcctttcaatctgcagagcatttgtaggggtataaaatttatcaaaaaaagagatagccatttttctgggatagagtataaatttaaaaattccctcaaaaataaaaggtctattgcgcaccgccctccctatcatgctcgagagcatttgtatgtgtataaaatttatcaaaaaaagagatagccatttttctgggataacctctaaatataaaaatcctctgtgaaataaaatggcgattgtgcacagccctccgtctcatacgcaagcgcttttgtgaggtataaaatttctcaaaaaaagagatagacatttttctgggatagagtataaatttaaaaattccctcaaaaataaaaggtctattgcgcaccgccctccctatcatgctcgagagcatttgtatgtgtataaaatttatcaaaaaaagagatagccatttttctgggata

SEQ ID NO: 38264 - DNA, 1704 bp, Heterodera glycines
  misc_feature (20)..(20): n is a, c, g, or t
  misc_feature (52)..(52): n is a, c, g, or t
  misc_feature (57)..(57): n is a, c, g, or t
aaaaccaaattgccgattcncatcgtaaagggaaaacggacaaattaacatntaatntaattaaaattttatttaattttaagcgaattggaaatgctgcgcgcccgttggaagcagctgacggacgaggagaagcggcttctcggagacaacgcgcgactttgggacgacctgacgaaagctagaaatgtgagaaacaaagcatttttgagtgatttgcctctcattttatgtataaaaatttcaatttaaaaatattagcaaaatttttttctaattttaggatttggacgaggaaacgttgggtcgaattgacttccaaaaccaagtgcaaactctgatggaggaactcgaagtctgacaatcagcgaccaattagctaattgatcaatcaattaattgtttttttttagtttttgcgtcgtgtccatgagcaggaagtgaaggagttgcaggcactgctcgcccaggcgccggccgacacgcgcgaattcttcaaaaacgaactcgcattggtgggaaatcagcgaacattaattgaatttaattatgccaaataaaattggcactttttaaaatctcaaaattttaggcgattcgcgacattaaagacgaatacgattatatagcgaagcaaggacgccaggacatggagagttggtacaagctgaaggtggattaaacttgaaaaaaattgaaaattcaaatttggtgatggcttaggtttccgaggtccaaggcaatgcgaatcgggcgcaaatggagtcgaattatcaacgagaggaggtgggtgaaagaacactcggcttaattggacactaattatttgcctaattgactcattaggttcacactaacaaacataattaatgcttgttaggttaaacggatgcgcgacaacattgggcgatttgcgtggcaaattgcaagacttggagggtcgcaattcgcatttggagaaagaggtgcaaaacctgaactatcagctgaacgacgaccagagacagtctgtgacttttttgaatttaacaattttaaattgaatttgcattttaaaattatttttagatttgccatttctttgtcccttttctttgcttaacttctcaattttccagatatgagcaggcgctgaatgagcgcgacgcgacgctgcgcagaatgaaagacgagtgccaaagtttggttgccgaattgcaggtgccaaaatgggcaaaaagcatttatctacagtaatccaatgtgttcccctctttttcaggcccttttggacaccaaacaaatgttggacgccgaaattgcgatttaccgaaaaatgttggaaggggaagaaagtcgggtcggacttcgacaaatggtggaacaggcgagaaaaacagcggaaaatccacggaaaaccaacgccccccccccatttttacgcttttaggtggtgaaaacgcattcactccaacagcaggaggagacggactcaacgcgaaatgttcgcggcgaagtgcagacgaaaacgactttccaagtatttgaattgttggcgaaatgttttgaagccaattcaaaacgccgacgaattcattccctattaagcgctcagccaaagggaacatcacaatcgccgagtgtgaacccagcggaaaattcgtcactttggagaacacacatcgaagcaaagtgagcgaaaaaattcgacggggggagtgccgg

SEQ ID NO: 38265 - DNA, 1250 bp, Heterodera glycines
tcagaacccaactgatttcagctaagtttgacctggaccagtttcttgacaacaattttgtatgtcaaaagcacataaatgaattgctgatcaaatgggccgactcgcaaacccacttccggacattaaccgaagcgaccggaacctattattactgtgcctttccaattactgtcaaagggatggacgatgcgccaattgacccgcaccgaagggttatcagacgaaacgctgcacaccttctgcataagaaggaggcaaaatatgttttggaaaaacatggactgctaatgcaccttggcacacgtaagacaaccagatttattattgttaggaagaagctggttgggcggttaaaacgcggaaagcggggattgataagatccataaaagaaagggtggatgtgcctcggtagatcaatggtagagatgcccacgcaaatggtgcacgagtgggttcgattcccacccgaggcctaacatttacttatttcttattcaaataagatttatttatttttcaaattttgtttagctgtctgtgaatggcatcttgatttgatcaagaaagggatggctgaacaagctgaaagcagcagaaaaggtgaaagccattcaattaatgaagggatggccgaacaagctgaaagcagcagaaaagatgaaagccattcaattgacaatttattcaaactagaataaaaaacgctgaaacaaaacgaacaaagtttaaaaaaaacatgatgttgtagaattgaaaaagagctttcgaattttgcatttttagtccatatttcggccatttttggcaaattttctcaagaacaatgcaaaaaaagcgaaaaatacacccctaaaattcgattttttggaaatttttaaaaattacatccccaaaaataaaaaatttgggtttgcatcgtcattttggcatttttaataaatattttcaccattttttttgcgaacttttctttttttaaatgcgaattttttttgaaattggcaaacttggaggtgttcttttatacaacggacgacaataaaaaatttgcatttttaattttttaaatccatttttttggttgtttattgtatttttatagtttatttaagcaaatattgaatatataaacctttttaggaatttttgagtgtttaaaacatatattttgccagtttttagtccatattttggtccatatttgggcattttttagctttttagtccatatttcgggcttttttag

SEQ ID NO: 38266 - DNA, 816 bp, Heterodera glycines
aatttctaaaaagtacgctacagtatttctagaaaagactgtaaatggttcaattaaataataatttagaggtaataaatcagaaaagtgattatttataagctaaaatcgtaaaagtggcatttttggacaaaactcaataacaaggtgccgcaatttaatttttttcattttttcaagaatagcttttatttttcccaaaattatcctcaaatgtcccaatgcgctaaaaagtgcgatttaaataatccataatttaatattttttaaaataaattatataattaagcgtagaaaaattgctatgagttttgttttttagggtaaaaaataagaacattttgcgaaattgcttcaaatcagttattttaaaaattattcatcaaaaatgttatttaattattatatttttcgtctcccattatcgcttttaacaattttggggaggagataaacaaaccataaatatcagacattctggatccattaaatcagatttttaacattatttgcggcacagttttccaaaaaactcgggtgaatgtgcgtggaaaatttttaaaatttttaatggattttgttagaaattagccaaattcagaaatttcctcttttagatgaaaataagacactacccccaaatcataacatttcttagaaaaaagaacataaagaaaccctgaaataaactgactattaccagaattttggtgaataagaattattaacatcataaaataaatgggaatacgtgttaccatggtggtagtttagcaccgtcttaaaaacagtaaaaaaagaacggtaaaccgagaa

SEQ ID NO: 38267 - DNA, 1264 bp, Heterodera glycines
  misc_feature (1173)..(1173): n is a, c, g, or t
cggaggggggagggcaacggcggggggtcagcagaccaaacatttagttggaccaaccaacagccccggagggggggggggaagaggacgagcatttaagcggatgtggaaaagccttaaacaaaggcagcaccagcattatagcaaagacagataaacagaaaagcgatgagacaaacaaaaaaaaggcaaaaaaaaaaaaaaattcggctatttcgtcagatgaattggccaaatgtgtggcggagagaagagacgacagagaaaaaggggggaacggatgagcaaaagagtacgggggaaatggagagaaaagaggatgtcagagaagtacggggaaggaaaagaacggcgggggttagacagcacacgcgaaaaacgtcgtccggaaatccccttgggggctgactggttggcgagaagaaattggcggcgactgggcgactggctgatgattgctgctggcgctaaggccggctggcacaagaagaggacagcagacaattcggcagggcagcaaaacgggacatggataattgtgatgtaagaagaagaagccgtagcagcaacagaaaactgtgtaaaaaatgaaaaattgcggcgaaatgtttttaaaaaataatagaaaatgaaaatgtgaaatgtgaaattggaaattggaaattatgtaaaattcttcgtaatattaaaaatgaaatttttgtatggtaaaataaaattgaatattaaatatgtttttaatagatttaagtctttaagtcattttttggcgctttactaacttaaaatcagtgcctgtcaaagtcttgaccgcattctggaccaggattttcaaattaataaaaatttattataaaaatgctaattgcatgcaaaaacttaagcaattttaaatttgccatttattttactttcgtttttttcgttttcaagctgtgacagacacttttttcgataaaaatattcaaatctatttatgtagatggtatctagaatcagaactgttcatgttaccagcttccccttttcggtaaatttttcaaacaaatccaaccggattaattgtttatatatattttttcattttacttaattttaatcgaacaatgtgcataacagtgatgtgtgtcggaatgccgacttccggtttccgaaattttttgagtgcgtcgncacacaaaagcggagataacctatataaaatttcctcttaaacctcagaaagtgcagctatgtagttcttttgtttgcattttttcatggt

SEQ ID NO: 38268 - DNA, 932 bp, Heterodera glycines
ttattaaaaattagagatcggagaaaaggattggccagttttttgagtaaaaagtctaaaaacccgaattctaaaaccttcgaaaaacataaacaaaagtctctatacctatgaaatactgtttattatgacaaatttcggactggccatttttgtggtgtcaatgcttactatgccattttctgacgaaggtgaggatgatgtcggtgccatttgctgtttaagtcgttgtacatatgccaatatttgttcgccattgaaatttttgacgcgaattcttagcggattcattccaaccgttatgcatttgttcaatcggcatcgcttacataatgtataatctatatatatttatagaaatatagaattttatttctatttttatactttttttagattataagtcaaaaataaattaaatgtttactcaaaatgtttattttcacaaaagaattctcatggtaattaggtgctatttacaaaactgaatgaataattttgatgaatccactctcaatttttaaatttttatcttatatttaaattttatagtatattaataaattttgttgttgttttaataataatttcctaaacaaaaatacaataaaaaagaaaaaacgatccgtatgcataaagatcacgatccgcggttcaggatccctatctacctccggagtaggattgatgagggatcatgagaggaaattaaaaaaataatctttagaaaaattaataaacgaaaaagattttatcattttttgacatgaatagaataaataaataaaatacccgccaaaaaatacaatacacgggtcgtgtccatataaatccatattttaggggttttcgtgaataaatccatatttctacatttttgcattttagtccaccattttggcaaattttcacatgaaaaatgcaacaaaaaa

SEQ ID NO: 38269 - DNA, 802 bp, Heterodera glycines
  misc_feature (765)..(765): n is a, c, g, or t
gcttccaccagtgcagatcttggtggtagtagcactattcaagtgagatccttgaagactgaagtggagaagggttccacgtgaacagcagttgaatgtgggtcagccgatcctaaggcaccggctaacgccgtaacacactacggatgacgacttttctgtgcttgcgcagttggtccatccggttgccgaaagggaagtgggttaacattcccacgccaggctagggaaatgacggttcgcaagagctgttttgcgcggtaacgcaaatgaactcgcagacgtcgtgtggagtccgagccagagttctcttttctggtttagggtgtgcgtgcctggaagtggctcagcctgagatagggatgttgcgcccgtaaagcaccacggttcctgtggtgtctcgtgcgctccacacggcccttgaaaatgcgagggaagctatttgaatctcctgcctgatcgtaccgatatccgcagcaggtctccaaggtgaacagcctctagtcgatagaataatgtaggtaagggaagtcggcaaattagattcgtaacttcgggaaaagaattggctctaaaggtcgggtcagccgggctgttgcgtgaaacaggcggcttttgcccgtggctgtgtgctgttctttcggggatggtgcgtggactagtggtgagagctgcttgtggagcgcttcagctgcgtgtatgctcgtcagggtatgcacttcggttggcgctgaacgaccagtttagaactggcacgaactcggngaatccgactgtctaattaaaacagaggagacggatg

SEQ ID NO: 38270 - DNA, 889 bp, Heterodera glycines
  misc_feature (342)..(342): n is a, c, g, or t
  misc_feature (404)..(404): n is a, c, g, or t
ccggaccccctttttttcctcactaaaagctttttggaaaagcgcgccgaaaaaaaagttatgtgaaaagcaaatctgaatttctaataatattcgatcatttagtccagaaatgattaatgtttgaaaatgagtgaagaagatttgatttgaaaattttcattgctttaatctagctttaacttttggagtttattcaataaacaataaaaaacaaagtaaaaatttaattttgtattattttcaattgaaataaattaaaattaattttttttttgaattttttaaatttcccggttgatcccggttcccggtcccggtcccgaagaaaaatcgatgtcncggtcccggcttctcaggtcccggcaagtccgggtcccgtttttgcccaaaattcccggtcncgcttcactctagaaaaaactattcaaaagtgttacaccgccagatttttattttatttttttatttttcagtcccgtcatttgagtcctaatggtataagaaatttcagttcagtctcgaagattgacttattttttggaagtttcataccaaaaagtcgaattttgccttaaaagtgtaaaaagtcatgaaaaaagtcacaaaaaaacaaagtcataaaaatcccaaaaagttgaaaaaagtaaaaaaaaaagtcacaaaaaatgtatgctagaagcttcaaacaaagtttagaacactttttaagtcattctaaggtcatttagagtcagcaaaaaaaaaagtcatttgacttaaattcccatccctaatacataatatcccaaaaagctgccttttttgttgaaaatctgttaacaaattacactcaaattttcaaaattttccccgacagcgcctatcggcaccgccagacccctttctt

SEQ ID NO: 38271 - DNA, 1120 bp, Heterodera glycines
  misc_feature (27)..(27): n is a, c, g, or t
atttgagtcgttttagtgcctattttntgggggtttttcgatcctaaaaaacgttccctcttattcataactttgcgcaaaagtattaaaattttaattcttggtattaaattcatagctctaagcatttgctagaatattgttggccaccataacattttgaaacgacgaattttgtgaaattttatgctttaataaacaacacagagagaaatcaaattatgccaattaagaaatctgggttcatttgatttccaaaaaaatacctcaattacaaatttttttacgaatgacccaacaccttttgaaatgcgaaattgaaagcgaaacccatcccctgctaatccctatcgaacagtatgccaaaaaatcctttttttcctggggtccggacaatccgtcagtgaaggacaatccgtcagtaatggacagtccgtcagtggataatccgtcagtggacaattcgtcagcaaatttttttgagcaatgataaaaaatcttgctaaaatggttgttaaatttaataaatacaatttcttttatattcttaacatttctaattatttttaattcaattaattgaccatctcgagaaattatcatttaattcttttaaaaatgattaattcataatttttataataacccaaattattaattcatatttttagcgacttaaattaatttttacatgattacaaataaatctgggtgttttaaaaaaaaatttgattatggattaattactgacgattgacgactgacggactgtccactgacggattgtccgggagccattataacattatgtcaaaaacagatacttcaaaggaaaatgaaaaaaataacgaatttttgactggataataataaaccggtaaaaaacggtcagccgggccgggccggtttggcattttcaaaaacgccggttcgggcacggtctctccaaaataggtttcaaatcgggttttttcacaaatcgccgggccggtttgccgggcccggtaaattcagttccgggcccggcccggtccggatgtttattttttgatttttatagtgtttcatggacggtaaaaaagaaaagaaagcgacaataaatctttttatggataattat

SEQ ID NO: 38272 - DNA, 273 bp, Heterodera glycines
cggtgtcatctatgttactagatcggggatcgatccccgggcggccgctcgagtaggacctgcagaagctagcttgatggggatcagattgtcgtttcctcgccctatccatcggcacagagaggagcacgaaggggaggggagcggcgcgtagcgggggaggtgggtggcggaagaagaaaagggtggggggagtatgagtatgatggtcaatatggagaaaaagaaagagtaattaccaattttttttcaattcaaaaatgtagatgtccg

SEQ ID NO: 38273 - DNA, 882 bp, Heterodera glycines
agaatatttataatttacatactgcataataatcgttagccgtcttggcgtgcgttgatttctacggagttttttctcgataaaaaataattttgtattattatttaattatttctacgggcactttaaaataaattaataataaaacttccatttcttagtcataaaatggcaccccttttcccgacagagtttttcgacttttttgcaatcctttctctaaaaactcatttataataatataacggttttttctatgctgcctttctataattattacattatttagagataaatataataaatttttgttagaaactagttcttaatttctgtatcttaaccagaaaaaaatgttttagtgattattttgtattatttaattgggaataataaaataataataatagaatatttataatttacatactgcataataatcgttaggcgaacttggcgtgcgttgatttctacggagttttttctcgataaaaaataattttgtattattatttaattatttctacgggcactttaaaataaattaataataaaacttccatttcttagtcataaaatggcaccccttttcccgacagagtttttcgacttttttgcaatcctttctctaaaaactcatttataataatataacggttttttctatggctgcctttctataattattacattatttagagataaatataataaatttttgttagaaactagctcttaatttctgtatcttaaccagaaaaaaatgttttagtgattattttgtattatttaattgggaataataaaataataataatagaatatttataatttacttactgcataataatcgttaggcgaacttggcgtgcgttgatttct

SEQ ID NO: 38274 - DNA, 879 bp, Heterodera glycines
gcagtaactcggctcagagtgaagattaaggggacgcaaaagagatgatttaaaagcgattcgaaaattctatcgaccgatataataacgatgcagtcgcggcgttgacaaccgagatggaaccaaaagttccataatatctttccataaggctggaaaggcagaatttgtatggccagtcgatatttacactgagcacccgttgaagcgggtgatgcgaagccatagcaaactgtatttttaaattctggccgcaattctaccaaaaaacgtgtttagaccgcagtaactcggctcagagtgaagattaagggacgcaaaagagacgatttaaaagcgattcgaaaattctatcgactgatataataacgatgcagtcgcggcgttgacaactgagatggaaccaaaagttccataatatctttccataaggctggaaaggcagaatttgaatggccagtcgatatttacactgagcacccgttgaagcgggtgatgcgaagccatagcaaactgtatttttaaattctggccgcaattctacgaaaaacgtgtttagaccgcagtaactcggctcagagtgaagattaagggacgcaaaagagacgatttaaaagcgattcgaaaattctatcgactgatataataacgatgcagtcgcggcgttgacaactgagatggaaccaaaagttccataatatctttccgataaggctggaaaggcagaatttgaatggccgagtcgatatttacactgagcacccgttgaagcgggtgatgcgaagccgatagcaaactgtatttttaaattctggccgcgattctaccgaaaacgtgtttagaccgcagtactcggctcagagtgaagattaagggacg

SEQ ID NO: 38275 - DNA, 887 bp, Heterodera glycines
tttatgatttgttaatttcctcaccaaaatttttaaagatgataatcgaaggcaaaaatataatatttaataatttttgattaaaaaattgtaaaaataaaagatttgaagcaattttgcgaaattttcttatttttgaccctaaaaatcttattttttggccttgatgttcttattttgaaaaattttcgatcgaagccctgcttcatagtaattttcaagctaaatttgtctattattgtgttttttgaatcgacaagctttttttaatagcccaactatttttatattataaaaatgttaaattatttatttattttttgcctcatctttgcaataagaaaaatttttcgtatttttttttcaatttaatatcgtattttatgatttttaacgtaatttttccaaattaaaacttttaatatttctctatttttcgtttcttacgttttctcatttaaatttacagtgtttaaataaaaatttctgaataatatttaaagttttaattttgataatttttttatttgttatctcgtgcatgggttactatttgattatatttttccaatgcaaaaattttttaatttttattaaaacaataaattttaacattattattatatgtgtcatttaatgaagtaaagtgctagtattggttattttaatgtattccattaaatccacatctcgtccatcccaattagaatcataaacatttttcgaaaaacgtctggcagtgaatttgatacacgttttattatatgagaaatttcggttatataaattgctgaaactgtttaaaaataaatattattatttaggttaattattagatcttcatattttatttattatacattaattgcctttcatattaaattgtt

SEQ ID NO: 38276 - DNA, 1095 bp, Heterodera glycines
  misc_feature (97)..(97): n is a, c, g, or t
gaaattcgcctatttatatttactaataattgccaacattatggcatcgggaaatggcacaaaaaatgacaaaataattgctaaaaaacggaaatgnatagcaatagattgaatcaatatgtattattattttttgactatttcatataatattataatatattaaaattggacaaatgaaaaaagtggagtgagggtgctcttgggatttgtgctattttcctcttctatttgtgcccgtaaaaaaaagtcggtcaccaatacttgattaattgcttttcatttaaattaattttttacatttcgccacatttcctttccatttagtttatttgttttttgtttctttcatttgttcttctttttttgttcagcttgtttcggaattttcatttcatttaaaaaaacaaaaattattaataacttttttttaatgttcatattcttccgttcattgtttgctcggctgctttgataaatgtacaacactaattgcccatttgatgttctgctgattttgctgctgttgttcgtccgcaaatggccgacgacaaagcaattgacgcctgctgatgtatactgcttaaatgggcatttgcaaattagcatgcttaatctattagaatacggtatgtaaaagatttggtagtaattttcaaaatgtgaaaagaatttattgaaattttttaaatgcatatttttaaaaatttttgcttttgtaatcgacaaagctaaccagttactagatggttccattactctttcatctctatacccaagtcagacgacctatttgcactgcccaatcgcttcaatacttccaccatagtttcctctggcttcttcctattcatgaacagttcaccatctttcatgactcaccgcatacgctctgtctccgccccatcgcatgcgatcgagacgggactatgttgcgccccaacaccgcagtgccagagatcacacatcagctccgcaagaagccttcactttcattgcgcctttgggttttgaacacccaatgacttgcgcatacgctaaactccttggtccgtgtttccaagacgacgcgaacagatgacccggtttttacac

SEQ ID NO: 38277 - DNA, 1568 bp, Heterodera glycines
ctcgccaatccgccgaacactttcacaccaaacagcatggcctcctctttgccttccgatggcagcccttcaagtgaagacgggtgagtttgtggccggaggttttcctttttttgcgaaatgagtccgagtgacgagttatatgacatgtcaaacttttcaatgagtaaacatggtaggggcgtggaatgtgcatgtgcctttttcatttaaccatgccaattctgtatttttcttcaattttagtttcccaaatgaaaacggttttgaggactgtgtgctcaaatcgccgatcactcgatgcatagttcagatggaagtgcgtcattctcctattatcccttcttttttgattgcttttcttccgtaggtggtcgactccgtctccaacatgttattcgggcgaaacgccttcaaagtggagggaccgacaaaaagaccatcttcgagtgccgtgggtgaaatgttcgccggcgcatcggccggtgctgcaaacacttcggaagattcgctttccatcggagaattgccggtactgtgggcaaaaaaactgtcaaaagacgaccaaaaatgactgttcattgtcagtcagttcgtcaccaccgactcattgaccttgacaggccatttggttgatccgttatttttattccgcaataaaaaagagagttgcgacgtcatcaaaaatgggggaaggccgttggaaattaaactttaatctttcgcactgttcttcaaattggattttttcgtgggacgtccccaaattgagggggagaagcaatttcggtacagatttgaattccaaaaaaaactttagtccgttgaactgtttgccattgttgtttttgtagaccaattaattattccccattttgcatattcagtgcatgttccaacacatttccacgccgaaccttctgaggattgtcgactgtttgctgaagagtcacacgatggctcgtcagctttccacaaatgcgtcggcacagcgcaatttgctgtggaaggccaccttcaaagggcgctccaaaccgaacctccccaaattggagggtaaaatcggcaaaaaaacaaatcatttattttcattgtcctttcttcagcccattcaatgcattgtgcattgaacattctcctccaattgttcgcttcacataacactccgacggaattcgttcctgcgatccgtgaacaattgcatcggttcgccaccatttcttctattttaagtattttaaatttggacaaattcagcactgtcaaatacgccctggagcactatttgagtacgcactcggacactttccgcagctattggcttaccggtcagcattttcatttcattgcgttttttcacttaatttcaattcgtttgttcatttagtgatccaaatggtactcaatcggctcagtgatttgccgtccgatcgcttttccgaattgagtgtcgaatttcggctgtcactcacatcgctcatcgaatcggatgagcaggtcgtccgtccactgttattttcccaaaaatgggtttgaaactctccatttagcccatcattcgaactgcg

SEQ ID NO: 38278 - DNA, 947 bp, Heterodera glycines
attctgcctttcctgccttatggaaagatattatggaacttttggttccatctcatgtggcaacgccgcgactgcatcgctattatatcagacaatagaattttctaatcacttttaaatcgtctcttttgcgtcccttaatcttccctctgagccgagttactgcgggctaaacacgtcccttggtagaattgcggccagaatttaaaaatacagtgtactatggcttcgcatcacccgcttcaacgggtgctcagtgtaaatatcgactggccattccaattctgcctttccagccttatggaaagagattatggaacttttggactccatctcatacgtctacgccgcgactgcatcgatattatatcagtcgatagaattttcgaatcgcttttaaatcgcctcttttgcgtcccttaatcttcactctgagccgagttactgcgggctaaacacgattttgggaaaattgctgccagaatttagaaatacagattgctatggattcgcagtcaccctcttcaacgggtgttcagtgtaaatatagactggccattcaaattctgcctttccagccttatggaaagatattatggaacttttggttccatctcagttgtcaacgccgcgactgcatcgttattatatcagtcgatagaattttcgaatcgcttttaaatcgtctcttttgcgtcccttaatcttcactctgagccgagttactgcggtctaaacacgtttttggtagaattgcggccagaatttaaaaatacagtttgctatggcttcgcatcacccgcttcaacgggagcttagtgtaaatatcgactggccattcaaattctgcctttccagccttatggaaagatattatggaacttttggttccatctcagttgtcaacgccgcgactgcatcgttattatatcagtcgatagaatttt

SEQ ID NO: 38279 - DNA, 1323 bp, Heterodera glycines
  misc_feature (150)..(150): n is a, c, g, or t
  misc_feature (1312)..(1312): n is a, c, g, or t
gaaagcgatggctacggtaaccaaaatgagcaatgttcgtcagtgatggcgcgcttttattgcttcaacaatggcaaatgtgtgcatcggggagagacaccgatatgcgagtaaagggaatttattcatttaaaattgacaaaaatattnattatttttatatttctaaattttgcgctattttttgaaggtgtacaaatgaattcgtcggtaatcgctgccaatatacgtacgattcgaccattttcttctaaaaaaaaccctcaacaaaaatggccgtccaattcaatatgttaattgataggcctttctttccaaatgtttattattattgttgtacaaaagtgagcgtaaatgttgaaatatataaagaaatttaaataatttacgccaattaatttacatttgaataattgtataataaatgttatttaatttattgaaattactttcctgaataaaattattattgagtgaaatatttaatgttttatcaaagtttaaagccaactgtaagtttaaaatttgacacatcattagtaatttagttaatctctttattcgagggaatatgctcaactctgaagtgtaccaaatatatttcataattaaagtctcgatttctttgtcaaccaaataaaacgaagatattaattattcaattagagactcccacatggaatagagcccccccccctccccttcgacccctcacccaaattttaattcagtaaatacagtatgcatatgcgttattgaaattgtaatctcaaaaattttttttaatataaaatttataacacaatgccaaaagtaaaatattttggggtattaaaaagtggtaaaatcaaaatgaaggtgacattgaaatttccttgctttacgtgcataacagcgcttaatcagagttgttctttcagccttagtgctttccctgttaattttgtgttcagactaccgcctgtggcgctcgtcagactttttcctccgccctccgtctcaccccacttcttgctccgtcttcgcatgtcccttttgcgaaattttgcttttaaattgttatttcccgtttattatttttcggcacggaagtgtccattttcactgggactcagttgtcccaatgctcagatggcgtcggttcgacttgattctttgatttttagacttagctcgtcaagagctgttgaatgataccaaatttgtccgaatttgaccgttttaaaaggtcaggcaggagccctccttttcactcaaattttcgagttttaaaccggtaaaagaacgcggtttaaatactttttcgcgccanaattttaagct

SEQ ID NO: 38280 - DNA, 775 bp, Heterodera glycines
  misc_feature (52)..(52): n is a, c, g, or t
gtcaaggtgctttctgaaatttccagtttaggttgactttgtgcgtgttttntaaattcacaaattaggttggtcccagcagtgtttggtccaacgctcgtcgtgacttttcttttccttctgatcccgtccatgcgttcgattggacttttactagcgattatcatggcactgtcggcgaaggcgttcgagtggaaaaagccagtgaaaacgaacgaattgactacgaaagactgaaacggagagacccaattcatttttatgaacaaataaccctttacgaagatgaacttgcagacaacggctgtgcccaggtaatcaagcggaggaaatgactacctgagaaggagaatgaggttcattctgtagagctcgaccttttgaaaaaagccgggacccgtatttcctgaatggcaatgtgcctgtactttctgtataaaagtacagaaaatacaggttgccaaaatttgactctatccaagaaaagaacaagcctggaactagctctgtcaatctgtatactttgctaatttactcttcacagatgacagttcgaatacgcataatgcacgacactttcttctttttgtcacgtttttaccttcggattgataatgttatggtccgggtatgtcttcgttaacgctatgaccagccagcaaacctttcgttttctttttgaggtgtgtgacactcgcatttacgggacagccgaaaacaaaaaatttgtattgagagaagcgtctggacgagaagcgtcattacgcgactctga

SEQ ID NO: 38281 - DNA, 922 bp, Heterodera glycines
tttttccgaatttctttctgggcgagtttgatgtcgaaaatttggaaaaaacgcctatctctttttctgatcatcagtctgaagaattccaaccacattttcggaatgatagcgccgaccttaattttttccgaatttctttttgggcgagtttgatgtcgaaaattttggaaaaacgcctatctctttttctgatcatcagtctgaagaattccaaccacattttccgaatgatagcgccgaccctaattttttccgaatttctttctgggcgagtttgatgtcgaaaattttggaaaaacgcctatctctttttctgatcatcagtctgaagaattccaaccacattttcggaatgatagcgccgaccctaattttttccgaatttctttctgggcgagtttgatgtcgaaaattttggaaaaacgcctatctctttttctgatcatcagtctgaagaattccaaccacattttcggaatgatagcgccgaccctaattttttccgaatttctttctgggcgagtttgatgtcgaaaattttggaaaaacgcctatctctttttctgatcatcagtctgaagaattccaaccacattttcggaatgatagcgccgaccctaattttttccgaatttttttctgggcgagtttgatgtcgaaaattttggaaaaacgcctatctctttttctgatcatcagtctgaagaattccaaccacattttcggaatgatagcgccgaccctagttttttccgaatttctttctgggcgagtttgatgtcgaaaattttggaaaaacgcctatctctttttctgatcatcagtctgaagaattccaaccacattttccgaatgatagcgccgaccctaattttttccgaatttctttctgggcgagtttgatgttgaaaattttgga

SEQ ID NO: 38282 - DNA, 1403 bp, Heterodera glycines
  misc_feature (27)..(27): n is a, c, g, or t
  misc_feature (68)..(68): n is a, c, g, or t
  misc_feature (106)..(106): n is a, c, g, or t
tgtgtgtgtgtgttcgcccatttgacnccgacccgccgatccgagcccggctgacccctgacgggacncagaggcactaccttgtgcaaattttgtggaggctccncacaatatatttattttattatttttattacttaataagtgaaatgaacgaattatttttttatatacttcttatattttttttaatattatattttttaaataaacgttattaacctttcctcttgatttatttttggcttaacatttgtaattaattaaatttctaaaaataacatttattaaatgacgatttgagtttaaatttaatatatatcgtttaatcattttgttattttatttgatatatttaataatcgtcgaaagtaaactttatctattattttaaatgccaaactataatgcaattatttttatttatcattcaaattcgtttaacgtttaaaattcaaaatattgatattctgtttatattattacttaagttccatattcatttaaatttcttgctctaattgcattcttttgccttattagcgaggaaatatctcgcatttgaaattatttttatgataaaaattatctgttgttttaaacttactttttcttttaatttctttcatatttttttaattcgtctttttttttgcttttctttttctcatgttttgtttcctcatttattgttcccgtgggaggtttttttttacacttattttgtcaatttctgttaaacatttattttttctttaatcgtctaatttttatcatttttccgctgaatattaatttatttattaattatttttacattaaattcaataatttctctatttttttaaattaatttaaggtataatttgtaattaaaatcaagtcaggatgatagtgatttctgtcgtttgaatgtgtggtacccattaatattaacttaatactattgtataaattaatctagattattgaatttattctaattttaaaatgaaaatttttaacattaataatttttttgattattttgccatatactgtaaaaatcgttatttgcttattttaatataacaattaagaataattattaatgaaattattctaaaatttaaaatctgtgggctttctttttaatcatccatatatatttgaataattataatattgttttgaattttattgcatagattttagcgtaaatctatttataaattaaaatcgttcatgttgttaattgcagatgccaacatttattttttggcatttctaataaaaattgttagttattcattttacatgaaaaaataattattaatatatttacttatttttaatttaattgattttattttaaagatggcacttttaaataattttgttattttttatttcatttatttaat

SEQ ID NO: 38283 - DNA, 1077 bp, Heterodera glycines
atcgatttaacaattagacaagttataaatgttttttctttttttgataatttttctttaaaatggtttttatttttgattttttgtcactattttcataactttttcattttagtatcattattagttaaccatttatgggtagcactttagcatttgtttgccccctaacttttataaaatatgtatcataccaaaagagtttcttgtcaagacctatcaacttgcaaatttcttttgggtataaaaaagcgattttttcggattttttgcggcctaattgagcttttcaagctcattcaaatgatatcaattttttaaagtttgttggcaagtaattttaacgtttggccccgaaataaccccggcatatcatgggaatgtaattttttttattatgttagtaattttattcaggactcccatcggcaaagttgggtttcaatgtatgggcgagccgattctcaagtacacaatggggaaaatatcgaaatccaagtacatttcatatcaatatggattaaaaaaggatgcgttggttttattttatacgcaaattccaattttgaattaggaataagatcggatttttcaatacttacaacttattttaagaacgctggcgagcaaataaaatagagaaatttcgtactattgtagaataaaaaaaaaacaaaaattttaaatttctttaaatttacaacccaaaatgggaaaattattcaaacaattttttaatttaaaattctaaaaatattttaagataatgcgagtcatttctcaaaatcacaaaatgatcagaaggaaattctggaaaacagtagtgagttggagaagcagaaaaaggtaaacgaagggggaagatttatattaatttttgtggaattttaaatatatttatttatttatgcctcctataaatttaaaataaattttttaaattaaattaagatgaatattttcaggtgcttttaaacttccgacaaaattattgggatgctgaagcatgtcacgaggacctcgaaatttctggtgacaattctttgactgtttaccgaaagagaactaatttgggta

SEQ ID NO: 38284 - DNA, 954 bp, Heterodera glycines
catttttacagtggacggaaagacaacgactggattgtaaaacccatttttttattggtttcttatcacttttcacgtgtcacgtgcaccgatcacccagcagcccagccaggaaaacaacaaatattcattcaaccaccaccaccccagcaagcagcacagcaatgagaaaagaatttggggatcaagaaaaaaaaaccagtcgattcggtggtagcccataatgaaagcaaaattactgatccaattctgctctgttttgctttgctgctgctgtgtgtgtgtgtgtgtgtgtttatgtgtgaaagtgatatctcttctgcccactgattgtgatcggtcggtcggttggtgccggggggggggggagaatgatcggtgataggaatcggttttgtgaatcgccgccggggggggggggggaatatttcgccaataaatttcctctctcttctgtttgcggttggaaagaaaaatcgatttgagttgagcgaggggggactaaagagacaatcccaacacagcacgacagagatggtcatcaacaggcctctacaaaaggtgctatgacgttagtcaaaaaccatcataattggcgttagtcaaaaaaccatcaaatgaaaatattttttgatataactttgctcaaaagcatctaaatttttaattattgatatcattaaatagcactaagtgttttctattagcctacaaaatttcaaaaagtttcgttaagtttcaagaaagttatgactgaaaatgttcaaaaaaacatggttttttgagcttctcaggtcataactttttttagacttaaagaatttaaaaaaatgtttgcaagatagtagaaaacacttaagggtatcgaaaaatatctagattataaaattttgatccattttatgcgaaattatgaataattttctgtcaaaattttcccttttgatggttttt

SEQ ID NO: 38285 - DNA, 1084 bp, Heterodera glycines
ttgagagaaaaattggaaaattattaggaacaaatcgaaaattaatacaaaaatggaaaaatgaattaaatttgaataaaaacaaaataaaaaacggttttatgaagagaaaaagcgcaaattcattgaacgatttgatgaatttaaagaattatatggacaaggcaaacagaaagaatttgtgaaaaaattgggcatttctaaagataaatttcgaaaatggaaaaataattgctgtcaaaatattataaaagtaagagatttattattttttagaccaggctacccaaaaccattttgagcaaacctccaagtgagcttttgagagccggtaagagaaacattatcattaattgtgtgggagaaagcatcccaaaaagagggccaattagactcatttccatcaaagtccggtaattggagtgatggcaaattaatttggggtcgaatttgggcgggaggggccggagattggcagggtggggcccttgatatcatggcccggatcccatctatttttatttccaactttgtcagcacttcatccccgtcagcgaggatttcgcccggagtaagccctcccaccgaaaaagagtcgaataaagcattttcctgctcccttacttctttacttgtggagggaaggattatagtccaaccctttagaagggcttgtgccttgcttaatttccgcgagagtttctcggcagcgaggctgataagctccagggaagtgggatccttaggcaacaaatcggaatcagccccctgtaatgagtcagcggaaatagcggttaaaagagcgcggagctgcttgtcggataatggccaacataattcagagaaaagagagaaaaaaacgcaaaaaatttgagtaaaaaaggagtaacttgacggtcttatcccttcacagtactaagtccctttagttttgccggtttagctcgaaaaaggcctggtcagtagagcaccagactcttaatcaactgtggtaacacatgaaaaagagggaacaatgggacaaggggcctgagtcaggggatgctggcataggcaacggaacgaacagggcaagcggcgtcga

SEQ ID NO: 38286 - DNA, 1640 bp, Heterodera glycines
ttacccttttttgcttttggcactttctccagatcaaatccatattcttgtcgtgaatttggtgctgctgctcttttattgttttgttgatttttcattggtaaatgtaatatttcttgaatttcatgctgattgttttgatttgatcttacagactgatcagttggattttccgtcaacggatgattattctggtcagtaagctgctgagaattggttactgaagctatcacttctggcaaattattcgctggatttactcgcataagcatattggaatcatcgtttatactccgttgcttggtctgatcagaattgcttggctgatttctcacagccggtaaaatcatttgattcgaattatttggttgatttgacaagtcaagtaaattgctttttgaatattctccaagattttgcctgcttaagttttgctgatatgcctttccggtgaaaaagtccaaaagcaatgggcctcctgtccttaatgcatctcttctgtccaaaccatcataatcatcatcatcgctgtcactatcaatgttaattgggatgtttatggaagatgatgatgcttcatttgcattttttgttgctaaaatttcaaattaaaataaaatataaattaaaaaaaacattttcacctttccattcgggatctgtggtattttctataacaaaattgcggaattgactaggagaaatttggtgaacagtcggctcttgcagataaataatccgtggccctttttgattgtctgtgccaacgctgaattgaagaacatttataaataagagcaaagtgattaatttcataataagcttattaaggagattaagaaatattttaattgaaataataaaaattgacataaaatatcacacataacacaaaaatttatgtgtttggactttgtaagtattggctcatattgttgcatttatgtcgccaaaatagctgcacatgcttttttgtaatttgcccggccttttgttggctttttttaatctggaaatgatacccaaaattgggttcaaacagcagaattaatgtccaaacaaactagaagactgtgttttcttaattttaatgctgtttaggctatcagggcttgaaaaaaacttaagtttgagtccgatttttgacataggcataaatgtccaaagcgcaaatctcatgtaacattatttgcctcgggagctcaatggtaaatctgcccacagattgggtggtggagtgggctcgattcccactcgatgctgaacactttgcctatttcttttattaaatttgtaacgttaataaatatgtagaaatttataagtgaatactacaacataaaataatatccattttattaatcggataagcataattattaagcataattatatttgccagcgaaaagaatcaataatgtttctttcaggacttaataataaaaaaaaataaatactcataagtttttttaaggatttaaataataatagtgataataataataataataattaataatttacaaataacagggctcccaattgaatttttaaaatcaacatttggaggatgaaaattaccattttgtaaagtttttatcaaaaaaaagcaagaaaaatgttttttgcggtttgctttt

SEQ ID NO: 38287 - DNA, 999 bp, Heterodera glycines
  misc_feature (948)..(948): n is a, c, g, or t
  misc_feature (962)..(962): n is a, c, g, or t
cttatctcacgaaaaaggaaggacaaaaatgcgaccggcccccctgggtctcacaaaagaaagtttatttgctttttgccattgttctgatacgttcgtaatgtaatcattacatagacagcgtttattagaaacatacattgacagataaagcacacaaacagtcaaaaaaaggttgaaatgaaatgtttatgagtggacggccgaatgtcctcggtcggagaagggcgaacgtcggcagacatttcagtccccgtccacccattggcctccttcgttcggctcgttcacaactcgtctttgttcgtcctttttcccgagacgaccttcttcaaatcgtcaactgaaagacatgactatgtttaacaatgcccgtgattaattcgaataatcaaaattcgcccacccaattcgcctctgctcttcagttccgcggtgctctccaccgagcgcaagtcgccgacgatctgacgagcttttccaaaatacacttcgttcagtgtcgccctcattttgctctcttggtcctgtttaaacacccttttgaggagagtcgctgcaattgtggccaacttcgatcattttgccgatgtttgccaagtgcgggttctgctcattcactgcacagtcttgctcgctctgccgggtcagagaaccgccgaggtcaatggttccggtggttgtcgggttttgggtctgcagccaaagcattaccgtgctggtcaatttgtacttggcgaatttcgccgccttaatttcgtaaaaatatgatgaattaccaacttttcaaaatggttaaattcctacggttttatctgttttagggagggaaagggggacggagagagagaaacttatagttagtgacacatatccaatgctttcgtcccatccctcgtaccttcgtcttctcattgacttcgagcacgtggatagagtcccaacaanccttgacgccctgncgccccgacagcgaattgtccgtctcctttttgagca

SEQ ID NO: 38288 - DNA, 1050 bp, Heterodera glycines
gaaaattttggatgaaaaaaggggcttcactgcagtttaggcgtccaatttttagtttcttgggccataactttatgttttcatacttggtcaatgcctacattcttgggagcaaatgaaggctttcaggaattaataaatttaagaaaaaaagcaaatattgatatttagacaaaattcaatgagaaaacataaatgcatccttttttgaatatattcaagaaaaagtttttttatctctcttgctttatgttcagattagagacaccaaaactgttcttggattacattacctaattggcattttgccagtttcaatgagtggtgttttcattctccagattcgcactccaaattggagggtaggcaatttaaaaactcgaaaacatcctaaattccgagatttatgtattaaattcaaaatttcgccttataaaatgcaaaaataccacgcaatgataactcatacaacaaaaaaaaaggtgaattttaaggcggtagtttaaaagtcaagcaagcttctaaacactttgaattgctgggccaaaacaatgtttaactaactcaaaaattaaaaataaaataaatgcattttaatttatttagattgtaccacccaacaaaaaatggcgcatttccaatgaatttgtgtcgctgttccattccattttgtccggcatttgggcacttgccattctcacacgctttgatttccaccaaattgacgacctggtcaacaaggattcgctcgacgcgcgttatttggttggtgattttggcaaaatgacaacaaaaaaacaaaattctccctttcacacccaaagaatgaatgttcagttttcaattgcgccttttcatagtgctgatatttggtgttcgatttaaaaaaattccagggcctcatgaattgattattttctcccctatgaaaaaataaaaattttaagggtctgtgaaaaatcgattattttttgtttcccacttatgcacgtccgggttcaagcccaataaactagagatatttttttaaatatttaatccccaacaact

SEQ ID NO: 38289 - DNA, 1428 bp, Heterodera glycines
ctgtatatgtatctaaaattccttctcatttttttattgtctttttcttccggttccgattcatctcaattcttcctttcactatcattcgaccataattgaaaaagaattttatttcactttttacaacaaatgaataaaagacacaattcaaacgccatgcgaaaaggagaatcatcaaattggaaaaatcgtggttcattggtagaatttatccttttcaacacaatggggaatcggaaatgtcgtcgattgcactccaaatcggatgagtgtctgtaaatgacaatatatgaaaaaggcaaaaactatgtacccataaaattttgtattttcgttttggaagtcgaattcgaggaaatttttaaaaattttcatttcaagggggattcttggaattttctgagtcccaaaattctgtattttaaattttttgcttttaaatcgctgtttttatggcaatgttttttcaaaaaacttttttgaaacattgggagagggcgggtccccgcggtgccgataggcgccgccggaaaaaattttgagtgagatttgctaacagaatttgtcaaaaaatgtttacatttacagcaataatcaattcatttaaaatttaaaacacacctcttttgccgtcggctgcagccaatagtctttggatggttggcgactcagcagtgcatagaaaatggctgcagcgagggccagagccagcttgaacagcgacgtcgaatccggaatcgcctccgatcggtgttcttcgtttggctttgccgttgtcgtcgtcgtcggtgccggtgtggttgatgttgaggatgccgtcgatgttgtggacgtgcatcctttacaccgcactgtgccgaacggtgtcgggtccagcacatcaagcgggctcttgctggtttctttttcagcagaagcagtgaccagcagcgcgatggcgagcgcaaccccgatgatcagcagcagcacaacgatgatcagcacaagcgtgctctttttagacataaatggcttcattctggaaatcgaaaacagttaggaaagttgtgaggaggcgaagataggcgccgccagggaaaatttgagttttggcaaatactctgtcttaaaatgaaaattttttatggaaacggataggtggatttgtaatttttgttagcatgcataagaagggggtctgtgtgaaaaatttgttatggaaaattagaataagaaaaaattcttgaaaaacttaacttaaatattcttttagagtttaaattttatgttctttatattgacagttaattattttttgctcttcatacattattcaatatgtattttcatcaatatagtattttggcgtctaattatttattttcaattttcggaaataacacaaaatcgcacccaaaataatgccagaaacggctacctcagttg

SEQ ID NO: 38290 - DNA, 1457 bp, Heterodera glycines
  misc_feature (1334)..(1334): n is a, c, g, or t
  misc_feature (1439)..(1439): n is a, c, g, or t
taaaaacattcgatagagactctcgagctgctcccggctttttgtgtatttgttccgggaccgtgccattctttagactcacagccttcaccaaattcaccaaattgtcaggtcgagagtgcccattcatcggtggcaatggcattccgccaaaactctgctgctggcggcggcacttcgtcagccccgacagcacaagcggacggcacaaaacacgcggtgacagaaaacagtgccggaagcaatgggaaggtgccgccgctgccgccacaaacaaaattttgtggcgtaatggaggtgaatcaatgggcagatttttttttgcatgattggaaaaataattttgaattttttattatttattaatttcacggcactttttgtagcacttattggcacgtttaaaaaatataaggggatactttgattttttgatttttgaattttttttcttgacataacaaagcagcacctaaagaatatattttcatgatcaagaaccctgaaaatatgtatttaaccgtgttgagccgaacctaaaaaagtaaaaatgacaataaatatttaaattgaaatatttattatttaaattactgtcagcaatatttgtggaataaataaatcttagctttgctataagtcaatcaaattaaacatcttttagcaaaaatttctgagtttttcctaaggtttgtacaaatacagaccccctgaaatccaacatggaagcatggaacccaggtccaggcccatgctttttccaaaatacctaaaaagcgtaaaatctgttaattgcctgatcatttgttgccaaatttactggtctaatcagcataatttttgccaaataaaagtttccgtttttacagcattcaaaatattttatggtgttgctcaatcggatcatcgacggggacggaaacaaccatcaacaggaagtgagatgccattttgaaaatttggattttttaaaatttttaccaatatttattcccccgatttggcacctggccaaatttaaaccatttctttatgaaacgaccctttgagaaacgaaactaacctgacgaacagatttcatgtttagggatttttcaaattcaagcctgacaaattcattgttctgactagggcacaagaaacccatggacaatttttgtggtttcctgcgtttcaagaacgagttctcgaattacatgaaccagagccgaaatttcggggcttgctggcgattaacctaaaatcatttaaaaatatttaaaaattcttgccaaatccatgcaaaaattcgcaaacctgaaattctgaatggaattcccctctaatacttctanaatttagaccattttttcggcaaaattcgatacattttcgtagtcctattcaataccgaaaatctcaccataccataggatctggaacgagaattgaagctgatncgcgccaggcacgtcatt

SEQ ID NO: 38291 - DNA, 1426 bp, Heterodera glycines
  misc_feature (1235)..(1235): n is a, c, g, or t
  misc_feature (1301)..(1301): n is a, c, g, or t
  misc_feature (1305)..(1306): n is a, c, g, or t
  misc_feature (1348)..(1348): n is a, c, g, or t
  misc_feature (1369)..(1369): n is a, c, g, or t
gggtcacagcaaactggggctaaaaagtgattttgtaaattcttcctagtaaaaaaatgcccaaaatttagctaaaataaaatttgcaatttttatttagggagatagctaattccataaatgaattatgtaagtatttttagagaaattaaatttttttcaaaaatatataaaaaattgcctgaaattatacacataaaatatattccgatttcctagaattgctctcttaattagtcttaaaaaacaaaaataatttgcttaaatggctattcaagaaatcagtccactgaaaaacgaccaaaaaaaattttgtcaaatattttttaaattttcaataaaaatttacggtctcttccattggctacaccacacaatactcaaaacgatcaaaaaactgaatgtcgtcaaaggtttgaacattgcgcacggtgggtgtggttggttactttaactgtgaattttaattattaaaatgcagagaattttttattattaatttaaaaaataatttattttttataaaaaattttccaactgaagagaatttgtgaaaatagaatatttgtttgcttaaaactcatctctctctaaagcattgctttaatggaatttatggaaattatttttgcttttctcaaatgcataatttgtttttattattccgatgagacaaatggaattgatttctcgctttcataaaatagattaattattagggatttcaaaaatatgtataaaaagtggtcaaaatatgtgtatataaatatgtaaaaaaaaaataaaaacaaaaatatgtaccaaatatataaattaaatttttaaagtggttttttttgaaaaaagttcttcgtaaagagcgaaataggcacaaaatgccataaaaatgacctaaaacagaaatgtttttcctactatttagaacattggagaatcgaggaaaatatgtattacataaaatttgcgcctctactaattataaatttttcgtcatttaatttaattttcttttgctccacaacaatgaaaatttaaaatacaatatattaatttttttcttcaaactgtctaattcaatacatcactttggatttttttttgcctaatgttagccatttttttgtgatgacaactgattgatgaatcacccaccaacgatactgctcagaataattaatttcaattacttttgattaataaaagatcacattaaatttcccaaaaaataaaatatngaaatttttgtaatataaattaattaataaaaataatattttaaaaggtcattgaatgcaaatggntaanngtgtgacacatttgtcaccttcccccgctccccaaatatcanatgcattttcacaaaactttntgattctattaatttattaaaaataaatgcttttactgtacaaaaatattttttaga

SEQ ID NO: 38292 - DNA, 1182 bp, Heterodera glycines
  misc_feature (46)..(46): n is a, c, g, or t
  misc_feature (50)..(50): n is a, c, g, or t
  misc_feature (69)..(69): n is a, c, g, or t
atcgggatacatcgtgcagagcagctcgaacccatgtgttgcccanccanccgctttcatgcgtgtcanaatgccatcagttttcatttgcgtaaacagacgaccatatggaatgccgacttgctgttccgctgacaaccattcatagtgaaattggtgtaccaaggtccagtatggcgcaaattctggcaatttgccatcactcatgacacaatgctgcaccgacggttcggtcggtagaacaaagccgccgcctgtgtcgtcgccagatgaagcatttttctcgtcttcatcagcgatcagtggcatcagaaacatcagccaacaaaggccctccatccgatcaaagttcgggtacacctaataagggttcagtgatcactatattttaaaacagggttctacaaaaaatgatcatgagttatggcacaaggaagcggagtgattgagaaagtgggatgaaggattattgattggataaaggatattgctttcatactcagttgtttaacagggttcaatagtttgaaaaggcaatatgatcgagtcccatcgcacgagttagcttttaggatctacaaatttagttaatataaagggtaaattttaaactcgacatttttgaaaatcaaggaaaattcaggcttgtaaaggcctggatttgggcttcctggacaaaatccaggaaattccaggtcccagaaaacgacagattgacaaattggccttgatctcgacccaggaatttcattttcaaaatgtacgtgacaattacgcatttccctgtcaccgtttggaaggttcgcattttaaaatagtttttttcaaaaaaattttctgcggcgcatatcagcacttgagcaaaacctgtggaggaaattttgcttaaaatgtagaataatttttaaaatttatgcgcccatttttattgtgcctattcacaccttattgcgcactgtgctgagcgcagcgcgtgtgacattcacttgcagttggcccttgttgagtttgacttgcaaccacgatttgaaatatctgtaaagcattgttgtggccaaacgcacttcggccacttttgcccgttcactcgaagttcgttgaaacaaaatgtctgtgtacagctcaatgcgatgagacaggcaaagggcatctgtacatgattaatgatgatggtaatgataa

SEQ ID NO: 38293 - DNA, 1491 bp, Heterodera glycines
  misc_feature (12)..(12): n is a, c, g, or t
  misc_feature (37)..(37): n is a, c, g, or t
  misc_feature (75)..(75): n is a, c, g, or t
  misc_feature (1437)..(1437): n is a, c, g, or t
  misc_feature (1444)..(1445): n is a, c, g, or t
tcctcaaaaaanaataagctacttaacctttttgccncctgaatttctttttttaaacatttttctagggttctntaaagtgctgaacacgaatcaggcatttattttatgctacattgcagatcacgtgagttacgtgcaaaatttacgtgtaaaattaaaaagtgcaacaaaaaaaaattaaattggagggcatattgtaagctcttggagaaccgcgaggatgggaaaaaactttggtggcaaaaaggataattaacaaaaaatgaatcctaaaatacacacaaaaaaattaattcaattcctaaactgacagaaaaaattgtacacaaaaaatttatttcctaaaatgtacaaaaataatatttacaatgcaagagggtatccggcgcatgaactgtctgagctgcaaacgccatctaaaaatttaataaaaaaggtaattaaaaataaaaatttgatttttttttgcctggggcaatgccaacaacaatgggcggggtgtcgcctccggggtcaatttggcttggtggcagcaacggcacgcggcccgacaattgtgggggttggtcatgttggacacctttttttattgttataaattgtaaaaatctaatttgcaatgtttataataaatgaaatttttgaaatatattttttaattttagaattaaattaaactaatacaagtaaatataaataaatatgtgtgttacttataaaaatgtgataccaataaataagtttttaagattgttttcaataatttatttcatataaaataatttttttaaatatttattattcattaaaaatactttaatttatttaattattaaatttttattatttgtcatcaatcaaataattgttaaaatattttgattttttcctcttgaaaaaaattcttgaaataaaaaataatttttttaatttaaccttaattttttcaaatattttttgtttaaaattaataaaaaaaatatatatattttttattttaatttttcaccaataatttcgccctcgacgcacgtgccatgctggggatgcatgccggccggacaatggcactttccttcaccagaacatgtcgcttccgggtaaaaaacggcacattgtcgccaatcaatgcaaccatctgaataaaattgaaaaagaaattatttttttaatatttaaccagggctctaattgtagtaaatttaattttgtttaatttatattaatcaaatttgaaaaaaaacaagaaatttttcattgtaactgtttactattggtgcacctccaagacctacctctacctcaccaaaaatttcccaaaatattacgcggaaattttccaaaatccaccaaaattacctattttggtgaaaatctgttaaaaatgagggaaaatcaaaaaaacaattttccgatggtgccatccctgattanatcctgnngaaagattgatagtaattgtgctcacattttttgcatttaaaaaaa

SEQ ID NO: 38294 - DNA, 1124 bp, Heterodera glycines
acccgaactcgaataaaaatcgaaattttgaatttttcacttttgttttttttgttcaaatttagattaggaaatcggaattggtcaaaataattgaaagattcgtgatcggggacccccaaaaccccatagaataaatttttatgactatcacaaaaaattttgcaaaacaaaagggtccccccttttgaaaaaattttcaaaagtggtaacttttacagtagcgccaaagtgtttttatgacttttgaacataaaaaaatttcgaaaaaaaggggggggggacaaactgaactattaccgtgcatttttattacctaaattctttttaggttctcatctatgtttttgatgtggaaagcagagaggtgcaaaaggactatcggaattatcagtcttgcctggaggcgcttatgcaaaattcgccaatggctaaagtgttttgtttggtccacaaaatggatctcatccaagaggaaatgagggataaagtctgaaaagctgcttttcgaagatatatttttgttttagatattttttgacaaggagagggacatcaaccaactttcggaggccaccgctctccgtcaacacgccaatccgataattcaatgctttcgctcatcgatttgggacgaaactctttacaatgcgtggtcagcaattgtttatcaactggttccaaatgtgagctcaatggagcacaaattaaagaaattcgccgacataatggacgcggatgaggtggttgaaaaagtcgccatgacgcgccctttcccttcagattttactctttgaaaaggccacttttcttgtgatcgctcaagcgcagagggcaaagcacgaggacatccatcgctttgaaaaagtgtccaatattatcaaacagttcaaactttcctgcaggtatttaaaatttgttttcttttaccatacaaaaatttttaaagtcgcatgggttcacagtttgaaagcatcgaaattcgcaacagcacttttgctgcattcattgaaagtgattttagtaaataattaatcataagtaatatttattgctattcatggttaggcttcacttacaacacttatgttatgttggttctgtcagatggaaacatttcgtcg

SEQ ID NO: 38295 - DNA, 672 bp, Heterodera glycines
ctgccctgtctattagcagtattttgaccatattaatttaggaaatttgaccctaatttgttaatttaaaataatatattttatatgtattgtttttatgtattcttttgtatttctcatgttttttaaatacataaatgtttttctcatgttttaaaacacaatttttttgtttattggcggtggaccttaggtaatgtgatttgcaactttttctataaaagtgttcaattgatcagtttaaaattaattatcaaatcaaacaatgtttaaaacaatttgtgtcattagcgttgcgattagtgccattaataaatttgcggtttgttgttgtcgctgtttcattgcgccgttccaataatagccgtaccgtccgtttggcccgtatcgttgagcattattgtaagggtcgtagcccccgttggaatacggtgaatgcctggaccgtatgggttgtgggttggacatggcatcgcaattatcgtagtcgcacgtataacagcttaattgtttaattatgccattggcatcctgtcaaattaatagtgaattgtagagaccggaaatttcaaatttgcggatcccgctgcgggattgaactcaaaattttttgcgggacgggatcccgcgggattaatcccgcaaatcccgcatttaaaatttgcgggaaaa

SEQ ID NO: 38296 - DNA, 796 bp, Heterodera glycines
aaaaaaatatttatgaaacaaaaaaatcgattttttcaagtgtccgtttggggtactcaaacatttatggggagcaaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggctcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggctcggggggactgccccgaaaacaaaaaaatcgattttttcaagtgtccgtttggggtactcaaacaattatggggagcaaaaatccaacgcagaattaaagtacaggctatagggaagctattcccgaaggattcggtctcc

SEQ ID NO: 38297 - DNA, 1069 bp, Heterodera glycines
  misc_feature (922)..(922): n is a, c, g, or t
  misc_feature (1012)..(1012): n is a, c, g, or t
cgttgatggcgatggatttataacgcgtaaaaataagtaatgaataaattaattattttaaaaattaaattttagatccgagctgaggatggcattccaacagatgggccatgcactcaatgatgccgatatcaaagccatttataaacgtgttgacaaaaatcaggacggcaaaatcaacttcaagggcatgttcttgaagaaaaaatcaaatcaaattatttcagaacttaagtatcttgcttaatgagagagttttttaatttgatctaattttattaggtcttttatattaatttaattaattaatttcaatttgatttattattttgttcctaggatttattttgagtttttgcgcgttgtttggtagttttggctttatgtcaacacctctaaaatatttttttatattttttgggtaattttacgtactgaacaggaagctctaacaaaaattccgtaatattaaaaatttcattaattgcatttcgcattttgccgattcaatcttgggaccataaccacggaagaaagtttcttcacctagatcacttaaaatgcatgtgttagcttaaagaaagttcagaatcatgttcagtaattaaaattagcctagaaaattaaaaaatatttcagtggtaatggcaaaagccaaagacacccattcaataattaatttttaatttgccaattaatttatttttaaatttttggcatttttttaaaattaattttctataatcaaaacaacacatttcattttaagaattttgtgagatgatgacccgaggaagcactagcaacagtagcaacagcaattcatgatgataaatgaatgacggaagaaggaatacaccataaattgtccaattaacttaagccaattaatggttgcttaatttttccggaaaacacttanattggcctaaatgataaagattaattaatcggaattaaaatcaaacaaaaactcaaagaataaacaaaacacagcccgattatatactanaaaatataaaatttgaaaagataaaaaaaacattttttttaaaaaattaaaaaaaaa

SEQ ID NO: 38298 - DNA, 1092 bp, Heterodera glycines
  misc_feature (10)..(10): n is a, c, g, or t
aaaaatatanttgaaaattaacaattaaaagggtgctgcggacctctgatggtaattgggaactttaaattaggaattattatttttaaaaaataaaaagtaatttacattaaaacatgaaaatatgtggaaaatataggtcatattttgactttcaataaatttttaaaagaccaagccataataaaaatattgaatgaatctaatatttttttaccttttaaaggcttataaaaatttatggtttattaatattcaatgggaaaatgaatttttaatggcaaaaagccaattctttttttataacctttatcaaaaattttttttttttcaaataaaaaaacaaaaagatgtgacgtaatagcataaatagtttttaattgtgctctgaatacaaattttgcatttttctttatacaaacaaactgatttatgacgcaagcttcattgtcatttttaaatgccttctgaaaactaatgaaaaagtgcataagttctttcctaataatgatcatgcctaattaagaaaagggctaagaaaaccaatgaaacatcaaaatttaaaatagtacattcgtgaatgtagttaattagtgtgtacttctttcaaacatatcaaagagataaatccttcttataatgaaatgcgattgaaaaaattatgaggaaaagcttcgattttttttttctcacatttatacaaccagtaacattatttttaatgaatcacttatttttcaggaattaaattaataattatttatgtcatcaaatgtaactgatcaacaggtaacaataataataaaagatgtgccaaaattaataatcttttcattcactattcatttattcaaggatgacgctggttttgtgtcggtcgaagttgcaattagtgggatattacgctgatttgctttttcgaattgcgctaaatgcgtcactggtctacgtgaccgtcaaatccaagtacggtttttattaaggtttcaaatattattatttttaaaaattctcctttaaatatttgcacaattttttcaactaataaaattatattttttattaatttttcaaaaaaaaatcattttttaa

SEQ ID NO: 38299 - DNA, 848 bp, Heterodera glycines
tttttattgaattcgggaccggtttgggttgagttagccttgaaaaattggaaaatttgaaaatcatttttcccccctccctttctcccaggggtattattttgtaaagtctttttttcaaaataaacttttcaaaccccattttttcgcaccgtgaatgttatttttatggaattctgaaccgttttgagtagattagactagaaaaaattgaaaattttgaaatcatgtttcccactcccttctcccaggggtattattttgtaaagtctttttttccccaataaacttttcaaaccccatttttcgcaccgtgaatgttatttttattgaattctgaaccgttttgagtagattagactagaaaaaattgaaaattttgaaatcatgtttcccactcccttctcccaggggtattattttgtaaagtcttttttccccaataaacttgtcaaaccccatttttcgcaccgtgaatgttatttttattgaattctgaaccgttttgagtagattagactagaaaaaattgaaaattttgaaatcatgtttcccactcccttctcccaggggtattattttgtaaagtctttttttccccaataaacttttcaaaccccatttttcgcaccgtgaatgttatttttattgaattctgaaccggtttgagtagattagactagaaaaaattgaaaattttgaaatcatgtttcccactcccttctcccaggggtattattttgtaaagtctttttttcccccaataaacttttcaaaccccatttttcgcaccgtgaatgttatttttatcgaattctgaaccgttttgagtagattagactagaaaa

SEQ ID NO: 38300 - DNA, 887 bp, Heterodera glycines
atttttaattcctttttaaacaggccaaaaagtttaggcttaacttttttttcagaaactgatcagaagcgtaccaaactttgcagggatactccccggtaaaggactaacttacactgaaatgagcgccgagctagctggctcaaaaaaattttcgaaaatctgagtctttcgtttttatttattttttgcaaaattaatttttaaatattttttcagaaagggttctgaaacgcaccaaattttatttacatgttagtttaggcactctgatgctttttctatcaaaaagggagatgaataaaatttttaaaaatttttaattcctttttaaacaggccaaaaagtttaggcttaacttttttttcagaaactgatcagaagcgcaccaaactttgcagggatactgaaaggaagagaaataacctattttaaatattatctagtcagttcatttaaataatttttatccaaaaaatttttttttgggttttcggggcagtccccctgaaccgatgcgcccagatttatggggagaccgaatccttcgggaatagcttccctatagtctgtactttaattctgcgttggatttttgctccccataaatgtttgagtaccccaaacggacacttgaaaaaatcgatttttttgttttcggggcagtccccccgaaccgatgcgcccagatttatggggagaccgaatccttcgggaatagcttccctatagtctgtactttaattctgcgttggatttttgctccccataaatgtttgagtaccccaaacggacacttgaaaaaatcgatttttttgttttcggggcagtccccccgaaccgatgcaaccagatttatggggagaccgaatccttcgggaatagct

SEQ ID NO: 38301 - DNA, 607 bp, Heterodera glycines
agttaggtttggatgagttgggtttgaaagagccgcaaatgggatccgatgtcatgtaagcggcattaaaaacagcgatcaaaatgccggacatcactgaagcggaccagtcgaggcgcaactgatcaaaggacggatcaagagtgggtaattaggggaggcagttagtagtcgtgttacgacttttcgctgcgacatttgcgccgctcagtcaaaaaaaaattatttttttctatatttttttgcgatttttaattaattttgtgaataaaattttttcaacttttcccccttcgccagcgactcctccccctatggtcatccttaacggtgtaaaaatttctcatgttccgaaactgaaaacatagactgagaacgagaagcaaaaatccgagaaatttctcaagtgagaatcaaggctctcgcgctagccactagtaattagggtgttgcttattaattaggaactttagtgccttacagtggccatgaaagtggtcagacgagggctcaaagaaccaccagcagatggagttgaggaacagagaagtgatggccagaaacaggtcggggatggccaacaattggagcacctgaggtggcactt

SEQ ID NO: 38302 - DNA, 1027 bp, Heterodera glycines
  misc_feature (67)..(67): n is a, c, g, or t
aaagtaatacgaatatttcaatttcttacttatcagatagacaaagataggtacacacgacattttntatagaattccggctgaaactaaaattccctcttttggtcttaacttatgaattttggcccattatggacgaattaagtatagaaggcgtcgcagaaataaattcatattttctcaattcgggtttcaaaaaattaagatttaaaagaagctaaattacagacgtttttcaaattttgggtgtctccgaatagaaagaagttggaaatcagtacttttcacgcctataaaattcgggccgaaaaatattggtgtttgtgactagaaaaatagcagatgcatatcaaatgactacagaaaattaaagcctccaagaaaataattgctttgcacaagcaatattttgtagagcccatcaaacacattgtgcttataggaaatgccgaattaaacaataggggcctttttattatgattacaacaaatcagcatggcgtctctctgatatggtatgtttcagttaaggtttagccgatctacaaatttcggcactgtctattttgtaaaagcgaatcaaattcctttggattccaaagtggaattacagaattgcaacggcaaatccaaaatagacaacgacgctttcattataaagctttaagggaggcaaagtaatacgaatatttcaatttcttacttatcagaatagacaaagataggttacacacgaacatttttatagaaattgcggctgaaactaaaatccctcttttggtcttaacttatgaatttttggcccattatggacgaattaagtatagaaggcgtcgcagaaatacattcatattttctcaattcgggtttcagaaaattaagatttaaaagaggctaaattacagacgtttttcaaattttgggtgtctccgaatagaaagaagttggaaatcagtacttttcacgcctataaaattcgggccgaaaaatattggtgtttgtgactagaaaaatagcagatgcatat

SEQ ID NO: 38303 - DNA, 1146 bp, Heterodera glycines
  misc_feature (75)..(75): n is a, c, g, or t
  misc_feature (1123)..(1123): n is a, c, g, or t
agaaaaaaagaaagaaaatagggaatttttttatgaaattgaaaaacaaaaaaaggacacaaaacgattattaantgtaatggattggggtgtgatttgagaagggaaagagagcccatgagaaattagtttaattaataacatttataaaattatttgatcattaatgattaattgcgattgttattgtaaaaataatccgaaaagatggggctgtgatgatttggagaaatgcttgagattgaaccttgtgctttttaaaaccgacaaactcaatagttgctaataactcgaaaagtagcttaacaaccacaaaaaaaaaacttttttttttcgtacatttcaggccaccggcgggagttgaggaaaaaataggctaaaacctaaaatatcatcccaactcatgactcatgagtggtgtttagcccatttcaaatctcttacttatatcattgtattaactataatttgtcattattcacgaaccagcggcacactgactataaaaacatgggtcaaataactgaaaaagatacggtaacggcgtaatttccgagtgtttaccctgtaaaagatacggtaacggcgtaatttccgagtttttaccctgtaaaagaacggcgtaattttcgaggttttaccgtacccgacgcatttgtcgaacactgtttttaaaattcaattattttcacatattttctaacccttcctcaggaaaagaagtgtttctccattctcaaagttcgaccgatttgcgtcaattcgaccgcggcgcactgtccgaatttgaaattcgaattcgtctcgaaaaacactgctgacaatggcccaacgcagcagcagcaactttccactgctgcttcttcgtcttcctcctcagctgctgcttcttccgctgacgaagtgccaccgattgcgccctccgttggccaaatgtccgtggacattttgtcacgccattttggcctcacatgggaacagctgatggcacagtttgtgctgaagttgcaaattcgagagcgcgtcgacgacacggaagcagtgtttatggacattgaagaagcagggtgggacaccaaattggttgaacaccgaaccatctagtgtgagatgctttacccgnaaattggaggaggaaaagaacgg

SEQ ID NO: 38304 - DNA, 1540 bp, Heterodera glycines
tgcatcaagattcgtcagctgctgaggacaactcttcttaataatattaaaataactttttataaataaaatcaaatttattttcagctattttttaatttgtttctctaaaaataattgattttttctagtctgatcttccatcagctgttttatagcttggctaaactagtccatcggagaattttttatatatattacgttagatgcccataacagtatttagccgtaattgaatttttataaatttaaacccaaagattttatagtaattattccaaaactgggccataattttttatcattcgtgaatgggttatgcttataggttccggaacatttacagtaatttgatggttcataattttccatattacatcatattcagtacaatctctccggttagcaatgagcttttgttcgaagtgttctatgaggaagaggccaagctcgactcacaatcagcaaactgcgtaagggaacggaaattttgcgggacagccattcaaagtttggccgaacttcgccaagcagttcagcaacaacggcggaccattgaacttcaactacagggacgtccatatatggaagaaaaacaacagcaacaacgaaatcggaaaccatcacaacaacaactacagcagcaacaacatcagcaggaaatgtatggtgttctggtgatcaaggtaagaaaaattcttgcaattttgtcaattatagaactcagaaaattcggaattagcacttggaaagtgtctaaacctaaaaacatgacccacaatggcgttaatcaggttaattgtaatggcaatgcctccaaatacaatcgttttggtaaatcagaaatccgctttcaaaaatgaaaataggaatccactaacattctttattaaggccagcaagaaaaatggcacaaagtgatggaaaacataaatttataggcttcgctcagcaactgtcatggcaccaaccgagccttggtaaaacaacattcaacagaatttgtgggcacgttggaaaatggtcatcattatcatcagccaacgcagcccaccaaatcatgttcaccatttgcatatcctggtgacaatcaacagcatcatcccccgccattgtcaccatcaattaaaaagtactcaacgaccggttccgaatcatcatcaacaattaaacggtcattaacacgacaaaaacaacactatatatacaatgtgacagacgacgaaggccattcgccatcatatgatcgacaggtaaagaaactgttgagtatgaataaataagatattggcattaaatcgaacttttgttaaccaaaacaagaattttccgtaacaattacactaacaaagtttcatatgtatatgatttttgaataatttgcaaaaaaaagtacagtcttctgtcatatttttcatttaaatgttttttgttgagcaaacattttttgcgtgggttttttaattctcagaaatgtttttaatatacttaaaatttccaatcgcaaaaaattgctttatttatttgtatataactgtat

SEQ ID NO: 38305 - DNA, 1661 bp, Heterodera glycines
  misc_feature (1629)..(1629): n is a, c, g, or t
tatcattaatatttataaaaatgtatcttctttataaataaaactgaattcaattaataatgcaaagcaaatataaaaagcatcggtaaatttattatagtcaaagctataaaagaaatttatatttttactaattattgcaaaattccttgtaaactcgcaaaaccataaaacaaataattgataaacataaatttttagacaaactatatatttataatgtgtatgaattattttattctttaattttgatatttttaagggggaagcaagaagtgttttatatgaatgaaaaataaaagtgatcataatagaaatgcaattaatttaaggacaatattattagcaatcaatgatcgaacaattcaaataattatttttaattgtgaatgattattacttcacgaccaacacaaatcttcaagttttcgatgtgcattcagagttgtattacaaaagagtagattgtaataaaaacttattttgcactaattatatttttgatatattcaatcttttttgtatgttataatattttatttattattcttatccgtaattatatatctaattaatatttttaatctagttaaagaaacttttggttttgccaacaaaaataggcagattgtcagtcatcataggcttttttaataacatagatttataatttttaaaaataataaggattcttatattatgtaaaaatctttaataacttcaataacattgaaaaggttgaacaaagtatttaagcataattatattttattttttaacttgaatttatttccgccagtatcacaatatttatagagcttttttaatctttggtggataattttcttatttaatggaattgaaaaaaaatatttttaattcttttataagtatagtagtttacttaattttattatttattattacaagtcatttaaatcaattagaaactaattaaaattgaatctgctattaaaattcaaatctggaagttaaataataggtcaataaaaataaaagttttatttaaaaaaatggaattggaaagaatttattaattaattaaataaaaaaatgacaatgtcaaaaaccttttaattttattatattttaattgaattattattttttaatttatttgcaatctaatcagctgcccgactgataaaagatgtgcggctatttaacatctcaggttgtatgggaaaagcacatttcattttatataataaacaaaacatatttaaataaactcgcaaaattcattaaagaaaatttaaatttaaattgacataattaactcaaaataacaagctcaaattttgtggaggaaatccaaagcggccacctctaacattttaatgagtttttgaatgtgcagctaaatatcttttaacattaattgttcgaatttaatatacaatttaattttatgcaatattctataatcagtgaataaatataaaattctttaataatattaatgaataaagtaatcattaaatatgaattaaattaataaagataaaataatttaatgaaaagcattatacaattgaaaagtgttattgtaacaataatatataataatatcataaacagtctattcaatcttttcatgaaatctcncaagaccaaatattcataataatattatatat

SEQ ID NO: 38306 - DNA, 1193 bp, Heterodera glycines
ttatgggttttcaatttagcattaaattatttctagtccttatattcaatgaaaaggaaggcattctattattattatatttttttaaaagtttataaataatgtttataaggtgccataaatttggtattagtttattttaatatttatataatctcatatataattaaattgataagataattttagtattgtacacttttatatcttgttgcatagttttctttgctgcaagattttcaataaattagtaaaagaatttcaatttcgtggattgttcagtttcttgattaatgttcttcttttaattattatattttaatatattcattgtattttaatattactatctacaaatttaaactgttattatttgttcattttcaatttaaaaatccattattttctttagttgacaataaacattattaccataatagaatttatatataattaaaaaaaaataaaattttattatttatcagctattttgttttagcttaatttctatgtttaagaatataatcatacctaatatattatcacattttcacgtttaagctcgcctatatatttaagactgttaatgtttttagtatattacttggctaacaaaaattattgcttataattaatatttgaaattaaaattttacagaatcatataaaatttaataatcattaccgccttttctgactataatataagcgatttctgtatatatttattaaatataaaatttatatttaataatgattacttaaattttaagaaactcgcatgcacatggtaattaataaaattaattcgccttgtgcaaatcgctgtaattttcacttttttattaatatataaattcaatggaattatgatacaaaataactgtttgaagtgaattattcttttaattaaatatgtgattttttgtttcttcttttttcttcttagtgatccaatggagaaagactgctcaaattaattttttttttgccttatattttgtttgtcctatattttaaaggaatgttttttgaaattttaattcttttattcaattgagaaatggatagatattattattatttttgttttaatgaaaaatattgtatatattaagacagagataaacgatattcatgcaaatattatgactactaatttaaataaatatcatatacgaccaataaatatt

SEQ ID NO: 38307 - DNA, 1161 bp, Heterodera glycines
  misc_feature (11)..(11): n is a, c, g, or t
aaatgaaattnttgtttcactcttaaaataaaaaccttcaccgataaaaacacaaaaatttttcaattggaccacaaaaattgaaatttcgaaattgaattttgggttttctgtcaccattcccagagaaaatctggattcattaagatattccaattcaggaattgatagaaaataagagatacctcacttcaaaatcgtataccgaagactatgttgagaaacggcaaaatactaactcaatggcactcaaacgaaattttaatgaaaaaatgccaaatgggagaggcggacgaatgaaagacaaaatgccaatggaaatgaattccccaaggccaaggcgtaggaatggcactggtagtcatcgtggtgaaacgagtcaaaatttgggtgaaaaattccgacatgaaagccgagcagaccaaacaaatggtggacaaaatgccaaaatggaaagaagcgcaagtcaaaaccgccagagacaggttagaacagtggttggatatcgtacacttgacaaaacattttcaagtttttggtactgtccctccccatccattttggcattccgtttatccttattttgaaaaattgggtttttaacactttttttcagcgtactgaaatgggcaggcaaaagtcacttaggaaaaaagatgaaatggataaactatggcaagagttgcaagacgatgaaggtacggtaaaaccgccaaatccaaaaaaaaagtcacgaattaagaaaggagcaaaagaccaccatcactaaatgagaaacaattcgacaaactatgggaagattttaatgataaagataaggaagaagcacttgctgtggaaaagaatgcaaaaagtgggaaaaagcatcgaaaatcggcggagaaaaagcgacaaaatgccgaggccagccgaagttccaacgaaggcaaaatgggggccatgaaagtgaacggagaaagtgccaagaaaggaaaaagcggcggagcgaaaacgaaacaaagtcattcatcctgaattctatttgatgaataaaggggggaggacaaatgtggaaaatggaaaattgaaaaagaaaaatagggaagaaacatttactaaaaaaataattgtaacttaattgggaataaaatttaaaaaggaattttcaattttttaaaacga

SEQ ID NO: 38308 - DNA, 1016 bp, Heterodera glycines
tttcccccaataaacttttcataccccattttcgcaccgtggatggtatttttattgattctgaaccggtttgagtagtttagactacaaaaaatgaaaatttctaaatcatgtttcccactcccttctcccaggggtattattttgtaaagtcttttttccccaataaacttttcataccccatttttcgcaccgtgaatgttatttttattgaattctgaaccggtttgagtagcttaaagtacaaaaaattgaaaatttcgaaatcatgtttcccactcccttctcacaggggtattattttgtaaagtatttttttccccaataaacttttcataccccatttttcgcaccgtgaatgttatttttattgaattctgaaccggtttgagtagattagactacaaaaaattgaaaatttcgaaatcatgtttcccactcccttctcccaggggtattattttgtaaagtctttttttccccaataaacttttcataccccatttttcgcaccgtgaattttatttttattgaattctgaaccggtttgagtagattagactacaaaaaatttaaaatttcgaaatcatgtttcccactcccttctcccaggggtattattttgtaaagtcttttttccccaataaacttttcataccccattttcgcaccgtgaatgttatttttattgaattctgaaccggtttgagtagattagactcatgtttcccactcccttctcccaggggtattattttgtaaagtcttttttccccaataaacttttcataccccatttttcgcaccgtgaatgttatttttattgaattctgaaccggtttgagtagattagactacaaaaaattgaaaatttcgaaatcatgtttcccactcccttctcccaggggtattattttgtaaagtcttttttccccgaataaacttttcataccccatttttcgcaccgtgaatgttatttttattgaattctgaaccggtttgagtagcttagag

SEQ ID NO: 38309 - DNA, 113 bp, Heterodera glycines
cgaggagcggccagaagcggacgttctggctgacccgaactgccgcttcgaatccactctttcagagggtcggcagggattcgtgtaaaaaacggccaaaggtgagctaactg

SEQ ID NO: 38310 - DNA, 1047 bp, Heterodera glycines
tcagataacttttgttctattttctttttagcgagttcagttggctaaggttctctaaatttgagctaggacaaagcttttaatgaagttaaattcaactccctgctcggaagatatcagtcccgaaggataggaacacaaaatttcaataagtttccactcatttgaaaaaaaaacaatttgataggaacttaattgttagttgtctttttataaatttaataattaaaataaaatttagaattttatttaaaaaataattaaaaaaagaagaattaaccagtttaaaattattataaattcatatttcttattcatatcgaatatcgagcctcttgtcacgtgatcttgttattcaagatatatttcaaaaaattattttacaataaactcttaaattgtttaattcaattttatttatttaatacaaaaatatctttttgcataggttttttgtctgatgatgccttgcttttttaatccgttcgcttttacataaatgttttgactgtttttccaatgattgattgatgattggcatttcccccccccccccttttcattttttgccgacttttctcccattgcatccgtccatctgcgaagatgctttaggcccgactggcagaagaaaagcccggcccgcggaggagtgaaggcaatggcaatggtgcctcccccattgtcttcaattctcaaccgtcttcaacattttcccgaactgcttgccaaataccaagccgcaatacaagaacagcttcgactgtggctcatcgaaccagccgatcgaacccgaagactcgagcatttcctgcctcatcattgggttgtcacacacaaaggaatactcatgcgctttcgcctggctgggattgcgctatggggtgacttgaaaaagggcttcaattcactcaacctgctggaatgcgaccgagaattctgcaaagtgctctgggttaacgacgtccgttaaccaccgttgccggataacgaggtcatctaccgatgggcaagggtgccattcggtgtcattgactcggccttttt

SEQ ID NO: 38311 - DNA, 64 bp, Heterodera glycines
ccggggcgcggccaatatggtgcggggccacacgcagcgtttgctgcgcaatgagccggatgcg

SEQ ID NO: 38312 - DNA, 204 bp, Heterodera glycines
atattgaaataaaatgccatgggaaataaataaacattttccgcttatgcctaagaaatgcgcgagttttgtgctcccgggacagtgattttttacgattgttggggaaaggacaggaaaagtgaatggggtaggagggggaggacaacaaaaacagcgaaagagagggaaaagggggggagaaggggaggggaagagggggag

SEQ ID NO: 38313 - DNA, 1015 bp, Heterodera glycines
  misc_feature (968)..(968): n is a, c, g, or t
gctattagtatatgcacaaaattcgtaatatttttacagcattttttatttttcatagaaaaattaagaattggcacattttttaccccaaaatgtcccaataaatcaaattataaatcagctaataatgttctttaaaaatctcacatcagagatctccttcaacgttttgtcccggaattcgtccgacttcatgatcaacaggtcaccctgagtccgttcaaacttgtccaaccacatttcaaccgatgaatggtcttggcgttgaagaggcgccctaaaacaaaaaacattcggtttaaagacatgctttatccattcaaatccctccaattttctttaaaaaaaaatcattttttgaaaataaatttttggtggaccagaatgccaaaaatccgtaggatttaaacattaatcattttacgcatactttgatcgggcggaaaagaatgcatgtgagcgtgcccgagcctggcttcgcacatgtgatggcctattttgggacgggatttgaatggatttttgcataagcataaaacaaataaacaaaaaaaaatttaaatatcaaaaagggaactagcaatacggtagatcaattgtaccgtatgaacgtcaaaaaaaaatttgacgtaattagtgtaaataattttttatagactcaggatttacttttttacataaaaaactatcattaaagacataatttacccggcaaattggatgatcatccacttaagaatctggggacaaatagtgagtggtactgtaatgaatgcatgttacagtaataatagtatactttatcctccggcatttcgaagttgcaaaacagcgtgcgtatctgtgatgtggcatttaaattttatggtctcatacgtaatgaatgactttcatttaactgtgccactggttgacttttgaatacagtagacgagatttacgatacgatactgactgcctacacaggntctcctactctcatacaataatacttattatttctacgtatcctgct

SEQ ID NO: 38314 - DNA, 1066 bp, Heterodera glycines
ttgtatactcatggctttcctatcgacaaaatatgattcctaattttttttaattgtagtttatcattttttaaagaaaatccgtacaaattgagcctagtaatcccaaaaaccagcctttgataagatttcaaaaaagtgcacccaatttgtaatcagattttttgcctctcgagaatgagtaatttttgaatgaagcattcgtccagctgtttgctgctaaagcatgtttatttttcactttttctcccttcttatggttccgttacctgttcctgaagcatatgctgaaactgagcatggagttggtccacttgcggctgcagttccacctcaccagcacgcacccggttttccaaaagaatgatttcgataaaaagagcgcgcatctcaggcgttcgaataacatttcccatgtattttggtgtcccggcgagaaataaattgggtaatctatgaggaggagggatacatcatacattggaaaacaacattctatgactatgtgcttttatcacataaaggtacgaatcgggcgtaatactgtcgattcagggaattacgatttctgacatttagggatcagaattccgatttccgaaaaatttgggattccgatttctgagatttgggattggaattccgatttccgaaaaatttttggacgcgtgaattccaatttctgacaattgggacgcgtgaattccgatttctgacattagggaaatatcgtggagaacatttcaaaacgcgaaaatggaaattgacgaacaaaattcgaattagaagaaaaataggagaaaatggcacaaaggaaatgaaaattgtcaattgcgccgatcggaaagcattgccaatccctcaaaatccgttgacaaacaaagtcatcggatttagaagcattaaaattgtgtaattaaattgttgcaaatggtttctgtgccatcgtttttttgaaaaatgcgccgcagaaattgttaaaaattgattttttgatcccgaatgctctcaaatttacgatttgcaaatttcctccccaaaattgttaaaatcgataatgagaaga

SEQ ID NO: 38315 - DNA, 645 bp, Heterodera glycines
aaagtttaggcttaacttttttttcagaaacttatcagaagcgccccaaactttgcagggatactgaaaggaaaagaattaacctggttttatcacattagcttgtcatcagtttttataaaaaattttcaaaattctgagtctcctattattttatttttttttcaaaattttgaagggcgggggggggggtgtgcaaagaagaattagccaactgtaaacagcaagccatccaaatgcttcaatgtaaaaaaaaattacatttggatgcaacctttatttttcctcgcctctcttttcgaaaagaaaagctattagcaagcgtgtttggaccaattctagaacaaatcggggtaattaatttaatctgactttataagataaatgggaattgaagcgaaggattcatgcaaaataatattctatagaaattctcaaaaaagtaggtcctcgcagattcgggcaccgtttctataaagctagagacatatgcgctgaccataaaaaagatgaatcatgttttgaaaaatttatatagatcgactagatttgcaaatcaagttatggtggacaggatgtttgtcgaaacataactcgacaggactttaagaaagaccctgccatttgctattcctgcaaatatgg

SEQ ID NO: 38316 - DNA, 1109 bp, Heterodera glycines
  misc_feature (18)..(18): n is a, c, g, or t
aaatgccaatatttaatntaagaaagggaacggctgaataaacacaatgcgaatttgcgcgaatggcttatgcaatcgcacaacgaatttctgaatgaaagcgccaagttcgaggagttcgacgcggaagacataagcgactggtggaaagcatcagcaaacaaatcggaggaaacggccgttaacaaaaacttggcattggtcgcgaaaagtgtcgaagtgatcgcaggcaaattttattcaaattggaaaattaataattacaatttaaatcaattttaatttataattgtaaattagtagccattttatttagtcaaatatcttttttccattcctcattctacccttcctaatgttcttaaacgtatgagagtcattttcaagccccaaaaccctctcatgggcatggcactgccccaatgtttgtcctaattccctaaaaaatcgagaacgtttttaacaaaatggcatattttgaaatgaaaattactacaatattatcaaatggaaatttagcataaatagtaaaagatggaataaaagcctttattccgtaaggacaatgtaaagtaacattgtgaaattcctcaactcataacgggagaaggaaggatagtctggattcatatccgacagaattttgaatggaaagccaaggggaagagcttattaactaaattaagagagcgggaagaacacaaaggggccgccccaataaagaagtgccaaccaaactaataatgacaattaattatttttgctggtattccttggtaaggcagtgaatgaggcaaaaaaatcaacaaaaaaaattgtgcaattttgaattttccattattccaacaggtcataagccgcgtaacacccaattgttggccatctttctgcggatgtttgtgaagatattttgtccggaaatgcgcggtttgatgttgcaagtgtccaccggcgaaggcaaatcatggattgtcgcgatgttagcagtgattctgcatacgtttggcaagaaggagccactggctgatcagcaggaaggggctcagagtgatcaggaaaaggaaaagcatggtcatggtgaaacaagcactgatcagacggaggaggaa

SEQ ID NO: 38317 - DNA, 975 bp, Heterodera glycines
  misc_feature (40)..(40): n is a, c, g, or t
aaaaatcgatttttcagtgtccgtttggggtactcaaacnattatgggagcaaaaatccaacgcagattaaagtacaggctatagggaagctactcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacagactatagggaagctattcccgaaggattcggtctccccataaatctgggcgcatcggttcggggggactgccccgaaaacaaaaaaaatcgattttttcaagtgtccgtttgggttactcaaacatttatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggctcggggggactgccccgaaaacaaaaaaatcgattttttcaagtgtccgtttggggtactcaaacaattatggggagcaaaaatccaacgcagaattaaagtacaggctatagggaagctattacccgaaggattcggtctccccataaatctgggcgcatcggttcggggggactgccccgaaaacaaaaaaatcgattttttcaagtgtccgtttggggtactcaaacatttatggggagcaaaaatccaacgcagaattaaagtacagactatagggaagctattcccgaaggattcggtctccccataaatctaggcgcatcggttcggggggactgccccg

SEQ ID NO: 38318 - DNA, 787 bp, Heterodera glycines
ttcccccccggcccccggcgcggtcccccgaaggaatggatttaattaaattctctccttcggggatttttttccattaggtcgtccgttagcctttgaaagatatagtcaatttttcaaaatttttgttgaaatatttgtcgtcctctgaagggcgtgggaggggggggggcgaaggcccaccacgaggccgcgaagaggccgagtgagtaccttcggtgcaggaaaattattaaattttaaaaattttttaattgctttttaaatatgccaaaaaatgtaggcttaacttttttagtgaaaattcgatcactcatattttttgctaattgagcagaagcgtaccaaactttgcagggatactccccggtaaaggactaacttacactgaaatgagcgccgagctagctggctcaaaaaaattttcgaaaatctgagtctttcgtttttatttgttttttgcataattaattcataaatatttttttcagaaaatgctctgaaacgcaccaaattttatttacatgctagtttaggcactctgatgctttttctatcaaaaagggagatgaataaatttttaaaaatttttaattcctttttaaacaggccaaaaagtttaggcttatcttttttttcagaaacttatcagaagcgccccaaactttgcagggatactgaaaggaaaagaattaacctgttttatcacattagcttgtcatcagtttttataaaaaattttcaaaattctgagtctcctattattttatttatttttcaaaatttt

SEQ ID NO: 38319 - DNA, 958 bp, Heterodera glycines
  misc_feature (41)..(41): n is a, c, g, or t
  misc_feature (96)..(96): n is a, c, g, or t
tagactagaaaaaatgaaatttttgaatcatgtttccactncccttctccagggggtattatttgtaaagtctttttttcaaaataaacttttcanaaccccattttttcgcaccgtgaatgttatttttattgaattctgaaccggtttgagtagattagactagaaaaaattgaaaattttgaaatcatgtttcccactcccttctcccaggggtattattttgtaaagtctttttttccaaataaacttgtcaaaccccttttttcgcaccgtgaatgttatttttattgaattctgaaccgttttgagtagattagactagaaaaaattgaaaattttgaaatcatgtttcccactcccttctcccaggggtattattttgtaaagtctttttttccccaataaacttgtcaaaccccatttttcgcaccgtgaatgttatttttattgaattctgaaccggtttgagtagattagactagaaaaaattgaaaattttgaaatcatgtttcccactcccttctcccaggggtattattttgtaaagtcttttttccccaataaacttgtcaaaccccatttttcgcaccgtgaatgttatttttattgaattctgagccgttttgagtagattagactagaaaaaattgaaaattttgaaatcatgtttcccactcccttctcccaggggtattattttgtaaagtctttttttccccaataaacgtttcataccccatttttcgcaccgtgaatgttatttttattgaattctgaaccggtttgagtagattagactagaaaaaattgaaaattttgaaatcatgtttcccactcccttctcccaggggtattattttgtagtctttttttccccaaataaacttttcaaaccccatttttcgcaccgtgaatgttatttttattggtttctgaaccgcttttgagtagatta

SEQ ID NO: 38320 - DNA, 981 bp, Heterodera glycines
  misc_feature (25)..(25): n is a, c, g, or t
  misc_feature (38)..(38): n is a, c, g, or t
  misc_feature (914)..(915): n is a, c, g, or t
cttaaaagccgacaaaatgtcaatnggagcaatgtttncggcatgtagtgctggaattcagaaattctcgaaaactgacatcttagtgagaactgaaaacggtacggaagaattacaaaataagtccccatttgggcttaaaaggccgacaaatgtcaattggagcaatgttttcggcatgtagtgctggaatttcagaattctcgaaaactgacatcttagtgagaactgaaaacggtacggaagaattacaaaataagtccccatttgggcttaaaaggccgacaaatgtcaattggagcaatgttttcggcatgtagtgctggaatttcagaattctcgaaaactgacatcttagtgagaactgaaaacggtacggaagaattacaaaataagtccccatttgggcttaaaaggccgacaaatgtcaattggagcaatgttttcggcatgtagtgctggaatttcagaattctcgaaaactgacatcttagtgagaactgaaaacggtacggaagaattacaaaataagtccccatttgggcttaaaaggccgacaaatgtcaattggagcaatgttttcggcatgtagtgctggaatttcagaattctcgaaaactgacatcttagtgagaactgaaaacggtacggaagaattacaaaataagtccccatttgggcttaaaaggccgacaaatgtcaattggagcaatcttttcggcatgcagtgctggaatttcagaattctcgaaaaccgacatcttagtgagaactgaaaacggtacggaagaattacaaaataagtccccatttgggcttaaaaggccgacaaatgtcaattggagcaatgttttcggcatgtagtgctggaatttcagaattctcgaaaactgacatcttagtgagaactgaannacgtacgaagaaataccaaataagtccccatttgggcttaaaaggccgacaaatgtcaattggagc

SEQ ID NO: 38321 - DNA, 876 bp, Heterodera glycines
  misc_feature (12)..(12): n is a, c, g, or t
  misc_feature (45)..(45): n is a, c, g, or t
  misc_feature (125)..(126): n is a, c, g, or t
  misc_feature (141)..(141): n is a, c, g, or t
  misc_feature (174)..(174): n is a, c, g, or t
  misc_feature (197)..(197): n is a, c, g, or t
  misc_feature (268)..(271): n is a, c, g, or t
  misc_feature (298)..(299): n is a, c, g, or t
  misc_feature (313)..(313): n is a, c, g, or t
  misc_feature (316)..(317): n is a, c, g, or t
  misc_feature (319)..(322): n is a, c, g, or t
  misc_feature (325)..(330): n is a, c, g, or t
  misc_feature (333)..(333): n is a, c, g, or t
  misc_feature (336)..(336): n is a, c, g, or t
  misc_feature (339)..(339): n is a, c, g, or t
  misc_feature (341)..(344): n is a, c, g, or t
  misc_feature (351)..(353): n is a, c, g, or t
  misc_feature (370)..(371): n is a, c, g, or t
  misc_feature (385)..(387): n is a, c, g, or t
  misc_feature (393)..(393): n is a, c, g, or t
  misc_feature (447)..(455): n is a, c, g, or t
  misc_feature (476)..(477): n is a, c, g, or t
  misc_feature (612)..(612): n is a, c, g, or t
  misc_feature (614)..(614): n is a, c, g, or t
cataaaaatttngaaacaaaaaaatcattaacaaaaaaaaaacantttacggagagaaagaacggagggcggacgggcgggcggccgagccggccataaaattggacggattgaaaatgtgaaanncaaaaatgacatggnacaaaaaagggcgggagaaatgtgagtgatggngggctgccccacattttatgggncataataataatatataaaaatggataaatcgggtggtagtttctgtttcctgtgtggcggcacatcccannnnaaaaaatttgaaaaatttcgaaaaaanncagactatgtctgntgnnannnntannnnnntantanccncnnnnctataannncctaaaaaggggaaacnnataaaaaatttttnnntttttngtgtttttttttttctcccccccccccccccccaaaaaatgtgctctctttagnnnnnnnnncggggggggccccctaaaaanntttagaaaagaggggggggggagaaaaaaaaaataaaaataatacttaaaaaaaaaagtttttttttttaaaaaaaaaaaacccccccggaaaaaaaaaaaaaaaaaaaaaagaggccccccccccccccccccnanaaaaaataatttattaaaacaaaaaaaaaaaatttttttttttttttttgtgggcccccccccccccccccccgccaaaaaattttttttttttttttttttcctccccccccccaaaaaaaaaaaaaaaaaaaaaaaaaaaatattaattttttttttttttataaaaaaaaaaaaaaccccgggggttttttttttttttttttttttttttttttttgcaaaaaaaaaaaaaaaaaaaaaacacccccccccccccccc

SEQ ID NO: 38322 - DNA, 247 bp, Heterodera glycines
tgttttacttgcctgttgcacttcctcatgtattccgtcatttcctcatattataatgtatgtcatcaccgtgaaaccataaccaccgccattagtttgttgccggtactgggacacggcccctacaaatttgccactaacagatgaccgagtgccattatcgtggacattggcacactcccttcctctcccattgttaccgcaatggctggactcgcttcttgggcctttgcttttggcttaatta

SEQ ID NO: 38323 - DNA, 1017 bp, Heterodera glycines
taattagagatcggaaaagagggtcggtctgtcggtttcggataaaacccgaaaaaaccgaaaccgaaaactcaaaaaattctcggtcggtcggttttggttaaaaaaaccgaaaaaacctaagaaaaattttcggtttatttcggttttttgattttgtttattctttttcccaaaaaagcaataaaccattaaatgctctttaatatttatattaaattgttgggagattaaaggaattttttttgctttttctgcagggctacaaagtctactgatttttcagatttgtcctgaatttgagggtacctatctgaaaaatcaaaaaatgtcatgaattttcagattgtcctgaatttagaggtctccgagaaaagtctaaaaagggcgatacgttgtaataaaattcattaaaaataccaaaaattttcccggcggcgcctatcggcacaaccagaacctaaaaatgctatttttatttattttttacattacttgagatttcgttgaatttgctcattttgttgtttggcaaactgttcgcatgtcaaaattttgtgctcttccacccattttgcattgtatttgcgacacatttcgtaatggcactcggggcaatgaaatttcaatttatcatttggctcaataacggtttgttcattattggggtaattgtcagtgaaagcaattggaccatccatctcaacagcacaattgcatttagggcatcttaactagttgttaaattaattaattaattgcgtatctgactctccagtgttttaatagcctcgagctcatcgggtaacacaaattgtaattcttcttaattaaaaaaaataatttaataagcaataattcattatattacgccatggaatgtgattcttaaataattgattaattattattaaatggcatttttcgtttaattgctatgcttttttgtgcattgtttgagctgttaccaaaaattgcttcgcccattaaatgatcacagaaacagagctgatcata

SEQ ID NO: 38324 - DNA, 162 bp, Heterodera glycines
cttcgcgcacgcgtttgttttcgcgaggggccgaccagcggtatcagctcgcgtatgtttcgctgactcaagcggacaacgatgaagaagatccttccacggcacaattcctcgagcaaaatgccgtccatgatgacaggaagccgcttctgcccgcgggca

SEQ ID NO: 38325 - DNA, 1020 bp, Heterodera glycines
ctttatgatcatttttgtctaattcgcaatacagctcattcttcgcgaaatataaactgaatcagtgtttgcggaatgaccgagctgataatcgccaataatcttcgattacaattttctttgtcacctttttggaattccaccatttcaactccttatcctctaaatataaactgaatcagtgtttgcggaggaccgagctgataagtcccaataatctccaatttacaattttcatgatcacttttgtgatattctcaatatttcaatttcttatatccaaatgtaatctgtataagtttacagtaggaaattgtaatttgggggttattggcgatttcaaatcgatccttccggaacactgatgctgtttatatttagagcgtaatgagctgaaaatgtcagaattcaaaaagtggcgtcgcgaaaatagtaaatctgaggttattggcgcttatcaacctgatccgtctgcaacacttaaacagtttatatttaaagcctaattagcagaatgtgaaattctctcatttgttactttatgatcatttttgtctaattcgcaaaattacagctcattcttcgcgaaatataaactgaatcagtgtttgcggaatgaccgagctgataatcgccaataatcttcgattacaattttctttgtcacctttttggaattccaccatttcaactccttatcctctaaatataaactgaatcagtgtttgcggaggaccgagctgataagtcccaataatctccaatttacaattttcatgatcacttttgtgatattctcaatatttcaatttcttatatccaaatgtaatctgtataagtttacagtaggaaattgtaatttgggggttattggcgatttcaaatcgatccttccggaacactgatgctgtttatatttagagcgtaatgagctgaaaatgtcagaattcaaaaagtggcgtcgcgaaaatagtaaatctgaggttattggcgcttatcaacctgatccgtctgcaacac

SEQ ID NO: 38326 - DNA, 1043 bp, Heterodera glycines
aatggctatttttaatttgtttattctagggaagaccttggtcatcgaacaatcctggggcagtccgaagattaccattgacggtgtcactgttgcaaaggccattgacttcaaggacaaattccaaaacatgggcgccaaacttgttcaggtttttgttttgaatgcattgatttatagataaattggattgacagatttttcatgttattcggtgtaacaaatcattcatcgtttttaactcaggacgtggcaaacaagacaaatgaggaagctggtgacggaacgacttgtgccactgtgttggcacgtgccatcgcaaaggaaggcttcgagaacatctccaaaggttttgactctaagactatcattagaatcggaagaagaaaaaatagaaaccgattggtttctcgttcccgtttttcattgcaaaagtgttagtcgagtcaaatatggcccataaaagccactcaacacgtgtccataaacttcgttgctaaggtgctaatccggtggaggtgcgcaagggactgatgaacgcagtggacgaattggtcaaggaactgaaggcaatgagcaaaacagtgacaactcccgaagaaatcgctcaagtggccactattgcagcgaacggagacaaaaccatcggaaaactgatctcggatgcgatgaagaaggtcattgaaatagcacattgtctgatttaacaattttttgcttaggtcggaaacaagggtgtcatcacggtgaaggacggcaagacgttgttggacgagttggagttgattgaagggatgaagttcgaccggggttacatttcgccatacttcatcaactcggccaagggtgccaaagtggagtttgagaagtgcttgattctgttcagtgagaagaaaatcagccaaatccaggtgaataatggggtggttgttggtggtggctcgcattttttgacatggtaactaaagcgtgttttcctggggttctcttaccatgaattacatacatattcggacaactcctgaccttgaatctaatttgat

SEQ ID NO: 38327 - DNA, 1480 bp, Heterodera glycines
  misc_feature (794)..(794): n is a, c, g, or t
  misc_feature (1465)..(1465): n is a, c, g, or t
tatgtatatatatatatatatatatatatatatatatatatatatatatatatatatatatatatatatatccatgaacaaatgtaatccgtttatgaactaataaattttttgtgtccatttaaggactcattataccaacaagttgctgatcaaaaatataaaggcctaacattccccggctttggagaaatatttaaacgaacacgctttttcttgatcaattcacaacctgacttggattttaatcaatttgacatagtcaacgatgttgaaaaagtcaaatttattggtggattcaatttgaaaccaattcctaacgcagaggttaatttttataattttaaaagtagtttttggcacaaaaaaatttaggcttaaaagtgaaaattaatattcttttaaaaatattttaatttatcttttcattttttgaaaaaaaaatatttaaaaaaatatttttataactattattttaaactgttccactaaaataaaacaataataaaatttttaataattttataattaaaatgataaatttttttcaatttaagttcaaatatccatacaatttggactcaaaaaaaggcgttgttttggtcagttttggcactgttgtcaacacaacaatggtacaatcttcgactataattgaagcaattgccgagacgatcaaaaaatttcccaattttctttttatttggaaattaagtcaagggcacccgaacaaaacatttgtaggattaaaaaatgtgattacagaactttgggttgatcagaagaacatattngggtaaaatattaagaaaaattaaacaaatttatttatataaatttatattgttttacatatctcttaaaaatttaaattctctaaattcatttttattaaactttaaaaagcttttatttaagaacttaaaaaaaactttatttaaaattcctattatattaatagaattgttttttatttaaatttattaattatttcaaaatttttaattagtttggaaatataacaaaatgatattgaaggaagtatttaaaactttttttaaaatattttcgaaatattaagattagttgaaaatatttgtggattttacaaaataatctataatttctttatggcaaatcaaaaaacttgaaccatgttacagaacattacactaaaaagattttgtatatattaaatggggcataaaaatgctttactcttttaaacaattttaattaattttagcaaatccaaaaacggtggcatttgtgtcttattgtgggatgaacagtgtgttggagggcatttacaatggtgtgccgatggtttgtgtgccattctttggtgaccaattttacaacgccgaatcattggcacgccaaaacattggcctggtgggtgaccgtgaacaggacaagaaagctgtacaacagcagcttactgtagcactggcccaagcattgngacaaacgaattgct

SEQ ID NO: 38328 - DNA, 1272 bp, Heterodera glycines
taggagttatgacgcctcgtggcctccgctaaagcgctcatagtcgccctcgcatcgtatttccgatccaattgaaacatgagaagaacctttgcctgtagtacaaacatctcttgtacaacacatttgtggacgtccaaaatgcgtccaacagcacagggctttttttggccccttttaatttggccgtaactgctgcatcgatttcccaaattttggtcaaattcacaaacttacgtttttcctgtacaaaatgttcaaaagtcaccacaatattgtcttttccgctttccaagacgaacaacgccgtatgaatggtgaactcctccatctctgcttttgcttttagcagtgctccggacacagctgccgcaattccatgttcacatagcttcaaatcagtgcttgtcgaaaaggggaactcataaccaataaccaaaccactaatccccgtgccaatgcatggttggtgaacgaccaattctctttcagaaaccccctcaaaatcggctggtgtgatgtaaatgcccttaggaccaatggcaatgtcggaagggcgatggatgcgcacgaacgtgacatttataagtactccaggcttaattttggccaaatcaattgtgctgtccagctgatgttgatacagtcgctggagaacttgactctcggggaaggccacgtccaccgcctttggcacatccttctgttctttcaccatgctcatgacaatccctatgcacttttccaaagaattttgaagaacagatgagactgtcatggcctcggcgtcggcattaatcctaaatgcattagagagccaaacggaaaagcgctcgattggggcgtaacttgtgacaaacacgatgtcaccaagtctgagctgtgcacccagctcgaacgactcaggaattccgataatatccggacccttcatctttccgccaaaccgaattgcaatgaccattttgtccgttatttgacaaataaccattttccgtccacttccttcgtcatccccctcattttcaatatctttaccgttttcgtcttcactcagatttcggtgtctcttgcctaaggggtttttctccgtaaacacttcaattccatcttggtccacttccaacacataattaactccttggctcctctggtcactctcaacaacatccatgacagacggaccgaggtccgtatttgtttcctcttcgcacttctctccctcatttttcatctctttcatgatcatttgcccaactgattctttcattt

SEQ ID NO: 38329 - DNA, 1242 bp, Heterodera glycines
  misc_feature (1157)..(1157): n is a, c, g, or t
tatgaaatcgaactcagacattttttactggttattgagcatacgttttggcaaaccaattccaaagggcatccaagccacaaaggaggattaatttcgtcataattaattacttttaaataataaaaataaatttacccggcattgcgttatagtcctgtcgcttttgccgcaaaaagatgtcgttctttgtgggattttcgcgtgctctggatggtggcgtaacactgatttgcacctccatcagttcagtccatgccgtgtcagtgttcaaacgaaaagccttaaaataaaatgaattttattaaatttattttaaaaataattgaaataatttacctgaactccgtcaaacacacgcattttcacctcatttatttgtatgtttaatgtttgcatcatcacaactgttgcaatgatggcaccaattgagcacagcgatgcaaatccgatcagaaactttgcctcacccattgaataagcgtccacaaaaattgaataaaccctttaaaattgaatttaaatattggcaaattctgattattgtcactaatgagtcatcattaagctattcaattaatttcataattaaaatgataaaaatataatgagatttcacgaaaaaatgcccggataatcaaccaatgatcagatttctgattttggctgaatccaggatttggtcaaatgggatttgatcgtttttgttgaaaagaaacaatttggccagagatttttctagtcgagatgtttttgaaacattcattttttgataaaccccaattttgaaagataaaataaggccccaaaaattcctagatcaatcaaatagtttaactatcccggaaatgcttctcccgacaattactccccccccccgccccaaaccgaatgaatgaatgattggaaattccgatcaaacaatttttgcttaactaaatctgattagaatggactgatgaagccatgtgttgtatgtatatattgaaacatttatgtacaacaaagtgcttttataatcgccaaaatcctcctttacctcttcgtttgatcgccggccgacgtcgccgctgccgccgccggcgtcgatgattagattaagtggatttagcaaaaacaaatagtaattccattaaaacggcttcatattttagtcncaagagcagcagcagcagcagaaagctgtccaacacacacacacacacataagaacaaataataatattcacaaaaaaagtgtca

SEQ ID NO: 38330 - DNA, 400 bp, Heterodera glycines
  misc_feature (358)..(358): n is a, c, g, or t
aactgattcaggtcattgtccgaatttgtataattgcggaaacaatgatttattcgctgttctgtcgaccaaatgtcccccccccttccgccatttcgtatcatttccaaatgtccacccgcgccgcgccgttcggtggggcggaaaaaaaacaaacgacgaaagggaaagaagagaaaagggacaaaaggaaaaagagggaaaagagagaaaagagaggggggggggggagaaaaacattttgaaaaggtatcgaaatcagatcatttgaactccttagtaaaacaaatcaaattaaaattactgaagtggaaaatggagagaaaaacgcaaaaaaagaaaaagggagggaaagtgnagagatgccccaccgcctgccctccccccgcaactaccccca

SEQ ID NO: 38331 - DNA, 678 bp, Heterodera glycines
ccttggtttttctgatctgagtttttttgttccagaaaatacctccaaaatgtcaacatggaaatcaaaagcaaaatccaatcggcccttttcaaagaatcgaactctgagtttcacaaaaagtaataattttgaaacctttaagaaaaaacaaattcacaaatactttcgcttttctttttgcaattaattaataaatacattttcatttcacttttaattttgccgttctctcctccgtttttccccttttcttttgccaattcatccgaacgaatttaataaatgtggcaaaggcaaaaatggcacaataaacagacaatgaatgaattggacggatgaacttttcagcggatgtcccatttttttaaattgaaattaaataattttccattaaaatatttggaaatttttttccgtcttccaaagggtccactggcgtttcggcgccggcgtttcggcgccagcatgtttttggctataacttttttctatctaatccaaatccaacattgttgatataattcgaaagcttaacatgtttagaagctttttctaagcgattgcttcgcgattagacaattaccaaaaaagttatacatgaaaatttcgaaaagtcgaaattttcgaagttttttcttaataaaattttttacaggcttgaaaatctatccgctt

SEQ ID NO: 38332 - DNA, 500 bp, Heterodera glycines
ttttgcgatattgtggctggaaaaaagatgccatttcgctatggggagcgcggccgtctgggttcaagtgcttgcttgcgcttgtgctcggcattgaacggtgatggctgctgctggggtgccacctttgtcgtggcctcagtttctccagcgattggcagctgtcgaaatgaataaaacatgcagctcgtctgtgtgttaaagaaatttggcgagttaattgacttgtgtaaatgtggcctaaggcacaaatgctgtggggaactcagcactggggatgctgaacctaaagttggtggtggtgttggtatacgagtgagtggcgtattgccatggttgacaagccctatgagttcgtggatcggaactccttgcctggggaccagtgtgcttgcattcgaaaaaacacgagacataagcgcccgaaggcctttggcctgaggaagtgcctaaccgggaatccggagtgtcgtgtgagtgctgtgcactgcctcggagct

SEQ ID NO: 38333 - DNA, 841 bp, Heterodera glycines
cttattcgtgtgggtctaggattaggaaatgggttatataaaggtcgtattcttactcagtgaccccgaaaaccctaaattagacccgttttccgggtttttatgagctttttacacttttggacatttcgtggttttttactcttttggacatttcgtggcttggacaattcgtggcttggacatttcgtggcttggacatttcgtggcttggacactttgtggggatgccgagaattcaaagaaacataaacagcgagtaggacagagtaaataaaataacacaaattattcggagggaaaaggaacagacattaatgagagagtgtatctttctcccttttcctttttttcccattttttataggagggggtctgatgaaagaaaaaaatttggagaaaaataataatttaaattctgtctttgtcaccatccccacatagaataaatttcaatatatttcttaaaatatttttttatttaaattaaaattttataagttttcattccatccaaaaataaaataattcctttttaaaaggcagcatctacaggcaccgccgaaaccaaaattcggcaaatttgaaaaatttcgctcaataaatccataattgacaaaatattttaacaaatcacaactaaatttaaaaaacttatttgtatctagcagggatggcattttgattcgccaaaataattttttggaagtcggaaatcgaaatcggaaaatttttgaattcgtgcgtttcagaccataggaagcacgggtgtgcgaaattttgtgtcgttttcgtgtcgtccccttttttcgtcactttatgagtttcgttttcgtgtttt

SEQ ID NO: 38334 - DNA, 664 bp, Heterodera glycines
  misc_feature (558)..(558): n is a, c, g, or t
  misc_feature (622)..(622): n is a, c, g, or t
  misc_feature (640)..(640): n is a, c, g, or t
ccagaattctaaaaaattttggttttcatatctttaagatggccaaaaatcctaaattgttagaagaacttggtgcaaatttatgtaacaccctaattatatatttaaataaactttatttgctttaaccaaatatttagacattcccctacgaaaatcactgaagcttaaaatctactcaatccgtttattcgtattttgaaatgaacaaataaagtttccgaataaaggaaacattgaaaattttcctaaacatatttttagatttttgtaaatgaggattctaaataaagcctattaccataaattagaaaaaaaaccgaaataaatctcaaaaaataatttaaacttaaaagaagcaattcattaatataattaattccaaaattagtctacaagtctataaaagaaattttattaaattaaataatggacagttagctgacaagtgtcgtactccgggtttgagtgcgggtgtgggcgcggtggagtccgacaattgcctgcacttgggtgcaggacttcgacaatttggggggagagcacaaagggggcggnggcgatcgagacgggactacggtcggattgggccgcaaaaagaatcacagaaaattaccaccanattttatctcaaacttgngtaattaaccaaatgggtgagcaa

SEQ ID NO: 38335 - DNA, 1051 bp, Heterodera glycines
  misc_feature (11)..(11): n is a, c, g, or t
  misc_feature (135)..(135): n is a, c, g, or t
attggaatgcngaagggttgctgagtttgaatcaaagtaaggaatgccggagaattgaatcccggcgattgggatgcagaagtggtgagatagaattccaatgattgtatgccagaggattgggtctcagtgatngtaatgctaatgaatcaaattgggatgtcggggggttgagtccatgtgatagaaatgcagatgagtcccagtgattggaatgccgagggtgtttaagaaatgacaagatatgtacaaagagatcagtagaatgttaaaattttgtgctataaattgccaagagaaggttgcgatgccgcgaagcggccgagccatagtcggttttatcattcataattctacattgaacacataaaatcacgacccttccgatgaaatattcaatcaaaaacttgcataaacaatgcgcctacaattcgcctggtaaagcattacataaagactaaaaattaaaataaattactgcatgcgtaataaatatttatttttttataaactacttgccgaatacgagttcgcatccctcgaaattcttatttggctgagttgacgaatcgtcacattttggctgggttgacgaatcgttggcgcgcccatcaatataatttaacctcaactggattttggtgttaataaataaaatatttaaaaatttagtcaattttcaaaaatgtattaaaataaacatttattatcaacaaattattgtaatttaagaaggaggagcaatgtttgaaactttcaattagcgggtgacagaagctttcgtcgataatattttttgataaaatttttaaaaggccttacgatggttttctttggtgattaattttaaaatgctgaaatttgtgaaaaaactgagcatttaggcttcttaaactaaaataaaagcataaattttccaaaaaatcagaaaactcaaggaatattgggcgagaccaggatcaagataaccgggaaaatcccgaagggatcccaccaattttggcttgggtcgcaaaaactcacataatttaggaacgcaaatttcaggaaa

SEQ ID NO: 38336 - DNA, 939 bp, Heterodera glycines
ctcctcttttcttcccctccttccccacctgctgcttcttcttccatgttccaccaatttcccttcccccattttctgctccattttctctcccctttccctccctccgtctctctttctctgcgtgttccttcggccactttttcctttttctgttttcccttcccttcgccgtttttttttgccattgcgtcgtttcgattatcaaaattgggcacttatttggcgctcacttagcggaaccaaaaccgcctttttgaccacaaaaaatttaatttgttctcaccctttttcggcattaaaatttaggaaaataaaaataatttttttgtttttgtacgtttcgccaatttttggcattcgtttttaaaccatcaaatggttcctttttctatggctttccaatggcattttttgccctaataacctctttgtccaaaactcttggtaattttgagcttttaaatgcgtgatccgcgatgcgcgattctcggcaatttttttgcgcgaccgcggcatttttctatccgcgcaccatccctgcttcacacaataattaaattttttggaaataataattttaatataaaaaatatttatataatttttattgttgagaattttttttccgttattcccacaatattttgcataattcactatttatagtgtccgatgccaaactgctgtctggactatgatggccggctttttcaggatcatattccaaaatactggtggtttttgtgggtccaccggtttcccggcttccggatttttcctgattatcttggaaaatcgcatcagcaaaaaattcttaaatttccaggatttttttttggtttcggattttccggatgccctgatttttagaatttatgggaatatccagcagatcttgattgagcttaatcggcactttaatttcttaaaaattta

SEQ ID NO: 38337 - DNA, 906 bp, Heterodera glycines
  misc_feature (801)..(801): n is a, c, g, or t
  misc_feature (812)..(812): n is a, c, g, or t
  misc_feature (844)..(844): n is a, c, g, or t
  misc_feature (849)..(849): n is a, c, g, or t
  misc_feature (893)..(894): n is a, c, g, or t
actaaaaatccctcaaatatgccctaaaaaccggaaaaatgcccaaatatgcactaaaatatgcttaaaaattacccaaaatggcttttaactctcaataaaatgccaaaaattgtgtgtaaattaagaattgactttgaaaagaccaaaacaagggataaggagcatttttaaattgcaaaattattgaatttttaaatttttattatatgctaaaacaaaattacattttttatataaataatttttttcaaaagttcatacaaaaagctcaatattttacggtttttggtgtgtattttctaaaaaattttaaaaagtcgatcattaggagtttatttttcgctttttttgcatttttcttgtgaaaatttacaaaaaatgatcaaatatgctttaaaatcctaaaaatggcaaaatatgcatttattctcaaaaacaccaaaatatgcttttatatgcactaaaaaccttaaccaaatctaaaaattttaacttagaaatgctatttttgagcccctttcttgatagcatatgcgcagaaaaaataagcaaaatcatacaacttcgaaccctagttatcagtactgtaggactcttaaagcttgctctgttattttgcactttgtcatatgcagtttattttgatttataaaaataaaatattcttaaaaatttaattttcttatatatttttccccaaaaattgtcagaaaatgtctggttcttgggttcatgttaagtcccgttcaccggttaaaaaaaaattcgtacttataaggtccttagggactcaattanaaaggagttanaaaccaaactttgattgctaattttttaatanataanattaatattttccctatttagctctctgaaaatattcgaattgnncagcagctaatt

SEQ ID NO: 38338 - DNA, 1132 bp, Heterodera glycines
gatttcaattttgttcaaactttgtttaagttctaatcaatttgggagccttgaatttaatatattcctgccatcattgtttaaaaaaatttcacgcgattttgttagataaatgtgaattttgatcagaaataaatgaatgaaattttaaattcaatttccgtaaaaaattttccgtttcgcgtcgggagttttcgttaacgggaacaggaaaaatacagaaacccttttccgttccgctttttagatattccagttttttaaattcatattgaaggacacttctgtatgcatttctaaattttttttacctcaagtgtcattcgttccttatacataatttcttcttcatccagcaccgtccataaatctcggtctttttcaaacagcgacggtggtggaagcccgtcgcgcattcgttggatacgccgtcccaaatcggcagtcctctggccaccgcgaattgccatgaaaagttcgtattcctctctagagtcgaaaagttcaggttgaaggagcgaaaattctcggctcatttttagaaattttagcttgactaaatatataaatgcaatttaatttgattttgaaaaattaaaaaaaatacaaaataagcattcacgatttaatattcaaaactaaatatgatcccgaagcctgtaaaacaaggatttttgtgggggattcagcccggatttactctttaaaattaataaaagaaaattgaaggacaaccaaaaaaaaacttaaaaattgctaattatgaaagaaaatggaaggacaacaaaaaataaataattaaaattgtaattaatgttcagttttaaagtatgaaaagttggttgtgaattgttcctttctaaaatagttttctaaggaaaattgacaagttattcctgagcaaaatgtcttacagatttttgtaattttgttgcaaaaaacccatccaaaagttttattaagaaaaatgttaaaattttataattttcataaagtttgctaattaatatttcattgtgcaatagcttagaaaaagtttctaaacatgttaagctttcaaatgataccaagtttattggacttggatgacaaagaaaaagttatagaatgttatagtggaaaacatgctggg

SEQ ID NO: 38339 - DNA, 1063 bp, Heterodera glycines
  misc_feature (5)..(6): n is a, c, g, or t
  misc_feature (16)..(16): n is a, c, g, or t
  misc_feature (27)..(27): n is a, c, g, or t
tctanngagtcttgtnacatttgtaanttccgttttgcaccacacaaaacatccttacattataattactttattttttattctactttcttcttctgtcactctttcgtcgttaaattatcggtccatcacgaacaggctcataaactctgattggagttacaaaaaaataattggattcataaagtgttattgagactcataaatatttgatttgactcataaagtgcaatagagcctgtaattcgaactaaaatatttaattgaattatttcatgtagtttacattgttttatatttttttacaacaattttattaaataaaatttttgataatatttataaaataaatagtggaaataaggatgatgaatggaaatgttaagatgctaattggaaaaaacaataaaaccatgatttatttgaatatgatcagcggaaagcataatatagcagtttcttttattttcgcttcattttgtgatattttctccattttttgccccatttttaatttcttcgcttttcatttctcttctcctaaaaacttattttataaaaatatttcttttgcaaaaaattgttaccattttgcccttctgttttggaaccaaatctgaaagaaaaagcattttgtaaaatttatatccgattaattttaattttctaaattaattttgtgggagttacaagaattcgatcttcgtcgagcccagttttaagtgccaattcgtcccgctgtaacatgtccgggtaatgggaacagctgaataccatttccatttgccctgacatataattttaacaactataattaattaggtaatttaacttatttttaccaattatttttaataattaattaggtaattatttaacttatttttaccaattatattttataattaattaggtaattaaatttatttttaccaattattttttataattaattaggtaatttatttttaccaaattattttttataattaattaggtaattaaatttatttaaagcaattattttttatagttaattaggtaatttatttttagacctgca

SEQ ID NO: 38340 - DNA, 895 bp, Heterodera glycines
tggtcagttggttgtgttcttggttctgttcctttttttgcattggatcaattcccctccaagagttgtttctcttttaattttcgacaacctggatttttcctggacctggattttcctggatttttgtccaggaaatccaggtccaggcaaaacaggaaaaaacctggattttcctggacgaaattttagaatttattttttcaagtgaccgatgttttttcaagttttcaaaaacagattaaataaatttaaaaacacattattactattaattagatatttttagatgcttctagcaaataattgattttttcaagcatttgtttgccttttaaaacaaatttcaaaaaatccaggtccaggcctggatccaggtctcgaggagcctggatttttcctggacctggattttcctggatttttgtccaggtccaggtccaaaatggaatccaggtccaggtccaggcttttttcaaaataccgatctctataaatttatattttcttttagattttttaaatgaagaatcaaatatttcatacacactataaatttatattttcttttagattttttaaatgaagaatcaaatatttcatacacacgtaaaaaaaatcaatattttaaaaattatggtgtagaagtaaatcttttaataaataaaatttggttaaattttaaaactttaaaactgttaagaaaactaaaaaattgtgaaattttgtagaataattttcttacaaaatcaccccaaaattgcgaattatgtacgaaaaagtgcccaaacgtctaaatatatagaaaataatgtatatatggtaatacatatgtatataatagataaaatcctgaaaaatagcatatgcttgtttttctgcatgggacttttta

SEQ ID NO: 38341 - DNA, 1321 bp, Heterodera glycines
ctttgcatttattcgcttttccttttgtccaaacccatcgaccaacagaagttgccttattaaattaatgggtgccaaaaataacggcgacagcaatttgaaacggcgcactcggctgatcatcgacttggcctaccgatcggcacttcttttattgctggccaatcagcggcacttggcacgaacaacattcagtaaaattcagtaaaaatatgcagaaatatgtcagaaacatttaaaatcgaaatttatttccttttttacttcgatgcttttcattccgtcaattgcttttgcttctttttccgtccgtttcccttttcatttttcgatgctttcgcactttctcaggttggcccagggcgcgcattccctttgaggacgacccgcggctgctggtcgacccggaccaagcggttgcactgaacaacgcccgcatggacctgcaggtacgcacctgcgtccgcttagttccgcgtcgtgccgaggcggattatgtgttcttcagcgacctcggcccgcacattgagtgagctttaggcattttaaatttgaaatcattaattggtcttgatcaactcattattatttatcgtttcgatttattataaagccaatttgtgctgcttcagatgctggaatatgttcgaaccgttcccgccgaaagggcgaattctggtcaatgccggtacttcctgccttgagccgatgcgccgtccccaccggccacggcgcgtattcagcgattgtgagttgatttttaatatgtttgaatgtcactgtttctacacaatgccaacacattggttcaggtgacattgagtacattaaccatttgtacaattgcccacggcggagaaagtcttcgcccatttgcccagcggggcgactaattatggcaaaaccgatggaactgcgccagctgcagcaccacacaacgccaatggcagaggaccaggaggaattggacatgacgagcacaaacccaatgccaaccacaacgatgacaaagacaacgacgatagagatggaagaggtggaggatgaagagggagggggagaggcacaggaagaggaagaggaggtgaaagagcagggcgagcgagagggcgacggggaggaagggacggaaaacatcacgcctgggacggagacagagacagagagagagacagagacggatggagagagggagagagaggacggcaagggaaaaggggacacgggcggagcagcagccgaacaatccgcagaatgggccgaggtgaataaaggcgaatatgggggagggggaagggaacgtattggggaaatgaaagat

SEQ ID NO: 38342 - DNA, 995 bp, Heterodera glycines
atttcctactgtaaacttatacagattacattttggatataagaaattgaaatattgagaatatcacaaaagtgatcatgaaaattgtaaattggagattattgggacttatcagctcggtcctccgcaaacactgattcagtttatatttagaggataaggagttgaaatggtggaattccaaaaaggtgaccaagaaaattgtaatcgaagattattggcgattatcagctcggtcattccgcaaacactgattcagtttatatttcgcgaagaatgagctgtaattttgcgaattagacaaaaatgatcataaagtaacaaatgagagaatttcacattctgctaattaggctttaaatataaactgtttaagtgttgcagacggatcaggttgataagcgccaataacctcagatttactattttcgcgaccccactttttgaattctgacattttcagctcattacgctctaaatataaacagcatcagtgttccggaaggatcgatttgaaatcgccaataacccccaaattacaatttcctactgtaaacttatacagattacatttggatataagaaattgaaatattgagaatatcacaaaagtgatcatgaaaattgtaaattggagattattgggacttatcagctcggtcctccgcaaacactgattcagtttatatttagaggataaggagttgaaatggtggaattccaaaaaggtgaccaagaaaattgtaatcgaagattattggcgattatcagctcggtcattccgcaaacactgattcagtttatatttcgcgaagaatgagctgtaattttgcgaattagacaaaaatgatcataaagtaacaaatgagagaatttcacattctgctaattaggctttaaatataaactgttttaagtgttgcagacggatcaggttgataagcgccaataacctcagatttactatttttccgccccccactttttgaattctg

SEQ ID NO: 38343 - DNA, 849 bp, Heterodera glycines
  misc_feature (840)..(840): n is a, c, g, or t
tttttacatcatcttgatgctcactggcggcggtggagtggcgagatgagcgaaattgcgtctggtgttttacgccagcaactggatttgattgccacgcgcactggggaaaataaatggctgacgcgtgagcaaacctctggcgtgcagcaacaaatccgccaggctttgtcggcgttgccgttgccggttaaccgactggaagaattcgataactgccgtgaggcgtggcgtaaatgtcaggcctggttgaaagatattgaaagcgctcggttgcagcataaccaggcgtataccgaagccatgcttaccgagtatgcggattttttccgccaggtcgagtcttcaccgctgaatccggcgcaggcccgggcagtcgttaatggcgagcattctctgttagtgctggcaggtgcaggaagcggaaaaacgtcggtgctggtggcccgtgcaggctggttgctggcgcgtggtgaagcgtcccctgagcaaattttattgctggcgtttggtcgcaaagccgctgaagagatggacgagcggattcgcgaacggctacataccgaagacattaccgcacgcacgtttcatgcgctggcgctgcatattattcagcagggcagcaaaaaagttccgatagtcagcaaactggaaaatgataccgctgcccgtcatgaactctttattgctgagtggcgcaagcaatgcagcgaaaagaaagcgcaggcgaagggctggcggcaatggctgacggaagaaattgcagtggtcagtgccagaaggtacttctgggatgatgaaaaattacagcgtcgccttgcctctcgcctcgatgcctgngtaagtctg

SEQ ID NO: 38344 - DNA, 893 bp, Heterodera glycines
tttgagggttcaagaaatattttcaaatatttctccttagcggtcattttatttggtagtccacagtcggaattatttacggtacgtcgcctaaaatattccaatagaaaactgaagattcaataaatttgagagttcaaaaaatattttcgaatatttctccttagcggtcattttatttggtagtccacagtcggaattatttacggtacgtcgcctaaaatattccaatagaaaactgaagattcaataaatttgagagttcaaaaaatattttcgaacatttctccttagcggtcattttatttggtagtccacagtcggaattatttccgataggtcgtctaaaatattccaatagaaaactgaagattcaataaatttgagagttcaagaaatattttcgaatatttctccttagcggtcattttatttggtagtccacagtcggaattatttacgggacgtcgcctaaaatattccaatagaaaactgaagattcaataaatttgagagttcaataaatattttcgaatatttctccttagcggtcattttatttggtagtacacagtcggaattatttacggtacgtcgcctaaaatattccaatagaaaactgaagattcaataaatttgagagttcaaaaaatattttcgaacatttctccttagcggtcattttatttggtagtccacagtcggaattgtttacggtacgtcgcctaaaatattccaatagaaaactgaagatttaataaatttgagagttcaagaaatattttcgaacatttctccttagcggtcattttatttggtagtccacagtcggaattgtttacggtacgtcgcctaaaatattccaatagaaaactgaagatttaataatttga

SEQ ID NO: 38345 - DNA, 614 bp, Heterodera glycines
cgcgaaaacgacggcgcgaaaacgtcaacgcgaaaacgacggcgcgaaaacgacggcgcgaaaacgtcaacgcgaaaacgacggcgcgaaaacgaccccgaccgaatttttagctaggcgacattttgactcattttagcttgggcgacatttcgacgcggcgacattatgacgggcagcggattcaaactctgttaacaaattggtccaaattgttttggaacaaaatattctttgatgttgaacgtttatacatatgaaagaaaaaaaattttcttttttactattagttttactttttactcgtaaaaacaaaagcttgcttttaacagcaaatgtgcaaaataaatccggtgctatggacgaagtacgacaaaatgcaaatgattaaaatgaaatggaattaaaataataaaataataataattcacgattattaataaacaaatattttaatgggttcaataatcttagcgttcatcagatgtatcacttatttcaaatgcaccgtctccgacgattaaattttcccgcgcttttaaaatgctacaatttgaattacgttccatattacagcctccttcgtagcgcgaattcgcagaaatgaagttgca

SEQ ID NO: 38346 - DNA, 1263 bp, Heterodera glycines
  misc_feature (245)..(245): n is a, c, g, or t
aaaattaataattaaaatatttatttttcgactttccccacccggtgtgtcgcctttgcccgttttgcgcgattttctccagctaaattaaaaaaatatttttccaaatgcgaagcactgaccataaggaacagtcgcattcgctccacttgctgaagtttgctcagcttctccaactccaattggtgctccaaaatgattgagtcccctcggggcctaaataattttaatttaattattatttntaattggcattttcgcttttcctccgccaacctccaagtgccaagattctcttcgcctcgcacatctgtggaaaatgaaagaatgaaccgatggctcttttttgttagctgtcttcccacatgttgacgatgtgtccaaaattcgccgctttctccgtgccgtgccgggactgttgttcgcctcactgtcctccattacggtgagaaggtaaacaccgggcacacggttcatttctgaaggcatcgaaaagcggtgcattgcaagcagaagaaggcaaaatgttaaaaataggcatttttggcattggaaagtccgacaaaaaaagggggcgatgacggcacgtcaaaaaacccaaaaatttcaaatgcttggtaggccaattgttgccatttttgtcgcccatttacccgcgctttttgagattccgccgatcagtgaccggcaaaatctgctggccgcactgatcttcgagtcccgtgcgtacacaatcagacccaaatctttggtgataattgccgactgcgcacaattttcaatttccatatacgcctaaacaattaataaaatgaataaattaattgaattattaaattgaattgaattcggtaccgaaattgtcatgtaaacgttttcgccgtagcccgagacgcggttgagaagcggcgaattgtgcagcgaagagtcccaagcggcctcaaattggaagaaaaccctgcgaaagaaaaaggaaattgtaattaattacctaatctatttaatatgattaaaaatccacctgtcgtccatggagaattcgaggtaagtgcccgggaaaaggcccaaactgagcacgtcctcgtcctccccacccgaccaatcgggacaactgcggattcggccgaccaccagctgaaagcaataaaatgcaaattgcagggaattgataggtcattttgtacacaaagaaagagaggaaaaagaagggggagagacaacttggacacacacacgccgaaagagagagggaggggagggggg

SEQ ID NO: 38347 - DNA, 1092 bp, Heterodera glycines
  misc_feature (751)..(751): n is a, c, g, or t
  misc_feature (757)..(757): n is a, c, g, or t
  misc_feature (762)..(763): n is a, c, g, or t
  misc_feature (770)..(770): n is a, c, g, or t
  misc_feature (772)..(772): n is a, c, g, or t
  misc_feature (782)..(782): n is a, c, g, or t
  misc_feature (789)..(790): n is a, c, g, or t
  misc_feature (800)..(801): n is a, c, g, or t
  misc_feature (813)..(813): n is a, c, g, or t
  misc_feature (818)..(819): n is a, c, g, or t
  misc_feature (824)..(825): n is a, c, g, or t
  misc_feature (830)..(832): n is a, c, g, or t
  misc_feature (836)..(836): n is a, c, g, or t
  misc_feature (849)..(850): n is a, c, g, or t
  misc_feature (855)..(855): n is a, c, g, or t
  misc_feature (857)..(858): n is a, c, g, or t
  misc_feature (884)..(884): n is a, c, g, or t
  misc_feature (891)..(891): n is a, c, g, or t
  misc_feature (893)..(893): n is a, c, g, or t
  misc_feature (915)..(915): n is a, c, g, or t
  misc_feature (920)..(920): n is a, c, g, or t
  misc_feature (925)..(927): n is a, c, g, or t
  misc_feature (930)..(930): n is a, c, g, or t
  misc_feature (935)..(935): n is a, c, g, or t
  misc_feature (950)..(950): n is a, c, g, or t
  misc_feature (972)..(972): n is a, c, g, or t
  misc_feature (983)..(983): n is a, c, g, or t
  misc_feature (987)..(988): n is a, c, g, or t
  misc_feature (991)..(991): n is a, c, g, or t
  misc_feature (994)..(994): n is a, c, g, or t
  misc_feature (1007)..(1007): n is a, c, g, or t
  misc_feature (1022)..(1022): n is a, c, g, or t
  misc_feature (1029)..(1029): n is a, c, g, or t
  misc_feature (1037)..(1037): n is a, c, g, or t
tttttttgtatacttttctcattttttacagatttcttcactctgttacacgattcttcattttccgccaaatctttcttcccattcgtttctttgtgctctgatggcaaaattgaggcgaattttgggcctaatttcaaattcgatttgacgactctctgttgaaggaagaaaattcattaaatttggtcattttttattctttttattccttcatcaattattaaatttgattgttttttgctttttatttgtttagtaacaaagaaaattattcatgtctatacgctgcctgaagagcattattttgaaatagaaatattttcttatattgttccaaaaacccgttaacaatcgctaaaaactaaaaattatcagctaagattaaaatttaaaaatgtgttggttgttagcttagaccgcttttagcaattttgaacgactatgatgcatatattccaatctgagtaaatctgtttcaacttaaaaatttttagtcatttttcggacaaagtctgttaataaattacactcaaattctcaaaattttcccgccggttatgacagttcagacgaaggttgacaatatggaaaagggaaatgaacaccaaaagtgtaaaggataattataaaattagtcatttaaaaattacatttttaattaattcaattttacctctttttttgggtttttcagtttttctaataattcatttttcttatcattaaattacactaccacaaatccttnaccttntaacnnacaactnantacaacttantaccaanntccattcccnntttttcaacccnaaaanntcccnntcccnnntttncccaaaattcccnntcccntnncactctacattaaattccttttcatnttttatntnctcattttcctcaattccattntactnttttnnnttnttttntcaataaattcaatnaatttctttaaccattttcttntttctttactnatcnnttnttnatttacattttcnaaattctcttcttcncctatcntttttttntccttatttttagaaaaattttttcctcgtcttttgcatgaaacacctttgtgaa

SEQ ID NO: 38348 - DNA, 801 bp, Heterodera glycines
tcccttctcccaggggtattattttgtaaagtcttcttttcccaataaacttgtcaaaccccatttttcgcaccgtgaatgttatttttattgaattctgaaccgttttgagtagattagactagaaaaaattgaaaattttgaaatcatgtttcccactcccttctcccaggggtattattttgtaaagtctttttttccccaataaacttgtcaaaccccatttttcgcaccgtgaatgttatttttattgaattctgaaccgttttgagtagattagactataaaaaattgaaaattttgaaatcatgtttcccactcccttctcccaggggtattattttgtaaagtcttttttccccaataaacttgtcaaaccccatttttcgcaccgtgaatggtatttttattgaattctgaaccgttttgagtagattagactagaaaacattgaaaattttgaaatcatgtttcccactcccttctcccaggggtattattttgtaaagtctttttttccccaataaacttgtcaaaccccatttttcgcaccgtgaatgttatttttattgaattctgaaccgttttgagtagattagactagaaaaaattgaaaattttgaaatcatgtttcccactcccttctcccaggggtattattttgtaaagtctttttttccccaataaacttgtcaaacccccatttttcccaccgtgaatgttattttttattggaattctgaaaccgttttggagtagatttagacctaaaaaaaatttgaaaaattttgaaaatcatgg

SEQ ID NO: 38349 - DNA, 1283 bp, Heterodera glycines
  misc_feature (9)..(9): n is a, c, g, or t
  misc_feature (23)..(24): n is a, c, g, or t
ataataaancaagccgtaataanntttttacacattgaaaaacaataataaaaacaaaatgtgaacagacatttccgaagcaattgaaattaaagaaaaccgaataattattaattactttaaaaagaatacttaaaatatttatttttaaaattttcttcaaaatactaaaaatctttaaaatatttatgatttaatgagttcggagtttcgacttttaaataagtccattcaagccaaaatttaaataaaaaaataataattttgccagcgaattaattaattttcgcaccttcacattcaaacacgcaagggtagaaacacaaatgcatcgccttgggcaacacaaagggcgtgccgcctctctcggtcggcacaatgcgttttaatgggtgccaccctcattgtttttgaagctttggcgcaagtacaaatgccggacaaattatgaggatgctaagatttgttaattgagtcggtggatgtttcggtgccgaactctgaaaataaatctttttttttcttagtgagccaaatcccataaattcgttatcatccgatccgaaagttctgcgtgtttggaagctttggttaagctattttgaagattgtgaagggctttcaaataataagaactttaaaagattgatttatgacgtcccaaaattctcggagccgaaatttttttttacctataaattttccatggaatttttattgtacaattttattaatgaaattttaattcctatatatattttcataattgtagtaaagtttatttatttgttatccgttttttgcgaataatttttaaaaaattaccctcaatttcccataggcatttaaagagcttaattacgtatttattcaatcgaacaaaataacttattcagcaggcgaatgtttttgcttttatttgctcgcattgacaagtaaacaattcatttattattgtttttaaatacctattttttaactaaactatttttaaaaattttattaaaacatttcattaaatttgcttttcattgtttctcttttacgtgttaaattatgaaaatgcaccatataaatatgtaaattgtaaacaatacgccaattttttccaatccggaaattattttcctgttttttcaaaatacccacggcacttttatcctgtaaacaatacaaattccaataatggagtttgtctgtcgtccattaaattttgtttcacatcatcctttatatgatgccctcgcattaggcattgtgccaatccattcaagtgcaatgcg

SEQ ID NO: 38350 - DNA, 1038 bp, Heterodera glycines
tcctttttcttcagtttcatctctgccgacggttggctttgtgtgttcgatttgcttaagccttctcaacttggcctcggaattgcgctgatcagccaccgatttgacttttacgtcgacgaacacttcaagactcgcaaatggacattggaatacatggaaattcgaagcaaaattggagaaaatggcaccaaagaaatggaaactgtcaattccgatggaaaattaatgccaattccgcaaattcaaacgccacgcaaagtcgtcggattcaaatggatcttcatctcgtaaaattggccataatgcaaacaaaaaacttaaaaatcaattcgcattcattttcagttacatcgacaaaaatgccatcgcttttctccgccatttttgccaacttttcgccaaatgtcaaatcaatttgtgcatcaaaacgacgagtgatcgcatttcggagttccttttgcacaacatttggccaatgctcaacaaaaacattcatgccttggaattatcccccagaattttccgccgtttgcgacatttcgtgccgtcaattctcaacgactgtccatcacttcgctttgtctgtttcacttttgacaatctcttcgccgaatttccatgcgatgacagtgccatggcatcggatggacaagcattggcaaaatggctgttcactcgacttcaaaatgatgtgccgaagatgttcaactgttggttgcataatgatgatccgaattggtcgtcaaacgttgaagcattcaaagcggtgattaatatttgattgatttaaaatggtctcatcctaagcgaagaaaagtgtcgcatttctaattgaatttcttaaccaatttttccatattttaggcttttgtcaatgcttcatttcccgtcaaaaaaattggcattgaaaatgactaactatcgttttttgctcgtccgttgtccaattgcgcgagatgaaagcaaatggactaaatgggaagaagaagcgatttattggcaaattccttatcaatggaacaaaattgacattca

SEQ ID NO: 38351 - DNA, 276 bp, Heterodera glycines
aaaaatgcttctgtgcccattgatcaatgataactgattgatcaggaatatattagagtgaatgtaggcccgattgatgatctgataaaactatgatgactaggctcagactaaggtgaattgggagggaccatgtcagatcaaactgaacgcactttaagagacggactatgggccgacagatcgaatcaagccaattcaattgctctgtatggatctggaactgatcagcgattaacgcaaacccactggagaacaatgaattaaatcaaatca

SEQ ID NO: 38352 - DNA, 1608 bp, Heterodera glycines
ttttcttttaaatgtttttttcagtttattaaatagtatgcaatacgttccatgttaaaaaaacaaattctgcataaaaaaattatgcaaaaaaaaagtgaaaaaaatttccaaaaactaaataactgtataataggttcagttttattataaattttaattgtaaaatttagccagaaaaacaaaaattctaaataattcaatgttaaatggaatagtgagaaaaaccatccgtaaaaaaccgatacggacccggcctctattcaatcagatttattaattttgttgttttttcagtcgagttcgacacgcgtttctcatgaaattgttttggatgacgatggcgtcgactgtccatccgttgttagagacgaattgccggcgaaaaagcagaagagaatttgaatgaatagaaatgaagaccttttatttcttttcgggtattcgttttgtttatcgttgctcttttttacggtgctcaataaatttatacatttaaatcgctgacaattttttaaaaattagtttcgaaattcgtttattccgttcgttttgttttcatttttgtcttttacacttaggaaaatggcttccactcatgaaaaacggacagattctcggcttgtttttgtgccattcgtcaccttcgccgaccctcttttttggaatgagattaaccgactgaaagtggaccattggaaattggacgagtcacttaagccaatttatgccacaacaacttttcgtaagttttatttacctaaatactattcattgcaattttatttgcattttttagtaaaataatcaaatttatttaattttgtacataaaatggtttttcttaagagggtgcccagccttctgatgggctcctctccttcgaccaattttccatcgctgccgaaagtggccaaactttgccgcttcaatctgtccaaccgtttgtctctccattccatggcacttttcttttgctaaacacaaaaaaagcattttccgatggttttgatcgaaagaaatttttggaacagtcagctgattcggtaatttattgaattttcataatataataaacagtaatccttggatagttatggaaagtcatcgaatcaaagaaatggttgacggaagcgcaactgctcaactcatttctgttaaccgcttgggctgtcagtgcttttactttcaattgaatttttcattattccaaattcaggacgtgaagaatttcacatattgtttttggaattgcgtccccgcacttcttttcccggacaatcttcgtcagttcagcatcggtccttccccaaatgtcgaaatgcatcaaatattgttggaatttatcaccaaaaacggatgtcgtccctttttgttaattgacggtaaattccttaatctctactcaatttttttcgtctttaatttatacagtcttttctattttagacaaaattccggctgaattggtgcaattagaaacggttaaatcgccaaataattttttgttagtgtttccaaatccgagttctgtcaaacgccgttttggttggcctttgcgaaatttaggcgcttccattgcgcatttaaggtccatttttcgttctt

SEQ ID NO: 38353 - DNA, 936 bp, Heterodera glycines
ttgtctttccagccgcgtccaatccgagcattaatattcgaatttcctttttgccaaatagtttcgataggattttgcccatttaaattaatctataaatgacaaaacaaaataggtggcatttccaactgatgttttccaattgatgtctcgagcgttatttgcatttttctgcatttttgctatatgtaaaagaaactcaaaaatagaattttttgtgttacaatttttgtttgttttggttaaggccgtttattatgagaaaaataagtccagaaatgggaaatttcatttttctactactcatttcttcaaaattaatattagttttattttgaatttttttttctaaatttatttcataccatatttaatgcttaaatttaacgaattgaagaaattttgaaaatttgaagaacgctcgcaattgaacccgaaatatgatgtccgatttctacccatttcgaactcctaacccggattctgacaatcatcaaaattcaattctattacatataaaatgctttcccactacattgacaatctataatattaacatacaaatttctatctataaaaaatattcatcattcttaaactctcatataaattttgaatttttttccaattaattaaatttgcctttgtgctgaatgccttcagcgctttgaccgcttctcgtgtcacaaagccatggccaaacaaataccaagtgatcgggaacaaaatgaacagtgggccaagtgcataaatggcatggtaaatgccgaattttttgatcgcttccatgtaattgcggccaactttctgctcaaggtccatttggacgcccatcaccgactcttcaaaaggcatcacaaatttttacaaaaaattcttgtgattgatcattgcctaatcagataatcatctgaactgataactataaaataagga

SEQ ID NO: 38354 - DNA, 1202 bp, Heterodera glycines
  misc_feature (76)..(76): n is a, c, g, or t
  misc_feature (1189)..(1189): n is a, c, g, or t
ttcattttatatgacaacaaacaaagtggactttttatgactgccagagtcggcatataaaagcactcattttgcncatattttacattccttgtcaattgtttattcgtcagcaatgcccgtttcccccgtcttaaatcagcagaagggagcgccaaatgcaaacgaaatcgcgggacgtggcaacgcaaaaggagagaattccgtcagaggtggagccgagcaacattcattttgacaaaaactttatttcctctttttcagtgaaccgttcagtgcaatcaaacggagacgaaggaatggaaatggttggaatggccggtgagaatgggcgaaacattgaaaccgttgaaaaacgattgacaattttcattttcagagattcgctacgaacagaagcaacaggtcgccggcgggggtctctgctgctgctgcataccgtgttgctttttcaacgaatcgtcgcacgaggaaccgccgaaaatcttcaaattcttcatgacaaaaaagaagactccacaacagcctccagcagaagtcgtgcaaccgcaaaactccgttccatcgccaaagacatcgacaaaccaacagcctccagcagaagtcgtgcaaccgcaaaactccgttccatcgccaaagacatcgacaaaacaacagcctccagcagaagtcgtgcaaccgcaaaactccgttccatcgccaaagacatcgacaaaacaacagcctccagcagaagtcgtgcaaccgcaaaactccgttccatcgccaaagacatcgacaaaacaacagcctccagcagaagtcgtgcaaccgcaaaactccgttccatcgccaaagacatcgacaaaccaacagcctccagcagaagtcgtgcaaccgcaaaactccgttccatcgccaaagacatcgacaaaacaacagcctccagcagaagtcgtgcaaccgcaaaactccgttccatcgccaaagacatcgacaaaacaacagcctccagcagaagtcgtgcaaccgcaaaactccgttccatcgccaaagacatcgacaaaccaacagcctccagcagaagtcgtgcaaccgcaaaactccgttccatcgccaaagacatcgacaaaacagctgcctccggtctccgtgcatcagctccgctccgttcatcgccaaaggcccttcctgtcgaaactacacactncacgcgacgttta

SEQ ID NO: 38355 - DNA, 804 bp, Heterodera glycines
tcgcttcttctatgaaaaattgctgccgctgccgtgccacccttctgcttttagccaaattggcttaaatgtcaaattttcgccctctctctctgtccgatgcttttggcccttttcattatttttgattattccaaattcttcttcaaaaagtattttttacgctgaattgttttaggtaatgactgagttagaaaaatgccaaaaatagaattatccccccacaaacaatgattttttgccattgccatcctttccctttttcctttccctttcccgtgtctcccctccctccgcccttctcagtttctttgccatgccatgctaatttcccaatggataaatgacaaagggcccactgaacagaccataccatttggggtgggtcgcccccccccccttttttttcattgtttttcccttgggggtcaatgaatgaaatattttcccatccgtcgcgagacttaaaaatagcgccgcggcatttgccgagaatgagcccaaaactcgcgccggaagtgtaaacattttgttgctgctgttcctttgcatgtttttcccttctcattccctttccattctcttttcccaatgactttcgtcacatttgtccacccatcggcgcacaatgtgagccatcatttggtccttttgcgcttttctgcaccaaatttgggctggccgatggaggggaatggtccccgcgtggcgtttaaaaaaaagggagacaaaaaaaacggagggaaaaagggggggggggggggggaatcatcgtaacagcacagggggaggcaatgcgaaccc

SEQ ID NO: 38356 - DNA, 1562 bp, Heterodera glycines
ttaaatgggtaaaaaatttatgtatatattaatagatgagcaatggcactgctgcattaatttgtaaggatttgctgcctcccaaaactgcttgtgattgtgagttctcgacttttttggcactttgtctacttcggtgtcgagtgcggtttctgcgcgattattggataattatgcgccatttcagtctcgtagcatccattcactcttcaccatcttttcaatatgtgtgcctatgccctgggacagatatccgcgtgatatctgttgggattagggtcccattgggatttagccgtataatcccaatcagactcccataaaaaagtcgggaacaggattctgacaacatcagggttgaatcccgatgtcggtttgaaacccccttcaaaccagcaattagagtcccgctagccctatctcgatgtgtttttaccaatcccaaatgctgaaccgtgcccaactcaagtatttgaccggaaaattgaaaatcctcatttcgggaagccgaccggacggaaactgttatgaaagactaatccgagactgagtccggttcgaccatttcataagaaccaagactcgcccattataggattcaaaaataattatctctctgcctatcttcttaaaaaaaaatttattattaaaaagcggcaaaattaaactttatttatatcattgttagctctaaacattttcaattagcaaaatttcaaagatttcgttatatttcaataaaaagttatggccaaaaatattttatattctgccaaccaattttcaaatttattaaaagaaaaaaaagaagaatattctaggatatttcaatgatatcatgaactaaaaaagttgggttacattttattcatattttatttatttttttgtgttttaaatttatttttatttttcaaattttatttttatggtttttgagtaaccaccgcaaacaccgcaacacccccccccacccgttgctgttgctggttctgttgttgaccgccggcggttggtccaattgaggaggacgaagttgtggtgctgatggacggctctgtgcctccactgtctggccccgttgtgcagctgaaacggcgttgcataataaataatccaacggattgtgtgccgttcagtttacaacgtttaaacaaaagcaatgccgtgaaaaatgtcttttttggtgcctgaaaataaacaaattttatggcaatgatccgtgaaattgacgagaataaacatgtgaacgcatttcagtcttggtcttgactataaggaggtaggaaaagctactaagaagcatttttcgaaaatggcatgccaagcgaagactatcgggatttggcattgagagagaggtctgtctgctatgaaatttaagttaatataatttttcaaaaaaaccatcctaaattttcaatttttgctgtggaagaggaggaaggtgtctaatcaatcacccattttagggcattccctcccaatgtgcgagactctcgacgacctcggctcattaatctctggaaaaatattgttgaccataaaaaactataatttaa

SEQ ID NO: 38357 - DNA, 1220 bp, Heterodera glycines
  misc_feature (1193)..(1193): n is a, c, g, or t
cacgaggccggaagcggccgagtgagtaccttgggcgcagaaaaattattaaggaggagggttcattatttatttattttttacaaaattaattcataagtatatttacagaaactgctctgaaacgcaccaaaatttatttacaagttgaataaggcactctgactcttatattatcaaaaagggagatgaataaatattttaaaaatttttaattcctttttaaacatgccaaaaagtttaggcttaactttttttatataacctgatcagaagcgcaccagattttgcaagggcatcaaaaagacaaggaaaagcaccgctatgatgctaacgcccctaactctttatttaaaaatttttattaacttatttaaaactcgcatgaattctattttatttttttaatagatttttaaatgtttggattttttttggcttaccaaaacttcatcgaacctggttctttctattctctttcaaatcgccccaaattttttttacagcttaactaggccctattaagcttatttccaaaaaatctcgcatgaattctaatttttaaattttttatagatttttaaatgtttggatttttttttggcttaccaaaacttcatcgaacctggctatttctattctcattcaaatcgccccaatttttttttacagcttaactaggccctattaagcttatttccagaaaatctcgcatgaattctcattttaaaaattttttaattgctttttaaatatgccaaaaaatgtaggcttaacttttttagtgaaaattcgatcactcatattttttgctaattgagcagaagcgtaccaaactttgcagggatactccccggtaaaggactaacttacactgaaatgagcgccgagctagctggctcaaaaaaattttcgaaaatctgagtctttcgtttttatttattttttgcaaaattaattcttaaatattttttcagaaagggttctgaaacgcaccaaattttatttacatgttagtttaggcactctgatgctttttctatcaaaaagggagatgaataaaatttttaaaaatttttaattcctttttaaacaggccaaaaagtttaggcttaacttttttttcagaaactgatcagaagcgcaccaaactttgcagggatactgaaaggaagagaaataacctattttanatattatctagtcagttcatttaaata

SEQ ID NO: 38358 - DNA, 970 bp, Heterodera glycines
tcgtttttaatttaatttcgttaatttttcctttgccctttttatttttgttttcttaataatcccaacgaaaccaaagtgaaatttaaatgaacgaatttgaattttctttattttttccaattttcccatcattacctttttaatccataattaaatatttaaaaaattgtgaacttcaattaacattttaaaggtatcaaaatgcattaaatttatgccaaagaaaaaccaattttattcacctcatttattttacttttaaagaaaaaccgcacttttgctcatattcacaatgctaactatccgcagataatccgctagcattcgcatattatgtaataatagttgaaagaaaaagtaaacggttaaaggagaggagataattttaaacagcagaaatattattaacaagttttaaagtcctttgttaaattaaatattttttgattttggtttccaaatatgattacataatcttaaaatgatttaaataaaggaatttaatatgaatttaattaaaatttatttaaattacacattttatctgataattttttgagtgattgtgccgattcgtacactgaaaatggcacaaaaagagccaacggaatgaatagtcaaattattggacaaatgaactaaaaatggagaatgatttaaaaacgaattttatatattcatttgaattatcgttatctgatcaataaaaaaatgtttacatttacatctatttcgacttaaaatttacaaaagaaaaacgaaaataatttattatttacgaaaaacagaatccttatgaaaaaacaaaatattgaaaaaagcctgcattgtactcgacgagagtaatttaaaaaagaataataaagcaaataaaacgaggaaaaataaatataataaaatgaaagagtaattttataaattaattgacaattaaaacttgggtagaaatctgtagtgcattgagagt

SEQ ID NO: 38359 - DNA, 1307 bp, Heterodera glycines
  misc_feature (65)..(65): n is a, c, g, or t
  misc_feature (76)..(76): n is a, c, g, or t
  misc_feature (272)..(272): n is a, c, g, or t
  misc_feature (1232)..(1232): n is a, c, g, or t
  misc_feature (1286)..(1286): n is a, c, g, or t
  misc_feature (1294)..(1294): n is a, c, g, or t
gcattaaaatgacatgtaatcatatgtttttgtgccctgatttagcattagctgtggaaatttanccatttccttnttcatgtaggttttctatgacattgtttggcgtaattcgcacccttaaattcccattgctatgtctatgaaaggtttcatatcatgttatctgagttgtcagggatgagaatttaaaaaaataaattaaatttgaaagcattccgaagattattatcattatggtgagctaacgattccgaattgcccgaaccccngaatagtccaccgactttttggggcccatccataaatttagttccggggacgtgtcctctcccaataaataaggcccatgatgggccattaacgcaccctaattagcaaggatatgattttggtttcattttcaactgactggctgtttttttggaatttttcaaaaaaaatgatttaaaaaatctaattctaaaggacactcgttccatgccccgctgttccagtctcgagtcacctcaacaaagtccaacaacgacaacgacgtcatcaagcagtagcagcaacagcagcagcagaaccgcttcattgtcatcaacagaagaaccaccgcgcatgagcaaaggcagtgccgacctttcgattcatcattatcaaaaatttaacaatgccaacaaccgcatcaccaacaacaatggcattggcaaaagcaggtccgccgtggtccgggcccgctacgaaccggacgtggacgggatcaaccgattcaggcattatcataggtgggcgcacttctgagccagacaaaattccgaaaatgactcaaatcgaattagcccgaaatcaatgagtggatcccccattaaaaagtgatttgaattttgcatttttgacggtcgaccgattgctgaaatattcattacggatttcgttattgagcaattaaatttttgtaaatttttctacagacccaaaccaccgtcgaaattcttcactcatcagtcaaccgctaagaccattaaagacgatggtcaaagcattgacaaaacgtcgccacggagaacaaatcggcaccaatggaccaacggctttctaccggccattgtgtgtccgaatgttttggaaaacggtacgtttgtgaaatgggtacggtaaattgtgaggattcctgatgaaattcaaaaagagagtgatgtttgctttatggcctggatacgataggattgatatgttactatttntagttggctttccgtgaacccattttttaatcccccctctcccctaaggcgctngcaaccanagccttccaaaaa

SEQ ID NO: 38360 - DNA, 732 bp, Heterodera glycines
gtcaaattcgaataaaattttccaaaattcctcctctcccaagtaccatcctttttgtaaatgacatcatttcacataaaatttgtaagaaaaatcattttttttaaattaaattgaattatgaataattgaacaattgcaaaaaaatgtctgtacatttttccaagtaaaaatatataaaaatcgtatttttttgcaagttttcgagctgcaactttttttagtactttaatcgcatagcaaaaggcttaagaattgcttaaaacagctagatctttcgaatgatgccaaaaatttacaaaattcaagaattccttaaaagcaccgtcattggcacgcccttttcggcatcttcctccgcacctgagcgtaccacacacagtgaagtgttgagtcggtagtgtttgaacaaactttgaaaaaggaatagaaatatagttaaaaacatatatttttaaattttttttattatttattaatggggcttggctttcggcgcttttttggagggttctttgagccatttttacgttcggtgaggcaaaaaataaaaataatatttttgccattttggcctccatttttcaaaaatatggtaaaatggggggccggcggtgccggtaggcgccgccgagaaaatttttgagtattttaatgcaattttgttaagaaaattacttaaaatttcaaaaaaatttactgaaaatttttactttttgggtttcagggggg

SEQ ID NO: 38361 - DNA, 872 bp, Heterodera glycines
  misc_feature (831)..(831): n is a, c, g, or t
ttattttcattaatttcaaaaacacatttataggcatttaaaaatgtacgttaaaagtatcccctaaaccgaataagtacccttttttcatatttgtaaatgctgaaaaattagttagaaagaatattttcataaaattttatttaatttcctaagtatatatgtaaataaaaacctttgaattctaaaataggaactaaattctaaagaaaatttaataaaaaaaatttattttattttatttacaacaatggatcattggaattatttcttgtattttttaaattaatcgcttttccgtgttttgttttaatatttttcataaaaaaaaacttcgaaaatttgtatatttttttcaaaatattccacttccaaaagccttacaccgctacgacaaaatttgttgttaggtttcgcctctacggcagggtggtcaaaccgtggcacttggcaacaaacatctattattaatggcactggccaacacttttggccacggagtgccgcggccctgcccgcggtgtcaatgagcgtaaagggcggcaaaaagttcacgctctcaacgtgagtagtattgggttggtgcaatgagtcttgcccatttaaagaggaatcgatggatatattgggttgtctgtttcagaaaatatgttttatctcatattaaccgtttaaactgtcctctcgaaaaatgacaataaaagattttggccaacattcaaaaatgccttgtaaaaaattctgaaccagtaaagcccagatttatttaacatataatgcaaaggaccccatatgaatcgaccaattctaagatttttttatgatttttanaattcacatccaaaatctcatttacgaggagcatttaagct

SEQ ID NO: 38362 - DNA, 985 bp, Heterodera glycines
ataagaaattgaaatattgagaatatcacaaaagtgatcatgaaaattgtaaattggagattattggggacttatcagctcggtcctccgcaaacactgattcagtttatatttagaggataaggagttgaaatggtggaattccaaaaaggtgaccaagaaaattgtaatcgaatattattgacgattatcagctcggtcattccgcaaacactgattcagtttatatttcgcgaagaatgagctgtaattttgcgaattagacaaaaatgatcataaagtaacaaatgagagaatttcacattctgctaattaggctttaaatataaactgtttaagtgttgcagacggatcaggttgataagcgccaataacctcagatttactattttcgcgaccccactttttgaattctgacattttcagctcattacgctctaaatataaacagcatcagtgttccggaaggatcgatttgaaatcgccaataacccccaaattacaatttcctactgtaaacttatacagattacatttggatataagaaattgaaatattgagaatatcacaaaagtgatcatgaaaattgtaaattggagattattgggacttatcagctcggtcctccgcaaacactgattcagtttatatttagaggataaggagttgaaatggtggaattccaaaaaggtgaccaagaaaattgtaatcgaagattattggcgattatcagctcggtcattccgcaaacactgattcagtttatatttcgcgaagaatgagctgtaattttgcgaattagacaaaaatgatcataaagtaacaaatgagagaatttcacattctgctaattaggctttaaatataaactgtttaagtgttgcagacggatcaggttgataagcgccaataacctcagatttactattttcgcgaccccactttttgaattctgacattttcagctcattacgctctaaatat

SEQ ID NO: 38363 - DNA, 987 bp, Heterodera glycines
ctgcataaaactttttaaccatccccgctggctcaatcctttcgaggatatttgaacaaattttataaaacattgtttaaaattgcaaatttctcccggtggcatataccggcaccaactctcgatttttttctctattcgtccgaatttattttaactacaaaattaaattaaattttttttttgaatatttttttaatgatttttagcttaacaatcactgatgtgttggactggaaagaaggcgaatacatggtgattttttggctggaaataaagacatgcatttcataacatattatttattaaatataaaatttcgcaaaagaattattgaaaattaatttatttttgctgtttaaaaaattgaaaattgtcaaatttggctagtttaagtgtgtcgctgaagtgtacggcttcccgccaaaatcattgcaccacatgctgttgctgaaagggccgccaaaggtggaactgtccgaccaattcgactttgacgctacctctgtcatactgtcctgcaaggtacggtacaccaacaaccactaactatgggagacttaatttttaatgctttttaaattttttcaaaaccattattagctaaatgttttttagaatttcaaataaatattattttcaaaaaaaattattgatttaaaaaaaacctcaccaaaaattctgaagcaaattttttgaatttcatgactaacatattgttacttttttgttttcctaccccttggccggtttaagaaacgcccattagtgccgtaatttaagaaatgacctagcaccattagattaattatgataatttgtgctgccaggtccaacaccgttccgagcgggtgaaggtctattgataccacaacggacgtcgggtggacatcatcgagtcgggcgacgttcccgcgccaccaccaaccaaacagaaatgccgatgccattgacggggacagtgatggcgatgaccagcaacagtta

SEQ ID NO: 38364 - DNA, 754 bp, Heterodera glycines
ccgccggagaaaattttgaaatttttagtgcactttgttaatagatttagtccaaaaatgacatttttacaattttaattgttaaaattgtgtttgaactcccatcgaaaaaaacattaattttgaaaaatgagaagaaaaaataatacttggaggggaactgatccaacgcaaaaataaggaacaaaaccaagaacacaacccgctggaccacgcatatattaacaaattgaacaaaaagaacctaaaatttataaaaatagaagtttaccaaaggccaacaatcattaggggtgtaaaaaagtctcggtctcgagtctcgaaatcgagaccgagacttgaaaacccgagactcgagaccgagaccaaaaaaccccgagacttttctcgagtcgagactcgagaccgagactctcgagcatcactactgacaataggcaggtcatccagcaaacggtgagacaaaacgcaaaaaaaaaaaaatgggggaagaaaacgcaaatgggagaaagtggggggggggggaatgggtgcaaagcaatggaggacaaaatggttttgggagaaatatttaaaatattcgtttacacagtaatagaagcaaaattttatcttttttgtttgcttttttataaaaaaatttatttacctatttttctacctatttcagaatttttgtacttatttaatagggatgtgcgagaagtgatttttaccgggaaccgagaaacgagaccgagaaacgatacgagaa

SEQ ID NO: 38365 - DNA, 696 bp, Heterodera glycines
tttataggcacgaaacccgccaaaataggtagactttaggttctaaagaacccctaaattggcactaaaaaatggaaaataggcactaaaaacttcaaatttagggggtgtaaaatgacaaaatttattcaaaaaaaattctacaaaatcagtattgagttacattattttttaaattcaaaaaattgtccaaaaaatttttaaggacgatttttggtaaaatttttcattttttacatagtttattttttttatttttgggtcaattcttgtggtgtattttttgtttttattgcatttttgttaataattttgggcaaaacgccaaaataggcaaaaataggctctttcaaaattttttaggctttttaggcttaaaaaacctataaaataggcactaataactcgaaaatcagcttaacacagcccaaaaaaaacaacatgttttacgtgagccacggggagctcaggaaaaaataggcttttgcctaaaaatattagccctagtcataactttctaaactttcttgaaacttttaaaaattttgtaaactaatagaaaacacttaggcctatctaatgatatcaagaattaaaaatttagttgattttgagcaaaggtatatcaaaaaatattttcatttgatggttttttgactaacgcccattatgaaggtttttgactaacgtcatagc

SEQ ID NO: 38366 - DNA, 1226 bp, Heterodera glycines
gcacgattacgattttgccaaaattggaaactcagcggactccgaattcgaatgcttaacaaaattccaattaaattccgagtgaaggacaacaaaagaatgacatttattgacccaaggacaatgattttgagctccgatgcgagactggcaccatgctcacaataccgcaaagaactcatttttgtacgcggttcgctttacgaaattgatcaaatcgatgcacaagtaaagcaggtaaatgccaaacgcattgaaggttttagcctgaatctgtcgttggcaccgacttatacccgccactcttttttacaccttgccctagtgaatgtgtctgactttattggccaatttttcgacgccaatttggcaagagaaagtgaactcacattccaaattaaaagtgaggacacggttataacaaagactttgtctgagcaatgggagcaggtgagtcagtccattcgtagcaaactgattgggaactgggaacaaattggcaaaattgtcctgtcaataatgataatcattgtttttacagactttttgatccggtttggattaatgattagagatgaatacgttggcagaggaacatgacttttggtggaaacaaaacgcagaaaattgtgaaatctccagcacgcctcaacatgatggatctgaatgcatctgtagaatttggtaacgaaattgagctcagtcccgttaagctcattgaacccgcccaaacccaggcatacaaaattgcaggaaaacgaaagagaccggtaaaaaggactcgcttcagttttcgggcgccaaaagtactcattgtgcttttagtaatttttcttcccaatgcttttgcaaatcctgatgtgaataaccaaatttcaattcaattcactcctccttcaatcgtttatctgcttattattccgtttctgatttttgtcactattacggtactgctctggtcaaaacggaattcagaccttccaatgctcccaaatctgaatgcgatttcgccgcatcacgccgtcgtacagacattgattaattccacacccgtccgctgcttaatggacactggcgccagtttgactgtcgcaccacgatcagttgcagatgaactcaattgtcggacattttcatccgatttggaggcaatgagtgcctcaggacatgtcattcgcctcaaagaatatgctcaggtgaatttaaaaattgctgggtacacagtc

SEQ ID NO: 38367 - DNA, 1123 bp, Heterodera glycines
  misc_feature (66)..(66): n is a, c, g, or t
  misc_feature (991)..(991): n is a, c, g, or t
ttttgacccgaaaaatctatctttatttcagaaaaattttactttatacattttttattcaaattntcgtccatattttgtttgtttttcgtggattaaaggaataatcgaattattatttcttctcaaacaaattatcttttctccaaatttttcaaaaatattttctcttaaccgcccatcccctcccattcttaattagagcacaatatgatagaactaatgaagcagttgaagaagcatttacaaattgatgaagaaatcggagaaaacaaagaaaaagaaaaggtggaggaaatgggggaaaagaaaggcaaaaaggaaaaagaaaaaggaaagaaaagggaaaaggaggacaaacaagaaaaaggagagggaaagaaaaggaaaatggagggaaaggaagacaaaaaagaagagggaaaggaaaaggagggcaaaaaaggaaaatgaaaggaaaaagagggaaaggaggacaaaaaagaaaaagggagggaaagaaagacaaaaaagaaagggaaaaatcaaagccaaaaaaaagacaaatgagagcagaggaaagtgaaaggagcaaaagatgctttgaagtagggaggaaaacagggcaaagtttgagcaccacataattctttatttcatgcttgagaaattacagacctgaaatttttcattcttaaggatgtattttttagttttagtgcattttttaaaggcaaaaatcatgaaaataggcactaaaaatggcgaaacttgggcttttgcctaaaaccccatccctaattataaaaaatgtttttcatatttcaatccgcaaaagtcggtaaccgaaaaaattaaaaatttatagcataatttttaaaattcaattataaaatgtggtgcacaaacttgaacaaaagtgatgtttttaaaaacaaaaactttcttcaaatttgcgatcgaatttatgtgcctgtttatatgatggataaagagtgacaaaattaattanaacatttatttaattatcgtcattttatacaatgagaggcgggcgcatggacagtaaaatcaactcctttgaattttgtagatggataaaggcatcaagccgaatgccaaaaacaaaattaaattttttatg

SEQ ID NO: 38368 - DNA, 829 bp, Heterodera glycines
  misc_feature (786)..(786): n is a, c, g, or t
taattccccccccccccccctcttaaggttcgcccagtatttgatcaccacaatggtcagtttcgtgctgatcagtcacctccacccaccgttttcttcagattcttgtcgctctgtccacaatggtttccgttgtcactgttaacattcgctttcgcagcggcgccacccaccaaatgtcgccttgggtccgcgtcatttttctcaattttcttcccaagtaaaggcatttttcaaaaattatattcattggcactctctgctgggtagaattttatttatgaaacggcccgaacgaccgccaaaattcaaattatcggcacaatcggagagagggcaaatgtcgaaaagtgtgtcgccaatttcggcgaatgatccgcccaatgctttggcgtccatttgcccgtcacttatggcaaaaacaacgacagaaaggccaaatagtgacgaaacagcaaatgccaatagcaaagaagattatcggcactttaaaacggttcaacaaacaaacgaaggaaaagtgagaaattttggctcaaatggatttttcggctaattaaattgtaaatggaagttagttgccgagtttagctaattccggtttcgtttgccattcgtgctaatcaattcactcttttttctgttcatcagatttctcccccgttcgtttctccccattcgccgtcctccgtcgactcttcccaagtgtttttccgtgccataaatgctccaattaaccacccaaaagtgcccattcctccgcctccctattcgcactcttccganagcatcaaaaagtgccgtccgtcgtccattttgcctttccaaa

SEQ ID NO: 38369 - DNA, 1127 bp, Heterodera glycines
  misc_feature (1086)..(1086): n is a, c, g, or t
aattttaaatggaggccaaaaagattgacccggaaattacgaccgatgacgttaataaattcctagaaaagcagagaacatacacgattcacaagcccatcaggaaaaaattcccgagactaaagacggtaccgagcggcttccataccgattggcagtgcgatttgtgcatatttgaccagttgaaaaagcataacgacggttacaaatatctgttggtatgcatcgacgtgctgagtcgaatgatcttcagtgcaccggccaagtcaaagaagagtgaggacatgattgaggtttttgatcgggtgttcgaaaagtcgaaaattatcccgatgaaaatatatagcgacagcggactcgagtttcaggctggaaaaatgaaaaaatattttgaggaaaaatttattatcaaaaatgtgatgtatagtcctgaccttcacgccggagtcgttgaaagggcaaatcggacaataaaggagcgcttgtacagatattttacaaagatggacactctacgatgggtcgatgtaatagacaaaataataataaacattaacaacagtgtgaataggacattgggggccaagccagtatccgtaacttttgaaaatgcccgggcgctctgggaaaaattatataaggcgaagaaatttaaaatttcgaaaaagaaaaaatttaaaattggcgatatcgttcgaattatcaaggaaaaaggaaaatttgcaaaggggtatctcccaaactttaccgaagaattatttaaaatcgttattgttaattcaacgacacccgattcatacaggatcgaagatttggaaggaaatttaataaaaggcatattttataaccaggaattagtgaaaacagatggatgatttttacattgtactaccgtcgaacacaccggggcaggagaacactacgtcaaaattcacagtacgcctccccgagactttggaattgggcacaaattggtcagtagctctctcatcaattatttacccctactcattcaccgctctcggcataaatggtcaagagtttataaaagtatgggaaaatgacagcggtgtcccccattccagnttatttaccgacatgaattttaaaaccgcccgggggattgg

SEQ ID NO: 38370 - DNA, 53 bp, Heterodera glycines
gcagcagcttgccgccgctgcgatcgacgtcgtactcgtacgtggtgggctga

SEQ ID NO: 38371 - DNA, 681 bp, Heterodera glycines
tctcttaattttttgttaatgggtttttagactgtttaaaaatgaaagtaaaataaaagttggaattttatttattaattaaatttcaattaaagtaatgtaaacatttctaacacaattctgtttttacttttttattattttttacaagcaaatcggtgtttttttcattttttaaaattccttttcaatttacatgttcttcaaatggtgtgcaccagggatggcacggaattccgacttccgaaaattttttgggcctcggaattccatccctggtgtgcaccaatttgatgatgctgattgtaagagttaaggaaggttgggtcgaaggttgtgaaggaaataatgcaaatttcatgggttattcaaaatttgtgcttaggttttttaaaatcggaaaagtgataccattatcgttaacaagttaattttattgagactactgaatactaattttcacaaatttctaaccttacatacataaatatccattcaaattaacaaccgttaatgaattttttgtacaatatatacataagaataatacaaaatgtgttagtgattgaagcggaggaagaggagcggagggagggcgcgggctccaggtcttgagcatattgctggtggaagctgatgaactttatgaatggctcaatgttgttgttgtttgaagctcct

SEQ ID NO: 38372 - DNA, 1208 bp, Heterodera glycines
  misc_feature (1189)..(1189): n is a, c, g, or t
cgggaccttggtactcagttgtactcagttgtccgtgttcatgtcccggtcccgctgcactctaatacatatatacctattttatgaaattagtttaaaaaattaaataagagcaattatttaaaaaaggcatagaaaaaattacatgaaaaattcacaacaagcataataagtgaccaatttgcaagttcatcaactaattttgagacttctttctccatcgcattatgcttactcttgacactcccaattctttggcaatttttcgctcgctttcccatgggtttcgttttttccttttgtcaatcttttcaaacaattccgatcgttcggcatccgtgtaggttttgtgccttactaaaggataaaaccgattaactttattattttattgttatttatgaattaaaaaattacttccgattaagccaaattttctcatccattggtaaactgtgcttaatccaacaccaatttttcccacaatttttctttcaatttcgtagctcggctttaaattgaatttcttagcaaattcatctttcactttttcaaatttctcaataatttcatgcctttgttggttggaaaaattctttgtgccaactgaaaaagaaaaattgaagatttttttgttgttgttaattaaacaattaaaagagaatttattaaattaagatcaaattgaagcctttaatttgaattttaattttcttttttatcgcattgctttttcccttttttaagggattcgtttttaggcaaatgccaaaaatttctgcgcacttaatacgctcagataagcacgaaaaacgagtttttcgtttgggttgggaaggctacgatgcttataatgcctatttcggggtttttgtgattgatgtgcctattttcaggatttccggaaaacccccaaaagttaattaaattagtataatcaaaatattttgtttaccaagttccttcttccattcttgaattttattccgactaaatcccatttcattcgcaattttcacttctaatttttttcgtttaattctgtcatatttaaagccatgagttttttcttttttctttttttcaaactttttcacaaattccaatttctccgcattcgaaaaatttgcttaaaaactcattaagttttaaaaaagtttagaaattttacatcgtttgattagaccgnaattcttgcttcccattta

SEQ ID NO: 38373 - DNA, 1130 bp, Heterodera glycines
  misc_feature (7)..(8): n is a, c, g, or t
  misc_feature (1071)..(1071): n is a, c, g, or t
taaactnntcgggccattttgaaaaagaatccagtaaaagtagataaacatggccatcttggcatgggccggcaaaatcaatatgcacacgttggaatggccgtttggtggcattccaaggagaaagcaatgtttttggtgctgctttctgggcgctttggcattcttcgcagctttttaccaatttctcgatagctgagtccattccaggccagtatacgtgttggcgtgcgagagctttcatgcgcactattcctgggtgtgccatgtgaagcgctttcaacgttctgtctcgtaacactgttggaatgatgactcggttttgataaagcagacaattctcgatttgcaaaatttcgttccgttttggaaagaatggtgcgaggtcggggtcattacacttttgtgaccatccttccttggagaattttgccactttttgtagaatttcatctttttgagtcatttctgctatttcggttgcagtgacgggaagttgatcaattcgtgcctgcaaaattgtgccgatgaaacattctgtttcggtgcaaattttcgctatcaaaatatcttcttcgggtcgcggataattcgcgataagtcgtgaaagcatgtcgacttgaccaaacgcagtggtattgatgtagcgaatgtcaaattcgtaatttgacaaaataagtgcccatctttggagtcgactggcggcataaattgggatccctttcttggacccaaaaatggaaatcaacggcttgtgatcggtcagaagtgtgaactttcttccaaaaatcattcggtgaaatttttggacagcgaagacaagagccaaagcttctttttcgacttggctgtagttccgctgttcttcagaaagaacacttgacgcgtgctcaatgaccttctccgttttgtctgggaaaatgtgacttatggtcgctctaattcgatcttttgaagcatcagctgcgatgattattggaagcgaggggtcgaagtgggttaaaagcagatcagacaacatgatctcttttgctttttcaaaactttctgctggtcttcaccccaattccnaagttcgtcttttcgaagagttggtccaatggcgcccctgagtcgcgcatctttttgat

SEQ ID NO: 38374 - DNA, 1332 bp, Heterodera glycines
  misc_feature (1296)..(1296): n is a, c, g, or t
catcatcctgtgtcctgataatgccaaccccttctcttactaagcctatgggcgggaaggtgtaattgatacggtgccaaattgttgagtgctcttgacaaaaaaaaacatttttcgccattaattgtttgctttctggatggattgttagtttgttgttatgtatttgcatggcttttttttggctttttgggaattttctctaaaaaggtgccgacgatgtaaaaaataaaaataaataaaaatccaaaaatggcttggcgcctcactaaattgaaattctaaaaaatgttttactccactaatttaaatttttaaaaaaaatactttgccccatttaaaaaaatcttggccctattaaattcaaattcttttaaataatgtttatcccttttaaattgaaattttttttaaatgcttgactccaataaattgaaattcttttaaaaaaaaatgttaggccccattcttaaaaaatgcttggccctattttgaaatttaaaaaaaaagtttttttaaaaagcttggctcctctaaatttaaagtttttaaaaatgcttggccctattaaattgaaattctttttaaaaaaatgcttgacagtttgcgagccatttatttattgactgttcccatttcaataatttgctgcgagtgttaacaaatgatgatggattgggatggttggttcttcgatggtttcactgataaaatgtgtgtaataattagtgacaaatcatcacacaaattttctcgtcccctttcttttacctccgtttgctctccaaatttatacttttataaagttattatattttaaatttactaattttgtaaaggacaaaattcgtcttatgactcagagaccgccacaaagttttaaactatgatctttatttacctttttaattgacatcatttttaattagccaaatatccaccaaaaaattaaataccgtactcagagaatgataaacaattaaacgggccaccgtaccaccacatttcattaaataggcaattttactaaccgttatgaaatatattcatattttcaactttatcccctaaatctcgacttttacaaatattcttttcgaatttccaacttcgatcgcctaaatctcggtttttaaaaatattcatactcgaataattcatcaatatcgttaattcaatttccaacttcgatcccacaagagtctcgacttttaaactcccaaccattatttcgttttttgcctatttcatacaagcataatttttttttcaaaacaattgcttcagattctttanagctgttttatgagctttattagcaaatctgatcaa

SEQ ID NO: 38375 - DNA, 835 bp, Heterodera glycines
aaaaaagtaattttaaacacgaaaaaataatagaattcattttataaataattaattacacaagaaaattaaaaacaaaacgaaaaataaagcataaaaagaatagttctaatgaattttttagaaatgtataattaaaaaaagaaggatttgataatgaaaaaattaaaataatatttctacaaagctcaattcatatgtcggataacatttgaaaatgataaataatttaagaagccgcgaaccaaacttacagaattcagacaccatgataatttgattaatataatttaaactgaattattatttttaaatactaataatgcaattatccacaaattaaataaattcatttcaaagtttcatgtctaaggcatataaaagcaaaaaaagttaatacatacctagataaataacaattaatcttattacttaaaaaaactttgttaaaggaatgaaggaatgataattagatatttcgctatttcgcatcaaacatgaaaatacagccaaatcatatggccgactttaaatcagattgtatcgaacgaggacacttttgggctgagacacccgttgtgaatgtaagaaagtgttatataggcacaaaattgcagaaaaatgacttaaattggtttagaataatcttttaacactttaaaaatgatattttttgtatttttaggggtgcattaaaaaaaagttttttattttctcgcaagaaaaatatgtaagaaaaagtccaaaatatgtaccaatatatgtataaaaatatgtacatatgtaatatatagaaaaatcccgaaatatgtaaaaatatgtaaataaaagtccc

SEQ ID NO: 38376 - DNA, 688 bp, Heterodera glycines
cctcggttcgcaccgggatgaatggaagtgtgcatcaacggacgttggatcatcaacaccaaattcgaaggtgagcaaaaatcaattgatgcaggcatcgcccgatgcatcgctggtgaactcccctcctcaaaaaggcgcccaaatatcgtgccgccgatgcgagaattcttcgactcttgcagagttacaatgccatcaacaataaccaggctccccaaaatgatcacaattaccatgcccttatcaatgttaaccccctataacatcatcaattttctccttggtatttctcggaattatgagatgcgccgtaatattttcaatgttttgttatttttttgttgttaacacattgataaatctgttatggtgttaattttaaataattttcgagaaacaaatcagaattggatcaatgtaggacaaaaacagcttgccagactaaaacgaccctctgactaaaccggccagactaaaccgaccctctgactaaaccggccagactaaaacggccagactaaaccggccagactaaaccgacccccaccgtaaaattgcatgttttcttttttatcacaaaatttttaatttttactgttattattttggtgtaaaaattttcggcattttatattttgtgtcctcctttactattatattatccaccattctcataacaaatgct

SEQ ID NO: 38377 - DNA, 1015 bp, Heterodera glycines
tttgactgcaaatttttttccttttttgaatggggtccaaaaaaattttaaagagaatttttgattattaatttgaagtcttgaatttatttgacaaatccaagacttaaaactgggagaagcaaggggctgtggctgggggcctaaaatttgggccacattggagaattaattctgatttctgaaaaagtcccagaaataactattttttctttccataccttcttgtagagctcgagctgctctttccaatggtcttatcccggtctcgatccgtgccgaactcacaaagttatggagtgaaatgtgaaatattgttttcaccacaaggcattttttctgaaaaccggattcaaaaatctggggtttggtataaccgttttagaaatagcgtagaaaacagcttcgatatcaagaaaccaagtcaagtccagaaaggaatattttaaaacgatttcgttttgttttggcattatgataccgaataactttcggaaattatggaaacaaaattggagaaattcgaataattttttgactgcaaatttttttccttttttgaattgggttcaaaaaaattttaagagaatttttgattattaatttgaagtcttgaatttatttgacaaatccaagacttaaaactgggagaagcaaggggctgtggctgggggcctaaaatttgggccacattggagaattaattctgatttctgaaaaagtcccagaaataactattttttctttccataccttcttgtagagctcgagctgctctttccaatggtcttatcccggtctcgatccgtgccgaactcacaaagttatggagtgaaatgtgaaatattgttttcaccacaaggcattttttctgaaaaccggattcaaaaatctggggtttggtataaccgttttagaaatagcgtagaaaagagcttcgatatcaagaaaccaagtcaagtccagaaaggaatataaagaacgatttcgttttgttttggcattatgataccga

SEQ ID NO: 38378 - DNA, 953 bp, Heterodera glycines
ccaatttgaagtcggtcccttccattccttcgtccgacgactcgccgtttgtttaatcgagaaaatagacggaaattttgtcgatttttgtcgtttatggaccaaatttctacaaattttgcgtcatcattgggagtacaatttgaacttgccaaagtcagtctcgccgattcctcctttaggtatttactttgcttttgagttgtcagttttgacactgatgaaaggccccaattgtcgtgctgtctcctgcaccaaaaactccaaatgattaacttttgcatttcggtgaagaaacgaaagcacaaagaaatggaagcgaacgaaacggagaatttgggcggaagtgccaaagatttgccagcaaatcgaaacactgcgggtaaattcggtgagattagtgggaaaaccgaccgaagacagaccgatttttaattgcatcttgttaaattgggagtgaatttacattatcattttggttcgttgaaattactctcttaagacgacgagtttttcgatgcgattgaatcattcgatcaatttgacgtcgccacttcgtcggagtgccctcgggggagaagccttccactcgattcgaatgaatttttaaagagcaatccaaaccaacgaatttttgttccttttactcaggtggtcattaattgtaagtaaattcgctgaatattaccgcaaagccctttaggaggagggcccaatgacggaagaccaaattgagcagagagagtcctttctgtgcaatttggaggacgccaatttgaggacgaaggcgcagtccgagctgttgttgtccgacatgcaagcattcaaagtaagccatgtttttgtctaagtttttggttctgtttaaggccgcaaatccgggctgtgaattggtggattttttgagatggcattcgccaagaggatctgacggaaggtgagggggaagggga

SEQ ID NO: 38379 - DNA, 1030 bp, Heterodera glycines
  misc_feature (910)..(910): n is a, c, g, or t
  misc_feature (915)..(917): n is a, c, g, or t
  misc_feature (946)..(946): n is a, c, g, or t
  misc_feature (961)..(961): n is a, c, g, or t
  misc_feature (980)..(980): n is a, c, g, or t
ttttaccaaaaaacttaaacaagataaataaaacaaaagttgtggacgctaaaaactttgaccagttcccatagtcccggggattaagaacggaaggacccatgggtggctctaaaatggggacggcaatttggacaagttcggtctcctcgttcgtggtctcctcgggtggcagaattatttcccggtactcgtttggccattccctttctgggagagcccccgggttcccaagtcggcagggttatccgtagacctcacgaacttaaaaaaggcgcccctttcctttcttatttcagccaatcgattggcgatgaaaatgggctgagaggccgtgctggccaaccaggataagattatctgagaatccgcccaaaaataaatgttttcgaacgaaaaatccaaattagaaacgacaaaatttttggcacgaattgccgtaataagtcccagtaattccagccggggtatggtgaacccatcgtttttgaactttttgggtctcagtcgcgacttagcgaaaagtagcgagacccgaacggagccgttaagctctgagcgcaggtagactgcggaggcaaatgaattgggaccagcatcagaaaatacatggagctgaaggcttgcctggccacacggggtataccgagcaaacgttactggggggcagtcccactcagaaataatggcaacccaatccttctctaattttggtccgattgactcatcccaccccttggctgaatcccagagtgactgaaaaaacatttttgccttgacgagacaagggctgcacaatcccaggggatcaaacaaagaggcgatggtgctcaatactccccgtcgggtggtcggaaaattgctcttggcaaggaaattcaaaaaatatttttttcctgtgcaaattccnacaannngcccaaactctttgtacatcgcccaccanaacttctttcggcgnggaggtcactcaaaattgnttgggtcgctgccacaaattcgtggaggtgcatccctgcccttgtcatca

SEQ ID NO: 38380 - DNA, 901 bp, Heterodera glycines
tttaaaaggcaagaaaaggtcctcacaaaaaaatttttagtgtttttttccatttcgtaaaaattgtggcctttgattgtgaggggggggggggggggggggtggatgggaggtggcatttttggaaggcaaatttctgtcccccccgttgtccatatatgcctcaaacgtaatgcgtcagcgggtattccgattcatctacgtttgacatcttttccttacgtacgtaaaaggaggggctgaaaatttcgcaaactttgggttttcattaaattggttccttttaaaggagtgaggatgactttttcatagttgaagtgaatgctattttgtcttaaggtggcagctgattttgtgcaatatgttctcttcgcactttgttctgtatatccgaaactgaaggcttaccgttcgcgttccttcgggaagtggtggcattttggttatacgagtcctttgtccatccaagtaaattagtggaattattatatgcattaaatattacattttgtttgtttagcattgggcaatgcccgtggaccggaacaattgtaaaatggattggcatcggccaacctttgctgaaatcgactttgctctatctctggggggcacatacatttttgatgagttggaacgccttgttgaaaacgatggaaatgccgcgctcaaacaaactgacgacaaacaattgctgaacatactgacaattgcgttcaaatgtttcgagggctgttccgcacgttgtcctttgttcgacgaatccgaaaaaattgtccaatttttgtgctgacggcactgtataaataaacagttgcatgaatgaagttctgatttgacatgcaaaatatcatgaaattggggaaatgaaaaattcctgtactttcctgttatgtatgag

SEQ ID NO: 38381 - DNA, 870 bp, Heterodera glycines
  misc_feature (747)..(747): n is a, c, g, or t
aataaatcgattttttcaagtgtccgtttgggggtactcaaacaattatggggagcaaaaatccaacgcagaattaaagtacaggctatagtgaagctattccggaaggattcggtctccccataaatctgggcgcatcggttcagggggactgccccgaaaacccaaaaaaaaattttttggataaaaattatttaaatgaactgactagataatatttaaaataggttatttctcttcctttcagtatccctgcaaagtttggtgcgcttctgatcagtttctgaaaaaaagttaagcctaaactttttggcctgtttaaaaaggaattaaaaatttttaaaaattttattcatctccctttttgatagaaaaagcatcagagtgcctaaactaacatgtaaataaaatttggtgcgtttcagaaccctttctgaaaaaatatttaagaattaattttgcaaaaaataaataaaaacgaaagactcagattttcgaaaaattttttagagcaagctagctcggcgctcatttcagtgtaagttagtcctttaccggggagtatccctgcaaagtttggtatgcttctgctcaattagcaaaaaatatgagtgatcaaactttcactaaaaagttaagcctaaattttttggcatatttaaaaagcaattaaaaaatttttaaaattttattcacctccattattgatagaaaaagcatcagagagccttattaacttgtaaatanaaatttggtgcgtttcagaaccctttctgaaaaaatatttatgaattaattttgcaaaaaataaataaaaacgaaagactcagattttcgaaaattttttttgagccagctagctcggcgctc

SEQ ID NO: 38382 - DNA, 891 bp, Heterodera glycines
ttttagacattcctcaattttcactaaatacaaattctcatatttgcttagtcatctgttaatttgtgtaatttacggtgcatttacactgaattatgtgctcgcatttgcattcgaaaatgcgggaaagtatggcgcaattaaatcaaaaattaaaattaattaataattttaaatttattcagtccaaccaccggtgttgtggccgaaactttgctgggccccgttggttataaattcttcgccggcacattcattatttcattgggtagcacttgctgttatgtgtccatttttgtgatcatcagatgcaaaaatgccggtaaatcttggcattcatttctttggcattttaaaattcaaaatattttttacagtaacccaacagacgaacacacgagttttacggtcattgatcatcattttgtccattaacattggcggatatctgaccaatttggccatatatcagttgctgtatgcatttggttcaattttggggtattttaaattaattttaatttaatttaaattttccaatttccctaagtctcccaattcgtacttggcaagtcggttttattgctggcattttgttaaacgttgcatcgggatcaaatgttgttgtcctttattttaataggtcattatcgcaataattttaaaattttaaattgtaaaactttttaacatatttttaaattatattaatatattttcattaattttaataatttttattttttacatataatattacatttaattcttaattaaaatatatttcttttttcatactctcttcagcactgattatcgccgcgtgttcaaaaaagaatttcaagcgttgaaaggctatttttgtaacaaaaatggtaattaaaataatta

SEQ ID NO: 38383 - DNA, 986 bp, Heterodera glycines
agcagaatgattgatcatataggatgataataaaaaaaattttgcccgcggatgcccctcccccctccccgcgcgctcatcccaaatcctggaaaacccgaaatcattgaccgtcaaaaaaaaacgtccagcagattgaaggttggctctatacatcactttttccaccgaaatcgattttttcccatcgttcagtcattactcaaccagggctgggcgtaattacgggttacgaattacggaagttatggcatttttggacccccataatgacggatttccgtaattgaaaatccagttacgctcagcagccctgctgagtactatccctaattaggcaaaaaaatgactgtatattaaattatcttttatcaattaattcaatcactgaatgaatttattcatctgttaattgcactttctttttctccatcccattttcttgaattttaatccgcctcctttcgaaaatttattttttgtacatcaatttgccattgtttgtttcttctttctttgccaatgcttttaagttgccgaaattacaacggttctgaattatttttggccaatgtttaatccaaaatatttatttaattaattcaaaatgtttcatttttcatagcagccggatacaggaactcactttgaagaattgaagattctaaaatgtaaaatattttaagcattcatttagcattagggtgctagcaggaaacaaataactgcaaggcctactgtatttatttgcaatttttcaatggattttggacccgaatgattggacatttttaaaatatcatttttttaaaattttttataaaattaatagaaaattcgaaatttctcaacattgataagttatctaaaaaaaataaaattcaaaatttagttaggttgtttttctctaaaaattaataaaattagattgttatttttgctaactcattaaaaataccatttttagccggtttcagatgtttttt

SEQ ID NO: 38384 - DNA, 606 bp, Heterodera glycines
atcagcgtcggctcgcgactgtccccaaatggcggaagtcaccataacttacgccattcgtttgccaacaaacagttcatcgatcagttggaggatgggtcatatgaagtaatttttcatcattcattcattaaatgttcccaattgttgtaatatttaaatcaaagattgtccatccattccaaattcgcgatcggaaggaacggattggcattgacacgcgaaatcattttatcaactccacccatccccaacattatcggcatattacaattgtgattcggagtgccgtgctggcaaatgcgcgtcttaagctgttgttgtcgcttaacgagcatatttttcacgagaaaagcaatttcagaaaagtgaaaaaaatgcaaaaacaataaataaaactgaatgcatttgctttcagttggatgggtcggacgaatcgccgttggcggtggaaaattgcttttatcaggtaggatatttgtcttggtgaaatttgatagtcatccaacgaaaaggcttcagggcaccatcaatggcaattcggacactctctccgcgctgtccacctgcgatggtctgctcggacttttggcctttcccaacggg

SEQ ID NO: 38385 - DNA, 508 bp, Heterodera glycines
cagtgattagaagtggtacaaaaggattagaagaggttcaacagtgatgagaagaggacaatggtgattagaagaggaagaccagtgattaaaagaggtacaaaagcgattagaagaggaacaaatctgatcagaagaggtacaacattattagaaggggtacaaatctgatcagaagaggtacaacagtgattaaaagacgtacaaaagtgattaaaagaagtacaacagtgattaaaagaggtacaacagtgattaaaagacgtcaaaagtgattaaaagaggtacaaaagtgaattaaaaaaggtacaacagtgattagaacaggttcaacagtgattagaagaggtacaactgtgattgaagaggtacaatagtgattaaaaaaggaagaacagtgatcagaagaggtacaacagagattagaagaggtacaaatttgataagaggtacaaaagtgataaaagaggtacataagtgattagaagaggtgcaacagtgatcagaa

SEQ ID NO: 38386 - DNA, 1708 bp, Heterodera glycines
  misc_feature (96)..(96): n is a, c, g, or t
taatgacaaataatattgtgtatttttatatgcaagcaaacaccatttccataactattaaatattaaaagaaaagaactagttagaaaacctatntaaaataaaattatattactatatctaaactagagtgcagcgggaccgagaatgggcaaaaccgggacagcgacttgccgggacctgagaagccgggaccgggacctcgcttttcgtccggcaccgggaaccgggaattttaaaaattcaaattttgttttatttcaagtgaaaataatacaaaattaaattttattttgttttttattttataaatcaaaaagttaaaactaaattaaattaatgaaaattttcaaatcaaattttctttaattatttcaaaaattaatcattttggactaaatttttttgtgttcgttatacttttgccgttagaatttgtttttaatttattttgttaatattttttaattgagatttaaatttttgcattgatttattctcatggtaaaggctaccgcgttagattacggcgtagaagaattgttaaagtaaaaatttccaataaaatttttatacgttttaaaaatcaaaaatgtaaaattacgttcgagcaattattatgcgcaaaatgtataagtaaatttgggttgaataacgtttaaacaatttttttatcacgcatattataagtttggtatttcaatggttattattttcataatttaaatttttctcaatttatttgaagcgaaagtattataaaaattatattttgattataaattaaaaaatatttgatttttttttgctatatttcaactccatgcagaatgtttgcttaaaggcaggcggcaatataaaaatgtaaataaatccgtttaaaattaaaaaaaattattataatatattttattagaaattttcatcagtcggagaaaccacaatagattagtcagatagtgtatgataattattcaattgttgtaattattatgttatctaattaggttgaataaattaaataaccataaatttatcttcttctaatttttgatcttaatcactgaatttattcaaatgattaataaaattcactttattatctgttaatggatattttatgtacacaaactatataataatattttttcattattctgtttttaattaattttatctttttaaaggtaaatttcttttcggttaaatatattttgttgcttacatggtaataatggtgattaatattaatttttaaaaggatataaaaggtatgattgtaaaatttcaaagtcttaagtcagatattttttatccataacttttttgaaattcaataaaattatttttttttgatttaaatcttccaaataaatatttctcaaaaattttttttttattttttttttactttattaattgcaatttaattttagttgattgtcgcattttaaaaaattaaataatttttaaattattccagaaattcaattgctcatcacataactcttttttaaattatcacattttaattggattaataagactttataaataataattaatttaaatgattattaaggtcttcaaatggttttttatgaattaataaattggaacaaaataaattgaatgtctattgttttccacgtaaatatttagattataatgaaagtgcgaaaatcacgctaacgaattgataagaaga

SEQ ID NO: 38387 - DNA, 771 bp, Heterodera glycines
gaatgatatcaagattataaaatttaatttatttttggtgaagttatgaataatttctgtcaaaaattttccatttgatggttttttgactaacgtcataacaccgtcctgtcttgctggtccatctctgaaaccttgggccgggttttttcgaaattccgtgttctatttttacaaaatgttcattgaattgcaattttgcatttaatttaggccactgtctctgccagcagatcaaagcgacgaaaaagtgttgttctcgactcccgggccgagtgatcagcggaatgagtgatcacttgagaaatgaccgatcattttttgtgttttttatgctgaatgaactgtgttgattgatgttattaaagaatgtaggcattgatcaaataaggaaaaagctatggcctatgaaactgagggtagtcactgatgattgaacgcctaaaatgcattaaagctagggcaaatttccaaaaatttgctacacctccttgctggtattcggcaagccctctaatgatgtaagggagaatatatttttgaaaaatctttcaagagtttgagaatttgtgttagagcgaaaaaaatcccgactcaatactgaaatcccggttccagactcttgtaattattacaaaaaaatttttttgcctacccggcaccaccccggccaccaaatgcatgcgctgctcgatgagcatgcgcttcagcgtacgccgtccgactccgttggcacctaacagcacaatgcagcggcgcccgaacgggctg

SEQ ID NO: 38388 - DNA, 1221 bp, Heterodera glycines
  misc_feature (64)..(64): n is a, c, g, or t
catttatttgttgctcaaaggctatgtatatgttggaagaaaggaggccaaaaatagtatctcntgtgaacaaattttttgaattgtgaaagtttttggtgcttttgtggatttttgagaataattcatatttaattatttttaaaatatagaaaaaatgaaaatgccaaatgtctcacaattattttgtgttttaattgttttttcaacatttattgaaaagtcaattggtgcccccaaaaaaggaactgcttctccactagaaaaagcagagcaaaaagacgacgaaccaaaattgggaaaagaagacaaaaaattggtgaacaacaaaaaagaattgctaaaaaaagaggtgaattttaaaaatatattttaattgaaattgaaatttaattttaatatttttgattgaaaaattgcaaatgcaaatggaccaacagttgaacacaattttggaagaaaaaattcctacttttatacttgaagtgaatgaaattgcccaaatgattgacaatgaacaaaagccattggaacgcaaatttattcaacaattgatagacaaaatgcgaccattgtacggtaagtgaaggaaaaagtactgtaattttaaataaaaataaaatattaaaaaagtagttgatgcgaagaaggaccatcttcacttgtggtccaaagtgcgcattttaaagcatgacaaacagataaaagatgacgtgcccaccatggaagtgttggtaagaaagttttatgcagccaatttaaaaatacccaaacatagttaatcatttatcacaaatttttttagttcaaataattaaaaatctaaaaaattgaaaaagaaatcgattcgttttttggcaaagaaattaagtttttaattttctcatgatttattaacaataaacgaaatttaaaattttttctccaggctgtcaatcaccacagctattatttattaaatggttttcaagataaaccacccattttgaatttaaaaaagtcatttttttaaatatatggaatcacaaaaaattagagttgtacgggaccgggaattttgagaaaaaccgggaccggtacttttcgggttgaaaaaccgcgatctttttttgggaaaaccgaaaaaaaccgggacttttcccggtcccggtcaaaacaggtcaaaaccccaggacttaggtactcagttgtacgtttttttcagtaccaagtcccggtccc

SEQ ID NO: 38389 - DNA, 602 bp, Heterodera glycines
tcattaccgttacaattattgtttatcggctactaaatttacgggtttttcatttccgaaagttgaccggatatcaaaaggcaatttactgtaatgaatttttgttttatctgcaaaacattagtgaaaactgaaaaaaacagcaggaaaaatttacgatgaaaaactatcttttgaatattggttctcagccaacagagttaattgttgtttggggcaacacatttattcatcttttgttggtataaaccattgtatggaatctgtaatatatttaaaatttttttaaaatgtattgaagttttttaaaattaattttatactggcttttaccattatgattttaaggggtaaaatataaatttttaaataataattgacaatttttgtaaaagtttaaacatgtactaattttttgtatatttctttacttggtttcccaaaaatattttatcaaataaaatataaaacattttttttaattttttgtttttacaccttaatttactctaaaataattcgaatttcttaaaatggactcataaaatcccggaactttgaattttttaaaaataattaccgtaaatgcattttgaaactga

SEQ ID NO: 38390 - DNA, 883 bp, Heterodera glycines
tatccaagaaaaatgactatctcttattttgagaaattttatacgttacaaatgctctcgagcatgataggaagtgaggtgcgcaatcgccatttaatttcacagagaatttttaaatttatcttatatccaagaaaaatgactatctcttcttttgagaaattttatacgttacaaaagcgctcgagcgtgagagggagggcggtgcgcaatcgccatttaatttctcagagaatttttaaatttatcttatatccaagaaaaatgactatctcttattttgagaaattttatacgttacaaatgctctcgagcatgataggaagtgcggtgcgcaatcgccatttaatttcacagagaatttttaaatttatcttatatccaagaaaaatgactatctcttattttgagaaattttatacgttacaaaagcgctcgagcgtgagagggagggcggtgcgcaatcgccatttaatttcacagagaatttttaaatttatcttatatccaagaaaaatgactatctcttattttgagaaattttatacgttacaaaagcgctcgagcatgataggaagggcggtgcgcaatcgccatttaatttcacagagaatttttaaatttatcttatatccaagaaaaatgactatctcttattttgagaaattttatacgttacaaaagcgctcgagcgtgagagggagggcggtgcgcaatcgccatttaatttctcagagaatttttaaatttatcttatatccaagaaaaatgactatctcttattttgagaaattttatacgttacaaatgctctcgagcatgataggaagtgaggtgcgcaatcgccatttaatttcacagagaattttaaatttatcttata

SEQ ID NO: 38391 - DNA, 1025 bp, Heterodera glycines
gttgtttttccaaattatatatataaatagaaaaacttttaaattttatttcaggcatttataatttctcttcgttataaaaaaataaaattttacatttatttagcatgttacataaataattagactgataaaattcgtttatagattaattatggaatatttaaagattgatttacaggaaaattatatctaattgtactttctttatatatataatctcattattccatgctagctattgactcagtttgctgaatcgttcaatgttttttttaataaaattttatatagtgcaaacatcttggcaagatggtgttaatccattgtgattcattctaacggcgaaattgttatgcatattcacagaggctcagtgaactggttcttatactatgaattaatttacattttttcaaaatatattttaattcaaattttgaataatcgaattaattctttttttattactctggttgagaattatatttaaaagatttcaaaaacgaaaaaaaaatgaaaaagcactttttatataaattcctggcgcagcgtttttatgtacacaaaaaaattaactttcaacattaatcaaaaataatgataattttgaattttaatattcgcagtgtatttcaatataaaaattctatattaattatgtatcaattaaaattaataaaaacattatttattgtattatttagtttataaattatattgtatttacataaataaatattgtcattaattgtaaaatcagactattttttatttaatatttaaaagtgtttaattaaaattctaatgaacttacatatttacattttcaattgatttttggttacattgaatttttatttatgtatactttcgccatttaatattttaattgcttattttttaatatattatttcttctgtcctggtaatggttatgttagagacaatagataaatttaactataaataaattaattttattatgtgtaagtctcattacgatgaatcattattttattgat

SEQ ID NO: 38392 - DNA, 1274 bp, Heterodera glycines
  misc_feature (47)..(47): n is a, c, g, or t
  misc_feature (208)..(208): n is a, c, g, or t
aaaaatgaaataattgttggcaaaaccaaaggcatggaaagaaattnttaaaaaaattttgtctcgaattaaaaaaaaatgccgcataaaaaaaataatattgcaaaatttgtcttttttaatgagtgcatttatgtagcgagaaaagcgtttggtttattaataatctatcattattttctgcaatttttacttttttggtttaatntaatattcattttggttaatgaattaaattgttttataaattacaggcttaacttaaatacacaaagatgattttgtttgcatttccccttatttttatttggtcccaaaacaatttttaaaacaaaaatatttttgcatttaaaaattactaattaaactttgggcaatttaatttaatgcacacagaggcgaaaaaggagagtaaatacataaatgcacaaaatcaaaacattcattcattttccgcgtttattcgtcggcgcggagataagcgccaaaaaggcgaattcatttcgtttcatttggtcattcattcgtccattttatattccattccctccgcccttatcgcagataattttggtgataattaaacctaaatttttatcaaaaaaatatattattttggagattaatttttgagaaatttctcatttcttagagctctattgaaaaaaaaatcttcaattctaagggggtgtattttctaaaaaaattttcgggtcatttcttagggtgcattttcccgattttattgcatttttaatggatttttcggaaaaacgccaaaaataacaccaaaatggaaaaatgccaaaaaggcatttaggcacgataatcccgaaaaaggcaaaataaaaatcaacgtagaagcctcaattcaagtggaaccgttgacactagaccaacaaatgaagatgcactaataatattttttattaatattttaatttatttttaagatttataaaaaataaattattatttttttaataaacttaataatttaaaagcaaataattaattaaaaacaaaaaagaaatttaaaaatgtggtatatcagaaagccaacactttgtatatcatgcgaaattgtttcgatttttgatttgaattttttaaggtatgaaaaaccgttcaaaaataggtcatacaaaaaaagtgcgatttttggttagtttttcgaacagttctaaacatttaggaaaacccgtgtttttcccttatagcacttcaaattatgcgtcgatagacccaactgtcgccccgtaacactctctaaa

SEQ ID NO: 38393 - DNA, 1244 bp, Heterodera glycines
gagcaaaagcgcattgaagagggacgaaaagcattgggaggagaagaaggaagcgacggggagcagaagggaggaggaggaggggacaaaaaggaagagcaatgccaagaggagaagcaaaatggagggcaaggagaaggaaaagcggtgatgccgaagagagcagtggcagcgagtcaaaattgaacaacaaacgatcaatcattctgcctttctttgttcatttgatcacctgtcaatcattgtcgtcaaccattctgatcagtaatatatacaataagtgctcgttttttgtttgtatattttcaaatagatttgttttatttgttagaaaatcgtaaacaaaattttaaaaagttggtttttgtgtgtattacacccgtacaaagcttgttttcgtatttagttggtgctcgggaatgcaaaattccagtcctgattcaaaaaagaacgaaaagtctgaatgttcttggtcgagaattgtgccgaactgtctctttacttaggattttcttggaaaagcccccatcccatttccaaccggcataaaacgggcagaccaatagacgccattgaaatggtgccattgagccgagactcatttggcccggactgaaacaagagatttctctggtagttcccgaacaccatcccaaatgtaagcgacttggcttcatttttatgccaactctttctgtcgatcacttttcccctcgccgcttctgtccccccgcctttttttgttagcatcgtccgcaccgtttttggcataacaatttgccaacgagtccctcgcatagctcctcccggttcaaatgcctgtcatggcacaacgctcgactccgatcggcacattctgctgttctctggtgctgatcgacgacgaagcggccgcccgcttctcctcctcccccgccttcgtccactgtcatcggtggcatttgatgggcggacgatggcgccgtcgtcgtcgaagtcgccggaggggtgcaagtgccgcaggagaggggacaaatctcggtccggatcacctccgatcgggcacaatggtgcagcattggcatggaccagaaaatgcagcgccagttttggtcttcgcacatgccgtcctcgtcatccgcggaatcggacggtttggcaccatcatcaacgatctgatgaggatgccaattaaagggacagataaattaaaagaattttatttttacaccgttctttgggcagagaaaaagcaacaaaatggt

SEQ ID NO: 38394 - DNA, 746 bp, Heterodera glycines
ccgcacctcagagaagatcagcatcagattcatgccgacaaacaggcgcggctgctgcgacaggtcgcgcacgcccgcgtcgcccaccacgccgatggcatagccggcgcccaacccacacagaccgcacacgaggcctgcagcgaactggctgaacccgcggtcgatggtgtagccgggcccggccgcctccagccggccggaaattatcaccgccaccaccagcccgtagatggccacaatgccggccatgaccactgaatttggatttttgtataaggggggaagggagaatggaaaaacgctaaaaaaaattgatttcccaaccgccggccaaaaaaaaacagaaaatttttttttgacaaattgtaattttcaaaaatttagtcagtttatcgggttgtgtcagattcgttatcagcgacaccgaaagcccccgggaagacttttcaagaatatgacaaaaaaacaattttttttacagccgataaggtctccccttttgttcaaaacaattttcaatatgtttttttttgaatttctttgaaaaatgtcaaatgaaatttccatccttcgctgcaggcatctcattaaaaaaaaattttaaaaaattaaagaaatgccattttgaaaaaacccataaaatttaaaaaaaaattttttttaattttctgtcttaccgggaatgatcgccttcatcacgaggtcaggcctagcgacagccatacaagcaatgccagtccctg

SEQ ID NO: 38395 - DNA, 859 bp, Heterodera glycines
agtgaaattacagtgcaacaaattgggactcatcacgaaatgaacagcagcagttgtgattgctttggacagtgaattcattgatcgctttttcgtcaacaacaataaattcatcaaagatttccattgaatgtgatttaagttctgttgaaaaataatgaatttatttattttacatattcttagataaaaaaaatgtgcattttgaaaaaagcctggacctggatttcatggacaaagaaaatccaggaaaattccaggtccaggaaaaattcatgttgccgaaaaatgtcttggacctggacctggatccaggaaaaatccaggcctgaaaagtccaggccgagctttaatgaaaattaaaggcaatggacttacatatacataaacgaattttatgaattctattttttcgcttaagggaattaccggactttcaagctttaaatttttgttgtcaaaagataatacaaatttaaaagaattttttttttgtaaaaaaatgggaaaaatctttataaatgaggaaaagatttttataaaaatgcaaatgcaaccactgcatatgattagagttgagcggtaatcggtaattgcaaaaaaaccggtaccggtactgaccggtactgcaaaaaccggtaccggtcccggtaccaactttttccaccggtaccggtaccggtaccggtaaaaaccggtaattttagaacataaaaatttttggactaaattttccaaatacaacatttttattcagttttcgcgcgagtgtctgttttttatcattagaattgttcagaagtatatgtatattcaggttgaccaaagttttttccaattcaggacatagaacactaaa

SEQ ID NO: 38396 - DNA, 1028 bp, Heterodera glycines
agggagtggaaacatgatttcaaaatttcaatttttctagtctatctactcaaaacggttcagaattcgataaaaataacattcacggtgcgaaaaatggggtttgcaaagtttattgggggaaaaaagactttacaaaataatacccctgggagaagggagtgggaaacatgatttcaaaattttcaattttttatagtctaatctactcaaaacggttcagaattcaataaaaataacattcacggtgcgaaaaatggggtttgacaagtttattggggaaaaaaagactttacaaaataatacccctgggagaagggagtgggaaacatgatttcaaaattttcaattttttctagtctaatctactcaaaccggttcagaattcaataaaaataacattcacggtgcgaaaaatggggtttgaaaagtttattttgaaaaaaagactttacaaaataatacccctgggagaagggagtgggaaacatgatttcaaaattttcaattttttctagtctaatctactcaaaacggttcagaattcaataaaaataacattcacggtgcgaaaaatggggtttgaaaagtttattggggaaaaaaagactttacaaaataatacccctgggagaagggagtgggaaacatgatttcaaaattttcaattttttctagtctaatctactcaaaacggttcagaattcaataaaaataacattcacggtgcgaaaaatggggtttgaaaagtttattggggaaaaaaagactttacaaaataatacccctgggagaagggagtgggaaacatgatttcaaaattttcaattttttctagtctaatctactcaaaccggttcagaattcaataaaaataacattcacggtgcgaaaaatggggtttgaaaagtttatttgaaaaaaagactttacaaaataatacccctgggagaagggagtgggaaacatgattttcaaattttcattttttctagtctatctactcaaaacgttcagaatttcataaa

SEQ ID NO: 38397 - DNA, 661 bp, Heterodera glycines
  misc_feature (372)..(373): n is a, c, g, or t
  misc_feature (375)..(375): n is a, c, g, or t
ttttttttttttttttttttttggaaaaaaaaaaaaaaaatttttttttttttttttttttttttttttttttcccccccccccccccctttttttttttttttttttttttttttttaaaaaaaaaaaaaaaccccccccccccccccacaaaattttttttttttttttttttcccccccccccgcctgccgggggggggggggggatttttttattataaaaaaaaaaaaaaaaataaaatttttttttttttttgttgtttttttgtggaaaaaaaaacaaaaaatatattttttttttttaaaaaaaaaaaaaaaaaagggggtttttttttttttttttttctttttttttttattaattccccannangaagacaaaaagaagagggaagaaggggaagttgttattattttttttttttttttttttcttttcccctcccccccccgcgcccgggcggggagaaaaaataataaaataaaattattaattatattagggggggggggggggggggggggtggggggggggggggggggacaaaaaaaaaaaaaaaaaaaaaaaggagaaaggggggggaggccgggcccccccccccccccccccccccccccccctcccttttttttttttttttttttttttttttttttt

SEQ ID NO: 38398 - DNA, 831 bp, Heterodera glycines
ttcacaacgccatttacaccgtaattcaggcagaattaaagaattactgatattatgttgggtcgagaaaatttcattgttttaaattgagggaggaattgttactttgccatttcagctgaagtcttccggtctgctcattgccgaactcgccgtgagcattaaagcggcgtgccgaattgatctgagaaattatcccaacgacaatcaggtcaaaattgcttttaaatgtttgaaattcaacctaattcagacttgtttcattttcctattcactccgacttattcggcatcgaggtgactgccacaaatgccaatgcttttccatttttacttttagtgtcactttttcgacattttcggcgatgctttccaaagagtcgctccaaggctcaattgggttcagtgaacaaagtgtggatgaggacagatcaaacattttgaacacaacaattgcaggtaaagctgcatttatgatacattttaaaatattttatattaaatttaaatttcaggaggcttcaaattggtcggaatgaatgtgcagcgtttttacgcttatggagagtttttcacagtcaatgagagtgtgtaagtaaaaaaacatgccaaattgcgaattaattatacactaatccttattataatttacaaaagtttcttttttagggctgcacttttctcgagcatcgccaacaccgttctgcgttatgaaatatgcctacagcgagaagtcggcggagtttacgccgccacagtgtccattcccatcttttgcatcacagcgtaaaaaacaaacaaacgaaagctaattagcataattaatcattg

SEQ ID NO: 38399 - DNA, 1177 bp, Heterodera glycines
  misc_feature (37)..(37): n is a, c, g, or t
  misc_feature (105)..(105): n is a, c, g, or t
agaaggggggcggggtggtaaaatttggcgtctgttngtcgggagggttagctcgcgtagaactcggtctgctcactccttgtaaattcaggtcaaaatgagttntagacaaaagtggtccttcctataagtctaccagtcacacatttcgtttggaattcgaatgttagccgcccaaatttggagataaactgaaattcagagtgtgcccttccttctgtttcaattcctgagataggtaacactggtacaaaaatgacgaaattcacaaataaggacagaactcgttcaaaaaatcacaaataacaagccggacaatcaaatctttcctttgaaaaagtcattgcttgccttttattggaaaaattggccttttttggtctgttaacaaatcagttttccgccggaccccctcccctcgcccgttcaccagaagttttatggaaaaactgcacccgcaaaaaattgttaaaaatcttattgtttgatcccgatgcactgaaatttacgatttgcttatttcctccccaaaaatcgttaaattcgacaatcggaggcgaaaaaaataatacattattgatcgaataattttaaaaataactaatttggaggcagtttcgcaaaacaaaatctgttctgattttgaaaaattgtcgatccgagccctgggtttaacgactttttaaaattttcatttttttcgaaaatggggggaacaaggtaaaacaattcagggggatgacaaaaaggataagtaacgtatgtccaacggtttctgtgatgacccgctaataggggacgaatgtttaaacgccaaaaaactttatgccatccaaatgtctacgtcaaacagagagagggagggagggagaggaccaaatttcagttaataaattgacacacgcttaatgaccatcaattcaatttatttcggaacacagatggaaataaagtgataatacacagcaaatgatatatgcatacaaatgtacaatacatcaataaatacagatcacgattatgggacatcttctttagctttgcatcttctgacaggtcgctcgctcttcaggtttcgtccatccatccgccggtcgttgttgcatcttctcacatgtaggcgctctgatccggggacttctcctgctgcaaaaacaaaagattagtgatgcttttg

SEQ ID NO: 38400 - DNA, 151 bp, Heterodera glycines
cgctcgagaagcgagtcctcgtgatgccggatgggcacagtctcgaactcgtgggccgaggacacaatctccagtagtcccttgagcttggtcgtctccttgatcgacgccgagaaggtctcgacggtgacataggagatgtagtagaacg

SEQ ID NO: 38401 - DNA, 931 bp, Heterodera glycines
tcctacgctttctatttctccttctccctcactctctctctccctctctccattcttcttcctttctctcttttccccctctttttgcctattattcgccttttcgctttcgttttgatcaaatatattttttcattgttcgcttttcttatttgtcctccacttcttccgtcttctttcttttcccttcccttccctttcttttcttttccttttctgtcctttcctttgcattttaatttttgagggtgcgcaacgcacaaatgggctgatgatcaatcattagcgcctcaataccattcttaaaaaccagcagtatcagcagtcccttttgggccattcccccccccccacaaatcagcacagtcaattcatcaattctttcgttccttcgttcatttccattctttgctgctctctttttctatcatttctcaatgctgcgcatgctcaacttttcgtttgcacagtattaaatcgaatgaaagaataatgaatttttcctttttatattctcccgccgatcaaatgggcccggaaattgtcactcgcgcacaacacaacaacaattgagtggtgtgtattgtgtttggtgaatgagcaatggcttaagaaagcacacattgtctgtgcaagatgagaaaggatgggagacggcgaaactttttattctcctcaataaaatggcataatttatttaccaacgaaaaagtaataataataagaaaatttcccatagggacggacaatcgtcattttctcacattcttgattttacattttgattcccattgtgctgagctgatgaaaagagaatcgaattgctttaacgaactgctgatatgtgcacacaaacgatcgttgggatgggagaagttatgaatcctagaaagcagcagctaactgaacaaaacgagccctacccaattct

SEQ ID NO: 38402 - DNA, 564 bp, Heterodera glycines
ccgccccccgcaccctctgaaccgcctctccccctcccgcccggcccattcattccctccctcattttcacgtgtgttcagcctcatcagcgatgtgtctaaatggaaactatccacacatacacacaacacatacatattcattggacgatttgcggtccaagagaatgggcgcgaattgtcggcattaaacaaaagccgcccttaatttattaacagtttcgcattttgttccccacaaaagtgtcgctgctcgagaccgagaattcccgagacttttcgggacgaactctcgaggagaaaaagcacaactaattaggcttttaccaaactcataaactaattgtgatcattttgtgcttaatttgttttcttttagttattctctaactttcgtcgtcctttcaccttttttctgtcctttggccttcgtccccccttttcggtgctttgtccaaattgccatcggcgcactctttcgatggcggccacttcgtttacggagtgtgttttccgtcaaataaacattcaaccgatagattggcttcaatttcctaatctccc

SEQ ID NO: 38403 - DNA, 855 bp, Heterodera glycines
aaatcctcctctgcatcttcaatttgagctctcgctactcggcgtctgcatccggttgttgatgcggctgttgaacaggttgaacattgccgggtggttggaagggacggtcagagttttcacttggtgacatttttcgttaatgcttaataaaaatgaatgacgaataagaatgagtcgctttgagaatgctccgccagcatgagtcattatcgatattgtcatactcaagagagagttcatgtctgttttctctaacattacatcattttgctgcaataaatattggtggttgccggcggatatttttcatttcttccattaccgtctcggcttcgctaggcgagaggtgaccgtgacttttaagccacctaattaaaacgaaccaaataagtaaaaacacaggaaatgcaagaagataatacgaaaaaagtagtacatgcaaaagggtttcattaggctcttctggggaattcaaaatttgtatggcgggtttcgttgtgttggtgttattcattttaacattacgtataatatttttatttatttataatttacccaagctttgagtcggagacaatgtgtcgattataatcaatcataatcatttggtcaaattctccgagaacaatcatttccactcctccctttggaattggtgaatcaaatgtggccctaatactggttgtaccgcttcttaacagctcaaatccacagctatcgtctaaggttgaattcaaagggatgacaaaatgcctatccatttttgaattgatccattgaaacgtcaaatgaacgttctgaattagccatgcccaacgcttcatacatctccacgaatgctcttacatagta

SEQ ID NO: 38404 - DNA, 1041 bp, Heterodera glycines
gtcgtcgttcttcttcgaccgcatccaccgccacaacctgagaatgaattagggccgagacggtgcccaaaagtgagtgaagctgcccttctttggggtcggtacgtttcggcttttaccgtaattatcgcaaaaaccaaaaataatgataaaaaatgccttttatcagagactcaaatataatgtacagacaaactatactcatacatcgtaaggtttttgctcatttttcaccaaaaaggctgaggaggaaccacaaaatctgaatgacgtccagaaacagaataatcgacgcataaacgtattcttccgaggaaatttcgtaggtacgaccgcccatgaccaactaaaaaataaataaataaatggttggctattcatcgcttcaatttttccatcttataaaattacctgaatgtgaatggcaaaccaaatcatgatcagaattgtgccaattgcggcgaaaataacttgcagaatgtgcacattggtgaaaaacgcagcaatggccacacccaaaccgaacaacgccaaacacaaggtggcgattgtcataatgcccattatgctgtattaaatgaacacggattaattagcagtagaaggcacttgctcttttggtgtgtattgcccccccccgccataagtcggtcttttccccatcaaaaaattcttacaatttgcattacaaaaatagttttgttttagtacattttaaatgcctactttctcacgggaaacccacttagtcaagtcctttttgatgattgtggcaaaaagggccacgccgaagcacgaaagggcagtgatggtgaacaccataaacacggaatggagggcgtactgagcagcgagcatcatggtcacgaagccaatggaaaaagtctggagatgaaaaatgagtaattcgggataaatccaatccaatggagtcaaaaagaagcatattggcgtaactttcaaagaggagtcttttgaaaaaattttgcactttttttggtctattttttttacacataatgataaatgcccagaggtttt

SEQ ID NO: 38405 - DNA, 986 bp, Heterodera glycines
  misc_feature (29)..(29): n is a, c, g, or t
ttcaaattgaaaagaagactcgcctcttntccgtctccgtcccccaccaaaaaataaacatccgcgtcttctcccgtgctcaacaaatgcttcatccgataaaccactgattgtgacattataaacaattgtgaaattcgtaatttatctattttatgcaataaaataattcgaattatgaaattggaacaagccaaaataacatttgaattgcctttgagggactaaaatcacaaattgccaaatttatgaattctcttttttaaataatatttaaaagggaacttattgaacaaaaaagtaattgcagaagagttaaatgaagaaagatggcatggttcacttatatttatgatggggtggcgagggcataaaataataattaagggcaaaacgatgacccaaaaaataataatttaatctccattttatatataataaaaaaataatatcaaaatgtgcaacagatagagaattttgtacaagattatggggtgcgtctcttccacccaaaaatatttatccaggcagaaatttctattctatgatttaactctgtacttatttttacaaaaaacctgacaaacttggttatttattgtggatttaaatttcaaatttataaatttttattatatgctaaaacaaaattacatttttatatacagaaatttttttccaaaagttcttataaaaatttaaaaatttttcgattttaagggtgtatgtttaaaaaaattccataaagtcgatctttaggggtgtatttttcgcttttatcgcatttttcttatgaaaatttccaaaaaatgaccaaaatatgctctcaaaacccaaaaatggccaaatatgcatttattctcgaaaacccccaaaatatgcttttatatgcactaaaaaccttcacctaattaaaaaattttaacgcagaaatgctatttttgagcccctttctttatagcatatgagcagaaaaaatatgcaaa

SEQ ID NO: 38406 - DNA, 610 bp, Heterodera glycines
cttgaccattcttccattcttgccttcgatctccggcgggtggcgacgagtcctttatttctttttcatttcgcttaaaaatgcttgtcctctctaatctatgaattatttacctatatgtagttttcattaccattttcacaaagtatttgtatcaaatctaaaattctcaggacaactagtcttttttgtaaattatttcttttataaatttctcagattattaaatgaaaaaataaattatgaaattccataatattaaaattctgctaatcttagggatatttttttcaaaatccccccccccccccctcgcttcaaaggcacagttgctcagccccgcaatgaaattgatgccctcgggcgactggcggtgtcttctcgcgcaaaggccaaagatcacagcacaaattatttgtccgttttgttagacgtcagacgcacaaaaagcagtgcaaaaatttgggttttctgctcccatttgtgacgtttaattcaaaaattgggatccatttttttattttccatttttagatatcaaatttgtacaaaaactttcacaaaatcataatatccattgatgaaaaagcataagtaaattattatttct

SEQ ID NO: 38407 - DNA, 1274 bp, Heterodera glycines
taattgaagacggtttggctcccagtgttctattcacacctttgttaatgtttgttttattttgtctattacgtcgacccctcgaagagtgtctttctttgtaaaatatctgtacaagcgctcctttattgtccgatttgccctttcaacgactccggcgtgcagatcaggactatacattacatttttgatgatgaatttttcctcaaaatattttttcatttttcctgcttggaattcaagcccactgtcactatacattttcatcgggataattttagacttttcgaacacccgatcaaaagcctcgatcatgtcctcactcttctttgacttggccggtgcactgaagatcattcgactcagcacgtcgatgcagaccaataaatatttataaccgtcgttatgctttttcaactggtcaaatatgcacaaatcgcactgccaatcggtatggaagccacttggtatcgtctttagtctcgggaatcttttcctgatgggcttgtgaatcgtgtatgttttctgcttttctaggaatttattaacgtcatcggtcgtaattttcgggtcaatctttttggccgcatttaaaattttttgaattccagcaaaacttgccggagattttaaattaaaataaattttcgataaaattttctctacagtcttgcccatattagtggtttgaagggtttcttcactcgcactatgccgggtgtttttatagattttattgcctttttccttccacgtccccacatgacctttgatttatcaaccatgtcttttactgttggatccttcagtaaccgatctttgagaaattttgcaccgcgcggcgtttcatctttcttccctgcgagatacaacaaaacatctctataattactgttttcaatcggcaaattcatgttcgactgtacctttccggccgccgtaattttaaataaatctttgttttccttcacgtacctaaaaagaccgtttaaaagggtcgggtgtataatagttttgatcggaacgggtgttttgagtgtggatgttgtttggggttccggacttaactcctcaagtgtatcattatctgattcaggatcaggagtttgctctttaagtcttttcctaggaataattattttccgtggttcttcggtctcctgtggtttggattggttattgaggcccagatatggtgcaacatttggacctggtacatgattctcaatcactaccttctgtggtctattttcaagtatcccctttaccgtacg

SEQ ID NO: 38408 - DNA, 786 bp, Heterodera glycines
tgatctctctctctctctattttttgaatttttgacaaaatttatgaatcaatattctgataggttatgtaaatttagttgattttttgcaatttatgctttaatttttccattttagtattacccttggaggaatttacgaaataacttatgtatcatccaaataacctacacaagcaacgcaaattcaatcagtacacaaaataccgtcgtatacaattcataagaatagttgagcacattaatcatctcattgtcggttgtaagttgaaaatgttggatggccaaaagtggcacggtgccaaaacaatgaaaaagtggcacagaaacactggtgccaattgacgagcagttcgaatattttcattcagctgaaaacagggctttcgttatattcaaaaaggaaaagcgattcttaattggtaaggatttcaatttatgtaaatacatatttttttccttgattctccatggtttaaattgtaggaaaaaacactttctttttgtgtttgcgacaaaaatcgggacttttatttacatatttttaatatttcaggattttctacatattttggactttttcttaatagttgagcacattaatcatctcattgtcggttgtaagttgaaaatgttggatggccaaaagtggcacggtgccaaaacaatgaaaaagtggcacagaaacactggtgccaattgacgagcagttcgaatattttcattcagctgaaaacagggctttcgttatattcaaaaaggaaaagcgattcttaattggtaagg

SEQ ID NO: 38409 - DNA, 970 bp, Heterodera glycines
cgagatagaaaattgtcctaaaaagagataaccatttttctgagaattaattcacaatttccgcagctcttacggtaatggaaaaaattttgaagaggctctccggaacggattagcatcggggttacgagatagaaaattgtcctaaaaagagatagccatttttctgagaattaattcacaatttctgcagctcttagggtaatggaaaaaattttgaagaggctctccggaacggattagcatcggggttacgagatagaaaattgtcctaaaaagagataaccatttttctgagaattaattcacaatttccgcagctcttagggtaatggaaaaaattttgaagaggctctccggaacggattagcatcggggttacgagaaagaaaattgtcctaaaaagagatagccatttttctgagaattaattcacaatttctgcagctcttagggtaatggaaaaaattttgaagaggctctccggaacggattagcatcggggttacgagatagaaaattgtcctaaaaagagatagccatttttctgagaattaattcacaatttctgcagctcttagggtaatggaaaaaattttgaagaggctctccggaacggattagcatcggggttacgagatagaaaattgtcctaaaaagagatagccatttttctgagaattaattcacaatttctgcagctcttagggtaatggaaaaaattttgaagaggctctccggaacggattagcatcggggttacgagatagaaaattgtcctaaaaagagatagccatttttctgagaattaattcacaatttctgcagctcttagggtaatggaaaaaaattttgaagaggctctccggaacggattagcatcggggttacgagatagaaaattgtcctaaaaagagatagccatttttctgagaataattcacaatttctgcagctcttagggtaatgg

SEQ ID NO: 38410 - DNA, 1014 bp, Heterodera glycines
cggtaatggaaaaaattttgaagaggctctccggaacggattagcatcggggttacgagatagaaaattgtcctaaaaagagatagccatttttctgagaattaattcacaatttccgcagctcttagggtaatggaaaaaattttgaagaggctctccggaacggattagcatcggggttacgagatagaaaattgtcctaaaaagagatagccatttttctgagaattaattcacaatttccgcagctcttacggtaatggaaaaaattttgaagaggctctccggaacggattagcatcggggttacgagatagaaaattgtcctaaaaagagatagccatttttctgagaattaattcacaatttccgcagctcttagggtaatggaaaaaattttgaagaggctctccggaacggattagcatcggggttacgagatagaaaattgtcctaaaaagagatagccatttttctgagaattaattcacaatttccgcagctcttagggtaatggaaaaaattttgaagaggctctccggaacggattagcatcggggttacgagatagaaaattgtcctaaaaagagatagccatttttctgagaattaattcacaatttccgcagctcttacggtaatggaaaaaattttgaagaggctctccggaacggattagcatcggggttacgagatagaaaattgtcctaaaaagagatagccatttttctgagaattaattcacaatttccgcagctcttagggtaatggaaaaaattttgaagaggctctccggaacggattagcatcggggttacgagatagaaaattgtcctaaaaagagatagccatttttctgagaattaattcacaatttccgcagctcttacggtaatggaaaaaattttgaagaggctctccggaacggattagcatcggggttacgagatagaaaattgtcctaaaaagagatagccattttttctgagaataaattcacaatttccgcagctc

SEQ ID NO: 38411 - DNA, 761 bp, Heterodera glycines
tttggtctcttcataaattccgccaagggatgggaaaaccttaatggaacacataaatataaactcataatgactcagtttcaaccaaattaaaatatttaatgataccatcattcaatagctctggattttctctatctgctgggtattaattttccaaaatttaaaaaaaaagtaaaaaagaagttgtgagtactcattaaaatgtttgaaattttatagagaaaagccctgagctatttaatgataccatgaaatattttaattggttaaaattgagcaaattatgaatttttatgtgttgttttctaccccttggcggaatttaagaagcgaatcagcataatatttaagtgatttattttataaatctttaagcatttagaaaataataatatggcaaaatgaacataatgatgctcttgttaataacatagatcagacaaattgatgaaaattgatgaatttttgtttttttgttttttgggtgggattcactcgctgtaacagcagcgaaatacgcataaaaatattttttgaattaggtaatttgaaaaaatgagtgttgatgctttattttgggattacattttgaaaatataaaaaaaatatcatagaaatacagaaattaatgctaagagatgaaaaacatcagaagtgtaaaaccataaaccaattagatccataaattaccatcttcttgaggatcagcattgtctaagaatatttttgaaaagagttaaatttaaaaaaatatattt

SEQ ID NO: 38412 - DNA, 1034 bp, Heterodera glycines
  misc_feature (82)..(82): n is a, c, g, or t
caacattttaaatcaaatcctaaataaaaattcgtgaaaatttcttcgcctcttatttgtgcaaaatttcgaaaaagtaatntactattaaaattaaaaaattcagaagcaaattcaagaattttttttatttttaaatgcattttttaccacatgaattatgattaaatttttgcgtttcgaattcattttggaattaagaaaaataaaaattgataatcatttgatcatttttagcgcactttaagcaccgccgttaggcagcgcagttccaaaatttattccatgccacagatattatgggcaggacacgccaagtacctcaaacttgggtaattaaaccgaagaaagaagtgcagtggggaagaatgacgcccaaaatgaaggaaatattcgatgctgtgcgaactctttgtgacccctctctgactctgccaatgcagcagtttaccatttttacaactatttttctctcactcatcgtctgctcgtctctcctttattataagctatttttccaaagccaacaacgcccttttctccctcttttctgttagtcatttctcattggtgttgacgatccaacattcagtgtacaaatttgttaaacctctcaacattttaaatcaaaatcctaataaaaatttcgttgaatttcttcgcctcttatttgtgcaaaatttcgaaaaagtaatttactatttaaaattaaaaaattcagaagcaaattcaagaattttttttatttttaaatgcattttttaccacatgaattatgattaaatttttgcgtttcgaattcattttggaattaagaaaaataaaaattgataatcatttgatcatttttagcgcactttaagcaccgccgttaggcagcgcagttccaaaatttattccatgccacagatattatgggcaggacacgccaagtacctcaaacttgggcaattaaaccgaagaaagaagtgcagtggggaagaatgacgcaagaaaatgaaggaaatattcgatgctgtgcgaactctttgtga

SEQ ID NO: 38413 - DNA, 1114 bp, Heterodera glycines
  misc_feature (9)..(9): n is a, c, g, or t
aagagcttncgtctttatttcgcactgatgtgaataaaaatttacggatgtggtcagtttctggtgagtgtgaaagtgccgaaaatgggcggaaggcgaagaaaaacggaaaaagacgccgaaagtgaactcgtcaagcagcaggcggaggaggtaaatgggtgtgagcagaaaaaagaaaagcgcaacaacggcaccggcaccgaaccaaagggccttaggaaaacaaaaataaagtgcagaaaacgaatgaaaatttaaaaaatcccacaaccatataaaaacggtaaaaaaataattgagttgccaattcggaccaaaaatcgtgatctgcgaaggccgagaatgcatcggtcaacggccttgagcagagcaagagttggacgaggatgagattcgaaattggacagatagaaacgaacctaaaattaatcaatcatacaatgaatttgattcttttttttactaaaatttaaattaaaaagataaaaattacttggaaaggtgtgacagaaattcgatgcctttccaaaaaattgagataactaaaagcgaaatttaaaaatggaaaaagtaacataaaaaatcacattttttaccgttgtgaattcaaatagcgcaaataaaagtcggagaaaagaacgaaaatccacgcaaacagaaccaaactcagcaaagtgaaaaaggacattcgcacggcgacatttccaaagattaaacaaaatctgaaggcatttgcttaattagtaattgatgaatgatcgaggcctcaaacttcaattattgggctattctcgtgaaaaaatacctaggtaattcagcattcccaactttcaaactccgctttccgaaacgcgaagcgaaacaaaaacttttctttacatttgaaatttaaattaaggattatatttcgtcaaattagcattttattgattaatttaaatgatcaataacaattcacgaacgaaccttgggaaattcaagtgcctattctgggcgccagcgcccgataaaagttaatctcaaaatttacagaattagcaaatccattcaaattccgttcctttcactagaagtacatgttggacttgttttcttattccaaaccattctt

SEQ ID NO: 38414 - DNA, 60 bp, Heterodera glycines
tatccgttaagctatgaccacgtgcatcgtcgcggggctttgttctgtcggacgggcagt

SEQ ID NO: 38415 - DNA, 924 bp, Heterodera glycines
  misc_feature (16)..(16): n is a, c, g, or t
tgcaggtcgaaatttnttttaagtagaaaaagtaggtagggtagtctagcaaaacatttttcacctgggtttaataaatctaggaaaattagtaagcttttgtagtgttccgatacgtatctctgcaaaatttggtgagccgctgatcaattacaaattatttatggacgatcaaattttttgaaatttttattaattttgcaaaattaattcataaatttttttcagaaactgctctgaaacgtaccaaaatttatttacaagttaaataaggcacactgactcttatattatcaaaaagggatatgaataaatattttaaaaatttttaattcctttttaaacaggccaaaaagtttaggcttaactttttttcagaaagtgctctgaaacgcaccaaattttatttacatgttaacaaggtcctcttaggcttatattatgaataagggtgaagaataaaaatttttctaaattttttccttatattttggttatttcgttcaactttcggtggggtgcttggaaaagtggaatcatgcgtacccgtccgatctgacaagttaagcaacgctggctgactagtcaaaaggatgggggccgtgatgaaacgaaaccagcactgcttaccccgcggcacccggcacggacccccgaaggaatggatttaattaaattctctccttcggggatttttttccattaggtcgtctgttagcgtttgattgctctagtcaatttttcaaattttttgtgaaatatttgtcgtgctctgaaggggggggggggggggggggacgcgtataatgtgatgggacgacgtaaaatgttgttgggacgcgtaaagtgtcatgggacgcgtaaagtgtcatgggacgagtaaaatgccctgggactcgtaaaaccgactagaacccttttttt

SEQ ID NO: 38416 - DNA, 503 bp, Heterodera glycines
ggctgctgcgtgtcctatttcatggtcgcacactctttcgccggcgtcgtcgtcttcgtggatgcgtcgtcgtcttccccgaaggacagtcggggccgcggcgcatccaacggcttctgaccatgattgggaattttatttattttagttaattattcaaacaattatttaattttcctaatgagcagggaacggtaacttcccaccccccccccactccaatttaccctaacaattcgtccgcaagagcggcgagacacgcgcgtcgtgcgcacgattttttttgttggcgtgttgacgccatgcagctgtcgaacctgttgttgttgttctggggcaatcccaggtcgtcctcgtttcctgcctgaaacgcacgaaaaacatgtttttagcttggtttgaagcttgttggcaggatttctatatccatatttttccatatttcgcgacatgattgagaattttatatattttagttaattattcaaacaattatttaattt

SEQ ID NO: 38417 - DNA, 832 bp, Heterodera glycines
aaaaaatatgctataataattcttaatttataaataaggttcttagagagtatttctgaaagtaagatatttgaataaaataatttaaaaaaattatttattcactaaattcttatttttttttttaaaattaatcacagtgcttaaattagtaagtaaaattaatttactcgataaatttgcaaagtggtgacagaattcattgaggatgatcaaaaaggttgagtatggccatgctttgacctgcagttaaattggacaaacaattaaagtgaataaaatgattatacaataattaccatttctggaaaagttgaggccatcttcggcttttctgctctcctcttgaatttcacactgccattctgttgaagcattgacacatttttgccatcttaaaaattaaaaaaataaaaattaatttttaaaatattaaactttttaaaaatttatttaatctgcttacagtgttggttctcctcatttgctgaagacattattatgttataaatttttttttgttaattagccaatttgcgctttgataaaatgagaagttgttgaagcgaatatgaggtaattaattaatcacttaaaataaaagaattatttgtttgctctcaaatttgaaaaaaaactaatcatttaaagatttttatttgctctcaatcgaaaaaaattaattaaattgaaatcaaaacaaacaataaatcagcctggcccacaaatttttgtttactttttgtctcctatttttacgacattttttaattaaatgtttgcgctcaatttttgatggcgttaaatgacatatttcatgtgccgccgcccc

SEQ ID NO: 38418 - DNA, 891 bp, Heterodera glycines
  misc_feature (67)..(67): n is a, c, g, or t
  misc_feature (100)..(100): n is a, c, g, or t
tctcatcttccgcctatgagtcgggcacaatttgcaccccccaccccgcatcctgctcttcattggnactgttagtgctgtcccccttcaccgagtcggncaatgtttgcagctgtgcccgcctgtacttccagaaattgtgccgaatcgggtcaatcccctccaacacatccaaatactaaaacaatggtaatacatgaacaaaaaaaaaatgataagcagcaggaaaacggggagccaaacttaattccggtttaatttgaaaaaaaactagggatgtaagtgaaaatcggatatttttaggggaggaattttttgaattcaaaaatttttgataggtccgcaaaaatccatgttctagaaattgtttttatatgcattcgtattgttggtatttcaatgaatgaatatctctactatctactcaattctccactccaaaatgagtagattttatgtgtatttaaaattaatttaaaaaaaaattttttttttttttgcgattaacgcccttatggcacgaaaaataacaaaataataatttattaataaaattccaacttcgccacttttttgtgccatttccgtcaattgttgctcatttgcaaccgcattttcgcgcattttgtccgcaattttgtcgatgagaaattggaacagatgggacgagttgcacggcggatgacgagccaacagttcgtcacagcagtgcacaatttcgggacggtcagtgcccaacggttcattgatcagaatgctgaaaaaattttggcatagaccatttatgtacctatttagttttcaatttttttccattccatccgtttaaaaccaatttttcgtgtggcattttgtttttttggctctgaagccaccccccccccccaaaaa

SEQ ID NO: 38419 - DNA, 977 bp, Heterodera glycines
cctttgccatggaatttccacgaaaggacgcgaaatgcttcctttgggtccaaaatgcggcccttttgatccgcataatttatttcaatcttaaaacaaatatacattctttcgttgctacctcaaattaacaaatgccaccacaccttcggttcgtactccgctttctcggggaatggacgagttggccctgtccccgttgtgcccatacgttccaactttcgcatcgttttgtcctcaatgtcactaaagagtaaaatgtgctgaatatccgaatttgaaaaagggagcatagggaaaaagaacgagcgtatttctcctaattaactttcctttccacctcttagctcctcaaaaaatatccgttaattacaaaatttgaaatttcctcatgaagtactcttaaattgttcgggtgaaacgacctgctccaaaaaggagcataccaaaaaataaaacgcttcttcgaatagaaaacgcgagagaatccgttctaaacggggccagagacccctctccccgtctgatgccgaatattatttttccgaaattaagaaaacggattcgtaatccaagcatgactggcatcaattaaaacacttactatcgtccctgctcaactttggagaagcgtttgctctccaggtgcttcagtttgccttcctccagcttccgctcgcccgactccaaatagcccttttggccggccaatttcaacatcgctcccacgcccttcgtcacgtccttttcttcgcccaaaatgttcgtataagtggtcgattcctcttccccttcgtcctcttctgctttttttgaattgttttgtgacactttgttaccaatcagctcaccttcgtcactttcgctgaccgtcgatttgccattccccgtcgctattggccccaacccgtcaaagtcagtggcaatgtccatttcattgtcctggcaagaaagccagctaattgtaagtctcctcc

SEQ ID NO: 38420 - DNA, 974 bp, Heterodera glycines
  misc_feature (925)..(925): n is a, c, g, or t
gggatagagtataaatttaaaaattccctcaaaaataaaaggtctattgcgcaccgccctccctatcatgctcgagagcatttgtatgtgtataaaatttatcaaaaaaagagatagacatttttctgggatagagtataaatttaaaaattccctcaaaaataaaaggtctattgcgcaccgccctccctatcatgctcgagagcatttgtatgtgtataaaatttatcaaaaaaagagatagccatttttctgggataacctctaaatataaaaatcctctgtaaaataaaatggcgattgtgcacagccctccgtctcatacgcaagcgcttttgtgaggtataaaatttctcaaaaaaagagatagccatttttctgggatagagtataaatttaaaaattccctcaaaaataaaaggtctattgcgcaccgccctccctatcatgctcgagagcatttgtatgtgtataaaatttatcaaaaaaagagatagacatttttctgggatagagtataaatttaaaaattccctcaaaaataaaaggtctattgcgcaccgccctccctatcatgctcgagagcatttgtatgtgtataaaatttatcaaaaaaagagatagccatttttctgggataacctctaaatataaaaatcctctgtgaaataaaatggcgattgtgcacagccctccgtctcaaacgcaagcgcttttgtgaggtataaaatttctcaaaaaaagagatagacatttttctgggatagagtataaatttaaaaattccctcaaaaataaaaggtctattgcgcaccgccctccctatcatgctcgagagcatttgtatgtgtataaaatttctcaaaaaaagagatagccatttttctgggatagagtataaatttaaaaatcctctgtgaaaaanatggcgattgtgcacagccctccgtctcatactcaagcgcttttgtgag

SEQ ID NO: 38421 - DNA, 971 bp, Heterodera glycines
attcaaaaaagcaattattaaaagataaattgttttcccgacacagttaaactgcgggactgcttttgctacaacaaaaatgacaaactgatcacgccagaaatggttgcagaagtgttgtgtgaaggtaattcaatttataaaaattatttgccttttttaaattgcattgttttctaggtaattcaaaattttctttatttgctatttaagaaaattttaaaaaataggggggggagtattttttaaggagtaggaaaccttcctcaccgattttaaatatcattggcttttggtttctttaaaagctccagaaactttttgccttaatctttacaatatttgaatttgtggcttttaaaaattacgatttttatatttttggaattcccctgtagatttggatttgcctctcaacacttttttgcccgctattgcccagaacatccagcaacaaattgaggcccattctgaaccaatgccggacgatgtgcaggccaccgaccaacgcgcattgctcaagctgaacatccatgttggcaaccaatctctggtaatttacacaccgacggtattttcaattctgtccattgaaatgacttttcccatcccccacaggtggaccaattcgagtgggacatgagcaacccgaacaacagtcctgaacagtttgcacagaagctatgcgcagagttgggcttgggcggcgaatttgtcggtgccattgcctactcaataagaggtgggtctttttgtacatgaaaaggtacttatgcagtttgggggccaaatttcacacatttttaaatgccaataaatgtacttgtattatacattatctggatacaaaagttcggctccggattcgaattggccgaaattgatgtcatattcgcgatcatcgacctggaaacactctaagatctttaaaaaaaagtatataatttaaacacatttatgggcttttaaaa

SEQ ID NO: 38422 - DNA, 1041 bp, Heterodera glycines
agacatttgcgcctatgtccaaatcggactcaaagttgaattttttcaaccctgatagcctaattagcattaaaaagaaaaaaacacggtcattttttttgattatgttcaataatttgttgtttgacaatttaatttttttttcaaaaattctttgaagatcaaatgatccgatacaatcactttcaatcgcatatttaaagctgtttatgcgatcagggattgaaaaaacttaatttttaactcgatttttggccaaaggcgcaaatgtcggggcacgcataaaacatatgcattttccgacttcagttcacgcccttcccttgttagcgtaagcagttttatggatttatttatttttgctgaaattggtttcttcaccattattccttttgtgttgcacctgcaaaagaacgccatgccaaagtgtctgccagccctcgtggcgcaaaatgtgccgcagaatgtcacgcaaccgatttgttgagccttcctcacgtaatcgtgtccgaatcacctctaaagaaggcaaaaaacagaaatgttaaaatttttctgtaagaaaatccaaaggaaaaaaattttgaaaacttttgggacacttactattaattcatcataaagttaaaaaatatatgaaaaatttttcgaattttttcatggaattttcttaaaaaattttttttgacagtagattttttcttgaagaattttatatttgaaaattaaaaaaaaaattcggcgtcgaaattttgccccgttccgtgaagcccagtgccccacttcggtccagactccttgtggccaattaaaaacaaatgaaaaattcccatgcccccccctctcctccaaattttcgggtgcacaaaaaatcgccgcagaaatttaaaaagaaaatttttcaaacttagaaattatcaaacagaatcttaaaaaaataaaaaaaattttcctgaaaaaatcattgaaacatttttttttaaaaatcttctaaaaattttgacaatattcataaaattccgaaaagcgctgaaaagtttt

SEQ ID NO: 38423 - DNA, 967 bp, Heterodera glycines
ttataaaattatgtatagaaaaatggatttttgttttactttaggagaaaaaaacattcttgggaaaaaataaattaaagaaaataactataattttgggaaatatagccctgcccttatttgtaaaaaccgtttttgtaattagttattttaaccgtacttgtattcaaggaccattccagccaccttttgacttgcttgtgatgggacaaaaatttttggattcggtgacgcaaattatggtcaatggaatacaaagaggaaattttgaccaagaattaacaactaaatttgataatgaaagctcttttggcattttgttttgtactgccaattttgcatttgaaatgaacgacaattttggaaaatttctgagcaatttttgccatgaatttaaaactggaaaaaatctggaagaagcaattgaaactgtgaagaattctttgataatactaacaagaagcatcacaattgagcaaattatcattaaggaaaatatatttcaaaaaattgccaaaaacgaattttttggtgccaaaaatgcggaaaatattgcaaaattttttgaacatgccaattcttcgtttcgcctaagcttatcggcacagttggtaagaataaaaatttaaacgcaagtttttaatttattaaaaaaaattctatctttttttagtttgtaatattttaaaaatgttttagcatcattttaacaatttaatgagtgcatccgaaaatgtgccatcgacaaagaaacgaattcgtcgtatgatacgccgaggttttagcagagcaatggaccaatttcaaaatagcctggacaactcacgatatcgccttcgaaatgatcggaaaaaatgtgctttctttttggcacttagtgtcgttgtgctggttggcatgttttcacgatggccaatttggccaaaatcagtgacaatgccagccatggtcaattggcatttttcat

SEQ ID NO: 38424 - DNA, 762 bp, Heterodera glycines
  misc_feature (20)..(20): n is a, c, g, or t
aggaaaattagtaagctttngtagtgttccgatacgtatctctgcaaaattggtgagcccctgatcaattacaaattatttatggacgatcaaattttttgaaatttttttaagtgcaaaagtggtgggtgtctgcaaaaaattttcaccgggtttaataaatctaggaaaataagtaagcttttgtagtgttccgatacgtatctctgcaaaatttggtgagcccctgatcaattacaaattatttatggacgatcaaattttttgaaatttttttaagtgaaaaagtggtgggtgtctgcaaaaaattttcaccgggtttaataaatctaggaaaattagtaagcttttgtagtgttccgatacgtatctctgcaaaatttggtgagcccctgatcaattacaaattatttatggacgatcaaattttttgaaatttttttaagtgaaaaagtggtgggtgtctgcaaaaaattttcaccgggtttaataaatctaggaaaattagtaagcatttgtagtgttccgatacgtatccctgcaaaatttggtgagccgctgatcaattacaaattatttatggacgatcaaattttttgaaatttttttaagtgcaaaagtggtgggtgtctgcaaaaaattttcaccgggtttaataaatctaggaaaataagtaagcttttgtagtgttccgatacgtatctctgcaaaatttggtgagcccctgatcaattacaaattatttatggacgatcaaatttt

SEQ ID NO: 38425 - DNA, 70 bp, Heterodera glycines
gtccgcttggttgcagtttattttttgaaagaattgctttaaaatcaaaattatggcttttgcaaaatct

SEQ ID NO: 38426 - DNA, 414 bp, Heterodera glycines
ctttttgaagatttttagtgacttaaattcccagccctattgataatatatatcttgtggtacaaatggtacaaattattaaattcggcatttaaaaactagggttggtcgggaccaaaacacggacaaccaagggcgcaggcagcggggggctgagggggctatagcccccccccccccgaaacccaaaaaaggaaaaagtttcggtagagttttattaaattttaagcaattttcttgacaaaattgcattaaaatactcaaaaaaatgtccggcgccgcctattggcaccgccggatccctattgtaccaaatttttgacaaatggagatcaaaatggcgaaaaataccaattttgtggcgaaaagcggggaaaaatttgtgtaaaatacaccccgtacgctacgattcca

SEQ ID NO: 38427 - DNA, 1154 bp, Heterodera glycines
ccctgatcaattcaaattatttatgacgatcaaatttttgaaatttttttagttgcaaagttgtgggtgtcttgcaaaaattttcaacggggtttaataaatctagaaaaattagtaagcttttgtagtgctccgatacgtatctctgcaaaatttggtgagcccctgatcaattacaaattatttatggacgatcaaattttttgaaatttttttaagtgcaaaagtggtgggtgtctgcaaaaaattttcaccgggtttaataaatctaggaaaataagtaagcttttgtagtgttccgatacgtatctctgcaaaatttggtgagcccctgatcaattacaaattatttatggacgatcaaattttttgaaatttttttaagtgcaaaagtggtgggtgtctgcaaaaaattttcaccgggtttaataaatctaggaaaattagtaagcttttgtagtgctccgatacgtatctctgcaaaatttggtgagccgctgatcaattacaaattatttatggacgatcaaattttttgaaatttttttaagtgaaaaagtggtgggtgtttgcaaaaaattttcaccgggtttaataaatctaggaaaattagtaagcttttgtagtgttccgatacgtatctctgcaaaatttggtgagcccctgatcaattacaaattatttatggacgatcaaattttttgaaattttttaagtgcaaaagtggtgggtgtctgcaaaaaattttcaccgggtttaataaatctaggaaaattagtaagcatttgtagtgttccgatacgtatccctgcaaaatttggtgagccgctgatcaattacaaattatttatggacgatcaaattttttgaaatttttttaagtgaaaaagtggtgggtgtctgcaaaaaattttcaccgggtttaataaatctaggaaaataagtaagcttttgtagtgttccgatacgtatctctgcaaaatttggtgagcccctgatcaattacaaattatttatggacgatcaaattttttaaatttttttaagtgcaaaagtggtgggtgtctgcaaaaaattttcaccgggtttaataaatctagggaaaataagtaagcttttgtagtgcttccaaaactattctctgcaaaatttgg

SEQ ID NO: 38428 - DNA, 678 bp, Heterodera glycines
cgcctgccccctcttcgcaaaaagtttttttggaaaaagcgcgcctcaaaaatattgatttttaaatttggaataaaattttaaaaaatgatttttgctttatgattttaactattaaaaagttgtagaaaaaatttcgcttttcgcatttcgcttttcgcattttcgcatattttggcttttcgcatttcgctttttttttcatttcgcatttttcagtttcgcaaatttcgcttttcgcatttcgctttttatttttcaatttggcccatccctgatacatatacaaggggtgtctcggaccaagggctatacgacggacgattgggacagggggggggggtgtctcgggaccgatttttcatacgaaggtccaattttttctacagcgaccttttttttttgcttttcaaataaaccaatttttatacgccattgtttttattcatttgaaaacttgaaaacatagagatttgattcgtcaaaagcggtgtcaaagtcaaattggaattggaagaaccctccggcaccgtcggtggcatttgcatttgagttgaaggcaaagaaagaactatttttgtaattaagacaaattataaaaataattttcacttgaaagatggagatagggatttcgaaacggtccaaaattctttttttgcggcgctgttttttcaa

SEQ ID NO: 38429 - DNA, 350 bp, Heterodera glycines
cgctggtaaggaccgacccatttgaagaattgttcggcaacgaaacctttaccattaatcggagttattagcatattcgtcaacaatatctattcaatttgacactgaccaacgaaaaacaaaatgccaaaattggccattatttgcacgcgaaaagcccgtgttcgctgttgtacgattgcgcctgatccgttcacttcaatatcttcatatatcggaggaggaagaaccacagaagttggacggttgtgcattgtctcgtcatttggcaacggatccatggggacaaaaggaggtagggattaagctaaatgaataaacgtaaagatggggacggaaagatggaggag

SEQ ID NO: 38430 - DNA, 1127 bp, Heterodera glycines
acttttagaaatcataaaagaaatacggaggaatttaaggtttaaaattaaattaatttatgattagggcgtgaatttatatggacaacaaatcgcgaaatatggacataaaattgcgaaaatctcaaatatggacataaaatgacaaaagatgggcataaatttttcaaaattgagggtgtaatttctccaaatttcttcaaattcgctaaatgtaaggtaaacaaaaagcgaaaatttcgcttttttgcttatttttgacataaaattacaaatttaaaattaaattcaatattctcgagaaaattttgcaaaaaatgatctttcgggaatttttccgatctttgggggttaaaaaggccaatttagctgatagggccgttctaatagatgtttttggaaaaatgccgaaatatggacaaaataccaaaatatggacataaatggcgaaatatggaaatatatggatatagaaatccactctagaagcttcaaaccaagctaaaaacatgtttttcatacatcccaggcgcctcccagagtctaggaaaaaatatggatttccatataattctatgccctatttatgatcacgagataaaactgagatttatattttttaaattataattatttttactttttgtgaattaaaataaaacagcaaaatgagtaaataaaaattaaaagaaaaataaaatcaaaagaggaaaaaagtaaatcaaaccctgaagtaattttcggttttggggcctagattagaatttaaaaaaaggacgcgcagaattgaaaaatattcgtttccattgcataaattaacgataggacatttgctttcccaattcaccactcggatagaataaattagcgcagaatggccataccttggctctttctcatcgcgagtagagaagatgtttcccagtcgaatcattgacaaatcaatcgcctaatttgcattttgcaaccacaattttttatagatgtgaaatttaaacagttataaattgggatgaaatttttaagtgctaaaactgcccaaatagttatttaaagcttaccaaataaattaaaattaaattaattattactacaataatgaatggatattttttaagatcaatcct

SEQ ID NO: 38431 - DNA, 700 bp, Heterodera glycines
ccgatgactttacgctgacaagtgccggattggtggccttactcggtgaggtgccattgtcgaattgattccccccccccctcctcttgcaacagctttcaatcgaaacgaccatttcggtgttcgacaaatccctgtacagtcaatttgtccatccccaaggccaactccattgttggctgcgatcgtacatttccaaccaattgacttccaccgcgcacgattgggtcaaaatttttgcgcggtattttcactttatccgatgttttaattgcctttcctcccttttttcagtttcaattcaggcacttacaataaccaatggactgtaagccttcgactaatcgcttttattaattattctgaccatttgcaggtggtcgactacaaaatgttcaagccgggccagcagctgccccagtccaatttgatttgggtgctcgagcaaataccgtaaccgccccacgcgtgttacgggaactctcttcattcccccaggggcacaactgtcagtcgggacgtgacttggttcctgcgcaagtacagctattggccctcctacaacattcctttccttcgccgcatttccgagctcagcggatttgaccggaaaggcgaagagaacgattggtggaaatggtcagccgaacatttcaaattggcacaaattgacgccaaatgaatgcccaagggcatttta

SEQ ID NO: 38432 - DNA, 1270 bp, Heterodera glycines
  misc_feature (89)..(89): n is a, c, g, or t
tataattcatattcgattatctggataactaaattaattttttttaaatgtaattaaacaatttatcttaccattactacatccccatntataatagaaatgatcatctgaaacggaaaaatatattatgtttattattttcaaattttgtccaaaaatggtttgtggccccctaaatttttaatgctttggaactgtttaaattggctgaatttcccaccaaaatggtcaattattctcttaaattcgcagttcaacaaaaaaaaaaggacacttttttcgagaccaaatgaaaaaggcaagaacaatattgataattaatttgatgacctggtgacgaaatgcacttggtgttgaagcaattagacaagtcacatggcttatatcccctgatacttagcgcaccatcgctcaatttctctcttttcatttgatcatccagctgaataggacggtagtctccatgaacgcaatcaaatgctacaacaagaaaaaatcgtaaattccaaaatcagcgccttttttaagtaattttaataaagttaacagaaaaaaattttgtaggttaataaagaaaacacttagttgctgactaatgtattaaatcattaaataagacaaaaaaaaacaaattttttttgtcggaaaacaaacaccccatttttgtggacgtcatggattaagaaaagttattttctttttttttgatccaattttaccacgacatttgtctggcataatgagcatgacaatgagagtggcaagaagtgcgaaaatggtagaagcagtgggaaagtcagtgttcatttttgtttaatttaaaaatttcaatttaatttgaaataaaatggaaataaaaataaaagaaatttttcttaagcaaattaaaaaatggaatttaatgaatgaaaatggaaaatgattacttaatgactgcaaaaattttccattcaaccaactaatagctaaaactctatgatttcgtggagcaagtgattgcagcgaaaagagatgattcattgagaaaataacagttaattgaataaataatttattcaaaatatttattttataatatattattaatttttgttatttaattattaaagagtcagtaaaataaaaattactttcaaatatttgtcatatttaaataattaagctttttatgctcatacaattatgaacaaagacataacttcgatcaaaatttcttaaataatatgcccaccaacacttaaaaacgaatgcaaattaaaaaaaaataaaa

SEQ ID NO: 38433 - DNA, 1321 bp, Heterodera glycines
gaaaagctcgaaggccaaaattaacaaaatgacgaattcctccaggaaccgtagaaatttcggcacgacattggggacactgtcgagaatcgctgccaattcgcatacgaagcgcacattccatgcaaatctaagcgagagggaattgcaaaagttttctttaaaccaaatgtatggagaagaaaggatttcaaaataccaacaaaataaagtttttgtattagtattttgacgcttttcctcccaaaatactcaccgggtgcaaacattcaccgacgccgtacacatcggagcgttggcaacagatgagacagtcactgacttggcccgacattggcacgccggcgtggtcaaaacgttgcttgtggaatattttagaaattaacccataaaaactctatgttgagaaaccttagcaattcgtttgtacgttcctcccatttgtccaccttcactcatttgtcgtgtgctccactgaccataattttgacgcggtccgccccgatgctaagagagagattaattaagcacagaattaaaatgataaatgagtcatcggtcccagacatttgtgtcgaatatttacgcatattcgaattaagcgaatcaaccaaatacccaaaaatttatagtcaacgtaggccaatattttttgaaaacaaagagacctcagcaaagccccgtcctctgtgctgctgctgaacattagtcggtgtgtttcgtccactgccttcgcctcttcgggaggaaatgttcgcggacgaatcatcggtggtgtccaaatggttttgttggtgttgcggcctttgccttgtccattgtcttgttgggcccttagattaaaaattgtgtcttgacacaaagaatgtttaaaaaattatgccaaacctgtcgctgctttgtccgttggtcttcgttgttcctttgtcccctgacattgtcatctccttccgcgttttctttcggctctcttttctgtttgtctcgacttcgtgcactaattcgattctcacgactttgatcagcaatttcattattttgactattgctatcttcgctagccttttccatttgttggttttcttgctgttccgccatagaatacaaaaacctaaggaaatttacatattccgcaactctatctaatctttttaaaacaattggcgtcttttaaattaaaaaatttaaataattttacgttttcaagttttacaaaaaagaaaagaaacgacgaattttttttataaatgttttcgtgatcaaaatattttgaaatttgcagtctgttagtccttatgctaacaactaacaataaaatgtt

SEQ ID NO: 38434 - DNA, 1488 bp, Heterodera glycines
  misc_feature (1300)..(1300): n is a, c, g, or t
  misc_feature (1305)..(1305): n is a, c, g, or t
tttagtgcgctaggttctatgaaactttttataatataatcctcaactttttgtcctgtttaaaaaggtattaaaaattttttaaatatctattcatctccctaaagatagaaaaagcatcagagacccaaaattaacctgtaaataatgttttgtgtgtttcagagcactatctgtaaaaatattaataaattaaatttgcaaaatataaataagttaagaattaatctgtacctcgaaaattgtctcaatcaactagtattgtcttattatcatgatttatttgtccggttcattgtagctgttttccaatttttttcttgaaaaaaaaattttttttttttgcttcattaaattttctagaaataattattttaaatttctttgtttatttattttttaaatttttatttgattttttctattttttattttatttttattaattggaaaaatcttaccctatccgctggtgttccttgaatccaaagtcaaatttgtggacattcctcggcccctctccactgggcatggtcacgcaagtaattttcatagtaactggctcagataataaaagcattttcttattttcatctccgtccccgctctgccccaacttattaatctcctgcatgataacatccgcattgttttgcgggtacgcccgatacggcacccaaaccggggaagcaagcccagcacccgtaattgccactccaaacatccgcacttttcgcttcattttttcttccgtagtttttaaagccacctttatcatgttgtcgattgaatccttcatcgcttcatcggggcgctccacatccgggttgacacgaaattccgtaatatttttcgtaaatccaaatttttcgcaagttgtcgattggtaatccatcaatttataattttccatttcttcagcaaaattatttctgaacaaaaaaattttttgaaataattcttaaagggtatttattatcttataattgtatttataattgtttaagaaattatttttttatttaatttattaaaaatgtcttacccgattgatcggaaatcccattttttggccattggcacggcgggttggaaggagttcacgcgtttaaaagacattttaaaacaagaaattgaaacagaagaattaaagagagcagagatttgaaaagaaaaagacgtaggtaaatagtaatagatttaattaatgcaaataaaaatagagcggagagaaataaaattagagcgtgaagagagtttaatgaaatccaactatttagttgaatgatttgcgatttgngccgngtgtgcgaaataggcaaaaggggggaggggtctagtcacgtgactggtctgggtttgccttaatttttgagggtaatcaatcatttccgtagacaactgtcacattttattcaaactgcaaaaaaatcgtctggatatctttatttcgaatgtcatcatcattttccttgacaggtttgcaaa

SEQ ID NO: 38435 - DNA, 714 bp, Heterodera glycines
atatctttatatctgcaagaaattagattggcaatatgtggttgtaaaaatcttgtgtgtaaggatttatttttaggagtgagtcacactctctattagtgcttttgtgtcgcgagacccggcaggcaatagatatctttatatctacaagaaaatagattgacaatatgtggttgtaaaaatcttgtgtgtagggaattattttttgaagagagtcacacaccctattagttttttggtgtcgcgagagacgacagacaatagatgtctttatatatacaagaaattaaattgacaataagtggttgtaaaacttttgggtaatgaattattttttgaagtgagtcaaacaccctattagtgctttgctgtgccgagaaccggcaggcaatggatagctttaaatctgcaagaaattagattggcaataagtggttgtaaaaaacttttgggtaatgaattattttttgaagtgagtcaaacaccctattagtgctttgctgtgccgagaaccggcaggcaatggatggctttcaatctgcaagaaattaaattggcaataagtggttgtaaaaaacttgtgggtaaggaattattttttgaagtgaatcaaacaccctattagtgctttgctgtgacgagaaccggcaggcaatggatggctttcaatctgcaagaaattagatggcaatatgtggttgtaaaaaacttttg

SEQ ID NO: 38436 - DNA, 307 bp, Heterodera glycines
ctcttctcttgctgggaatttgttttcctcccccccgatttttcaagaaggtcgagggatttactttccttattttaagttcgaggctcgtccaatttgctttttgtccactgctgaatcaccaatgccaggagcgccaagtcgtaaaaaaagagaagagatttgtgtcgtcaggggctttaagattgttgttgcactgcacacggcaaaagacaacagcccaaagcaaccacaaacaatgccgaagaacaagtttcgtttaattccaaataaatataaggcgaggacaaatcaataggaacttgac

SEQ ID NO: 38437 - DNA, 622 bp, Heterodera glycines
tttatttgaggtagcagcgccgaaacttaagaatttttcccgcccttttaattgtttggcggcgccaccgcggaaccccgaattttcctctttttccaaatttaatcaaaaaaatctgattataactattttttggctaaaaccaattaataaagcagcaaatttccatggtttttcgcttataagcaccgctgttcaatttatgataaagaaattggactcaaaaattgggtctccacatgaataaagtcaaattctgtatacttttagattgcaaaattacaattaaatctataaatgtcctttttgtttaataaaaatttctgtcccaaatcactttttaaccacttctatcgtgtagagcttagtcgatttactattggtaaattttcggcttttttggctccgacgccaaaaatgatcagaaaaaagtgatcaaacgttcgaaaaatcgataaaaatgacaaaatttttaaaaattcataaaaaattttcaaaacgaatgatagaataattaaaattatttttaaaatgatcagcaaacaattctctatcatatagcatcataaaatagattacaataactgaatagaatgagctaggtgtaataatagtatgaaaa

SEQ ID NO: 38438 - DNA, 1011 bp, Heterodera glycines
  misc_feature (63)..(63): n is a, c, g, or t
ttctcaaaagaagagatagtcatttttctgggatataagataattaaaaaattctctgagaanttaaatggcgattgcgcaccgccctccctctcacgctcgagcgcttttgtaacgtattaaatttctcaaaagaagagatagtcatttttcttggatataagataaatttaaaaattctctgtgaaattaaatggcgattgcgcacctcacttcctatcatgctcgagagcatttgtaacgtataaaatttctcaaaataagagatagtcatttttcttggatataagataaatttaaaaattctctgagaaattaaatggcgattgcgcaccgccctccctctcacgctcgagcgcttttgtaacgtataaaatttctcaaaataagagatagtcatttttcttggatataagataaatttaaaaattctctgagaaattaaatggcgattgcgcgccgcacttcctatcatgctcgagagcatttgtaacgtataaaatttctcaaaataagagatagtcatttttcttggatataagataaatttaaaaattctctgagaaattaaatggcgattgcgcaccgccctccctctcacgctcgagcgcttttgtaacgtataaaatttctcaaaagaagagatagtcatttttcttggatataagataaatttaaaaattctctgtgaaattaaatggcgattgcgcaccgcccttcctatcatgctcgagagcatttgtaacgtataaaatttctcaaaataagagatagtcatttttcttggatataagataaatttaaaaattctctgagaaattaaatggcgattgcgcaccgccctccctctcacgctcgagcgcttttgtaacgtataaaatttctcaaaataagagatagtcatttttcttggatataagataaatttaaaaattctctgtgaaattaaatggcgattgcgcaccgcacttcctatcatgctcgagagcatttgtaacgtataaaatttct

SEQ ID NO: 38439 - DNA, 956 bp, Heterodera glycines
taattaatgattggattgtttattgcctttacctttcccacggggatgccaaagtaaaagaacatcaaaattcggctgcgcatttgaccgacgaataaatcggcgattattgtgggtgcaatcactgcgtaagaagcctcgccaattccgacgacgccacggaggagcaaaaaagcccaaaaatgcttaaaaataattaactgtttattttcaaattaatatattttgttgttttacattttcactgataaacgaagaagcgaaaacggcgccgacccaaacggagagaccgacgagcaaaatgcgcttccgattgaaacttaaatgggacaacaaaatgggcatttgccaatgtatgggacaataaattaatttgtgcatttaccgatcccccaaaaagccgcaaattggggcaattgtcatgaagaaaatgataaaaactgtctgcagaaaacccgcacttttatcatcaatgtgataaaatttttggacgtcatttaaaactcctaaaaattattaattatttacttttttaaattatttatttttatttatttatttgaagtaaaatttacccgcaatggtaaaacggtccatgtaattgagcaaattaatggcgaaaaggacaaaaacgcaaattaactttgaacgatccatgccgaaaatgaaaagccaactgaaaattaattaaaaataaatttaaaaaggaaatggcaaaaataattaaagcgaagcaaagggaaaaaagaaaagaaagaaagaaaaagagattgattggctaatcgaatgaatggcggggaagaaacatttgcattggcacatttggggagagaaagggacgaacaaaaaagccgattgacattaatgaaaaagatagaaaattccgacaaatgatcaatgaaatgatcggttagctgttccccttttgtcgtccctttgtctttttgtcccttttg

SEQ ID NO: 38440 - DNA, 1355 bp, Heterodera glycines
tggagcaaatggggctttcagttgttgtgccgaatacccttcccagatcggattgaattcctggaaatttgaaaattatatttaaaaaataataattaaataatgcctatttgtcgatttaaaaattgaaccctacgatattctctagaaacccaaaattgattcgaataatctcttttttacgattcaacactttcgagcagcaccaatgaaaacccgcctttggatgtgaaagtgtataatccaaatcgggacgcaatgtccgctccaaatccatcgaagaacgtgtcaattcacaattcggcactgaaaacacaacatgaatactaaaaactattacaccgatgagcattgaatagcgatatcattaatgcaacggttttttttcacacatgtaattaattaattattaattaccctgtttttgcgacataaattttgggaatagcaaagacggtgctgctgttgaagtgccatgtttgtcctcggctccgtttcgctgctgctgcgtttttgccgattccttcttctctgccgccgattcatgacaaatgccgtcgatcagcaacagaaacaaatgcgaacgagcaaatggaagcagtccaatggtgctgaacaaacaaacaataccaatttttaatgggttttttcaattttattgttgttattaaaaatgggcacaatattcttcataattttctgttagcgcctgagggtatcgtcattcagttcaaagtttaaatcaaacgagaaattccttaaaattattttttgtatatgattaagtttagctctttttttgatgcagttagattcctaaatttattatagaatttaaaaatatgtaaatttaaattgtttttaatttttgtatattcaaatggtaaaatattttaatatttttgatttgatttatttagtttcatactgaacgagaatcttgaccaaaaaattacgaaatctcatttgttgcattacaaaacaaataaaaaatgtcttatgtgagtttataaaaaaacatttttgatttaaaaaatgtctgtaatatttttctaaattagtcccccaaaccgaccgattgcaccgtcggtctctcatccatacggcggcactttgatcattcctatgcgtgccaccgccaccactaccaccatagttgactttgtcctgttcccgggcacgtcctgttcgcagctgataacgaatgtgttcaacagtgcactgctccatcagttccgtgggctgatcattgtcaaattgacagtcataatcgcttaatccaacaaattgtggttgtagagggctagcagcattgttgtcgttgtcgaaggtgcaaatggctctagagatccccg

SEQ ID NO: 38441 - DNA, 789 bp, Heterodera glycines
tttcagtgacttttaaaaagttaaatatttttttcaaaaaaggggtcctaccatcggtagtattaccaaaatttttatatcccgattgcactgtatacgatttgctaatccctccccaaaattcttaacttaaaatccataatgcgaggcgaaaatataatttgtatttgatatatttttgatcaaataaatgtaaaaataagtaatttgaagtaatttcgcaaaatgttctgctgattttcgacccaaaaatttggttttttgggccaaatattctgattttgaaaattttttgttccatccctggattgagcatctaaacagtattttttgttttagtctgagcgcttcatgcggtgacgaactgctgctgaagatcggagaacaccaaacattgctcaattccattttcgacagacaaattggatttctttgataaaccaaagccaaaaatcattatattttccccaattttgttaaaatattgttcattttaatattttcgatcaaataaactcttcaaacatgatttacgagctaaatttttgtatatgccatcagattgtcatatgacgacatcaaatctatgatttttcgccatgtctatgatttttcatcaaggattttttccaattctaactcaattatgtagctcaaaaatgagctcggcttggttattgcacgaaaaatgcacaatattaaagcattgacaacataaaactgaccaatatggacgaacaaattttcgaatgccatctttatcatagatgaacaatgaaaacaatgaaa

SEQ ID NO: 38442 - DNA, 664 bp, Heterodera glycines
aaaagtccgcttcatcccccgcaatttgcagaacgcaaacacaccgcgcttgaagtgctgtacaaatgcaactcgtgtggccatgaagtgcacaaatgttacgaatgctttggtacggaactgaatgaatttcctctaatttttgtcacatttacatgtcctcccctttaagtgtactccctcgctttttccaacggtcaacatagagcgtatcaccaactctaccgtggccgaacgtacaattcgtggggacggtacacgagaaatgtcacgaaaacggtgctgcacaggcagatgaccatcaccaactatgaggcggtggagcaaaagttcgacctgatgagcggtgttcagaaggacagtttcagtaccagctgggcatgggcgaacgatttgataaggcgccttgaataagccgaaatgctaattaattgacatcggtttcttgttcaaataatgtattgtctttctgtatatgcataccgtacttcctttgtataaatgcaattaattattctgaataattgtgttgatgtgtttttcctggttgaatagtcgggaaccttttgaacttttcacttttagcgtacaaatttcgcaatttttttgaaattttttacataggaagtcaaaataaacaaaatttcatgtatgttttcatttt

SEQ ID NO: 38443 - DNA, 1413 bp, Heterodera glycines
  misc_feature (181)..(181): n is a, c, g, or t
  misc_feature (1266)..(1266): n is a, c, g, or t
ttaatttaattttttaatgtaaatttaaatcaaaaaattttataatatatttcttaaatattgatttattatttttatctaaattaaaatgctaattttaattatcattcaaaaacaataacaaattaaaataattaaattatctttaaaaatgaaaacaaaaattggaaaataaattatntaattaatgtaaataattttattgtacctatactgtaatttaatgccttcgaaacactttgaacacaaaatggcactttgctgtcgccgaatgaaatgcgctaaaaattgaaaaaataaaataaaatttgcatttattttttaattattctttttacctggccatcaaccgtgcaaattgacactccccaataatttggtgacattctggctaattgtggaatataattggccacatttccgtcagtaattggaatgcactaaaataattaatttgtttttagtcacaaaaatttattttcaaaacctccgtgtaaatttctttgatgatcgaaccgaaatgagcccacgccggcacaataagatcattttgtagcgtttgaacaataagcgatactgtagacgggggaaaaagttattgttttgtttttttaattggaattttattggcaattagccaatggaatctattttcgagtgcataaatagataaaattttgaaaaactatgatttgaaatggcagacaaactttttaaacgggttttattttttaggactgaaaaactaccaacaaaaaaggcaatttttacaggggtggctgggttttctgaaatttgttaagtcgtttcttaaggggagggggcttacttttttgactttatgtttaaaaaatttttaaaattaaaatttcaacgccaattaaaggcttcttttcattttaatgcgctgtttatgcagaatttccaaggattttcctaagcgcttttggttggattcactcttttttttaaataaatttgccatgactttccattttgacaatttgaattagtgccaaattatatttcaccaaaaaaccaacgcgattcgccgatgacccgcttgaagtcgttgtggctcattttccaatgcttcgggtcccgtgcctcgttcatgcgttcctccttctcattttcaatttcgcgaattttgcgcatcatcggcgccagccgagggtcattctctttggagtccgtaatttttcagtagctttaatgggggcagaaatgtttttaatgggactagggactctaatttcaacttanattaccaaaataggtagaatttaggacccaaaacccctcaaaatgggagcgaaataacaaaaaaattacgccatattaaatttagcaatattcacaaagtcccgggttcaggaaattttttaatgaggcaaaattttgaaaaatttt

SEQ ID NO: 38444 - DNA, 815 bp, Heterodera glycines
agttctgttgtatgcttaggaagacccatatcccccgcccgggtattcaaaaccttgagaaagaacagcaggatgtcctcccgggtgatcctttcggtgggaaaaccgaggcaaagtaaatggaaagcaaaatgaagagaagcaaatcgaacagaagcatcagaaaggccaatccaaaggagaatttggagatgccacttccgagtaacgcagaccatccaatggttttcactaaacgatgaggggaattccattacatggccagggaggggcctaaattatgtaacgctactgcctatgagacaaaagtagaaccatgtctaggtggaaaactggggaggtggcacaccaaaaatttaagataatttaggaaaaaagttctaccgaattgctccaatacgagtgcacttcattcccccccccccccaccgcgtcgttttccccgcgaaaaattttcaagaaaaatcttaggaaaaccaattttcaaacgaaatttcttttaactcctgcacgtaatgattttggttcgaattgtgttatttttatggcctccgaaataatggcacgcaaagaactaactatttttggcactaacaataagttgcaaaaaagacgcgtgattatgtgccattaaagattgcatttacaagtttattgtaaattacttttttgctcggtaagcgcaataatatacatggcacttccgaaggcgaaaaagggattaagcgatgagagcagacacaacggcacatttgcgagatccggcttataaaagagaggaggcgcgcaaaaagaaagcgctgccatcagagaaa

SEQ ID NO: 38445 - DNA, 702 bp, Heterodera glycines
agaatcgaatctcgggctcaaccttcggatatgaaactccgcccaatcctaatgcatttctatcttttcatccgcaataggacaatcttgacatgagcttaatcagttgctctgcgaacatttcgccatcagtgtgcacccgctgaccgcgctcttccgtctgagtccccgcctttttcggcatttgcctttcctccacggcaaattcatccgaaccaaaacggtgtaccgtaatttggacgcattctttgagcgccaaatcgacgagcacagactgaaaattaatcagctacagcaatgggataatgacaacacagagccaactgattttgttgaggcttttctaaaggaaaagacgaagcgggacggacggaaacgacggcgatccgatgcaccagttcaagtgagcggctgcaaaatctgttcccataaaatgatgcatttgaaacagtcttccaaaatgtttgtccatcttttcgcaacattgcctatctgaaccatcatgcccagattcaacccaaaatgatcgatgagcttcagaggatggtggactatgatgatgaacatgaacaccaacataccaatgcggcaacaaatcaaacggttgcgatagcgaaccgactcacattaccgtacaccaacgcagagatttgtgtaaagtaatgtgtataaaacagggatgatttgatgtaataataatgg

SEQ ID NO: 38446 - DNA, 1573 bp, Heterodera glycines
atttggggcgttaataattgttgaatctaagagagaaccccccccgtaaaattgttaattttttatatttgcaaaaaaaaactaccgtacatcatgagagcaatttgtgtacaatttttgaacagacgcaaacaaaagcacagaaacaaagccggagaaggcattaagcgacgaaatcagctaaaaaaaaataatatttaaaattattagaaaaaaattctttttaatttaaattctattaagataaaatttatttattttattttttattgctattgaccaatttcactccacgacaaattaagaaagtagttttttatattcttcgatacgttgaagaaaatatgaaaaaaaatttggaggggggtgggggggtgggagaaaaaatttaacgcacccgcccccgattctgaccattttccatgtcccggttggcaacacggattcgaccatgtccaagtcgggcagcagcatcaatgcctggaccgagccgtgctgtccgacagtgcgcagcgcacggccaacaatttgggcaatgttttcctcgggcgtcgccggccccgcgaaaatggtctccacggagaggcaaaacagcggcaaatggtccacgcggttgacgaggacgggcaaaaagtgagtggactgtccaagagggccatggccatggagcaacagacgagctaattaggtgataattaattaattgattgtaaaaatggacaattttacacaattgtttttgtgatcgtgggctgaaacttttgcgcatatgcttaaaaatgattcaagtctgttagttttttttaattttaaatgtcaaaaataacattaaacaggtgggatgataggggagcagttcgttttcccaccacatatcctttcgtataaaaataatactttttattatgtataaaattttttaaaatccgtttttttttaaaaagcaaaatattctgaattaacagtttgaaaagtaatttttttcaaaaagaagcaaagtgtatgtagttgtccaaattgatgaataaaatcatttgatagccctgtgtattttttagagtgccacgggaccgggacctggtagcggacaactgagtacaactgagtaccaaggtcccggttttgaccgggaccgggactagtcccggttttcccagcaaaaaattcccgggttttcaacccgaaaaggtcccggtcccggttaagccaaaaattcccgatctcgctcaactctagtttaaaattcattcattttacaaacatgatgaataaaatcatttgatagccctgtgtatttttctttaaaatccaaaaaataattttttttttttttgaattatgattgatacgttcgggaaactattttgtttgtttgttttagctaacaacttttttgaaacttaaacttttttgttaattttgcagacaaaaacaataggcctattgaatggtaataatttagttaaaaattggtataacaatgaaagggaaaagtgcacaaaccattcggaacaattggacgcgtcttcagcgacaacaccacccgttccagttcagtcttgtacaaattgtc

SEQ ID NO: 38447 - DNA, 944 bp, Heterodera glycines
gctgatcacaatggtacatgtgacctgtgatatggtattggaaccacgattcggatgatactatcaggaaaagaaaattatgataaaagacatttctgcagaattattgactttcacatgcaatgactgatcaaaaaaatcatcaaattgattaaatgataagaaaaagtggcgagatatgttcagataaatcagcttattatatttgtatataaaagtccagggctaggatttatggtgcttaaaaatgcataaacatgtacctaagagctttttcttttcttttttttaaagaaaaaaatttttaaattttttttcttttaatcatttttttttaattttttaaaatagtgaaaaaatagtgacgatacgccaaaattttgagctcctttcttcaaaacaattgagcaaaaaaaaagttttttcactaaaagttgctgccctaattatcacgcaatagcagttttcttattattctagagaaccaagactaatttgaacggttttattggaaaatcacatgtacaaacacaacatttaagaggctttcaatttaactccttaacattccatattattaacagacaaaatactcttcagagtaaaatttttgtaatgcaattaaaattttaatggccaaaaaatgaatttatcaaagatatctgcgcaaaacgtaaagaaattcattcctatctaaatctttgcctcccgtatgggaattcagcctttatttttcgaatccacgcgaaaactctcaagaaatgggtttcaaaataataaattttcacacgcatattatttattgattataattgttgagtgcatttgtcagcgaaataatacaacaaataattaaatttaatattttttgaaaatcataaacttaaattgttttattatagaagatgcattgtccattcatcaattttagtgcctttttatta

SEQ ID NO: 38448 - DNA, 839 bp, Heterodera glycines
tctcctggggatttgaccgcaaacttggtaccaacatttgccttctctagtctggctctaccaaacactcacacgatatttgaaatgctaacgaaaaaaattcttgccgaaaaaatggctatctcttttttctcctggggatttgaccgcaaacttggtaccaacattttccttctctagtctggctctaccaaacactcacacgatatttgaaatgctaacgaaaaaaattcttgcccaaaaaatggctatctcttttttctcctggggatttgaccgcaaacttggtaccaacatttgccttctctagtctggctctaccaaacactcacacgatatttgaaatgctaacgaaaaaaattcttgccgaaaaaatggctatctcttttctctcgtggagatgacagcgaaaacgtgacccccatatttctcttctctactgtgtctataccaaactctcacaatatatgaaaagcgatcaaaaaaaatacttgtgcaaaaaatgtgtatatcttttttctctcgtggatatgaccgcgcacttgtgaccaacatattccttctctagactgtgtctaccccacactctcacgatatatgaaatgcgaacaaaaaaaattcttgtccaaaaaatgtgtatctctcttttctcttgtggatatgaccgcaaacttgtgaccaacattttccttctctagactgtgtctaccccacactcacacgatatatgaaatgctaacaaaaaaaattcttgtccaaaaaatgtgtatctcttttttctcttggggatatgaccgcaaacatgggaccaacattttccgtctctatagtgtgtctac

SEQ ID NO: 38449 - DNA, 1121 bp, Heterodera glycines
  misc_feature (83)..(83): n is a, c, g, or t
ccgcttcgcgccctcaggacgggcgcttcgcgcccgtttttttaattttgtggggaacattcggccgcttcgcggcctcgggncgggcgcttcgcgcccgtttttgtaatttttttgggggacattcggccgcttcgcggcctcaggacaggcgcttcgcgcccgttttttaattttttgggggatattcggccgcttcgcggcctcaggacgggcgctcacactcctcagaatccccaatcacacagggattctgaggtcttaaccatgtctaaagtaaaatctgattacatattcgtaatcagcggcccaaataacccctaaagacatgtttttggaagatttttgtcgaaaaaattttttcactcagaaatcatggtcacacccctttggtcccgaatgccaaaatcacttttatttctataacttttttcaaaaaagtgataataagctaaattaaaatttataaaatagagcaaaaaattgcggattttttgagtatattatttttataaaatactttttcagaagggagttctgaatttttttctgaaaaatcgaattttttcagaaattctggaataacttttttattttggaagatagaaattcaaataaatctcataaaattctcccaatttttctctatttttaaagctttattccactaaatttgaccaaaaacgaagagatttatgaattttcgaaatttcacaggattttccggggctcaaattttgacgatttttcaaaaaattttaaccaccttccaaaaagtctgaaacacaaaataaagcgtatatacgtattcagcacctcaaattatgccataaaaatgcattttggctaatttaggagcaaaaaaattttttatgaaatgcaaaaccatggggtcccccctatggttttgagtttcaaaatcacaattaattttataactttttttaaattcaagataaaaataccggataaagcacattaaatagagctcgaaattctctacaaaaatgctctaagagaaattttcgctaaaatcaacgcctgacgagttataagccttgaacggaaatggggagctcaattccggaaaatttttctatttccggaaaatttgaaatttt

SEQ ID NO: 38450 - DNA, 1080 bp, Heterodera glycines
tttgagtagattagactagaaaaaattgaaaatttttgatatcatgtttccccctccctcttcccaggggtattattttgtaaagtctttttttccccaataaacttgtcaaaccccatttttcgcaccgtgaatgttatttttattgaattctgaaccgttttgagtagattagactagaaaaaattgaaaattttgaaatcatgtttcccactcccttctcccaggggtattattttgtaaagtctttttttcccaaataaacttttcaaaccccatttttcgcaccgtgaatgttatttttattgaattctgaaccggtttgagtagattagactagaaaaaattgaaaattttgaaatcatgtttcccactcccttctcccaggggtattattttgtaaagtctttttttcaacaataaacttgtcaaaccccatttttcgcaccgtgaatgttatttttattgaattctgaaccgttttgagtagattagactagaaaaaattgaaaattttgaaatcatgtttcccactcccttctcccaggggtattattttgtaaagtctttttttccccaataaacttttcataccccatttttcgcacagtgaatgttattttattgaattctgaaccgttttgagtagattagactagaaaaaattgaaaattttgaaatcatgtttcccactcccttctcccaggggtattattttgtaaagtctttttttcaaaataaacttttcaaaccccatttttcgcaccgtgaatgttatttttattgaattctgaaccggtttgagtagattagactagaaaaaattgaaaattttgaaatcatgtttcccactcccttctcccaggggtattattttgtaaagtctttttttccccaaaaaacttgtcaaaccccatttttcgcaccgtgaaggttatttttattgaattctgaaccgttttgagtagattaaactagaaaaaatggaaaattttgaaatctggtttcccactcctttctccaaggggtataattttgtaaaagtttttttccccaaaaaatttttaaaacccccatttt

SEQ ID NO: 38451 - DNA, 709 bp, Heterodera glycines
atacctctaaaaataaaaaattttgcaaatttggcgttttttctaaacgtggagttttttttttggctttttggtacctcatttttttcatttttgcaattataatttttccatgacttttgcagcaattttgcgacgacttggatggacattttaccactttttggccttgcacgctcaactcggtctcaaattggcattgcttacgccccaattcgatgcgctggtggacaaacatttcgatggctaacggatttcggcaagtttttttgaattgttgtaaaagtgaatttttttgctttttttaagcatttctgacaaaaaacatacggtctcaaatttcaaaaatggctctaaaaacaaaaaacatccaaattcggcaattttttaaaatttgttttttgtaaatgaatagttttttaggggtttttaatggttttaaggatttgtgcccaaaaacgggcctcaaattatcaaaatagtccgaaaataataaattttgcaaatttggcgttttttctattttttttggcttttggtaccttattttttaatttttgcaatttataatttttccataatttttacagcaattttgcggcgactttggatggacattttcccactttttgactttgcacactcaattcctcctcaaattggtattgctttcgccccaattcgatgcgctggtggacaaactatgttc

SEQ ID NO: 38452 - DNA, 977 bp, Heterodera glycines
  misc_feature (747)..(747): n is a, c, g, or t
  misc_feature (784)..(784): n is a, c, g, or t
aaatcttttgggggccgaggctttgcgtccggactgcgcaatgaccgaagggttggcttacctgggctcttttctgttcctctcccgtcatgagccgtggctttggcacgaggaatttgcccttttctcgggtaaatgtcccatctatcggtaattttcttttttttgagataatctttgtttttggccattcgtttgaaggacttacgaaacggcggacagaaaatggatggcagtgggagctgtggagccgaaatttcagcagaaactcttcgaaagtatgaagattttcgaatttggcacttattttcgattgctttgcagttttgggaatttccaccgaaaaaattgacggaatggcgaaattaacgcgcgaaatggaaaatgcgttcaggggaaaaacgcagggagaatgggccattatttttgaaggtgaaaatgaaaaaggtcgccttgcccctcccaaacggtgccattgaggggaggacgcgtgtgtaacgccggtgctgaacatggacgaagtggggaagtacgagcagcacaaaagacggaacgcattccttagggggggaagtggagggagaagccgtttgggtgccgagggcagtgccgaaacggatggaaacggagaaaagccaaacgaaagcaaaaagtgaaaggacggaaaggacggaaagggaaaaagccaaatgagggccaaactgtgagcaacgccaatgaatgaatgaatggcacaatgtcttccanatgcctttttctcccaaaatgccattcctttggcggncctttgcctttctctccttttgcttttattccgccaaatgttttccttctcttttcttttgttttccgtcacaaatacacaagggaatttgttccgttttccaaacttaagcatgaaaaagtcaatttttttaatactcaaacaaatttttataagcccttcaaattttcttcaaaatgggaaaaaaaaggtt

SEQ ID NO: 38453 - DNA, 280 bp, Heterodera glycines
cggtgtcatctatgttactagatcgggggatcgatccccgcgctggccgctcgagcaggacctgcagaagctagcttgatggggatcagattgtcgtttcccgccttcggtttaaactatcatgagagggaggagagggttggagaaggaaaggaaaaaaaaatgaaggaggagaaagggtggggggagtatgagtatgatggtcaatatggagaaaaagaaagagtaattaccaattttttttcaattcaaaaatgtagatgtccgcagcgttattata

SEQ ID NO: 38454 - DNA, 763 bp, Heterodera glycines
atttttgattttttctcttttataattgtcacttttatttccattcgcaaaaattaaactaataataatgattaattaatatttctctcttttccaattaaaatttttgccttttcaattgcttttttattaatttgtgaacgaaacggaggaacaattagcaaaattaatttggtaattaattgaaaaatttgtcaatatgaagtcacaaaattgtgaaaaggaactggattgaaatgtcagtaaaaatcagtacaaaatttatttttctgttcattacaacaaaaacaattctatttatttcttatataatccaatgtcaaaaaaattgttttttgttttttttatacattttcgttaaataaaaatattttaaattatgtaagttaattttctaaattatatggtaaactttgatttacaacgcttcttttacgtctgattttgctttttcaacaatgttgactttgcattgtgaaaggaattattttgaaattgaagcgtcattaatttatttgacgtgtttaatcttaacttttatccaaaaatctaaaattaaatttttttatgacttttcaattccgagacctttgcatttatttttaataatgacttgaaatgaacataccacattgacattatgaatatatttattcgacgcctcatcggtcttaaaaacaaaacccaatttttaaaaaaaaattacgaaatagaaaaatgaaattcaatttcgcaaattacgaaatttgagagaatttcgtat

SEQ ID NO: 38455 - DNA, 657 bp, Heterodera glycines
  misc_feature (640)..(640): n is a, c, g, or t
ttcggagaatgtcaaacgtgaaaggagaaaaaggaaattgagcaaatggaagcgaagtccgaagccagacgaaaagacgcggaagggaatgccaaagagaaggccaaagccgaaaaggaagaatggaaacgtgccctcctacgtccgccagttaaatattatgaccactttatgtacatatttttgacaaacctagtgatgacaaaaaaatttacaaaattttccctttattttatttaagctaatttgttatcctaccgtagtatattttttatttaatctgacaaattcttaaataaacgttgcttatttatttttttttgggggggggggggtttctattttagttaaatttatccaacttacatatcccacttcatttttatgatctctcaaaatttagagctcccaaatttgattgttgatatatcccagggcttcgatatctgaggaattttcctcattttgtggtcttttagagggtcaaagagtttgcggatttttgtggtcttttgagaaatttaagtatttttgtggtcttttaataaaaagtgacaaaaacgcatgatttttagaaaaattaggtatatttggcaaaatgtttgaactcttagtgagaatcttaaacattttttcgaanaaatgctcattttgcaa

SEQ ID NO: 38456 - DNA, 1035 bp, Heterodera glycines
  misc_feature (48)..(48): n is a, c, g, or t
  misc_feature (97)..(97): n is a, c, g, or t
  misc_feature (116)..(116): n is a, c, g, or t
  misc_feature (143)..(143): n is a, c, g, or t
  misc_feature (156)..(156): n is a, c, g, or t
  misc_feature (188)..(188): n is a, c, g, or t
aggggtatattttgtaaagtcttttttcaaaaataaactttcaaaacnccatttttcgcacgtgaaatgttattttatcgaattctgaacgttttgnagtagattagactagaaanaattgaaaattttgaaatcatgtttcncactcccttctcncaggggtattattttgtaaagtcttttttccncaataaacttgtcaaaccccatttttcgcaccgtgaatgttatttttattgaattctgaaccggtttgagtagattagactagaaaaaattgaaaattttgaaatcatgtttcccactcccttctcccaggggtattattttgtaaagtcttttttccccaataaacttgtcaaaccccatttttcgcaccgtgaatgttatttttattgaattctgagccgttttgagtagattagactagaaaaaattgaaaattttgaaatcatgtttcccactcccttctcccaggggtattattttgtaaagtctttttttccccaataaacttttcataccccatttttcgcaccgtgaatgttatttttattgaattctgaaccggtttgagtagattagactagaaaaaattgaaaattttgaaatcatgtttcccactcccttctcccaggggtattattttgtaagtctttttttccccaataaacttttcaaaccccatttttcgcaccgtgaatgttatttttattgaattctgaaccgttttgagtagattagactagaaaaaattgaaaattttgaaatcatgtttcccactcccttctcccaggggtattattttgtaaagtctttttttcaaaataaacttttcaaaccccatttttcgcaccgtgaatgttatttttattgaattctgaaccggtttgagtagattagactagaaaaaattgaaaattttgaaatcatgtttcccactcccttctcccaggggtattattttgtaaagtctttttttccccaataaggtaggtcaaaccccatttttcgcaccgtgaatgttatttttat

SEQ ID NO: 38457 - DNA, 896 bp, Heterodera glycines
  misc_feature (884)..(884): n is a, c, g, or t
cgatcggacgtctgctccgtggccccgcatgacgcgctctccgcacaccgcgcgaagtcccaaacgcgcgcggtcgcatcgtcggaagcggtggccaatttgacatcggttgggcaccagctgaaaaagggcggaagggatgaaaaagggaacaagcagaggaaagaaaaaaacaacggaaatgaacgaaatggcggacgaaaagcgaacaaaaccaaaggcaagcaaagaagcgactttggttacggagaaagaattgaagaaacaaatgaaaacagtcattgggcagccactccctttatcacgccgataataattcaatggaaaaagataaaattaaattcgctaattatttatcggtgcccaacccaaagattataacgcgccctttacaaaataagagcaaatttattcgtcggtcggagtgccactttgcgaagacgtttgttcagtatatttgaatatttaagccggtttaagtcagtttgttcaaattcattttttaatctggctaaatgcgttgctttgtttcttgggttgggtgatccgagtcaaattttatcgaatttcgtattttcaccctttgccaattaattttaacgttttcactagataaattgaatattgataaatgacaaaaatccatcatttcaatgccgaagttaacacataatttaaacttttgttaaagacgcaaatgaataaaacaaacaaaaagattgccctcctcctcctcaaaatcgcagtaatttatttcaattgacaaatggtaatgaccgaaatttgacgacgaattcatttaccaaattttacccgtaatgatgtgagcaaataaggtgattgattgagtggagattgattgatgaggactaaatgatcgactncacacgacaaag

SEQ ID NO: 38458 - DNA, 895 bp, Heterodera glycines
acaccctattagtgctttgctgtcccgagaaccggcaggcaatggatggctttaaatctgcaagaaattagattggcaataagtggttgtaaaaaacttttgtgtaaggaattattttttgaagtgaatcaaacaccctattagtgctttgctgtgccgagaaccggcaggcaatggatggctttaaatctgcaagaaattagattggcaataagtggttgtaaaaaacttttgggtaaggaattattttttgaagagggtcaaacaccctattagtgctttgctgtgccgagaaccggcaggcaatggatggctttcaatctgcaagaaattagattggcaatatgtggttgtaaaaaacttttgggtatggaattattttttgaagtgagtcaaacaccctattagtgctttgctgtgccgagaaccggcaggcaatggatggctttaaatctgcaagaaattagattggcaataagtggttgtaaaaaacttttgggtaatgaattattttttgaagtgagtcaaacaccctattagtgatttgctgtgccgagaaccggcaggcaatggatggctttcaatctgcaagaaattagattggcaataagtggttgtaaaaaacttttgggtaaggaattattttttgaagtgagtcaaacaccctattagtgctttgctgtgccgagaaccggcaggcaatggatggctttaaatctgcaagaaattagattggcaataagtggttgtaaaaaacttttgggtaaggaattattttttgtagagagtcatacaccctattagtgctttgctgtgccgagaaccggcaggcaatggatggctttcaatctgcaagaaattagattggcaataagtggttgtaaaaaacttttgg

SEQ ID NO: 38459 - DNA, 1074 bp, Heterodera glycines
aaattacgaagctttattttccaacgacgatttttccaccgagattttttaaaatttctctagccatacagacaaatctcgtagcggaatttgctacccgccccccgaattttcttttccttatttgttcgggatggagaagaaccctaagatacataattcttgctctacttttattcagcaagaaaagcatttgatgccccaaaaattttaagaaagtgaattcagaaatccgatgcccaaaaatctcagaatttttctaaagataaaaatagcactctcatcgaatttgcgtgtaacaggcgacaagcccaaaaacaaagttttatttagttttcagtctccattccttattttcagaaattttaaaaaatttttttacgaaatttttttattttttcccaaaattgtccgcaaatgtccgtccgcaaatgtcccactgcgtttatgaatgtttaaaaatgggaatttttatgaagttattaaaaaaaaatagtaaatattgcatctatgggcaaatttagtgctgctcgagactaccgatcttctagtccagagaattttgggttttttgtggggctcaattttctgcttatcttggagtaaattcttgaaggcgactctcgaatctcggaaaatctttttgacttgatgtgggataaaaatggaatttattatgaatttatcaaaaaataaaattaaaattattgtcaaaaaaactatcattagtaattggtaaattttagtgcggcgcgaatgtttcggtcttcttgtccagaggcttttcgtttgttttttgtggggcacgtttctctgctttctcggagtcaattcctgaactcggctcttgaatctcagaaatttgcttttgactctcagagtggacatttttagacataagtacccttttacttatccctataatggttcgtttattcttcagattgtctcccaatagaaaatcttttctgcctcctattttctccactccgtgtttgctccaatcagttcgttggctcgtgcccaatgggtttcgataggcgttctcttcgttggcgtatgtttagtgcaatt

SEQ ID NO: 38460 - DNA, 1187 bp, Heterodera glycines
atgttgtaaatacaatatctcttaaatttattctaaaatcgcttagcttgaaattttttcaagcttctgttacaagcaaaaattttgcctttgcaattctacccaatttctttagcattttaacagatgattctgtgacaaattttgatgcaaatccaaaaaaatccttccgattgtaaaataaattgaattactaatttcctttctttcttttatggtgtttcatatcaacttcattatttttctgcaaaggcttattatatgtcacaaaaacttgtttgttttcgtcgattggtaatgcgcaaaatcataaaaaactagcgcattaatttttatatgcaaaactgaatttaatatgttagttaatttaaaattttcttttattttataaaagtaataagcaaagatgttgtaaaatacaatatctcttaaatttattctaaaaatgcttagcttgaaattttttcaagcttctattacaagcaaaaattttgcctttgcaattctacccaatttctttagcattttaacagatgattctgtgacaaattttgatgcaaatccaaaaaaaatccttcatactgaaaaataaattgacttataaattcccactcaattttctatggatgtcttattgctcacatgactgtgcccatgtcacttctatcactgcattctatattagatcaagttatttacaattatatttacatgtattacaatatatttggctttcaaattttatttaaactaaatatttcaatactacttaatcacaaattaaaaattatgattatattacccctaattaattctataattacctacattagactcatatatccatctcggctcaataaaacatctcattaccacgaatgggacactctatcaactgaaacattgcacttgtgatcaagctttgcacgtacttattacattggctcccctgctggacctgatggtaatgctcgccactagagagccacgtgatatccgaccatattgtacgcatatgtataattagctctttttttgcttagatcagatgagcgatcgagcaattttcgaaataatatcatccatcccataaaataagattgtattatccataataaggacattttgcaaaattgctttaaatctcttgtatctcactttatacaattaatatataatcaactttt

SEQ ID NO: 38461 - DNA, 1146 bp, Heterodera glycines
caccgtgaatgttatttttattgaattctgaaccctccccgcgtagattagactagaaaaaattgaaaattttgaaatcatgtttcccactcccttctcccaggggtattattttgtaaagtcttttttccccaataaacttgtcaaaccccatttttcgcaccgtgaatgttatttttattgaattctgaaccgttttgagtagattagactagaaaaaattgaaaattttgaaatcatgtttcccactcccttctcccaggggtattattttgtaaagtctttttttccccaataaacttttcaaaccccatttttcgcaccgtgaatgttatttttattgaattctgagccgttttgagtagattagactagaaaaaattgaaaattttgaaatcatgtttcccactcccttctcccaggggtattattttgtaaagtctttttttccccaataaacttttcaaaccccatttttcgcaccgtgaatgttatttttattgaattctgaaccgttttgagtagattagactagaaaaaattgaaaattttgaaatcatgtttcccactcccttctcccaggggtattattttgtaaagtcttttttccccaataaacttgtcaaaccccatttttcgcaccgtgaatgttatttttattgaattctgaaccggtttgagtagattagactagaaaaaattgaaaattttgaaatcatgtttcccactcccttctcccaggggtattattttgtaaagtctttttttccccaataaacttgtcaaaccccatttttcgcaccgtgaatgttatttttattgaattctgaaccgttttgagtagattagactataaaaaattgaaaattttgaaatcatgtttcccactcccttctcccaggggtattattttgtaaagtcttttttcccaataaacttgtcaaaccccatttttcccaccgggaatgttattttttattgaattctgaaccggtttgagaaaattaaaataaaaaaaattgaaaaattttgaaatcattgtttccacatccccttcccccagtgtgtatttttttggaaaagtttttttttcccaaaaaaacttttaaaacccccttttttccccccggggaaggtttttttttt

SEQ ID NO: 38462 - DNA, 800 bp, Heterodera glycines
  misc_feature (777)..(778): n is a, c, g, or t
cctttcggctcccctctctccccgcctccgttcgcttttcctcccttttgctttcgcccggctgctgctgctgattatgataatgatgctgataattgctgatcctttgttggtggacagaactgaacattcatgctttttctgtggcttttcgtcttcgttttgctttcgtttcgtccctttcgcttttcgcaccgtttgtggtaaaccgacccgcttctgtccactcccttcgactgatttttctgactgcccactgaaattgccaatgtccgccgctgtccgtcgcccccgtgccgttggaattggcgaattgttctcaaaattttgccatagcaaatcaaaacggtgaagaggcaaacatagcaaagcacgaaaatctgaaaggccaaacggacggggaaagtgccgagaaaggcaaaccaacgaaccattagcatgcacaacacgttgacagaaagcccggccacctgtcggcgttggactccgcttgggtcatgcggcgggggattccgtcgtcgtcgccctccgccgtctcctctccttcctcggtcattttgtcattctgctggtccaatgaaactgttctgttcattaggaccaaaaccaaaatgggaagaggcgaacaaattggcgaacaccgacccaatgccgaacagaagagagaccaaccaactgaaagtgccaacacattgaccgcctttaacccgaccgaccaaatttgcgaggatcagaacgacggtacgacggcaaaagtaacgcggggtagtggagggnngatattgatgacgatgaattca

SEQ ID NO: 38463 - DNA, 695 bp, Heterodera glycines
tcctaaaaaagtatcaatgataatgaataattaaatttaataattgttaataaaaatattttgaaatatagatatcatttttcttttcattagtccgaatgtattttctccaacttgattcatttccaattataaaaatagtgttagtcagctttttggagaagcatttttcgactcaagtgcaggtgatggatcaactttattgtttgtgggcgcaaaaacaatttttatttcaaatccggatttgtggccttccaaataattaagtaagagcaagagaaaaataaagctaataaaaaatattttcattttttatgtcaatatatgacaagaatgattttaacactgaaggggacgatattttataaattgaaaatttttattaatatggcaaataatattgacagcattgattatcgtttctgatgtaataataatatttcatgtttaaaataatttttattatctgcttaaatattattccattgaattataattaatctaattattcattatcattgatacttttttaggatcgacctagcacccattctcatcctctgaggatcaaaacattttgcctaagggataaaaagagatcactgcaatagttgaaataaatggtttaattttggatttctattctaggtccgtatcaatttgttttctttcattttcgactattcataatcata

SEQ ID NO: 38464 - DNA, 1071 bp, Heterodera glycines
  misc_feature (1045)..(1045): n is a, c, g, or t
ttttccccagtgatttgtgagtgataagaaaatagaagaaattcagggattaattcctgaggaatttccaaggaccacgtccatcattgctacaccggtgccttaatggcattttaatgtcaaaatgcccgacactagcgcatttctttagacaacgaaaattaattcctgaggaatttcccaatgcattcgcagctttgttagaccgatgccgaaatggcaatataattggaaaaggacagacaacaatgcttttctttatatcagctgatggtttacaaaaatcgaaatacttcctgagtactttccaagaaccatgagaataaatatcgcactagcgccaaaatcgaacaagaacgctaatcatcagaatcatcttaattttccccagtgatttgtgagtgataagaaaatagaagaaattcagggattaattcctgaggaatttccaaggaccacgtgcatcattgctacaacggtgccttaatggctttttaatgtcaaaatgcccgacactagcgcatttctttagacaacgaaaattaattcctgaggaatttcccaaagccatgcgcagctttgttagaccgatgccgaaatggcaatataattggaaaaggacagacaacaatgcttttctttatatcagctgatggtttacaaaaatcgaaatacttcctgagtactttccaagaaccatgagaataaatatcgcactagcgccaaaatcgaacaagaacgctaatcatcagaatcatcttaattttccccagtgatttgtgagtgataagaaaatagaagaaattcagggattaattcctgaggaatttccaaggaccacgtccatcattgctacaacggtgccttaatggcattttaatgtcaaaatgcccgacactagcgcatttctttagacaacgaaaattaattcctgaggaatttcccaatgcattcgcagctttgttagaccgatgccgaaatggcaatataattggaaaaggacagacaacaatgcttttctttatatcagctgatggttttacanaatcgaaatacttcctgagtactttc

SEQ ID NO: 38465 - DNA, 793 bp, Heterodera glycines
catttttctgcagcccttcctattataggtagaagccctccacgtttttgttttttagaaaacacttcaacttagccccctcacagcgaacattttttgattcgagttttcgaaaaaaagttatgggccatcaaacgcaagcaaaagtgagaaattagccgccgggactcagttggccctcggagaaaaaaacctatagttttcccagatgcgcctcaaaaagttgtaagacccttccaccactttcagggcactcccggccttcggccgggagattttgttttttgaaacgaaactcaaaacctatataacatatatataactagcgtgtgcgtgaaccgtcggctatttagctggggaaaagcgcttcgcgctttgggagcttcgctacctagataagctatgggttgtgaaaaaattgggaattttaaaaaattatcagcgatttttaggccgcttccagtgattagaagaggtacaacagtgattaaaagtggtacaacagtgattaaaagaggtacaacagtgattagaagaggtacaaaagtgattaaaagtggtacaacagtgattaaaagaggtacaaaagtgattgaaagaggtacatcagtgattaaaagtggtacaaaagttattaaaaaacgtacaaaagtgattaaaagaggtacaacagtgattaatagagttacaacagtgattagaagaggtacaaatttgatgaagaggtacaaaagtgataaaagaggtacaaaagtgattagaagaggtacaacagtgatcagaagaggtacaa

SEQ ID NO: 38466 - DNA, 1479 bp, Heterodera glycines
cccaaaatataggaaataatgatatataaatacaccattcctcatacaaaacgaaaatttaatggattgacaatgattatgtccgtttcttgtaataatgtgtcgcatttccattggtcaatacagtggtgccattttgggcaacccgagcagcaggcatttccatgtttggcacattctcattttcatcggcaaacaacaaataaatacgataaatgatcgaaatgctggcccaagtgatgaacacagaaatcccggccatatgctaaatttatttaggcaaattattttatgtttttttattaggttcattttttgaaaaaagtctcaaaaatgctattgaaaaacacaaataaaaaaaaccatttagaaaattaaaaagcgattgtaattagaattgcaaataacgttttagtccaatttgtgggatccacgaaattttaaatggaaaattttgagttttcgcaaattttttagtaaaacaaaatcattttcggagtttgataaaccatcgttgaaaattaaaaaatttttcatcgagtaatttcatcataatgaaaatcgagggcctaaaattattaataatttctatgtaatttatttactttattggaccagtgagcatggtaaataaattgggaccaaaattgtgccaaattgatgcacacaatcatcaatgctcgtgtttctgctgccaatttgaacccttctcgacaaccataattaaacttaaaaatatttaaaattattaaaatatttttttatttatattgtattcttactgcatagttgctgataatgtacgaactcaaaaaattgaccccaataatttggccacaaaattgatgtgatgggtccaattgtataagcacttaaaattgtcagttaattttcaatgattaataaaaaaaaaataacaaataatcacttttattttgatggtattccttatcaattctatttttttaaaatttacttgattccgcagaagccataacggcgcaaatgcccagccaaatccaatcaaaattgccatcgcactgtccaattgacaaaaaatgttgccccaattgttggttgtcccaaatttttcaactgaattaaacaaatggaaagtataaatttatgcataatcgaaaattaaaaaaaaattttccaaataaatagctgaaagattttagatgaagcccaaaaataatcaaaaacaaaaaatctaatcgaaataattaaaaaaaaatttttttgtttgttgataaatgtttacttttcggccatccattaacaaataataggagcaagcacactgctgaattcgcaatgaacagccaaacaaatggacaaattatcacttcaaattgaaacattaattattataattttgcaatttaaattaattaatacaaatttaaaatatttatttaatacatataattaattaattacatgtctcaacgtattctgcattcattgcctgagtat

SEQ ID NO: 38467 - DNA, 957 bp, Heterodera glycines
tttttgaattctgacattttcagctcatacgctctaaatataaacagcatcagtgtccggaaggatcgatttgaaatcgccaataaccccccaaattacaatttcctactgtaaacttatacagattacatttggatataagaaattgaaatattgagaatatcacaaaagtgatcatgaaaattataaattggagattattgggacttatcagctcggtcctccgcaaacactgattcagtttatatttagaggataaggagttgaaatggtggaattccaaaaaggtgaccaagaaaattgtaatcgaagattattggcgattatcagctcggtcattccgcaaacactgattcagtttatatttcgcgaagaatgagctgtaattttgcgaattagacaaaaatgatcataaagtaacaaatgagagaatttcacattctgctaattaggctttaaatataaactgtttaagtgttgcagacggatcaggttgataagcgccaataacctcagatttactattttcgcgacctcactttttgaattctgacattttcagctcattacgctctaaatataaacagcatcagtgttccggaaggatcgatttgaaatcgccaataacccccaaattacaatttcctactgtaaacttatacagattacatttggatataagaaattgaaatattgagaatatcacaaaagtgatcatgaaaattgtaaattggagattattgggacttatcagctcggtcctccgcaaacactgattcagtttatatttagaggataaggagttgaaatggtggaattccaaaaaggtgaccaagaaaattgtaatcgaagattattggcgattatcagctcggtcgttccgcaaacactgattcggtttatatttcgcgaagaatgagctgtaattttgcgaattagacaaaaatgatcataaag

SEQ ID NO: 38468 - DNA, 868 bp, Heterodera glycines
atcaaaaatatgtaattagctgcagcatttagtggaattcctgctttggtatgtgtgtgctgtgcttcattggaattcagttgcacttaactgattatttacaggagatgccaatattggcatgagattgttatgggtgtgggggagggaatttatattagcattaaaagctttaaaaatatccgttcattgatcaacaggcatttgaaaatggaaaataagcaccatatggcatggaggaacatctaatagttcattaatttgtagtttatcgaacgaattccttacatttttggcatttcgttttccacgtagaaaaatgacggaattaatggcggatgataaagaaccaaaaaaagggttatacttcggaatttaatattgggttgtgaagcacaaccacgggtggaagaggtacaaccacgtgtggtagaggtacaaccacgggtgggaggtacaaccacgggtaaaagaggcacaaccactggtgggaggtacaaccacgggcaaaagaggcacaaccacgggtgggaggtacaaccacgggtggaagaggtacaaccacggtggtagaggtacaaccacgggtaaaagaggcacaaccacgggtgggaggtacaaccacgggtggaagaggtacaaccacggtggtagaggtacaaccacggtggtagaggtacaaccacggtggtagaggtacaaccacgggtggaagatgtacaaccacggtggtagaggtacaaccacgggtaaaagaggcacaaccacgggtgggaggtacaaccacgggtggaagaggtacaaccacgggtggaagaggtacaaccacgggtgggaggtacaaccacggggtggaagagttacaacc

SEQ ID NO: 38469 - DNA, 1234 bp, Heterodera glycines
  misc_feature (35)..(35): n is a, c, g, or t
  misc_feature (1113)..(1113): n is a, c, g, or t
  misc_feature (1204)..(1204): n is a, c, g, or t
agataatattaatagaaacaaaattaaaatatttnttgcactacccatttttatataataatttatctattaatctatatgctcacctcagtaaaattctatggtgctgatcacgaatctaaactcggatttatcaaatgccaaactccgtaaaaaaggtctaatttttttccaaaatatttgatcacaaagcttcaattgttaattgcataaaaaatggcaatttaataaaacgaattaaactcgaactgactaggattaattattaaaatctaataaattaaaagtaatgcaatttaaatgattaaaaggtcaccgaaaatttaactcccggcacgacatgattaaataaatatataaaatcataaaattatctttttgattcgccgaaccctcggaatttgtgcaacctccttttccagagacacacgtttcgggcgaccccttcaatttccatttattagcccattgtccatgactgggttgcggatccacttaaatatattatgaataaataaatattcaaataactatttttacggtttgaaattgaaaaccgatgccctgggcatgaatgaatgtatgcgtttagattcttcgggttgtacataaacaaactgaattgtttcgagcaattgtcttattaccagaaagtttgccagccgtcctggccctcccattttggatacgaacccacagggacataactaaacaaacaatatgatttggtttaatattctattaaaccgaaacggcgggtagcgacagctagtttctaggtgtccttgcttgccgcaattccagcatgctttcgaaccctctaagaaaataaattaaaaacgtatttttcttaacacaaaccaatgaaagtgtacggatggcaattagtacactctctagcgtcatgactccacgtacgacagcggtgacacttcatacgttttgtgccgtccggacccacaagtttcggacagcatttaacaagatggtcatccccgcagtgccaacatccaccacgctgcgtacccacaagacgaagacggcgaatctctctgcattttcttttatttcatcagcacgtgacataatttacttagctataattcactatgncattttattgcaaaaaatgattttttaataataggttgacttggcaacattaattgtacagtatatatcacttttactcatacacacatcnattagggctgccaaaaatatggcacgaaaa

SEQ ID NO: 38470 - DNA, 914 bp, Heterodera glycines
gaagaggtgcaacagtgattagaagaggtacaaaagtgattataagaggtacaaaagtgattagaagaggtacaaaagtgatgagaagaggtacaaaagtgattagaagaggtacaaaagtgattagaagaggtacaatggtgattagaagaggtacaaaagtgattaaaagtggtacaacagtgattagaagaggtacaatggtgattagaagaggtacaacaatgattagaagaggtacaacaatgattagaagaggcacaacagtgattagaagaggcacaacagtgattagaagaggtacaaatttgataaaagaggtacaaaagtgattaaaaaggtacaacagatacatgaaattctatcaattaaaaaataattaatttaaacttataaaatttatttatcaaaaaaaattaattaaatataattttttatttattaactcaacaaaatattttaaattaattaaaatcattgaaaataacgtaaaaatgcacaaaaaaataatgttacaccgtccggattcgaacctgccccccccccctcaaaatgatgcctcagaatccccaatcacacagggattctgaggtcttgacgatgtcaaaagtaaaatctgatcacgtattcgtgatcagcggcccaaataacccctaaggacatatttttggaagatttttgtgagaaaaatttttccactcaaaaatcctgtccaccccctttggacccgaatcacaaaatcacttttatttttatatcttattttaaaaatttgataaaaatgtaaaataaaatttatattatagaggaaaaaattgcggatttttgtaatattttacttttacagaatgacttttcagaagggagttctaaatgtttttctgaaaaatctaaaatttccagaatttctggaa

SEQ ID NO: 38471 - DNA, 796 bp, Heterodera glycines
agagaaattgtatctctatatatgtatgtatatattgtatgtccatatccctgtggcattgtcttgctgaatgtaattctcccacaaatggttgttgttctatttaaatatgccatatatatgtgtattttttataattgtaatatgtttgccctgtttatgcatgttttatggtcatttattattattgccgaataaatacatttatatgaatgagtacattttccatgtcatcaattagggagtccaaaaatatggatataaaatcgcgaaatatggaccaaaatcgcaaaatatggaaaaaaatttttcaaaattgagggtataatttttcaaaatttgctaaaatattgtaaaacttacaaaaaatggctaaatgtggtattaaaaccattttagaagaaaaaaaacatgatacaactaaaatttactcttttttagcgaaaaatcaacatgggaagcaaaatgtcgaaatttgtcacggatggtcatgttagctttgagaaagagtgaataaaaagcggacgaacggcgcttctgttgggagagccgcttgacgagcatccgtatctctctgatcataattcgcggacaacaagacgaattgttgagacttttgaactgctccgagtaaatccggattaacaacaattggcaaatgagttaaaaaaggagtgagctcaccatcgtatatgaaatggacgaaaagcttcccgctgactgtattaaaattttttgataagccatttaaaaaactcgccatttcgtaaaatttccgaaaattcattctccaaaa

SEQ ID NO: 38472 - DNA, 1257 bp, Heterodera glycines
agtctaaaaaagttaagcctacattttttggcatatttaaaaagctattaaaaagttttaaaatttaataattttcctgcaccgaaggtactcactcggcctcttcgcggcctcgtggtgggccttcgcccccccccctcccacgcccttcagagcacgacaaatatttcaacaaaaattttgaaatcatgtttcccactcccttctcccaggggtattattttgtaaagtcttttttccccaataaacttgtcaaaccccatttttcgcaccgtgaatgttatttttattgaattctgaaccgttttgagtagattagactagaaaaaattgaaaattttgaaatcatgtttcccactcccttctcccaggggtattattttgtaaagtcttttttcccccaataaacttttcaaaccccttttttcgcaccgtgaatgttatttttattgaattctgaaccgttttgagtagattagactagaaaaaattaaaaattttgaaatcatgtttcccactcccttctcccaggggtattattttgtaaagtctttttttccccaataaacttttcaaaccccatttttcgcaccgggaatggtatttttattgaattctgaaccgttttgagtagattagactaaaaaaaattgaaaattttgaaatcatgtttcccactcccttctcccaggggtattattttgtaaaggctttttttcccaaaaaaatttttcaaacccattttttcccccggggaaggtttttttattgaattttgaaaccgttttgggaaatttaaataaaaaaaaattgaaattttgaaaatctggttccccctccctttcccccgggggattttttggaaaagctttttttccccaaaaattttcaaacccctttttcccccccgggaatgtgatttttattgaattctgaaccggtttgggtaaatttaactaaaaaaaattgaaaattttgaaatcctgtttccccccccctttccccgggggatttttttgtaaaggttttttttccccaaaaaaattgtaaacccccttttttcccccccgaaagtgttttttttttaaaatttgaaccgctttaggagaatttaaaaaaaaaaaaaattaggaatttttaaaatccttgtcccccccccccttcctcccgaggggtttttttttttaaaaagtttttttttcccaaaaaaattttttaaacccccttttttcccccccggaagggttttttttttta

SEQ ID NO: 38473 - DNA, 631 bp, Heterodera glycines
  misc_feature (41)..(41): n is a, c, g, or t
  misc_feature (533)..(533): n is a, c, g, or t
tttttgttttggttgacttggccattttggcttgtcgcttntactgaatatcgaagatacatataaatgtaatagttaaacattcttcatattgccatttttgaagatcatcaccgaattccactaccacaaatcgcacgtgccaacctatggggtgataatgctcgacccgacacttaattatgtgctgctcgtccaaggatattacgcctcgaaaaactcgtggggttttccgaagggaaaggtgggaaagtgtttcacaaaatatctaattccaattgacatttccttttcagattaatgaggacgaagtgcctttgaattgtgcgttgcgcgaggccttcgaagaagttggctttgacgccaccgaacacataaaaaaccccgagaaatgccgcccactgcagcacttttttggcgaaacattggtccgtctttttcttgccacggatgtgccgatggatttcccttttaaaccgcacttgcgaaaggaaatcaggtgaaagaaattccactgaataattttgcatcanagtcaatttcttggcatctttcgggtgcttttttagtttataaagacacttttaacttgcactttctgggccgataaaatttctttcattacattgat

SEQ ID NO: 38474 - DNA, 1826 bp, Heterodera glycines
ccaaaaatctctccaaaaatatcggattttacggggttatctccgcgccgccgatcacgaatacgtaatcagattttactttagacacggttaagacctcagaatcccagtgttatcggggattcttaggggtgggagcgcccgtcccgaggccgcgaagcggccgaatatctccaaaaaaattaaaaaacgggcgcgaaccgcccgtcctgatgccgcgaagcggccgaatgttctcaacaaaattacaaacgggcgcgaagcgcccgtcctgaggccgcgaagcggccgaatgtttcccacacgattaaaaaacgggcgcgaagcgcccgtcctgaggccgcgaagcggccgaatgtttcccacacgattaaaaaacgggcgcgaagcgcccgtcctgaggccgcgaagcggccgaatgtccccacaaaattaaaaaacgggcgcgaagcgcccgtcctgaggctgcgatgaattgctaaattacatcactttctagcgacgcggcgaagccgcgtcccatagcgcgatagcgctttaaaacatcacactaatggaattaatgttttgtatgttttaaaataacaaataagggccatatattaccaagccacgcatgcacaccatagccaactgggcaccctagtttagatataactaaagcaacatcgagtttcattgctaaaacaaaaatctcgagaaccgctggggggagggactcgggagtgtggcattgcttaagcaactttttgaggcgcatccaggaaaactatgggcattccggtccggtggccaactgagcgccggcggcgctgaaacggcttttcgtttcagtctcactgttacgaaatttttttcttttgctttgatcaaaaaatgcttgctgggaggattttaagttgaagtgtgccctacaacttcgcttccaatcatttttctctacggcctactgtattccgtgtacagtcgtggaaaaattgcttacttttttggccatttcagcgccggccgaataactcgtcggggttttgagggaggaggtcggtgtaagcggcttttttgtacagctcgacgagctctatccaaccatgtttttgtatttctgaaattttcagaaattttcgagctaggccccctcgtcacttttgaggtttttgaattttagtattttttgcagatttttccggggaaaacgaagaccactttcaagcaaccgtttttcatgctctatcgattggtgtgattttcagaaaaaattttcaaaatttttttggaaatagaaaaatttggttgctaggcctcaattttagttcttgcgcaataacttgtcaggagttgaatttatcaaaaaatcgtctaagagcttttttgtagagaattttaagcccaatctaatgtgctttatctcatgtttttatcttgaatttaaaaaaagttataaaattaattgtgattttgaaactcaaaaccaaaggggggaccccatggttttgcatttcatgaaaaatttttttgctccctaattagccaaaatgcattttttatagcctaatttatggtgctgaagacaatatatactttatttttggttccgactttttgaaaaaggattacaaatttttgaaaaatatcaaaatttgaaccccggaaatccaaggaaaattcaaaaattctaaatcccttcttttttggccaaatttaagggaataagtttgaaaaaaagaaaaaaattaggaaaattttttgggatttttttaaaatcctatcttccaaaaaaaaaagttattccaaaaattctgggaaaattcattttttaaaaaaaattc

SEQ ID NO: 38475 - DNA, 1128 bp, Heterodera glycines
cttaaatttaattaatttttgtatgaagctttattacttccctgcgaggtatattgaagaagtttgttctggttttaacctatttaaacaaaaacatttcattcttcatttcataaattatagcatttgtatagattagaacccttaaattttttcctctgtaacaaaataaagattcgattttatgtaaatattttaatagcaattatttttaaaattcttttttcttgttttaaaagtttatcttaaatatttttaaatcgagttaaattaaaataatagaaaatttctaactaacattttttgaatcgctattgtttgaatactatttttaaaatttggtatgaaaaatataaatcaaattatgattttaatttaagttaattattttgatacaaaatgcagatcgattattcattattgtatttcttttcaactataattttttctataaatattattatttaacttattaatatatttaaagttattgaaaaaataaatgcttttataaaaaattataaaataaatgcaattttaactaaaaatattaaacttaagtttttatatacaaaatttgtcattgacaaaaattatgcttaaaacaaataatttaaaacaaattaattataaaatcaattaatactatgtttagtgtttttgatggaaactaaaatttttttgtaattttgaactcgtcctgacggcctaaataaggatctgaagctgattaaagcttattaaactttttataattttcgctgatttttagatttaagtttgtttatattttaataatattttttatgaatagcttttatttcaagaattgccatttaataaggcatagtgttttaaatattatttgttttttcttaaaaattattaatgtaaatttatttattcgtacttttaatttctgactttattttttctggttataaaaatttaatatttggtttttcatgctaactttaagggggtaatattgaatgaccattttcataaaaatttaactcaatgattttattttattttcctgtgctttgatattttttcattactaagaacaatattggatttgataatgtcatcaaaaataattaaatattagagaaacttttatat

SEQ ID NO: 38476 - DNA, 785 bp, Heterodera glycines
cgcttctgatcagtttctgaaaaaaaagttaagcctccccccctttggcctgtttaaaaaggaattaaaaatttttaaaaattttattcatctccctttttgatagaaaaagcatcagagtgcctaaactaacatgtaaataaaatttggtgcgtttcagaaccctttctgaaaaaatatttaagaattaattttgcaaaaaaaaaataaaaacgaaagactcagattttcgaaaatttttttgagccagctagctcggcgctcatttcagtgtaagttagtcctttaccggggagtatccctgcaaagtttggtacgcttctgctcaattagcaaaaaatatgagtgatcgaattttcactaaaaaagttaagcctacattttttggcatatttaaaaagcaattaaaaaatttttaaaatttaataattttcctgcaccgaaggtactcactcggcctcttcgcggcctcgtggtgggcctttcgcccccccccccccccccgcccttcaaaattttgaaaaaaaaataaaataataggagactcagaattttgaaaattttttataaaaactgatgacaagctaatgtgataaaacaggttaaatcttttcctttcagtatccctgcaaagtttggggcgcttctgatcagtttctgaaaaaaaagttaagcctaaactttttggcctgtttaaaaaggaattaaaaatttttaaaaattttattcatctcccttttcgatagaaaaagcatcagagtgcctaaactaacatgtaaataaaa

SEQ ID NO: 38477 - DNA, 525 bp, Heterodera glycines
  misc_feature (257)..(257): n is a, c, g, or t
  misc_feature (312)..(312): n is a, c, g, or t
ccttcctttgacttcgttttttcagagccatatagtcccaacaattttggcacaacaatttgttttggataagtccgttgtgtgccaaaaattgtaaaatctcttcagagtttttggaaaaaagccatctcaaatttatatcgtccaatgtttgaaaagcgatgagcggcagattgttggaatcattaatggaatatcttgaaactttaaccatttgctaaaattgcatgaaaaaaatcgggtcctacatgcaggtntacgcgtcccaatcgactttttacgcgtcccaatcacaaaatttacgcgtccatncgactttgtacgcgtcgcaatcaaaaagtttaacgccgtccaatcacagttttttacaatgcttattctgtatccagtatatggtttcggtagatctaacaaataacgaaaaaattttttcagcaaattctcaaagaaatacgtattcaataccctgtctaatcatcttttcgttgtagtaatcaaaaagtcttctttttgacatttaagcat

SEQ ID NO: 38478 - DNA, 1000 bp, Heterodera glycines
agatagccatttttttggaccttccatacctcacatacccccccccggcccgaaaatcatttttagagcataacaactgatgacagccactgtcattgtttccaaagagatttctattaccagattgccaaaaaaagagatagccatttttttggaccgtccatacctcacatatactcaaacggcccgaaaatcatttttagagcataacaactgatgacagccactgtcattgtttccaaagagatttctattaccagattgccaaaaaaagagatagccatttttttggaccgtccatacctcacatatactcaaacggcccgaaaatcatttttagagcataacaactgatgacagccactgtcattgtttccaaagagatttctattaccagattgccaaaaaaagagatagccatttttttggaccgtccatacctcacatatactcaaacggcccgaaaatcatttttagagcataacaactgatgacagccactgtcattgtttccaaagagatttctattaccagattgccaaaaaaagagatagccatttttttggaccgtccatacctcacatatactcaaacggcccgaaaatcatttttagagcataacaactgatgacagccactgtcattgtttccaaagagatttctattaccagattgccaaaaaaagagatagccatttttttggaccgtccatacctcacatatactcaaacggcccgaaaatcatttttagagcataacaactgatgacagccactgtcattgtttccaaagagatttctattaccagattgccaaaaaaagagatagccatttttttggaccgtccatacctcacatatactcaaacggcccgaaaatcattttagagcataacaactgatgacagccactgtcattgtttccaagagatttctattacccagatgcaaaaaaagagatagcatttttttggaccgtcatacctcacatatactcaaac

SEQ ID NO: 38479 - DNA, 948 bp, Heterodera glycines
tttctcgaaaaatattttacttatacaatttatgatattctgacaccaaacagtttatttatttttaaatttattctaggcaaataaaataaatattaaaaagttattttatttaacaatgattttttaaattaattatgtaattatttaagaaacactaaaaacaattaaatttttatacattcaactatgtttaactattaattacttaattgaattattaaattttgcccaaaggttggcccatccgtgaacacatgcatttgtgcggatcgggaccggtgcaacaatgtgacatcggtggaaccatttgtggagtatcgtgacaccattttcggtgccatcaattttgacgagttggcacattttaggcaaatttaattaattaatttaatttaaatttaaaaatggacactaaaggaaatggatggatgaaaaaaaaattgcaaaattttagggaatcggaattttcaaaaacctttaaaaaaccttaaaaaattttcaaatatttttcaaagcttttttaaaaattttagaaaaaaaaacttaatcattcataataaaaattctgaaaaaatcgctacaaaaattttttcaaaagtttttttattgtaaaaaattttctacatttctgtttgaatttctttttaaattactccgaaataaaaaccgattattaaataattataattttttactattcgtattaaaaaaaaaattttgtattatttttcctacattaaaaattttttttttttctttcgtttggccattcaatcgttttttggccataaatcaggaaaaaaaaattcaaaatctccaattattatttcatttcttgttgttgaactgttcagacatcttttgccaaacgacccaattttgaatgattttgagcgtgatcggtccacggttggcggtggataccttctgatcaccaattcggtg

SEQ ID NO: 38480 - DNA, 714 bp, Heterodera glycines
  misc_feature (13)..(14): n is a, c, g, or t
tctagagtccatnnttttctgagaattaattcacaatttccgcagctcttagggtaatggaaaaaattttgaagaggctctccggaacggattagcatcggggttacgagatagaaaattgtcctaaaaagagatagccatttttctgagaattaattcacaatttccgcagctcttagggtaaggaaaaaattttgaagaggctctccggaacggattagcatcggggttacgagatagaaaattgtcctaaaaagagatagccatttttctgagaattaattcacaatttccgcagctcttagggtaatggaaaaaattttgaagaggctctccggaacggattagcatcggggttacgagatagaaaattgtcctaaaaagagatagccatttttctgagaattaattcacaatttccgcagctcttagggtaatggaaaaaattttgaagaggctctccggaacggattagcatcggggttacgagatagaaaattgtcctaaaaagagagacatttttttgagaaattaatttcaattttcccagatcttttgggaaagggaaaaatttttagaggagctccccagcagagtatcatcggggggacgagataaaaaaatgtgctccaaagagaaagacacttttttgagaaaaaattctcaattttcgcagctcttatggggatggggaaaattttttagagggtctcc

SEQ ID NO: 38481 - DNA, 697 bp, Heterodera glycines
cggccgccctttttttttttttttctttttttttttttttttttttttttttttttttttttttttttttaaggaaaaaaaatttctatttattttcattcacgatcaacgaaacaatatcgttttaacagagtttataggattttaaatcaaaaatctaatttcaacagtttcgggggggggacaaggggtttattttactaatacaaaagggagggaggaccttaactagggtggacatatacaaaaataaaaatatttggaaaggagtattttttttctttaactgcagcatgacgcagggtgggggtctttgcctgatcgttttgggacattgattctcgggaattcttctgctagggggggatgaaggcctacagtttccattaaatcctttacgggtaaatttaatttgattgctggggcaaatccttgaataatctccccagcgtttggcccaaggaagggcaatcctacaactttttgattaccctctctatgggcgactacctttaagtaacaattggcaatacttttctggggaataaagaactcagggggcttgaaatatccggggaaaacttcgatgttgtcttcaccgaatcgttcaagggctgtttcttcgctcaagccgacacaaccatactctagggggctgaatactgtaggggccacgttttcgtaatccataacttga

SEQ ID NO: 38482 - DNA, 613 bp, Heterodera glycines
ctgccgtccgtccgttgctctcttaattcattcccctcaattcatctatccatccacctttttatcgtcagccagcttggcagcattagcaataaatttggggcccaatattcgcttctcacccactttacctcggccggcacattttttgctccaacggatttgcccctccgggggcactccccgccccccgccccgctaatgtgacaaaggccgcccgaggcgcggggacagcagccgccattggccaattcattgccgtcctcgtcgccgccccttcggccacggctctctcggcccctgccctctgctgccagccgccgctaattgctcacagctgctggtggctggctggctgactggcgagagtgaagtggggtgaaggacggcgacgacgattttagttgggcggagggaggggttacggtggaatgaatgggcgggcggtgggaggggggggggcaaaggcgagaattgggggaatgaatgaatgaatgaaaatgaattgaaaattgctttagggggagggggagggggggagcagcaatttaaggggggggacacacaaacacacaacaagcagaacattattacataacacctaattgatttg

SEQ ID NO: 38483 - DNA, 975 bp, Heterodera glycines
aagcccattttattgaatgtttcctaaattaatcattctcaaacaaaatttgattattttcactggccaattgaacaaataaatgcccactcattcactttcaattcgctcactatttcctcccacttggccattcattattccactcatttgttttgtttttttccttttacatatgtccaacattccctcctcccatttggtggctgactgaatgactgttggttgttgggaattggaaggactgctgtttcattatcagtactcccacccactccgccacattcactcctctttcatcttttcgtcacaaccaaaacgggaattcccccggggggcaaagagaaggcacccaccccttccctatttcccccccccccatccatcgataggcatctgccgcttgccctgtgcttctttctcttctcactgtcgatattcctcgcttccctcaaacaaagaaagcggagggaatggacgcattggtcggcggacgatgttgtctttctttcacaacaaatgcatcattccctcctcattccctcccttgactcatatgctgacaaattaatgcgacggcgacaaaatgtcataaaaaacgtttgtgttcccttttcaaatagcttttctcatcttcacccctctcaaaatgggtttttaaatcattttcaacacatttttaattatcctttcggcatcatttttgccacaaaagccgttaaaagattcatttggcttttctcacttcaccaaatgccaattttggcttttgcgcctcgttctctcccctttcttttcttccgttccctcgcatcctttttcggccttcatgaattacgcattgcctccccttaaattataaatttgtcgccgttttctcccgctgtgagccaatactttttcctcccctctccctttgtctatcctctttcggacgtctctctccccctccccttttctcttttcctttcctcc

SEQ ID NO: 38484 - DNA, 831 bp, Heterodera glycines
cgctgtcgccttctttcgccggcaaaagtgccgtcgttgtcgcttcagagcgtccgcgtcccgaaacgacctcaccaggttggattggatgagatgctcaaacagttcttggcatgccaatgaattcaattgtcgcagctgcgcactgtgaacggattggatagaatgttgacggactgaaacaaaataaatgattatattaattactaaacttaaaaagggactgatattcggattattattttatttcgacaataggggttgtatcagaaagatgtctgaatttgatactttttttacaatggtctaattgatgggttgatttcgtcgcaatattgccaccagcagagggatgttacgagatcaaaaataaaatgcgagaagctacagtcatggtcataccacgatgccctatcgtgctgtggattgcttggatcgccacaatccctgtggttatcgtatgaatactactctaggtcattattctgcgtaggaatccttctgtaggtttctcaaaaatgatctgaggaagcgattttccactcccttttatagactttgagctcgagcaggataactacattagcctagtgtaggaaaggctagcgtaggaatcctacgctaggtcattagccagcgcaggattcctacgctagattttcacaaatgatccgaggaagcgattttccactcccttttatatactttgagctcgagtatgataactccattagcctagatgtaggaaaggcgagtgtaggaatcctacgctatggcatcacgtattcgtgatcagcgtcataaactaaccctactgacatgattttgaaa

SEQ ID NO: 38485 - DNA, 1416 bp, Heterodera glycines
gatttttaagaccaaaaaacccaaaatagttacctaacccccacagtaaaataaaaaatttttgccaagaaagtaaattttttagaaaattttttcatttcataggagtatattttgaaaaattttagctcgattcttaggggtgtatttgcatttttgacatagtgaaaaaatagtgacaaaacgccaaaatagtgaaaactccaaaatagtgatactcggagggggggggggaagatcgattttcttcattctcgagcgcttcattatgtaatgatgaggaacactgtgtgtgtgtattgtagacgtattaggacctttcaatgatgcaaaggaagctgagagaatgatagctttgggaataatataacagacgttgtgttttgagaaatggcatccccataccttgctaaagcattattctttggctagaaaatatcattagaaaatagcgggtgtagatactgaaaaaactgttcttataattttaattttacaattagaaacgccaaaggtacaattatagtaaatgccaaataggttgtaagaataggctcatttgctacaatttagaacagaatgtaatcggcaagaaagggtttttaaactaatttcaatgaaagaacttcataacaaataaattaatgacttctctaaatgaattgcctgcaataaaaatgctaattttctaaattcgcatgtgccaaccttgagcaccttccattaaacaccatcttttttgaggcagacaatcaatgaaactcacaaccttcggttgtaattagtggggctgttagtggaatagaaatgttaaattttttgcctatcaaatatttgcaataaatgcccatctatttaaaaaatattctattctattaaaatgttctgtattttgctatatattaagaatagccgtacatctaaaggagtcagtaattgaacaaatttctcaaatttcaagaaaggttcaggcagtcgccgtaaaaattgtctatataaaaacaatggcgttacgcatttctgcactaggtcctttttcaaaattgatgtgcttttattgaaaaacatgtttaacgggccacaaattaatagacaaattcaggcacattcttaaaaaattctgcttttaattagttcatttaatagattatgcttttgctttgtttttttaaattctacgcctgcgattatctgataggacaatgatatcaataaattttcttctgaagaagcgaagagttagcccaaacgttttccttcctttctatttaatgatctatcatttcagatataacagtcaaaatttaatcggccggctaaaatgaattcggtaggattttatgaaaatagtttgaaaaaaattgaaaatttcttttcaagatttaatggaagctagtagaaggaacctttttgagt

SEQ ID NO: 38486 - DNA, 1210 bp, Heterodera glycines
ggacgcaattcagcgcgaattgccaaaagaagagacggttaaaactattgaacaaggcaaccaaagtaacttttggccattttaatgaaggtcttttgtcaggttcgattgaccatggtcttaataatttccgaaaaaatcttaacaaaacttataaaaattttacgagagtgccttgtcggcactgtcggattctccccattattctttaaaaatgacaataattttaacatttttaagatgcgatgccgttcaatgttcttcctcagtgatggattgagtaggagatatatttgagttacattaattgtattatgtgtgtttgatatgataaactaggattgacatcggcattaatacgacaattctttaaattagagaccgagatttccaaattctccggaccggactggtattttaaaaaatgactggatcccggatccggtctctcataatccggtcaatccggattttcatattgccggatccggaaccggattggtaaaaatttaaaatttcgcatcttaaattggggaaaaacccgcaaaatgtcatcaattatatgtataaattcggtgcaccagaaaatgtcgccgttgaaaagacaatttcgccaaaaaaataatttttcaaactcagattttgcaaaatctaattatgcctatgacttttcatcaagtactcgattttctcaaaaattgatcttttcaatggcgtagaactcataagtctttcaactaaaacccatcacaacaattcggcattttaaatttgccttcatatattatagctctttctaaaaccacttattagttatatgccactgaggataatattaattttaccgccaacaattttatagaaattaaacattggaaatcaaatacttgatgaaatagccctatttgataaaaatcatttcgatcatagctataaagcaacaatgttagttgagatagaaatttataagaaaatctctatagaacaggtttcaatcagatcataaaaataaacggtcaatttcacaaatgtaaaggcggctcgatgaatggaaaaatgtttgtcattgaggctggcggaaaacgaaggctggcatacgctgcggcggagccatatgttgtggtggagcaacacgttgcggtggaggagccatacgttgcggcggagccacatgttgtggtggagcaaaaagttgcggtggaggagccat

SEQ ID NO: 38487 - DNA, 901 bp, Heterodera glycines
  misc_feature (409)..(409): n is a, c, g, or t
  misc_feature (866)..(866): n is a, c, g, or t
aaactagagatcgacctggacctggatccaggccctggtttttcccggatccaggtccaggtccaggccatttttcggcaacctggatttttcctggacctggattttcctggatttttgtccaggaaatcaaggtccaggtcaaatgtgaaaaaaaatccaggtccaggcaaaacaggaaaaaacctggattttcccggacaaaattttagaatttattttttcaagtgaccgatgttttttcaagttttcaaaaacagattaaataaatttaaaaacacattattattattaattagatatttttagatgcttctaagcaaataattaattttttcaaacatatttttgatttttaaaataaatttcaaaaaatccaggtccaggcctggatccaggtcccgatgancctggatttttcctggacctggattttcctggatttttgtccaggaaatcaaggtccaggtccaacatggaatccaggtccaggtccaggtccaggcttttttcaaaatgtcgatctctagtttaaacagctgtgagaattggcaaaataaaaaattgcaggtttcaataatttttttgttttcaaggaaatataaattttaagcacagggttgttaaaattataaaattttaattagatttataacattttatagattttatttttttaatccatccctttggtgcccaaacttcatatccgctttacagcaactaattaattatcgataatttaaaaaaaaatccatccaaaacttacccatgaagcgtcttttgttttcgactaaatcgataaaataattgaaaatttaatgattattaccgtatttcctaaaatacagtcctccctcccctanattagaacgcccctgaaataaaggaccctttttga

SEQ ID NO: 38488 - DNA, 1356 bp, Heterodera glycines
aaaagctcaggtcccggtcccggtcccggtagggcaaccgggaaccgggaaaaacaagcactggtaagaatggggtctgagtgaaaaattagtgaagaaaattggagtcaaagggaaaaataaaaaataataattaatatattctttaaaagtaacactgcccaagtgtgcaaatggcctaatggctagtctccttgactttcccttcttctttcccctggtttaatccctctacaaaaaatagattattttcaattttttgttttgtatactcgtgggtttcctataaagaaaatatgattcctcatagtttcttttaaattgatacatattttatcattttttaaatgaaaatcctaccaattgagcttaataatcgcaaaaaccaaccttttttgttgaaaatctgttaacaaattgcacccaaatttttaaaatttcccccggcggcgcctatcggcactgccggacaccttcggggggtgaaaattttttgattgatttcaaaagtgacagacgaggggaggggaaaatttttgacagaaaaattttttgattggtcaccaaagtgacagatgagaggaaattcaaattttgtggggagcgggtggggagggtagagagggatattttctcatcttttctctgtgcgcatccattcctgcccagcacaggaatggattatcgatttgacctgggagtggacattaacccttcccatttttaagcgttcccttccacattttcagcgttctttccccacaagcattatttcggcagttgcgagcaacaacaaaaacaacaaaaaaataatgccacagaaaaaggtgcgcaataaaaatttgaattaaaatagtttttttttcaattttagcaaaccccccgcaaacaacaacaacagtcattggcacagcttaaaaaagtggaaaattttgattttttttcaaattttggttttttcagtccaccgcgcaattgactcaaatttatgctgatttttttggattttttaattaaaataaaaatggtaatgattgtattaatttttggatttttttttggaatcaggcagcaccgcaagtgtacgacaattgcccgggggagcacgggcacgcatcgcagacactgttggagcagcaaacaacgccatgtatcgacttctgttcgacgacagccgcgagaactacttcagccatcttgagcgagtaattggtcagccgtaggatatgggatggggtgtgagcaattaattaattaattagggaaacctaaacctatgagggggcgtgtgtcaaatgtcatgttcttttttgatgagcggaaaaattgattgatttagcaactgacagccgatgg

SEQ ID NO: 38489 - DNA, 1204 bp, Heterodera glycines
  misc_feature (9)..(9): n is a, c, g, or t
  misc_feature (19)..(19): n is a, c, g, or t
  misc_feature (79)..(79): n is a, c, g, or t
  misc_feature (82)..(82): n is a, c, g, or t
  misc_feature (90)..(90): n is a, c, g, or t
  misc_feature (1033)..(1033): n is a, c, g, or t
ctatacgtntaatcattantcagtgccattctgtaaaaaatgatctgatttatgaaaactgatcagtgatttgatcagnccntaatgttntacagtttatgctaaaaattagagactacccccagaatcggtacgaggccgagatcccaaatttgcgcggaccgcgaccgtgggatttctgtccacgacccaccccagactcgaacctctcaccttttttaattgactcttacgataactactaacaaatatgacaaaaacaattagccaagattgactggtgagtgtgtgatttaaattgtactgatctgcccagggcattttttaatttgcgcacttttttgctgctacgtatcacgcgctttctacggtgtgtgtaatacactttttgaatggagagaggttccccggagggcgggtggtggtggagtggggtgactgagtggccatgcggttgttattgtgctcatgttagttatgttcccaatggggaacgtgtcgagaggggagggacagaaagaacaaaatgtcgtacactataaaggccagggtttgttctttgccttattccaccaacccaaccaatgaccatttttgttttaaattcctatttcactcattcgcctgtcccttccactttttttcgtatttttcgctcctttctccgccatcccaattccctccaatttatatagcgaccgcgagaataaccacgtggtgggccatgtggtttgttagtgaaagaggcgaaaaaacgcatgcgggcggccattttgggtacattgtgctacaaaatgggaaatgacgtgactaatgatcactttaatcagtcagcgtttccaaatttttaattccaaattttcagattactcttcaatttttggtgattttatcaatgctttgtaaatattttagtatttttttgaatttttcatttaaaattcagaataatttaacaagcaataaaatgatttttttgacggtgacattttttggccaaaaatttaaaaagctgcaatctcgaatcttaacngagagtgttttttattcaacttctgtgaagcctttctgctgctaggatacaattttcttcgtcattacgtgaaggggtgaatttgattagattgatatctatgaaggtattttgtttagctttagacagaccaacaaagataactgctttttaatctcaaatacacatttc

SEQ ID NO: 38490 - DNA, 834 bp, Heterodera glycines
ggaaaaaaagactctttacaaaatattacccctgggagaggggagtgggaaacatgagttcaaaattttctattttttgtagtctattctactcaaagcggttcagaattcaatttaattaacattcacggtgcgaaaaatggggtatgaaaagtttattggggaaaaaaagactttttacaaaataatacccctgggagaagggagtgggaaacatgatttcaaaattttcaattttttgtattctaatctactcaaaccggttcagaattcaataaaaataacattcacggtgcgaaaaatggggtatgaaaagtttattggggaaaaaaagactttttacaaaataatacccctgggagaagggagtgggaaacatgatttcaaaattttcaattttttgtattctaatctactcaaaccggttcagaattcaataaaaataacattcacggtgcgaaaaatggggtatgaaaagtttattggggaaaaaaagacttttacaaaataatacccctgggagaagggagtgggaaacatgatttcaaaattttcaattttttgtagtctaatcttctcaaaccggttcagaattcaataaaaataacattcacggtgcgaaaaatggggtttgacaagtttattggggaaaaaagactttacaaaataatacccctgggagaagggagtgggaaacatgatttcaaaattttcaattttttgtattctaatctactcaaaccggttcagaattcaataaaaataacattcacggtgcgaaaaatggggtatgaaaagtttattggggaaaaaagacttttacaaaataatacc

SEQ ID NO: 38491 - DNA, 948 bp, Heterodera glycines
ggcatttcaaataaaaaaagagaggagagagagagagaacgtttttctgatgtcagagaaaaaaagaccgtatgcatttactgtctttgaacccacattgaattaaaacccccgggggttctatctaatacagtaaatacggtaggtaattccaaattgttaaatttccaaaaaattcggacgtttgctttctgccggccgccctgaaaatggcgctcagctttttgcgcttctgctccaactccatcatggcattggccagctcattggcacggatcagctgcatgtccttgggcgcaatttgaaagtcggacaaatgccctttggggatgatgtcctggagggcgtgaaatttcatgaaaaatttccaaaattttaaatgcctgaattttgaaggatgcccgcgtgtgcgggagcgtgacctccatctcatcggagatctttgacggaatctgatcggccaactcggaggctatcatatgcgctgatcagagagattaaaataaaacagtcaggagagagattttattagggaccgaataaggctcaaatttagaggttttttatcaaggaaatttgcgtaaatcttcgaaaatcttggttgtttttataggttagaaattactatgcctcctaagtcaaattaatcttatatttgtacatagtaaagctcgacattttgaacagcctggtatggacttggattaagtcattccgttttaaaaccaatcacacctaccgatgtatgtgttccgatcaagcacataattgagctcttgagaaaacaaaagtcaacaaaatcaaattaaaactgtcaaagaaacaaccaaaatcgtcgtcgtcctctgaaaaaatgaaataaaaaaaatttcaaaaatttttttgtggacctccgaatggattcatcaaatattgtccaactttaagccatccgatgtagaacacatt

SEQ ID NO: 38492 - DNA, 977 bp, Heterodera glycines
  misc_feature (880)..(880): n is a, c, g, or t
  misc_feature (934)..(934): n is a, c, g, or t
tgttgttaatggcatcgcttgtgacggcgctactgacagtgtgtggtggaaaagttgaggaaaacgctattaatagtaaagcattaatttgtgacgataaagtttggtatcagactcgattccgatgtcactgcagcgcccgactcgtccacataaaacattgtttttggccgttgttttttggcgcttggcccggaatgcgtggaacagacccttcgaagttcatcgtaaagtgaacgtcgagagcgagtcgaattggcaaccgccgttgaggacagtgcaggagctgagaagtaacagagtgaaaaaggttttctcattgcttaccgctgatttggcgttgatggacaattctttgataggttctgagctgagaggggtccctgcgggtgaccagcgaccgtttttcagagatcgacctaaacgaaaattaatagagtaaatgtgccaaagtaattaggattatgattgaaaaggattcgtccatgaatcgatcgttttttaatttaaagacctccgtgaaggcgcttcacggtcgaaatttgacagctgactcaaatcactgtcactgccacgtcttgcgccaccaccgaatggcttcgaatcgcgcgattgatgcattttacgcagcacgaatagtcttacataatgcaaaaataaataaatcaaaaaattagcattatctcaccgtagtgaatgtttcgattgaggcaactgagaaatggtccgcataaatgcctccaaagcttccccattcagttcatagttaagcaaattttgggtttcgatgccaaccaaacggtcgttgacttgcaagcgcccgtctttgaaggctgcggaaccgtggaggatctaacaataagaatgggacatcgtaatncaattcgtattccttttattcatgactattaactcacactacgaaatgaaaggnccgcatccgtggccccgactcgctgtgctttcagtgagagtcc

SEQ ID NO: 38493 - DNA, 995 bp, Heterodera glycines
  misc_feature (936)..(936): n is a, c, g, or t
ttttttcaacaaatgtggccattttccgcccatatttaatactcccttcctactggccccagaaaatttgatatttttttttactcgaatgacctattgatattatttttgtgactattttgggttttttacacttaaaatgcctttttttttttgccagttccttctggtctgctcttgtggcccaatttcccaccaccaaacgcaattacgaatgccgggcaacgcttcggcagaaaatcgacaattttgccgaattggcttgacaaattgttggcgacagtaaacggagctttgacagcgttgaaatcaggggcgtaatcggagctaaaaaggatttacataaagcagggaaatcccagacccttaaaatatttttttggcatgaaattttggaaaattctaaaatttaatttcaaaccgtttttaagcatatttctttgtcctaaagtttattttttaaaatttttttagtggacttaaatggcaactgaattcttgtgtgttaattgatcatatggtgaaagatggtgaaaaactaatcagttttcgtttcgatattgattgtgacacggacagcaaaatttgtgagtaaaaaaagacaaaaatttaaaatttcatggtttagttcaaggggtacgtaatttcgtaaattttggatggaaatcggaattttgatcgaaaccgaaaatcggaaaaccaaaattccgacccctctccctcccaaaaagttatgtcggaaaccgtaagtccgcgttatttagcaaatgccaaaattttctaaatttttggcgaatgaataatgaaaaaataattattttcatccatttgcctaatttttcaaataaaatttagtttccgaccgagaaatgttctttgaaacacatttcgaatttgttcgcaaaaagatgaaaagaattatcgcgtggaaaagtngtccagcatattctacaataataatttttttagttgaataattaattaattaaaatgaa

SEQ ID NO: 38494 - DNA, 958 bp, Heterodera glycines
ccatccaacaaatgccatccgccgcggtcgccgatgcgctccacggcatttgcccagccgaccctcgccggcacgggccactcgcgactgttcgaaagtgtcagtgccctgaagtacagcgtcagcttcacctttgtacgaagcgaatggcattttgccaaaaacacacagaaattgtgggtgttgtaatgcaattttagcaaatcaaagagctttgcgacatacttccccatccgttggctgtccaaatttactcggcattggcatcgaacacgctgaacattgatgcgcgcaattaacaacaattcaatttaaaaatcaagagcgtacaggggggggggggctaagcgggctaaagccaccccccaaaaagaaaaatacatccctaaaaattgaattttgaattgagcccccccccttggctacgccctgattaaaatatttaaaaataaaaaatttttctagcaaaagttggccaccgttgagagtgtaatggccgaattgccatttggcgttttggaccgtttgtttttcgtcggagtgccaattgtggacgcagaagtcagagagcgatttcgaagactatggtaattggaaaattataaaataaagattaattctcaaattaattaaggtatgatcgaccctattggaagtcatcagacaattttgaaggggaggagcaaaatgatgagccgaaaatgccaaatgaggaaaatggtttaaaaattaataatatgaaaatttagttaaatgcctataaaattgttttgcccttttttaatggcactttttgccgtgcctttcttttcagagggcgtcgacactttgccaatgtttttgaatgtgccgcagccccgcctccatgagcccgtggggagcgcctcaatccgttacagcaaaaacaaatgccaatgccatcgttcacttctgccgatatgccacaatttctccccct

SEQ ID NO: 38495 - DNA, 1248 bp, Heterodera glycines
ttagtctgccctctgccgcgctctttgccgcgcggacccccccacataaaaatgtttttttttggaaacaggcgggcccggggatccttccaaggccataaaaaatttttggacgaaattttgtgcgcaaaagacagatcaacgaacgatcataaaaatttaagccggcccaatttagcctgataatagaagggcacaaatctgatgtttgattcgtcgaattaaaaatatatttagaaagcctaaatttggattttctttaaatttcaaaatttttaatctttgaacccaataaaaaaaagtaaatttctaaatttaattttagttagatcaaattggtctttgatcatttataaaagagcatttaaaatggtatttaaggatgtcactttcctcaaataaatgcataaaagaattaataaatatattctaaatttacttacttcacccttaaaatttaatttgctcttattttaatgatgcggccacgttccaaatccctttcaaatataaattttgaaattactcaaacaccaatctgccgtttttatctacgctttatggatgcgttatatggtagaaggcgtttatcaactcctcatagaaattttttcccaacaaaaatgaacataggtctttctcagcacttttttcattttaaaatatattttttaaattttagaagcaaaacatgatcggatttttttgaagcgaaaaaagaacaatcattgggtgaagattcgacgggtatatccagtattcatcttggcgttaatataatttaaataatttagtcgtcacgtctgctggataaaagaaataatattgataataaaatgaaaatcttttccaattaattaattaattatttttttgttttttggaaaagatgaaaaatgttgattaaattgtatttgtaaaaatttattcgcagataaaataacaaatttaaataattgtagcttacacattgaaggcaatatcaactaaaatgaatggtcaaataattaatccataatattcaaaagagtacaaatcacatggataagataaacaaattagtttgaattttttcatcatttcatcaatttaaaaataagtacgatttgttgtatcggtggtataatggttagtgtgctttgtttaggacataggagttcaatgctgcgcgaagtagtgtaattaaagcaaattaaagaaaaggaaaaatacagaacaccgaaacaaatggtcgacactaggacaaat

SEQ ID NO: 38496 - DNA, 635 bp, Heterodera glycines
tagtgattttttctggattaggccggagaaataaaatcacttcctatttcaaatgcagtgggcaagcacagcgagtcgcttaaatgcacaccctttgacacgtaaaatattccaaaaaaagagatagtgattttttctggattaggccggagaaataaaaattaccagctatttgaaatgcagtgggcaagcacagcgagtcgcttaaatgcacaccctttgacacgtaaaatattccaaaaaaagagatagtgattttttctggattaggccggagaaataaaaattaccagctatttgaaatgcagcgggcaagcacagcgagtcgcttaaatgcacaccctttgacacgtaaaatattccaaaaaaagagatagtgattttttctggattagggcggagaaataaaaattaccagctatttgaaatgcagtgggcaagcacagcgagtcgcttaaatgcacaccctttgacacgtaaaatattccaaaaaaagagatagtgattttttctggattatggcggaaaaataaaaattaccagctatttgaaatggagtgggcaagcaccgcgagtcgcttaaatgcacaccctttggcacgtaaaatattccaaaaaaagagattgtgattttt

SEQ ID NO: 38497 - DNA, 96 bp, Heterodera glycines
tggccatgtccaggctgcggccggtctgttcgttgtggccctgcttgaactgctgggcaacgttggagacgcgcacgcccgaacccacggcgttct

SEQ ID NO: 38498 - DNA, 979 bp, Heterodera glycines
  misc_feature (796)..(796): n is a, c, g, or t
  misc_feature (810)..(810): n is a, c, g, or t
  misc_feature (944)..(945): n is a, c, g, or t
aaaaagggtggcatacaattaactatgattaatccaaaaaaaaactattcaaggactatatatttttttaaaagttactttcctttttttgatcaccacagcattttcattacaaaaagaccaaattgaattgataaaattgtttttaatctctgtttgtttttggattgtaactttgttcattgtcgaccaaatccaataatcatggtatcattcaaaagctttacactttagtatgccatgctaaagtttcattatttctttgattaatctattggaaactatgccgaaaaaataggagttttttaaataaacaaattgcaataactaaatgttaattgggcttttaaatttttgcagaatggccaccgctatcagctggatgcctttcgcaaaggtaacatggcccgttttgtcaaccattcttgccagccaaactgttgcgctctgctgacaaccaccacaacttcaacagatgatgccaattctgatcagaaggaagtgccgtccgtgttggtctatgcgctgcggcgcatttttgcgggcgaagaattgacaatggactacggtaagttgtcaaaattgacgcagttacggtaccggaccgcgagttactgactatctgtcctactgtaatttggaacaaattctggaatctctgaacatccgctactgggaaatattggatagatttttgaaaaagattttatactttatggtataccaaatctcgaaagagataatgctttcgacaaacaaagatacatttctaggggggggggttgggtcattatanggaataaatctttncgctaattagtcgcaattaatgattttgattgatcaatacacaaaaggtgaacgtttggtggattgccaaggcggactctgactcattgaattgtcagtgcggaagcgaagagtgcaatatgacgaaagattgnnggtgccgatgtggacaaaaatgatgccattgcgc

SEQ ID NO: 38499 - DNA, 899 bp, Heterodera glycines
aaatgttaagcagaattgccatgaggtattaagtcatttataaaaatttatttaaaatattaaaaaaaactcgcccgatttcagaaataattcgcccatttgcgctgggggcgtttcccctgcaaatccctccaaccgttgggcgacttttccgtcggccattgaactgagcgaaagtgaaaggcattcgacagcaaatgcactgctccaatttcttggcctccaattgcagcaagaaaagttcggtcagaagccgaaaagtgtgcaaaactgtggtgccaaattgcgcccaattcgcggtcattcgcgccaatcggcgcccatttccttagcgtccgtccgacgcccaacggacgacacatcgccacaagtcacaactgctgatagcgactattcccatgcttctgcttcttctcttgtttctgcttcgtccccttcaattcaccgtttggactttttgccttccgtgccgaatgattttcgtccggcgaattgccacagcgaacctttgcccgacttcatctttttcctcgtcacacagtccgaactgctcgttgagctgctccgttgtggccaatttggccattatttgctgaataaattcgtctcttttgagcggcttaaggacagcggggcggaacacaaaatgatcgaatttgttggcaaaatggactttctgatcactaattttgacatgctcactggtctcaggcactttgtgcccaatttgggtgcccgattagtcgaggtgagaggcaaaacatcgaaggaatggaattttacgaaaaaaacttaatttgaatattttgcaaaatcagtttctgcacaagtactgctcttattcgtccggcaatttgctgatgagcgaattaagcagaaggctctgtcagttcttctcc

SEQ ID NO: 38500 - DNA, 1317 bp, Heterodera glycines
  misc_feature (37)..(37): n is a, c, g, or t
  misc_feature (47)..(47): n is a, c, g, or t
  misc_feature (140)..(140): n is a, c, g, or t
tgacttgtcccaattgtgcgagtccttcgccgtacancccctccttnccacacccttccttgcgcattgcgtcaatgatttcgttgggtctaaggccggtcgcgcggcacaccgagttgttgatgcactcaaaaacttgnccagcacattcaaacccaaaccgaagtgtgtggcggaaaaatatttgtacagccgagtctttagggtgcggatggcccgctccgcccaaggcggccttcttctttgaactggtctcaaacttttgaatgcccttctccgcgtaaaactccttcaacggttttgccacaaactccagccctcgatcggtgtacattgtgtctggcacccttggcatttgctcaaatagctcttcaaacgcccttttcatgtccacagggcgcttactctttacgggcgcgccgaacattcgcctcgatagaacatccaccgccaacagcaagtaacggtagccgctgttcttgcgcgaaagtgcctggaaatctgccaagtccgcctgaacatctgaaccctgaattgtgcgcaataagccccggtacaacgtaccggtcatgaaacccgtaggcacagtgcgtaggcgtcggaacttgtctctctttggcttgaacagcgtgtaggtggtgttcctttgcaaaaagtcctcaaactcggcacgcttcaacttcgggtgcttctccttcaccgccgcgtacagagcactcgcccccgcatacccgcccggattggccgggtcggtgtatattttgtttattttcttgtccattttgagggaacaaatcctctcgtttgtttgacttgtccgacgaacccagacctaacaaacagtcgatcgagtaggctactggcgagcggattctgtgcgagtttcctcttcaactctttggttccgcgtggcgaaggggcattctccgggcgagggtccaccaggcgttcaattgaccaggccaggtccgagtcgataaactctcggcccgtctttgggttaatgattttcccacggtcagttgcgccgaatctctgcggatcagacataatgatggccaacaggtggtccttcttctcgatcaatttttgctgatttgctgctttcttattggtcctgggtgatcggctgcttccctgcgtctggcttgatgaggttaaaaactttggcacttcaatttcttcatcttcatcttcgtccgtaaccatcacggacttgtccttcggttcgtccggaccaggccgtacctgcacacccgtctccactgttttaattagcatttgagcgccgttgctgagatgtactcggacgggccg

SEQ ID NO: 38501 - DNA, 1264 bp, Heterodera glycines
ttggaattccaatttacttaattaaaatatttcacttctttcaatttgttgtttattttggtaattttttgtctattacttttcttcctatttttacaattccattgttcatattgctaaaatctttctcatttaccattgaacataataattctcctattttcttctttgtcaatttccaaatccattttttatgtcatttgaattccaatttctctaattaaatgtaataaaatgctttaatttcgatcagaattccttttgacaagcaatcaattcgtttttattaaaaatgggcaatgtcgtcagtaaagtgggcaattttatggtcaaggcagcatttgttgctgtcgacggatttttggctgttggcgaagcgtttggccaaggaatgcgcgcacttttgtccccggaagagcacgccaatcctccgatcactcaagtgcttttggttcgacgccgtggcgatctcatcccgtgctttcgcaatgtgttgaaaagcaaagtaaaaattttttttgaaattttaatccattttttggatgccattcgccattttgtatcactttttctttttttttctttttaaatttaagaatgaaactgctcttggaagcatacatgatgaactgagcgacctcggcttggaccacatttcgtacgcatttgttaagggcgtcgagtgagtgaaaaaggaaaaggcggaaataatttaaataaatttaattttaattatttagtctaaaattgggcttttttttacgttcagagtggacatggtctgcaacaaatgtgccgccaaagtggagcaactcgacgacttgtgttattgtgtggatgccaaagagagatgccatcaccgcaaatggtgggaaaaaagcagattttaattgggatattatgtgctggtcaatttaaattggttttaaatgcattcgacatatttttaccatttttaatgttcgtgcggcatgggagcaaaaacaattggaaataacttagttaaattgataattcacaaatttcaaatagttattcagtttataataataataataatttctaatcttataaattaatttgcttttcagctgttccttccgcaacaatcagctcgctttgacattttactgattttgatgaatgaaagaaaataatttttcattttatatattgaggagcccaaatgaattggaaagaaattatttcttcgttttatgaaaaatatttttgtgaattttctcaattcacgagttttttctat

SEQ ID NO: 38502 - DNA, 1104 bp, Heterodera glycines
  misc_feature (1073)..(1073): n is a, c, g, or t
tgaattggacaactcgtcaagtgttttttacgtacaatggacaacgcttgagtttgtgtttatgatggcaatttacataaacttgctaattgcctaattaagacaacaccaatttgtacgttgatgagggcacggcggacctttacccgaccgtttcaatgctcgattacttggaagaggtcgaagccaacttcggtcccaacttcaaatacgatttgtccaaggaattttgagactttggaaatgatttaattggcttactgctgggataaaaaaaaagcttaataaaattgagaaagttttgcctaaatcgttccgcttttgttccaccgtttgtctcgtaaaaacttaatctttaaggcacaaaaatgaaaatcaaaagtgcttaatttatttaataattagccatttaccggcatacttgtttcaaagaggcgcggcatggcaaaattgcaaatttcaatctcacaattagttgagaaaatgatttaaaaatatttttgaataagaatttgtcttgttcttggaaaatgttttgaagaatttttaaaagggatttaaggattttcaaaaaaagcatcagttttttatttttaaattcatataaacgtaaggtttttggtttctagagaatgtttttgtatatttttaataggcaaaaattaaaaaaatattttaattaattttaattgaaaatcattaaatttaccaatgatgagtccaaccatcatcaatgccattcctccgccgttgccgtggcgaattgtaaattaatttgttaattttacaatattttatggcttaattatttgtaaaggggtttgatttttttgcaaaaaaaataaaacatttttttagccattatttattcatcatttatataaaaattgtcgtccttaaaaatttttgtgtccttgaaaacagttctgcacgaaattttgtttcgtccccttcttttcggcataatttttgagtttcgtattaagtttttaattaaatttgagcccggaactttgtaaatttgggaaatttttatttcggcatcaaaacatggtacaaaacctcatatactngatatatgtgagaccaaaatgcctaaatctc

SEQ ID NO: 38503 - DNA, 793 bp, Heterodera glycines
gttaagatagtataaaaccaatttagtcttttagaaacttgacctcattaagaatttttcaaagaaaaagaccgtaccgtttttgaacgtattggcgttttgtttttgccgctttttcttcttctctccttcaacaaaaatagtgcactcgtctgcctgtctggtaatattcctgacttaaaattgtaatgtcaggttttttccaccttatttgttaggtgtgtgtgaacttctatataaaaggttgtttttaagattttcattcattataaaaaattaattccgcacatcgaacacattcttccgcccccccccccctccatcttcaaaagcctttcatttctcctcccaccgccccctcctttcttagcatttttagtatttttcgtacatataatattaaagataactatggcctataaaaaaattaaaaaaaagtacgaggcgttgaaattgtcatagtattcttgtgctccgccgatcggctctcctccactgcttttccttcctccccaaaacactcattcttccatccatccaccccctccctccatcatcaaaaagcctcaatttaacaaataatactgaaatctccgcttcctgatgattttattctttgacataaataaataaatttaactacaatttgtcattttcaagattaaattcaagattttcgatggcagtgcattacgcgggaacggtgcgatacaacgcgaacagtttcctggagaagaacaaagacccgctgaacgattcggcggtaaacaaaaaggggcaattcgttaattaa

SEQ ID NO: 38504 - DNA, 896 bp, Heterodera glycines
gtcatcaatgggaaaaatttttaatcatcaattcactaaatcaatgaaatgaaaatattttatatttttacatatttacattttccacataataatttttttcttcatttattactcttttttgcttttttcttcatttattactttttttcgctctaatttcgcataaagctcttaaatatcttaataattataatgaataaaaattttatattttttataattaatattaataaccaaataaaatattctccttggttattttaaaacaattcaaatttatgattttagaatatttagagcaccgatttattaccaatatttggggaacaaaatgagaaaaagcaacaaaattttcatcattttggcgttgtgtttttgcgcaattggaacaatcttatgcatggacacgtcgcgcagcaggaaaaaaattgacggagttaatgaacatttgcctaatggacatatagcaattaaaagtaaagattaaaaaaaattatttaaattaagtaatttaaaattcagtgaaacaaactttaagatggagttgaattagcattaaccgatgacgagtcatcagcagatgaaaggtcgaaaattgacggcattaaccgacaaaaaaaaagtaaaacaaaaacaaaaatggaaataaaaaataaaatttatttaaaacaaaaatttaaaatttaaaagccaccaaatttgccatacatatattaggtaagaaatattgcgaaaaggtatttaaatttgcaaaaggtaaaaccatatgatgaaaggtaggccttggttgggaaaaaattctttgaaaagagatgtgctatgaaatttttgtaaaatagttaaggaaatttttttttgtcataaatcaggaaaatgatacgagctattaaata

SEQ ID NO: 38505 - DNA, 1130 bp, Heterodera glycines
atttttggctgccaaatggatggatttgatcggattattgattggatccatcgtgtttaaataattgaaatggcgaaaaatgccaaaattggtctcagtctcacatagcattcctcctgcagcgcgcgcaccttcggattgtacaggccgtatttgcccatcaccaaaccgccacaacgcgtgccctccgggagacgaggcaaaattttaccataggcctgtagaaagaaaaaatgataaaataaaaacacggtagaaaaaatttgtggtaatgacacagtacagtatacaacactgttaaagacttttaagggctcaaacatcaagaaacatgaattattcctcactaattatggctttgtcgtttagaatagttttgaaatggtggaaatttttttttttttttttgtcaaatgatgccatggcaactcattaaaagacaactcgtaaaaatttcttaggtttggcccagaggcttcggcccaagctttaggctaggctttgtttttgtaaaatacgagtgctttttgtattcccccactcgaaaattgttaagtgagaaaactcacccccaactgccactcgccggggttcaaactgaaaaaacaaatcgctttcaattatagcaattaaaattgagtgtttttacgggtcgaattcctcaagcgttggcggctctttgccggtcaccggatggaccaaaccaccgccttttattgaacggcagcaaatttggacggggctgacaaggcgtttgaagaggaaaacattcgtcggtttggagcacattttgggtagcttttgctttgccttctcgttgaaaaaaaaataatgggaaaattttaaagaaaaatgattaaaaatattgaaaatgattcaaatcactgacataaatgcgcacaaaaggaaataaatgaaaaacaatttattaacaaaaaaatcaaatcaaaaattatttgaaaaaattaaagaaagcgtctgccgattcggcacttttgcacagcgaagtgagcattgacagataggcaattttaagcgaaggtgccgagattgcccgattttcggatacaaagtcgtacaaatccttcctgaaaaaaagcaaaaagaaaaaatgtatataattttgaaaa

SEQ ID NO: 38506 - DNA, 1198 bp, Heterodera glycines
acgagtgttagttaacacacatttcaattttggcctctcagttccaaaaatatttgtatgtgtggcgaagttgttttttgtaagatagtaaaggaacaaagggagaagattcgagtccattgtgcaacatgaatttttttattttggttccaaatattaaaaaatgtgcacaaattctcacttgcgtgcaatgcatttgcttatcgcattctcgcgcattttggactgttcccctgacgaagtgggcgcgcgaatttgctgtagtgttgcggatcgagaaaaattgttgaaggaatttgcacatcgtaagctcatcactacatactccgaccgtaatggcttcacccacacactcttctttgctgggctcactgaagagggcgccaactcagtgcttgcttatggtaacctgaggcgcccctacaatgtttgcgttgtcgcccattattactcacgacatcgtattatgctaaagtacccgaaattcccatgtgtaattgagaagtgttttggtcaaagggatgatggacccttgcacaaatattacccgcttgaactggtaaaagtcgtcgatgactgttttccgcctgtgtacgcgagtttactgtctcaaaagcgtgacagctcaacgtcatcgtcatcatcctcgtcatcattgccgcgaaatttcctatcatctccttccgacgatacggatgctgacgaccatggtctctggtttggctcgatgcccacaaaaaaaaagtgttgcggaaacaccacctcctccgtcttgtgggtatgtgaagggaataatatggattgaaaaagagcaaatcaaaaatattctaagtcaagcaattaaacatgactaattgtaaatttttctacctaaaaacagcaactctgtaactcagatgatgatgaatctttttaatatttccaaaactgctacttctcttactaaattatgcatttttctacctaaaaattacaacttcgaacgcttcattattttaaattgtaatcttccatttgttaattatgcatttttaaaaaagtacaattccgtataaattacggcctttataaaaccaaaatcatgtacaatagcattcatccccacaaccccatttagttacaataggacgatagcgtttcgacagcttaacagaaataacagttccgtccttaatgttgggcctcaggaaattggggt

SEQ ID NO: 38507 - DNA, 878 bp, Heterodera glycines
attttccattattagtcttaaaatggtctaaatgacttgttattgaagctctatgactttatttcgttttcatgtatttaaacaaaattacgaaatttgagtttttgactttttgttcgagttcgggtccggttttcggagttcggagttggtcaaaatgggtgacgaattagtgatcagctaagcagaaaacccttggaaacatattttaatgacttttgaaaacaaaatttcttggggggtcaattatatggacataaatcgcgaaatatggaaaaatatggatatagaatccatcctagcagtttcaaaccaagttaaaaaacatgtttttcgtacgtttcagacctctcacagtccaggaaaaaaatatggatttccatgtaaatgatagccctaattattacacaaatgccttttttaattgctcacccaatgcaatcaattagtgccactaaaaagccaaaagaacacattgttacaattgttgtcccactttccgtcttcccaatgaaccgccgccgtctccccaataattttgcatcgtttcattatccaacttttgtccaattcattttcatttgctttggccaatgtcagcttttcctttgtccattcgttcaccaattcgaatggcattggagagaaactttgatgaaatataacttattaaatacataataaagtttgcttttaatgtattattaaacgaaaaaattctggcggcgagattgccaaaaaacaaggcgcggcgagttggcccgcggcgagttggcctcgcggcgagaaagcgcgcggcgagttggccccgcggcgagttggccgcgacgagttgggcggttcccgaatttttaggcctttgtcgccacgtcgcaaat

SEQ ID NO: 38508 - DNA, 154 bp, Heterodera glycines
tttgtcaccaaaaaaaattatttcgaatttgggtttgaatgtgttattttgtttcgagttaatgaatgattgttgattaattgatattttacgcatacccagctaagggccttatcattagctacaatatttttttacctgattgaaagtcgga

SEQ ID NO: 38509 - DNA, 1132 bp, Heterodera glycines
ggggagaagaagctgaatgggttgggttgttgttggttggtcacgggtgtgtgggtggcgaggagaagttgacttgaacgactgctccgactgaatgatttcatcttcccaaaactgaaggaagacggaggaggggaagaagaacccgatcatcctcctcttcatctctcaccccttccccgcctgataaactggactcgaccagtagcagaggaaaagcatgcgttgcaggggtgggaggaaacggattggatcggtggggaacgacgtcgacggaggggtggacgacgacgacgcatcgaatgggctggaggtggtacaaatgggagaagcgccgtcttcgtttgatgatggtatccgggcattcgggcggagatgagccaggaagttcaaaaaagccacaaacaaagcatccataagcttacatgcatccaatttaaatattacgaggcgaaacgttcaaaatgctcgaaaatgatcaaaaaaacgaaataattggccattatatgaagccctttggccttaacacataataccagctttgctggtgacgttttaaggtgtttgcttcgacccttcccttttcctctcggttattttacacttttactttcatttccaaaaaatgaatgccaaacatttccctccccccccctttttttgcgttttcatttcttttaccttattaattccattatttatttgaatgtgtttacctgttttttttctttaagtttcctttttctaaaaatgaatagcgcaactcaaaatgagcacgtccatcaccagcagcagcagtttcagcccgccgccaccttcaacgaattgttaataaacgaagtgaacggattaccccttaaaactcggcggaacctctccaaattcacgacgactttctgacaatgacaaattctaaaaatttccatttttgaactaattgggcaaaactaactcattaaatatagaaaatactatttattttttaatttaggtccgttctcatccgcaactttatgaccaacaacatcgggtgggttagtgaacggaatgagcatgacacggaagattctgttagaggggacgcgtaccaaacagaagttgaaaacaaacaaaatttggcactgtcctctct

SEQ ID NO: 38510 - DNA, 1194 bp, Heterodera glycines
  misc_feature (933)..(933): n is a, c, g, or t
  misc_feature (1077)..(1077): n is a, c, g, or t
  misc_feature (1130)..(1130): n is a, c, g, or t
  misc_feature (1149)..(1149): n is a, c, g, or t
tgctttaaggttttgtctttgactttgcttttttgtcctcacccatggatcgaccacgttaattcattctctatacatttcttttcttatttcatgaaattatatataatttaattttaaataaagaggcaaatttttacagaaaataaatagacgctgactaattagctaacatttataaagaaagtagaaatttgattaaatgcatatacaaaatattacttttttaaaatttgtataaagttcctagtcgtatgtgctttgcgttggttggttggcgtgggtgactgtggtggttgggccgtttttgcgatattatggctggaaaaaagatgcgatttcgctatggggagcgcggccgtctgggttcaagtgcttgcttgcgcttgtgctcggcattgaacggtgatggctgctgctggggtgccacctttgtcgtggcctcagtttctccagcgattggcagctgtcgaaatgaataaacatgcagctcgtctgtgtgttaaagaaatttggcgagttaattgacttgtgtaaatgtggcctaaggcacaaatgctgtggggaactcagcactggggatgctgaacctaaagttggtggtggtgttggtatacgagtgagtggcgtattgccatggttgacaagccctatgagttcgtggatcggaactccttgcctggggaccagtgtgcttgcattcgaaaaaacacgagacataagcgcccgaaggcctttggcctgaggaagtgtcctaaccgggaaatccggagtgctcgtgtgagtgcctgtgcactggccctcggagctgtgtccagcggcgagatggttcttcccaagtccgggaagctcggatgcctggccagcgctgtgtcattaccacttgctctgtctccttcgctgcccatgcgcacgcttgcgctgaaacgggangttgtttctgctgaaactatccgtctttacaagacggctgtaatatagcggcgcttggcaacgctcgctagcagtattctggttgatcctgcctgaactgatgtgttcatttcaaagattagccatgcattgtgtaagttcaancctgcagacagggaaactgcgtacggctcattacaccagctataatttacttngacttgacttctacttggnatactgtggtattctagagctatacatgcaccaagctccatctcc

SEQ ID NO: 38511 - DNA, 874 bp, Heterodera glycines
ccattcccttaagagctgcggaaatggtgaattaattttcagaaaaatggctatctctttttaggccaatttctatctcgtaaccccgatgctaatccgttccggagagcctcttcaaaattttttccattaccgtaagagctgaggaaattgtgaattaattctcagaaaaatggctatctctttttaggacaattttctatctcgtaaccccgatgctaatccgttccggagagcctcttcaaaattttttccattactctaagagctgcggaaattgtgaattaattctcagaaaaatggctatctctttttaggacaattttctatctcgtaaccccgatgctaatccgttccggagagcctcttcaaaattttttccattaccctaagagctgcggaaattgtgaattaattctcagaaaaatggctatctctttttaggacaattttctatctcgtaaccccgatgctaatccgttccggagagcctcttcaaaattttttccattaccctaagagctgcggaaattgtgaattaattctcagaaaaatggctatctctttttaggacaattttctatctcgtaaccccgatgctaatccgttccggagagcctcttcaaaattttttccattaccctaagagctgaggaaattgtgaattaattctcagaaaaatggctatctctttttaggacaattttctatctcgtaaccccgatgctaatccgttccggagagcctcttcaaaattttttccattaccgtaagagctgcggaaattgtgaattaattctcagaaaaatggctatctctttttaggacaatttaatatctcgtaaccccgatgctaatccgttccggagagcct

SEQ ID NO: 38512 - DNA, 924 bp, Heterodera glycines
aaaaaacaagaagcgctaaaataatgaattagcaatgaactgaaaatcgatctattctgcgcgtcccgaacggacgaatacaaaaaaattttcaatttcttatgacatatcatgaagctggcgaatgtctgatcaagcactcataattaagccaattatcgataactaaacttcaaataatttaatataaaataaggtttaaatatagcaaaaaatcttttaatcatcgtactaccacttttatctaggatgcggtaagtgaccaaataattaaaatattaaaccattttcaatattattccatcgttaatattcccatattttttttcttctcaaacaccattctcatcaaattctttgtggcatctcattcaaaattttgcgtcgttctcactcaaatacaaatttgcatatagtccaacatttacctaaagcaaatgacaaaatggccacagcatttgaaattgccaaacattgcagctctccttctctttgctatttatttaatccatttttaataatgtatttggtactacaacgatcccttgccgtttcatccacttttaccctaatgagtaccttacaaaaaaactaactagtccctaaattccaaaccaatccggaaaaatttagactcattaaaaagaacagagcctgggcagtcaaactacttaccaaatatttttatttgatctccaactcgtgttatgtacagttgaaataagccacttttgatttgcccaattccaaaaaaggacattttcataaaataacgattttactaaatgtttactaccatttcccatattcctttatgtacagtaagcattgaacttcaaaaaaaagcaataatagctttgaactacagtatgcttgaattttaaattactgtttttccattaatcgtaatagttttttttctca

SEQ ID NO: 38513 - DNA, 807 bp, Heterodera glycines
agtacgatagaatttacactttaccatttgtttatgactaataattaattaccaactaataaaatttaaacgttcttatgaaaatacccgcaagaaataattaaattaagtaatccctaaatatttggaataattaaaatctttcacaaaggaaataaaatggattaaataaaataaatcattttgaagattgtattaaaataacatttttgtgcgttaattttaaattttatttaatttcttattttgcaataaaaccattaattttttgaattatttatttattttataatttaaaaatctaaaaatattagtagtgataaataataaaaaaaaaattaaattaaagtattaataaaaacacgaccaacgaaaacgtgcggagtctcatggacataattaaaaaaactaaaataaattattattcaataaagacacgaataaatatttatataatgaaccaaaaatgaaattaattattgaaaaaatttttaaaaaaaattgaagtatttaacaaaacgagaacaaaatataattaacatttaaaatgacaaatatgcaaaaacatttttaattatttattaaaatctaagtaaataaaatgaaagccattgtaaaaaaagaactaaattaatatttagttaaacaattacttttaatgtttttcaaaaaccagccgattaaaaaaatgcataactaatttaattatgtaaaagtgaaaaaaaaaattcatttttcattaggcacaaatttaaacaaaaaaaacattcgtcaacacccgtggtgagtcaaagtgcaaaaagtccg

SEQ ID NO: 38514 - DNA, 768 bp, Heterodera glycines
tgaacaaaaaaaaattataataccaacgaagtttaacaaacaacaacaaaaagtagggggtagtctgggaattgaacccaggacctctcgcaccctaagcgagaatcataccactagaccaactacccgcacagatcaatggtgatttgcgtggatgataagcatgctattgatcaatttttcctattcataacaacgaatgatcataattgctacatttaaattcataaaatttaaattaataaattcatttttgggttaataaccttatctttattacgaaaaaagttttttaaagaaatattgaataaagctttaaaaattataccgatcttcaatgagtctactcaaaatttccatagcaaccacctaagaacctttatcgaaagtttcaattatttttaaatttgatttaagaaaggatttagtgagtacaatggtgagcgttcatcagtaagcgaccaaaaaataaataaaaaatacaatcatttcattgtaaaatctatttttgtcgaattagggtcaggagttcgaaattgggtgaattggctgttaaattcttgaccagtggaccaaccaaaaaataatttaaaaaagatttcacaagcaagtgcatttgaacccatgacccaaaaacccatttttaaccaaccgtgcaactcagtttcgctggtttcctctgtcgagaatgggaaaattcccgacttttgaggccctgtaactcttgaaggaggcaaaatgcaccgctaaaatcaaaaattcacaata

SEQ ID NO: 38515 - DNA, 1030 bp, Heterodera glycines
  misc_feature (867)..(868): n is a, c, g, or t
  misc_feature (897)..(897): n is a, c, g, or t
  misc_feature (901)..(901): n is a, c, g, or t
  misc_feature (939)..(939): n is a, c, g, or t
  misc_feature (985)..(985): n is a, c, g, or t
tagtactatctcgtcgtttttctgtttctttgtaatttctctcactttggcgtactatctcttcatttttaatgatgtaaaaaacaacatttacttctctccatataacttattttctatgcatacaatttgcaccaaattttgcaaacctatagagaaaaaaattctgaatcgataataaggaaatttaatacaaaaataaggttcactcaaaagttatttggtgaaaaattttgtgaatttctttttctctctttttggcgtactattttcatgtctctaacacatgaaaaatagaaattcacaaattataataatcttgattgtaaaggtacaaaaacactatggacatttagaatcaataaaaaatgattaattttagcatttttgttagaaacggcggcctaggacttgagttataacatgataaaagtttgaaattcccacaactttttgctgagatgacaaattacttaacattcgcttagaaaaagattctccttttcaaaaactttttttagatatcaaatttgttcagtttcattgggtatgaagcgagttatggtagatcaaaataaaaaaattaaaaagtcattttccagtgtaaattttgaaataacgcgcaaaaatttacgccaaatgcgctatttggctttatgagtaattttgtctgacactggcgcgtaccgatagtggacattgaaacgaagagaaagagagagagagagagagagaggaaaagcgttagaacgggataaaagagataggagagaggaaacggagaaggagagagagaaacacagaggaaaaaaggagaaaaaagaaatcggaattctgtgccatccctggtacatacttttatcttannattaaatttcctgctgattttattattanattntttgtagctttttttggtttttcttttatactgactcnaagaaaaaaaatcgaaggaaattgaggtgtttccatttgatcgctngctcaatatcccatagatatggatatgacacatactgtagaatag

SEQ ID NO: 38516 - DNA, 996 bp, Heterodera glycines
ttttgaagcgaccaaacatttgtggcaatgcctctcaactagcagcatttgacagaagtgaaaaatgcgtgcagttcggccaaggcaaagtttgacagcatttggagaatgttcgtcgactgcgaacaggcggtgaggacggcgctgagtttggacgaagcgaacattcagcgcagaaaagcggtgcattttgttacattggaaatggcattttcgaacttgacattatgtttaggaacaagaaaaactcagtttggaccgcttcagtgacagcacaattgacgaaaagctaagtgatccgaacggaataattttggagccgatgaaggaattgttgaagacagaaaaggactacattgaagacatgaggtgggaagggactctgaatttgcattttcgaataatttaaggcgatgcgttgacatttatttgtacgcctaccgtacgtccggctcaatgtgtccaatgacaatccgaggcaaagagcgcgagatttttgggaacattgaagaactttatcagtttcatagcaggtgatccgaattaaaactatccaaaaaaccacaaaagtgccgcaagttaatatgaaagtaattgttttagtgttttcctcaacgaactgatggcttatgcgttgaatccggaggatgtcggctattgtttcattgaatggatggaaaaactgaaggaattgtacgcggattactgcttgaacaaggaggagaacaattacctcatttgtcttcctgaaaccatcaaaattttcaatgtaaaaataaatttgcattagtcaaaattgaaaacttcttcccattttaggaaatacgcgaacagaatgggctcgacgtatcgcatgaccttcagtcactcgtcatcaaacccgtccaacgagtgaccaaatatcacattctgttaaaggaactgttgaagcactgctccaaaagtgcgaaagaaattaaaaatgcccacgaaattgtgctgagatcccaaaactgg

SEQ ID NO: 38517 - DNA, 917 bp, Heterodera glycines
accgtgaccggaagaattcagtttttcctttacgatcgtaatttttctgagaatggtcaggagtgtccagaattcttttccggaaaccttgaccagagttccaattttggaaaatcgtgacctgattttatgctacttattctgaaaagggccagaatctccaaaaaaagcaagaaaagaacaacaagaacaaaaaacagaccaatggaaagcgaaaaaagagaaagatacggtaaaatttgtgtagttttggaaatttctgactcttcggcctaattgattttcctggcccatggccgaaattgggcttttcacttgagaaaatggaaaaataaatttaaatataatttgctactaaaaagaaaaagttctctggattgatgattaaactaaagaacatcacaaatgctcctatgtcaagtcaattttcaacggaacagccactgcaaatatactttcattttgccaaatccttcatccgttttcatatttttcgtcgtctccgtcatcgatttcatccaattttcaaatgcttttcgtgccaactcaatttccgcttcatttgctccatgttctttgtctttgtcaattaaattttcctttaatttttcttcactttcttcgggtttttccccatccaacatcatttgcttattagcgttgtcagcaactttaacattttgcgcaatttgttgcccaatcgttttgttgtccgacgacgccgccactgctggagattccaacggctttttcatgttgtattttttaattttttgaaaagcatttttgattagctgcccaatcggcggtaggttgcctgaacaacttcggttccgcataacttttgaacatagcgctcaaactggtgtccatattttttggccgtaatcataatcaaaaaagaacgcccaaattgg

SEQ ID NO: 38518 - DNA, 1672 bp, Heterodera glycines
  misc_feature (8)..(8): n is a, c, g, or t
  misc_feature (16)..(16): n is a, c, g, or t
  misc_feature (46)..(46): n is a, c, g, or t
  misc_feature (55)..(55): n is a, c, g, or t
  misc_feature (1476)..(1477): n is a, c, g, or t
  misc_feature (1483)..(1483): n is a, c, g, or t
tagaaganatacaganccattacaattaaaatgccacccgagaccnttccccctnttttaatttattttttaatagctgaaaattgctgtaattcattgctttccaccaacagaattgtggaagtgtccggcgacaacacgcccgagccacacgaactaaacagggcatccattctgatcacaacacccgagaaatgggacgggatcacgcgctgtgcggacacacggcactacgtcaaacaggtggaactgttggtcatcgacgaaattcatttgcttggcgttgaacgcggtgctgtgcttgaggcaatcatcaccaggtgagtgggcaggcaatcctcggatattgttatcatgtaaaatttcaaattttttgaatttttattgttaaagaatcaagtcgatggcacgccgtcgtgagcttgccaagttgccggttcgcgttgtttgcctgtccaccgcgttggcaaatgctggcgatgtggctgaatggattggcgttcgggatcatgggctcttcaatttcaggcccagtgtcaggccggtgcctgtccaggtgcacattcaaggctttcctggccaacactattgtccacggatggcactgatgaacaagcccgcttatcaggcaagtgccatagcgactgatggcaagttgtgggtgccatggtcattgatggcaccgtgtggttgccatggtcattggtggcttagtgtggatgccaggtcattcccccatccatcactttttcagtacatcaaacaattctcgtccacaaaacctgcactgatctttgttgcctcacgacgacaaacgcgcctgacagcgatggcactgctcggcttgttgcagcgtgaaggggaacaaagccatcagcaatggttgggcatgaatcagacagagttggagcgcacgttggcctctgtgcgggatgacaacctgcgactgacgctgacctacggtgttggcatccatcatgccggactgcacgtggtcagtcgatgaaataatgtaatgtcatgtcactggcattttctacctctcgaaactctcgatttggttcatcgagtctgaaagatgaaaacattgagtcccatattttcaaatctccaccaatctgtgttattgttttgttgtacaactacaggctgagcgtgcactggtcgaacgactgtttgttgaacgcaaaattcaagtgttggtcgcaaccgcaacgcttgcctggggcatcaatgtgccggcccatttggtcattgtgaagggcaccgaatactatgatggcaaaacgcacaaatacatcgatttcccagtgacaggtgagaggagcttgtcatggactctcgattctcgagagacactagttttggcgttcattcattgtatctcttggtcatgtgccatggtttttggttgtttacagacgttttgcaaatgattggccgcgcgggtcgtccacagtatgacacgtccgctgnntgcggntggtctttgtccaggacaccaaaaagaacttttacaagcgcttcctctacgagccattcccgtgggaatcgaagtgccaaaaaatgacaaaaatgaaaaaataaatcaaagcaattattttcttcagccttttgcccccgtgtggcaccacgtgaatgccgaaatttgctcaggactgatcacaaatcg

SEQ ID NO: 38519 - DNA, 1399 bp, Heterodera glycines
tttgggctaatgttggggcatctctatcccggtttttagcgttttagccgatgttcggcaatgtttgtgtctgtttctggtagtgtatttgtcaatgtttgggaatgttctgtccatgtttttgtttttattttctggatgatttagcaaatattgccaatgtttgctcctgtttcttataactcgaaaacattgacagagagagattcccaacatttgccaaaaacattgccaaaacaggcgcataccaaaaacaggcggaatgttttgggctaatgtttgggcatctctatcccggtttttagcgttttagccgatgttcggcaatgtttgtgtctgtttctggtagtgtatttgtcaatgtttcggaatgttctgcccatgtttttgtttcatattttctggatgatttagcaaatattgacattgccaaaacaggcgcataccaaaaacaggcggaatgttttgggcatctctatcctggtttttagcgttttagccgatgttcggcaatgtttgtgtctgtttctggtagtgtatttgtcaatgtttgggaatgttatgtccatgtttttgtttttattttctggatgatttagcaaatattaccaatgtttgctcctgtttcttataactcgaaaacattgacagagagagattcccaacatttgccaaaaacattgccaaaacaggcgcataccaaaaacaggcggaatgttttgggctaatgtttgggcatctctatcccggtttttagcgttttagccgatgttcggcaatgtttgtgtctgtttctggtagtgtatttgtcaatgtttcggaatgttctgtccatgtttttgtttcatattttctggatgatttagcaaatattgccaatgtttgcgcctgtttcttataactcgaaaacattgacagagagagattcccaacatttgccaaaaacattgccaaaacaggcgcataccaaaacaggcggaatgttttgggctaatgtttgggcatctctatcccggtttttagcgttttagccgatgttcggcaatgtttgtgtctgtttctggtagtgtatttgtcaatgtttgggaatgttctgtccatgtttttgtttcatattttctggatgatttagcaaatattgacattgccaaaacaggcgcataccaaaaacaggcggaatgttttgggcatctctatcctggtttttagcgttttagccgatgttcggcaatgtttgtgtctgtttctggtagtgtatttgtcaatgtttgtgaatgttctgtccatgtttttgtttcatattttctggatgatttagcagatattaccaatgtttgcgcctgtttctttatactcgaaatcatagacagagagagattccctacatttgccaaaaaca

SEQ ID NO: 38520 - DNA, 925 bp, Heterodera glycines
tttagaggggatttcttgtcccttccctggctatacatataatttttaaaatcattgttcttgtacatgcgcttttcaatgtgctgttccgcgtccaccacattgcacgtcacttggaattgctttttgtgcttgaacaacagccgatgaatgtacagtgtggccaggtggttcatcaacatgctgcgcgagtactggcgaaatttgtcgtacaccgagcgctcgcacatcaaatcgttccagtcaattgagcagcttaaaatttttggcaattttttataatttgatttaaaatggcatttatatgtgtacaaattatgtagcattgagccaacagtcaacaagcgtgacggcgaattttgctcgagcagtggcaaaagatcggtccacaacaaaacatgcgccaaatgattcacctaattggaagagggaaattaattttaaaaaataataaatttttttaatttaaatatatattttgacacatatttaaattaattgaaccacctgaattgtaagttcaagaccgtcatggctttttgtcctacgacttggaagcactgacgcacagctgacaatgccattcaattttgggaatcgtagccgaatttcctcacacatttgtgctacctacaaataaaaaaattattattttttctacaaaataccgtttttggggcataattttttgaatggtttagctacgcaattaaacgtcactaatatttttatactaatatagccaattacttgagcaattaaaagctaaaaaaaattgtctagtgacattcggccggcccaattattacgcgtcaaatgccatccgcggcccgtcaaaatgtgatgccatttttttcacacattgacgcattttagcattaccatttgattgcatactaacatttatttaattgcctttaactgc

SEQ ID NO: 38521 - DNA, 1006 bp, Heterodera glycines
tgtctcgtaatgcaaaaaccagcgcggagcaaacgccgctttgttgggttgcctccccccacccccgcccaatacgaaattatgtccctttgccctgagcatactttattttttttttggtgtaaaacataccaaacggtctcgaacccctcctgttcacaacgcctaggccaacaacgtccacttgattttgaagcatttttttgacgaaaattttacttctaaataaatagaagaaattgattatatgtatctaacttttgttattaggttaatatgaaagaacaaaaaacccagtggaaatggataggtttgggaatcggagactctctgttcatgaacctgaaaagccattttgaaaaatgttttttttcagtgtttcaagcatttgcttaataaaaaaatgtcaaaaattccgaaataagggcaaaacgatggtactcttaaaaccctctgcttttttaacgaaaaagaaccaaaaaggaaacggcactttttcgtacggttatatttcaagaaattcaacaaaaattgtcggcgtcgacggaacctatctttctatttttaaagatggttcaaaaacaccccaaaaagcgttgaagtttaatcaatttggacaaattctattaaaaaattgtctaaaattttacataacttttcccggaagcggctaaaggtcccgcctctgaccccatatttccagagttttttgtaaaagcgagtctcataaatatgcgggactgggacaattagaattacaaattccttttaatttttcggaaccttccaaataaaaaatagcccatttatctcttaaacaagtttccttttagcatctcggcgctatccccctgagaattttaaagaaaatttttttaattcgggcaaaacgcgatactagtttgttttgtctcttttattccaaaaacgggggatgctcgggaaggaatggcattttgtccacttttgtctcccagaatcaagcaaacacaaattgtgggggggg

SEQ ID NO: 38522 - DNA, 1059 bp, Heterodera glycines
tagcattttctccgaacaatttttgatttagagcgacttatacaaacataaaaacacacattttggcgttttggcacataaaaacacatcgtacatttcggggtttggcacattttgtacatattttttacatttttgagaaaaattaagaaaacacataacattgaaaaatacactccttaacatcaacattcttgccatttcttttagcattttcaaaattttctttatttatttctgtgccgaaaatagcctaattcaattcttcattaattcgtcaccggatttcgaactttattgctggtacttactcaactgatggcatagggagtcgttcctcccgtcatccgttcccactgtcatgatattttgtataatgtgcagattttacatttgataactgatatatgatgtttttgtgggtagatattcattatttctaagtaattttttgcatgtgcagaactatatacctcaaaaaaatttttcgggttgtctggtacagaaaccatggggaggaggaaacgagtctgctttttttaatggttttctcattgtatcttttacaatcctctctccaaaggaactcgcgcgaaataggagtgctaatgttttttatcttgagtgtgtaggtaccataatcccgtaaaatgtaactcgacgtctgtcttccccgtctccgcagtcttgtaatagaatattcgatttagaagtgaaaataatgtgatcacgtctatttaataaggtcacatgtaatgttctatgcaatattacttgaatccaaatacaatttgttgcaggagagtgtcctccgtcgggacggttgcattgtggtgaaagacaacgtggccaaagggactgaaaaagaatttgacgaagtcgacaattcatgggccaggcctcgggaaatgctgcacaaattgttcgaacgagccgactgtcgaattgtgctggagagaaaacagccgaacattccgaaagctctttacgaggcatgggaaagtttctcattttttaggaggcctaaaacccttaaatcgctaaaagtttttccttttt

SEQ ID NO: 38523 - DNA, 1258 bp, Heterodera glycines
  misc_feature (1227)..(1227): n is a, c, g, or t
catatatgacgccgtcgccatccctcgtaagtttggcgagaatacgttgccgaagaactgcgtcctttgaagacttcagcgcagttaggagcattagccctttgaattgttcctcattcaatttgtcatactgaaaatctttcaaaagtcgtttgtgcctgttaacaaattgttgaaattcttcgccatcgtctttggtggccatcagacatgcaaatcggtccacaaatattgattgtggtttggcaaacagcttctccaatttcgaaattgtttcatcaaagtcgaaatccgtcaccttggccgggagaacaaatttgctgtactcgctgaacgcggtttccgacagtttgttcatcagtgcctttacttttatgtcatcggccgcgttcggtgcgcacgagtcaatggcaaaagtgaaacgctccagccattcggtgatgcgatgcttttcgtcgcaatgttcgaaaattgcgacgtccggcattgacggtattgtttggatgattgctggatttggctgattgtttctttgaacatttatcagctggttgatttgcgtctgttgctgagcaattacgtcgattaattgctgcagatttggctgaaccgcggcgggttgcgtcattgtagacgattattgtttcgacccgaaatcaataaacgttgaagtattgcaccaataggtgtcaatttaatatttagccaacccggcttttgacgaatttggcgtgccgactccgctttcgaataattttagagccgtctcggctttagaagaaatcaggtcggtgcagtcaatggcacagtcttggcagaatgtttgggtaaactccagcttctcttggccactgccagtgttgaggatgaagcgcttgtcgcctcgcttgaagttttcgtgacaggcatttcgtctgcgtcataacatgtgtgaaactacatccactactttctcacggaagtatgactcgatcgtacgaacaaactctcagaccattccctattccaaatggcgcgagagctcccttgtacgaactgccatgacccaaaaaaagatgccatttgtattttttacaccaaattaaggggataaagggcttcattcaataatctaaaaattttctcattaactctgcaaaattgaaaaaaaaatcgttagtttcaaaaaaattagggtcaaaatttcttgacttttgcttttcggttttactggattcaccctagcanaatttacatatttcaatgtttttctttgatg

SEQ ID NO: 38524 - DNA, 917 bp, Heterodera glycines
gtgcttttccttgtctttttgatgcccttgcaaaatctgttgcgcttctgatcagtttatataaaaaaagttaagcctaaactttttggcatgtttaaaaaggaattaaaaatttttaaaatatttattcatctccctttttgataatataagagtcagagtgccttattcaacttgtaaataaattttggtgcgtttcagagcagtttctgtaaaaatacttatgaattaattttgtaaaaaaataaataaataatgaaccctcctccttaataatttttctgcgcccaaggtactcactcggccgcttcgcggcctcgtggggggagtgcgtgcagtgcaactgtcgcggcgcaagggtcggtgggcaaatggcagcggcgcaaatgtcaacggcgcaagtgtcattttggcgtgagcggcgtaagagactgcggcgcaactgtcacggcgctaatgtctgcggcgcaaatgtcgggcaatccgaaaaattgattttttaatgctttccaatttccttctcctaaatcacgattaacttaatattttaatgattaaatattttaatatcttattagatatgttaaaatgtttattaaaaaattttttagttaaaaaatgtaaatgctattattaaatctcttttttacttttgaattattatcagggcttctttttttatgtaagaaaattcgcgaaatatgtataaaaatgataaaatatatatgaaatatgtacaaaaatatgtaaatataattgtttaaatggttattttttggaaagaattactctctaaatgatgatatagggacaaaataacataaaactcaaatatgtaaaaaaagaaatttatatgataaatccaaaatatgtattgaaatatgaacatatgtaaatatgtaaaaatatgtaaataa

SEQ ID NO: 38525 - DNA, 755 bp, Heterodera glycines
ttttgaacaaaatcaattccgaaaattctattttattaaattttttttgttatttttgtccatttaattttaaaaaatactcaatcatttacacatagaaattttttaaaccgtttaaattataatattttcacttgaaaaataattaaagtaaaaaatttttaaaaaatcaaaatttttcattaaaaaattttttcccgtttcccggcgggattcccgttaaaattgacgggatttttacgggaacgggaaaaagccgggaatcccgtttccgtttcccgtcccgctctttatcgattcccgtttcccgttccccgttcccggaaatttttttttaccggactctaggtaatatgataaaggcgcaacaatcaactgtttttaaaaaaatgtaattaaattaaatgttgaaaaaactaaaaagtttatatgggaatttaaaacaaaagggattcttactattacaaaagttaaaattaattgttgtttctaaacataaaaaaccatagtttaattaagaatatgaaagcaaaaagaaaaggatcaaatttcacaatgtttgtttttttcacaaagcagccatcattactttctattttgttttcaacacattaaactgctgccctttctctcgtttttgctctctaatctttaccttttctctcgcaaaaatttaataaaagttttcgtttcaataaatattccgttcaaaatgtgacatacagaatgacagcatcaatttagtaaggttgatt

SEQ ID NO: 38526 - DNA, 1112 bp, Heterodera glycines
  misc_feature (52)..(52): n is a, c, g, or t
  misc_feature (71)..(71): n is a, c, g, or t
tcattttcaatagaactagctccaatgtttggttttcaaattaaactaagtntaagctaaaaccgatcttnatgatggtataaaaatgaaggctttaaaaattatatttttgattgccaatcatttgacttttctttaccagtatgtaaaatttgaagcagaaaataattaaacatcacgaagtattttctgtttttctcagttaaccgagataaagaaataatagacccgtgcctcggtagctcaatggtagagctgtccacggattggctgaacgagtgggttcggttcccacccgaggccgaacattttgcccatttctcattttatgatgtatacattccatttgtagttcgttccattttcctaatttcatcttatcctaactgttatatttttcccccagaaaatgtcatcatctccgtccactgctgtattcattttcgcttacacacttttttccgttgaactgatcacttgtgtcgccgttttggccatcacttttctgaatttggctgtcattgtgccaactaaacttttgcatttgaacctgaaaagcattctgatcgtccaaagtattgccgttatgctttatgtgttaccgcgtgtagtaatgcttttccaaaaattcacatccgacgacccatttgcacctgccaacgttgtactacaggtacaagcacagggatggcataaattccgaacaaaatttaaaaaatataatagaatcaaaatttaccgatagtcggaaataatttttaatggatttaaaaaatcgcaaaaagttttttttttataaaatgaatttctaaaattatagaatataatgacttttgacgctttgttccgccgtctgcttggtcatgctttgatcattgaacgatttatcgccacacttcgcacaaattcatatgaaaagttttcaaaagtgttttttactctgacttggttttgcattacggtattcgttggtttttaaaaaaatttaattctttaatttaatttatttattttttacagttcgccatcgcttttgtgaacactaataacacaatgaatcagtcagtggactatttaccgaaattctaatttaattacttcagactctagag

SEQ ID NO: 38527 - DNA, 846 bp, Heterodera glycines
ttttggcagtcccaggcatctttcatttctctctcatttcattcttctttggaaaaacccgaggccccctccacgtaacactctgtgtggaattccaactcattgcgagctctgtgaacacccacacagtttcaagtgaatgagaacgcgttgaggtggacaggaagccgacatacgcgtattccattcactgcgcattcccacaaatagccgacggtttaaacgccaatcattttatttcattcatcatcatatttgacctgcggactggccaattcataagcattcacaccaaaagccattgctgacgccgcccaattcatttgactctcatttggattcgatcatttcattgtcttcattccactcataatcatggcaaatcccgcggacatggcactgctgttccaacagctaacagacactctcaaaaacattgcaaatcaaaatgcaaatcccaataaacaaaactccgatttattcgctacaattaattcacaattgtccgaattcatctacaacccggaggcggatttggtttttgagatttggcatgagcgctatgggccattcctcgagacagatggacagtcattgccagatgaaatgaagacacgtctgttggtcggtaagcttggtgcgcaagaatacgcgcggttcacggagagcattctcccgaaaaaaccaacagacctatcatacaatgtcacagtaagcaagttaaagagtctattttgcggcatcaaatcaatttttgttaaacgatttgagtgttttcagttgcagaaagcaccaacacagagtccaatcgatttttgcgcacaagtcagcgcacaatgtgaacgg

SEQ ID NO: 38528 - DNA, 1021 bp, Heterodera glycines
tattttatttttcaagaatatcttttcagaaccgagttatgattttttttctgaaaaatcgaaaattttcagaaattctggaataactttttttctttttaagatagaaatcccaaataaatcccataaaattctcctgatttttctctatttttaaagctttattatagttaaatcgatgaaaccatcaccgagttatgaattttccaatattaacccaaatttccaagggccaaaaaattgccaaaaaataaagaatttttaaaaaatttcaaaaattatgaaacttaaaatagacatcatattcgtgctcagcacctcaaaataccccagaaaaatatttttcaccacccttttcaagcctaaaaaaattttcgaaaatttctagggggcctagctcgaaaatttttgaaaatttccgaacatgaagtacaccgttcgatagagcttaaaaagctctacaattttgctctaaggcattttttggctaaaaccaatccctgacgagttatgggcccgggactcaaatgtcccgctgaggccaaaaattttttctatttccgggaaaaaatcgaaaattttccgaaaaaaataccagtcgatagagctcgaaaaactatgttttggaagtggtcttcgttttgccaggaaaattcgttaaaaattcttaaaattcaaaaacccaaaaaccgttttttaggcctagctcgaaaaattttgaaaattttcgaaatttttaaatttcagaaaatcgagcttccaaaactctacaataagtctgctgggcacctttccctcagataaaaccccgacgcggtattcgcctggtactgaagtgtactttttgagcacgcttcagttgccattttctgcaggccagggggtggctctattaaaaaaataaaaaataccagcatgtagaggacactttggcggggtgccctcgcagcgggcattttttgattcgagttttagaagggggagttacgggccttgaaataaaaacaaaagtgagaaatta

SEQ ID NO: 38529 - DNA, 1330 bp, Heterodera glycines
  misc_feature (5)..(5): n is a, c, g, or t
  misc_feature (51)..(51): n is a, c, g, or t
  misc_feature (1220)..(1220): n is a, c, g, or t
  misc_feature (1236)..(1236): n is a, c, g, or t
  misc_feature (1253)..(1253): n is a, c, g, or t
  misc_feature (1273)..(1273): n is a, c, g, or t
ttttntaattagttggtcatttgcgtttaatttatagttttattaaaattntgttgataattacctaatgttgaattttatttaaaatgtaattggaatggaagttttaattccgaatgctacattaactttaaacattaaaattgattgagaaaattatgctttaaataatcaaaattgggggggggcggcgcaaatgtcggcggcgcaagtgtcattttggctggtcggcgcaagtgtctgcggcgcaaccgcggcgcaagtgtcggtggcgcaaatggcagcggcgcaaatgtcggcggcgcaagtgtcattttggctggtcggcgcaagtgtctgcggcgcaactgtcgcggcgcaagtgtcggtggcgcaaatggcagcggcgcaaatgtcggcggcgcaagtgtcattttggctgggcggcgcaagtgtctgcggcgcaactgtcgcggcgcaaatgtctgcggcgcaaatgtcggccaatccgaaaaattgattttttaatgctttccaatttccttctcctaaatcagattaacttaatattttaatgattaaatattttaatatgttattagaaatgttaaaatgtttattaaaaatttttttagttaaaaaatgtaaatgctattattaaatctcttttttacttttgaattattatcagggcttctttttttatgtaagaaaattcgctaaatatgtataaaaatgataaaatatatatgaaatatgtacaaaaatatgtaaataaaattttttaaatggttattttttggaaaaaattactcgcaaaggatgaaataggcacaaaataacataaaactcaaatatgtaaaaaagaaaatttatatgaaaattccaaaatatgtattgaaatatgtacatatgtaaatatgtaaaaatatgtaaataaaagtcccaacctttattagcaaacacaaaaaataatttactactatttagagcatggagaatccatgaaaaaaaacatatatttacataaaaatataagccctgattattatcaataaaattatgtatatttatatttctagaatttctctccttcattactttttcaaaaagacataatatatattaaatattatgtgcatatttcggttattatgcccgttaatttgaattatttaattggtattacaattaaaatagttatcgaaagaaaaaacattagaaattataattattattanaagtatttatttttanattccatttattattanaactagataatctttataanatcatacgaagaattctcatttttataatcttaataaaatccaaaaaaatttagtaa

SEQ ID NO: 38530 - DNA, 694 bp, Heterodera glycines
agatcggacgggtgggcatgatttctttgtttcacgcaccccaccaaaagcaaaacgatataacccaaatataaggaaaaattttttaaaaaattttttctccatcttcctttttgatactaaagcatcagagtgctaaaattaagttgtaaataaaatttggtgcgctttagagctctttctgaaaaaaatatttatgaaacaaaaaaatcgattttttcaagtgtccgtttggggtactcaatacatttatggggagcaaaaatccatcgcagaattaaagtacaggctatagggaagctattcccaaggattcggtctcaccataaatctggacccatcgtttaggggggtctcccccgaaaccaaaaaaattgattttttcaagtgtccgtttggggtactcaaacaattatggggaccaaaaatccaacgcagaattaaagttcagtttatagggaagctattccggaaggattcggtctcgccataaatctgggcgcatcggttcgggggggctgtcccgaaaacaaaaaaatcgcttttttcaagtgtccgtttggggtactcaagcaattatggggagcaaaaatccaacccagaattaaagtacagggtatagggaagctattccggaaggattcggtctccccataagtctgggcgcatcgtctcggggggactgccccgaaaa

SEQ ID NO: 38531 - DNA, 1544 bp, Heterodera glycines
ggcgagcatcatgcaggtggtgaaggctaatcaattccatgataagcatggatccgtcccgataaatttaatgatataatataaagaatgggattaatttttatattttttatttggtaaatttaaatcttcaaatatgtgtatatgtaagcattgttgttaagcatcatcgcgagtgtcgattcggcgtcgctatgggagtagtcgtcgggctcagcgtccgatcaagcctcagtcattcgtgcgaggcctcgccgtcgacaataagtgacggcgaaagcgcggcatctgcttcaacttctcggcactgtcgtcacaatgccgacccctatcggcactgccgccgtccgtactcaaagcggcggtcgctgccatgccgcgagtactgtaggaggcagcggtgatggaagcggtggcggtagatattcatcctacgccgcaccatcgccacggtcaatcagtgcgctccaactggcggctgtgcgctcccggacgccgtccccgttgtgccgtccgttcaacataacgccaatgttgtcgccaacgctatcggacgcggacgatccgcagccgcatcataatcatcaatctggaccaactgacaccatgtcgctggactcaaccattggcgccaccgcaacggccgcgccaaattcaaatgcacagccaaaggcgtcagtggcgtgcgcggcgcggtccaacgggccgacgccacgctacgcgcagttgcgctcaccgctgcaccgcttccgcatccgtcagcagccgaggccgcgcagcccgcaaatgtgtagggatcaacagaaaatgccacggcacggcaccctttgccgctttttctatctcttccttccattggggcaattggtcgagactcttcgcacttttttggggccaattttttgcattttccatttgaaaatgcgtcagtgaattattcgaatttcttcaaaactagctcgtccctgctgattaccaagaaatatttaaatccaaaaattatccaaaactactctgatcagatcaatcagttttactgggctccgttaaagcatcaagctcttgtgtggtccagggatggcacggaattccgacttccgacatttttggggtcggaattccgatttccgaaaaaattttggtcgccggaattccgacttccgatttccgaaatttttgataaaaaatcggaaatttttttttttaattttttttttcaaaaaatatttatttttgtacaatttctattctctaaaaaccttaattttcttgaaaaatttactcaaaatcgctaaatttggtcatttttggtcaaaatctcttaagaattcgtattaaaaatgcaaaatttttttcccgggcggcgccttatcggaaccgccggcccgccctgccccccttttttccaaaaattgttttaaaaaccgaacccgcaaaaaaacaatggaaaaatgacatgaaaaagattttgatgaaaaattattgaaaactttaacaaaaaattttttgaaatcaccctttcactttggttaaaaattaaaaaa

SEQ ID NO: 38532 - DNA, 1004 bp, Heterodera glycines
ttcgatatcaagaaaccaagtcaagtccagaaaggaatactttaaaacgatttcgttttgttttggcattatgataccgaataactttcggaaattatggaaacaaaattggagaaattcgaataattttttgactgcaaatttttttccttttttgaattgggttcaaaaaaattttaagagaatttttgattattaatttgaagtcttgaatttatttgacaaatccaagacttaaaactgggagaagcaaggggctgtggctgggggcctaaaatttgggccacattggagaattaattctgatttctgaaaaagtcccagaaataactattttttctttccataccttcttgtagagctcgagctgctctttccaatggtcttatcccggtctcgatccgtgccgaactcacaaagttatggagtgaaatgtgaaatattgttttcaccacaaggcattttttctgaaaaccggattcaaaaatctggggtttggtataaccgttttagaaatagcgtagaaaacagcttcgatatcaagaaaccaagtcaagtccagaaaggaatattttaaaacgatttcgttttgttttggcattatgataccgaataactttcggaaattatggaaacaaaattggagaaattcgaataattttttgactgcaaatttttttccttttttgaattgggttcaaaaaaattttaagagaatttttgattattaatttgaagtcttgaatttatttgacaaatccaagacttaaaactgggagaagcaaagggctgtggctgggggcctaaaatttgggccacattggagaattaattctgatttctgaaaaagtcccagaaataactattttttctttccataccttcttgtagagctcgagctgctctttccaatggtcttatcccggtctcgatccgtgccgaactcacaaagttatggagtgaaatgtgaaatattgttttcaccacaaggcattttttctgaa

SEQ ID NO: 38533 - DNA, 711 bp, Heterodera glycines
cgacatttttacacatttggatgtccaatgaggcggaaaaggagttcacatcgacgggcaacccgaaggcaccagcgcttcacgtggtacttgactggatccaccgatcatggcaggagatttccaaagaagtgatcatcaaatcatttgagggtcagttgaaaaggaaaaaagaaaaatgcctgaatttttagtctgtggattgacaacgccattggacggaacaggagacgaaaaaattgcttgcttcaagccgaacggagcaattggaccgatcgggatcaaatttttgcgcgaatttagagcaactgaaacagtgaaagatggacgaaatgatcaagaggaagccggcctttctgaagatgacggtgatgtagagctggatggagttggagatgacgatgaatttttgatttgttagcattttactgtttctttcgttgttattttaaaaaaattgctgtaataattttttaaataaattctatttaatcccccgggggataattggagatagggcctttaatagagacggggggattatttttcaacctcgtcagaaagggggacataattggagacagggcctttaaaggagacggggccttaattagagcaaatacggtattctgataattctgaaccaaattaccaaaatcaacttgagcaaaattcaagtttttagtcactaaaaatcacatccctagtaat

SEQ ID NO: 38534 - DNA, 1268 bp, Heterodera glycines
atttaaagacaaaaaaagtgattcattgatgcgcccctgctatttcacatttgactctttgtgcttgtgctgttgttgtttattgttgtgtgtctgtcatcgcagacatttgaaaaatttattcaaattttccaattttgatatttctgtttaataaatgtgtagaataacaaacacgtgtggtgggtacaccctcgggacgaatgaataaaagtccttggacagacgcgcccaggagcccaggacaccgtccttgaaaaagcgatttttgacaaaaaaaaaaattacattcaggtctctatcagcgatggcacggaattccgatttgcgaaaaaattttggtcgtcggaattacgacccgatttccgaaatttttgatgaaaagtcggaaatttaaaaaaaaaatttttttcaagcaattaatcaattcgaagcaaaattatccaaatgtcgttttaattttctgttaggagtttaaatggtctgaagctccctccgataaggcttaagcatccacagagcacggatccatatcatttttatttacgccatctataagtattaaatcgatgtttttaaaatactgctaaaataacgaaattatgatctcccaaaataaagagggtttcgagcgactcaaaaaaaagcgttggccaattactatgcataatataatttttatagagtacttttaaaaatataatggccgaatattgaccatatcctttttgttatatttattcatacagaaaataatattttattgagaaaaattccaattttacgcggcggtttctggacgttctgtcaaatattcattcatttccgaacctataatagtataccaattttggttatgctcagttaaaatatatgaaatatgatctcccaaaataatgagggtttgtatattgaccccccagacaatgtattcctgtatcagtgggcgctggtattgggcccttcgacgatgaactggcaccataaacgcccgctgcccgtttgtgccagctctattcctcaaaaaagccactcattcacatttcctctcaactgccctctgttatatgtcctgcgcagaatgcatgtctcgtcaatttcaacgatcaccctttaatatattctagagttgagcgggaccgggaattttgggcttaaccgggaccttttcgggttgaaaaaccgcgaatttttgctgggaaaaaaccgggacttcggtactcagctgtactcagttgtccgtgttcaggccccggtcccgctcaact

SEQ ID NO: 38535 - DNA, 337 bp, Heterodera glycines
gcaggtcttaaaaaatcaacaaaatgaaaggaattcattggccttgcagttaccataaaagcctccgaaaaaaattcaaaaaaattaaaacatatatatatagaattatttgtttttaaataaattttttgtggggatgacgatttttgttaataaaaatcacctcggaatatgcagcagatccatgtttgccaaatcaaagaaatgttttttcgaaaataaaattctcaaacgactaaaaataatatgaaaagcgaaacgaaaataaaagatttaagaaatgaaaaaatatacgaaattttttatcatgtatgaaacaagggcgtaggaagggggg

SEQ ID NO: 38536 - DNA, 1185 bp, Heterodera glycines
tagcatataactaaatttattaaaattctaagtctattgagctagaaattcggaatgtcgaatgataccaatatttctgagaacagttatgaatttgaaaattgtcgacatttttgtttacgtgaacatatacagcctttgtaaactgcaataaaactgccattttagatattgagaaggaagggaagaatggtgaatggccttaacccctcgtggtagaaggtcactgaaaaggggaaatgatgagggaaattgaagatgcaacggaagcggcgaaacaattgattttaaataattggaatgcatttgaaaaggtttttttagtcttttctaaatctaaaaaaactagtactttaattcgatttatttagctggccgacggtttccggtttttcctgtagaaactttttttggacacaattaattcaattggaaaaattttaaatgggaaaaaatttacgacgtaaattttccgctgtttcactactcacctttttatagacttttctggcaatcattttctgtgtggcactctccgagtacgacatggtgttggcggaggatgacgaaatggtagcaaatttttggaaaaattttttttttaatatttttttgtccaaccaagaaacggatgattgaaagcatgaagttgttcgactccatctgtaacaacaaatggtttctgaacacgtccatcattttgtttctgaacaagaaggacctttttgaggagaaaattcgcaggtcagcgccaaaaatggttttaaaaaattatagcccggtgagcaaaaaaaaaaaaaagtttacggactccccctccgaaatttttttttctgaacaggcctgtatcttgtcagcctccccaaaaatgtaaattttgtaattactggtggaccacctgaaccaaaggtaatttgcgttgatgtcattttatttgtcggcactttttgaactaatgaaaatgtgtggtaatccggagaaaatttggtgtcagaatttgttaataaccccaaaaacctcccaaagaatttttttttttgccaaccctaagggtcctttacccctatggtttctcggagtgcttaaacagcaagtgtcggactttattggagccgaattccgactttatgtcatccgccgttacagccctactggcccaaacccataaaccttaaaaattttgat

SEQ ID NO: 38537 - DNA, 1361 bp, Heterodera glycines
attagtgctttattcaacgctacaatagaagacaaaagttggtgtccaattctcggtagggatttaatagtgactttcagagatagccatatattgtcaagaaatatttttcgagcgttctcaaacacattattagtgttctattcagcgctacatcagaagacaaaagttgtgtccaattcccggtagggatttaatagtgactttcagagatagacattgttagtctataactatttttcgttcgttttcaagcactttattagtactttattctccactacaatagaagacataagttggtgtcctattcccggtaggaatttaattgtgactttcagagatagtcattttatgtcaataaatatgtttcagtgcggtttcatacacactaatagtgcccccccccccccatcactcccactcccgattcccctcggttctccccgattccccccccccccctcgtccattttctcactgccaccatttttaatttttaaatattaaaatcgccattctcacgcacatcgattgtcgtttctgctagtctatttataaatgtgtgatctgctgaaggattacagctttttatatataagaaaaccaaaaaataaactttttattcgcaaaacccctcctgcaaaaaatctaataattattttcagcatgaaatgagtcaactccacaaatacctagtcccttccattttttttactcttctaaatgcgcccgtctagcattgcccaaaattccttcacctccgaccatccctgatgcctttgcgaaccttccgatcactacacatgaaacactaaaagactagttttcactatcaaaaattaagctaccttggttgttatctgctcacgattcttccccaattaataaacagttgaactaatcccgacccgaatcgcactcagtatccctcgtacgttcttcgaattgcaagtgaaacgcaccaatgttggcaaatatctcaaccggattgccattccatttccaatttttaaattgccaggccggaccctaaagcagttttgcaaatcccctgaaatgaccatacgcccacctgcacaaacactgcgaccactcggtcccattcctcgtccttcaatcgtgttggattgtctacgactcggtacggaacagtgacgccattctttgggatttgcagtaacagctcattctctcgtttactgctaaattgctttttttcttctgtgcttacgtaaccgccaaatccttaacataaattaatttataataattcttaaatgaataaacctgcaaaattcctgcgcattgtaaatttgtgatgaccgaacttgccccccaaggataatcattattggaac

SEQ ID NO: 38538 - DNA, 846 bp, Heterodera glycines
  misc_feature (759)..(759): n is a, c, g, or t
tttttaataattattctaaacaactattatttttttttcacgaaacaaacagttcccgtcagctgtgacattaatttttttggctatctttatattgctcgttacattttcttcttgctaaaattttcaatttcaattattatttattaaatttgtattttcattttaattttttaattaagttttactaagccacctcattttattgttaaaaattttcaatttaaattattaaaaatttcttcaaatattttaaaattttttctaagccacttcatttgttggtgtcggtgtccggtccactggcaatgattttgaatgttggagacggtaaaaaggcaatatcgatgactcatcatccttaaaaattatttacaaatttcgtttgtttaaatttaaaaaaaaataataataatttttttattaaaaaggcaatatcgacgactcatcatccttaaaaaattatttacaaattttgtttgtttaaatttaaaaaaaaataataattttttattaaaaaggcaatatcgacgactcatcatcctttacttgtttaacaaataattaataaatttctttgtttattaaaatcaaaaaaaataataatttttattcaaaaggcaagatcatgacggagtgaatacttttcagttttgtgtacatagcccaaaaattttaaaaaatatgttgtacaaatgattcacggaccatggaatctttttgatggcacaaaaggaaaatttgccgttagaatgtcanaaaaaaacctcagatatgtcttttagggcaaatcattccttttgtgccaccaaaaaactccgcgcatccttttgtgacatatttttg

SEQ ID NO: 38539 - DNA, 342 bp, Heterodera glycines
ttcgccatattaacactttggctgtgcaaataatcgcaaggattggaaatccctcctttttggccaaatatccaatgccgaatttggacaaacattgggaagaagcggaagaatttgactgatgcgattttgcggtttgttcggctttttcatgtatttttttcatcgtttttaaagcattccgacgatggcccgccaaaataaaaacgatttggacaaaaacaataaaaaaaaaattctgcgaaggcatgaaaaattcggtaactttttatcaaagaaagaaaaatgatcggaccgtgtcaaatatcagaagccatttccccaatagttttgccacccaat

SEQ ID NO: 38540 - DNA, 1044 bp, Heterodera glycines
attccccccccccccccctttttctgtttgctcgtcgctctcccttcagtccgtccatcccaacccatcggcgggaatgaatttgtggccaattgatcggccaagcgacacgagcaatgaatgaaagcgccgccgtccgattttttcctttgccaataatttattcactttatgttttcctcgctaattgccttttgcttttccctttagaaattcgtttgattgccttttaatttgtcattttctctttgaccgttacggtcattttttgtgccatcgacggaatgccttcgctttcattaagcgaagggcggccaatgattggtttcgttcgcgcgatgactcattgttcggtgccgggcatttttctgatcgtagtcgtgccattcggtgatccctttggcttttccctttccccttttaattacccccccccccctctcttagtgtttttcgcttgtccaatttctggccaggctctgaacgacccgtccactcaatacattgagggtcggctggccaaccgacgtgtttggtggtgcccttccggttatggtaaatgtcaattaaaattgaaatataaattcagcaaaattatcgtttatggtcccataaaaaaggcgaaatattactttgggtagttttgcgttgttctcggggttttcgaggtaactcacgaaatctgacacaaattcgaccaattcgaacctatcaattttgtcacttatgcttccaaatatgcataataactacaaagtttggtcaagaaactccacggacacctgctgaccatccattattctaaaataagaaagaacaaattttgtttttttttcctgggtttttcgtaatcagtaattaataattatatatccttaattacccttaaacgattttaacttcaagcgatgccccccccccttttctcaggttacttggcgtactgtccccagcccaccgattgggacaattacaattggtgctgcactttcccttacttcggctcctggaagccctcctgctgcccttttgccattcccacgg

SEQ ID NO: 38541 - DNA, 1022 bp, Heterodera glycines
aaaatttagaattcattttccccactcctttttcccgaggggtattatttggtatttttttttccccaaataaccttgtcaaaccccatttttcgccccgtgaattttttttttttgaattctgaaccgttttgagtagattagactagaaaaaattgaaaatttgaaaatcatgtttcccgctcccttttcccaggggtattattttgtaaagtcttttttcccccaataaacttgtcaaaccgcatttttcgcaccgtgaatgttatttttattgaattctgaaccgttttgagtagattagactagaaaaaattaaaaattttgaaatcatgtttcccactcccttctcccaggggtattattttgtaaagtctttttttccccaataaacttttcaaaccccatttttcgcaccgtgaatgttatttttattgaattctgaaccgttttgagtagattagactagaaaaaattgaaaattttgaaatcatgtttcccactcccttctcccaggggtattattttgtaaagtctttttttccccaataaacttttcaaaccccatttttcgcaccgtgaatgttatttttatcgaattctgaaccgttttgagtagattagactagaaaaaattgaaaattttgaaatcatgtttcccactcccttctcccaggggtattattttgtaaagtctttttttcaaaataaacttttcaaaccccatttttcgcaccgtgaatgttatttttattgaattctgaaccggtttgagtagattagactagaaaaaattgaaaattttgaaatcatgtttcccactcccttctcccaggggtattattttgtagtcttttttccccaataaacttgtcaaaccccatttttcgcaccgtgaatgttatttttattgaattctgaaccgttttgagtagattaaactagaaaaaattgaaaattttgaaatcatgtttcccactccctttctcccgggggatgattttgtgaagttttttttcccc

SEQ ID NO: 38542 - DNA, 1346 bp, Heterodera glycines
  misc_feature (18)..(18): n is a, c, g, or t
cttacattcgcccatccngggttgatcaccaatggcacttccatggcctcattcacttccaatttcttcccatttcgccagtttgtccatttcttcaccggctccgacaaattatcgacagcaaacgcactttcaacaacaggccccgagtggacaatggcatcagattttggcacaattttgtcggaagaaattgctaaaattaaattttcaaaaaattagcatttaggatataaaaatcatcattttgaagaatttattacagatgaaaataaagcaataaaatttaaatttagaaaattttagcggaatttttggggcaaacggttcaaaggaataaaaagtcatacacacaaaaaaatcagcatattgccataaattaaaaaatttgggagatatgaccagatgaattttttcaaaaaaagaactcagtgttcgaacatttttgccatatctttgttcaagctttccgaaacttttgaggctataacatttagggctatcgaatgataccaagcaagattggctggatttggttggcagagaaaaaaattatagccaaaaacatggtgggcccaaatgagataaaccgggacagtggggttcgattcccacccgatgcctaacatattttgcccatttcttattgtagtaatgagacacacaattggctgactaattaatattttttaatcacctttggtgacattgtcttcattgtttttgtccgtggcatttgctgctgaacattgctgcagaacaacaacaagcaatgacgaaaacaacaagaaaaaattgtaaattgacatataattagttctaaattaacatccaattcatattaagagaaaatttaaagaaaataaaaattttattttttaaattcttttgaactttccttaagatctcaaaacttacgaaaaaattatgaaattttctatttttatgcatttaagaaaaatttcattaaaaatcccaaaaaaaaataaataaaaagaaaaactgcaaaatttgtacgaaaaaatgtaaaaaaaaatatgtaaatcccaaaatatgtataaacataaaatcgctttttttttaattaatttttaaaaattaaagatgaaatcatcatcactttctgtgctttcgattaaaaatgaaaattgcacggaaatttttgtgatttatatttaataaaccaaaagcagtgaatgcaaaaataaataaaaatcagccaccacttttagttaatgtgaaacaaaaaacagaaattcctatgctaatcaaaatgtgtaatatgttgggacaaaatatctaaataaatgaagaaatatatatatatatatatatatatatatata

SEQ ID NO: 38543 - DNA, 988 bp, Heterodera glycines
cattccgaggccccaaaaattttcggaaatcggaattcttaggccccaaaaattttcggaaatcggaattccgggggtccaaaatttttcggaaatcggaattccgaggcccaaaaatttttcggaagtcgaaaatcggaattccgaccccaaaaacgtcggaaatcggaattcggaagtcggaaatcggaaatcggaattcggaaatcggaaatttttcaaaaaaaaaaaataataaaaaattttctaaatattttaataggctaaattttaaattcttaaccaagtaaaaggtgattcaaaaattttttgatctatttaaatacatatttggtttaaaaaattattcaatgattttcatcaaaaattttacctttttttttgcggcgcgttttttcaaaatttttgaaaacatggcgggggaggtccggcggtgccgataggcgccgccggggaaaatttttgaaaatttcagtgcaatttattaacaaaatttgtaaaaaattgttaatttttgaaaaaaaaatcaaaaaattttcgaaaatttccgactttttatcaaaaatttcggaaatcggaagtcggaattccgaccccaaaaatatcggaaatcggaattccgtgccatccctggtacgtacgggccattaattctcttgaaattttcattatggattgattaaaaaaaaattgttcacagtaaaaatgttttttgggggtgtcaatttcgtaaaaattttagacaaaatattttcaattgaaaaaatgttcttggatgtaaatcatgtgcatttgaatgtcgacaatcagtttggcaaacaatagaaaaagctgtacaaattcaacaaaaacttaaattttcaacatgatgttgaaaaatcgtgaccaaattttcatgttcatatatgttcatccaaggaattttttttgtttaaaattttgtttaaaggattttcatttttttcagttttggtaagcaaatttctgt

SEQ ID NO: 38544 - DNA, 1068 bp, Heterodera glycines
agccgacccgcgccggatgatggcgtcgcgtccgcctccatcaacacggaggaggatttgggaggactgaacaccgaatggctaactgacgatcagctgagcgaagtgatcggattggccacacggaaacttactttttattcagttggcctctgccgggagtaacgaagaacgaatgataaaaatgaggaccttttatgacaatttggaaggcgaagcgaagaaaggcgcaacgaagaaaatagtggaggaatgctacggatgggtggacgaagtggcgacggaggacgagcgaaacgcactgaagcaaatgcaccaccaaagccatgacgaatgcaaggccaaagtcagggaactgatgggacggctaagtgaggagagaagcgaacaagtggagaatcggatgggtttctgcgaacacgtctattacgggaagatggacggggaaggcgacggaggagcaggaacagctggagacgaacaccaccaccaccatcatcaccacaccaaaagacgggcaagcgatgggaaaagcggacaatgcccaaacaaaatagggaaaaagcggataaaggaaaaagcgaacaaacaaaaatatcggaaaagcggactaaagggaaaaagcggacaaaatgcccccacccccaatatagcacaataaacagcagtgaaaatggcagtttaaggctcacaggcaacgcagagaccaccaccaccaccaccatggcgaacatggacttgaggattatttcaaaacgcatttggcatggttaacggatgagcaaaaagcggaaataagcaggatgaaggagtcagggaaaagccgacaggaaataaagcagaaagtgatcgaattgtacgacgcaaccactggagaagcgcgagaaaaggcaaccgaactgctgaagggcgggtgccgagagctgattaaaattgtgctaggagaggaaaaggccggcaagatcaaagagatgaaggagtccggcacggatgttgccaagatttctgagcagatcaatgcgtggatcgaagagttagcggatgagaaaaagaaggaatggccaatga

SEQ ID NO: 38545 - DNA, 1079 bp, Heterodera glycines
cttccccggggggaaaaaagggggtttgaaaaattttattgggaaaaaaagtctttacaaaaaataatccccctgggagaaggggagggggaaacatgatttcaaaatttttcaattttttttagttttatttacccaaaccggttcagaattctataaaaaaaaacatttcggggtgggaaaaaagggggtttgaaaagtttatgggggaaaaaaaagactttacaaaataatacccctggaagaggggagtgggaaacatgatttcaaaattttcaattttttttagtctaatctactcaaaacggttcagaattcaataaaaataacattcacggtgcgaaaaatggggtttgacaagtttattggggaaaaaaagactttacaaaataatacccctgggagaagggagtgggaaacatgatttcaaaattttcaattttttctagtctaatctactcaaaacggttcagaattcaataaaaataacattcacggtgcgaaaaatggggtttgacaagtttattggggaaaaaagactttacaaaataatacccctgggagaagggagtgggaaacatgatttcaaaattttcaattttttctagtctaatctactcaaaccggttcagaattcaataaaaataacattcacggtgcgaaaaatggggtttgaaaagtttatttggaaaaaaagactttacaaaataatacccctgggagaagggagtgggaaacatgatttcaaaattttcaattttttctagtctaatctactcaaaacggctcagaattcaataaagatgctatgcacgcagcgatacgaaaatggcggtacgaaaacgtcctggcccgcaacattcactatgggtaccgaaacgggtcagttgcgtctggccagttgcgtctgggcattttcctagtgtaaattttgaattaacgcgcaaaaatttacgccaaatgcgctatttggcgttatgagcaattttgtctgacactggcgcgtgggacccacgcgtttcggcgctcgtgtttcggcgatcgcgtttcggcgctcccgtttcggcgccagctcgttt

SEQ ID NO: 38546 - DNA, 766 bp, Heterodera glycines
gtacacatgtggcctggttttttgaattcttctagtcataatttttttgagcattaacgaaattttttgaaacttagcaggctaatagagaacacttactttcgaatgataccaataatgttagatttggttgccaaagaaaaaagttatagtccaaaaactgggctggcgccgaaacgagcggcgccgaaacgagggtgtcccaattaaaaccccctaagaagtctagaaatttaattttcagtttaaaagtttttatggcggaggaaagtagcgatacggagaaatcttttggtcagaccatcaacagatttccattatgtcaaccatgtctgatcaaaagctttgtaacctgctgatcagtatcattgttgagctggcagcaatcatttcaatatttgaatgctttttaaaaaaataggcccagaattttgaaaaaccggtggattgagattccggccggaattcgagattaccgcgactcaaattccgattttgccgtgacgatcggcgattccggtcgggattcggaattttcacaaaaagaaaaacttaatagaaaaagttatttgccattttttaatttaaaccatgagaagattttaaatcccatgtcagggtcagattccatcttcaacttgccgagatccaattttgtcggaacctgacgacagattgtgacctgattccgggaaaaccccaaccgagtcccgaaccagttcagtctctatttaaagacacaaattttaattttaaacttaatctg

SEQ ID NO: 38547 - DNA, 981 bp, Heterodera glycines
atacaagggaattttttttagttcttttggatgtgtattttcgccacgttttgattcgatggtggacaaaaatttcaatgtagatagtgaattttttaaaaatttcggcaagttctttttttaatttgtttaattaaaaacttttctgcaaaagtcattaaaaatttttttgttaaaatgccgggtttttttaagggtttttgaatctttttaaagattttgtgccctaaaatgggcctcaaattatcaaaatggctctaaaattttttttctttttgtaaattcggcgttttttttaattaagatttttgtctttttggtacctcattttttaatttcaggacgacattcaaaataggcaaaaaaatttagtgtgtttaagatttgttaagacattttctaggatcggaaaaatgagctggtcacgaatctgagcactaatttagcaatatcaaaatttatgattttcgtcaagtcttgatatttacaatttttttttattttctaaaaattatttggcatacgcttgggctaaaccagcgttcttggtatttttagctttatctcactgaggcacatctaaagacaccaagaacgcttggtttcgccaagcctacgcgaaatggtgaacgtttgtctttagtagtcacaaaatttagaaaaaattttgaaatttattgtttttaacgtaggtacggggctgaaatttggcataggtatgtaacttgggatggcgcattcaggaaaactataggttttttggtccgaagtccaactgagtcccaccggcgctaaaactgactttgctggcagtctcagtgttacgaaaatttttcctttagctcagatcgaaaaacgcttgcaggtaggaaactaagttggactatgcctgacattattgccagcaacccctaacccctacctatacccccctggtctgtacgtttatacaactttttgaggtcagataatgtacacttc

SEQ ID NO: 38548 - DNA, 851 bp, Heterodera glycines
ttattttaaagaattttaaaaaaatgtttaaattggctcaaaaaattaccacaattgattattgagaaaaattattttatggatgtgtttttaattaatttttagttattttcgtaaaaattatttgtctctcgaaaattttttgtcgagttttgactaccttttgttggtaacatttctaaccaccaactcccgtcaaatgaccacggactaccttcttattctacgggtaaatggtggtcatttaaccatgaccatgactctcttttttacccgatagaataagattatagttcatggtcgcttgacgaaggttggcagtcaaaacggcacttcgtggtcattttcttattctacgggtttaccaccaatttcgtggtcatttgacccggtctttaaccaccttcttattctacgggcccagccgatttgtttcttcagctgattagtccagaagccatttattcgttgaagtacatacataggtaaaatatttaaatatatttttgactgagcggcgcaaaagtcgcaacacgctaccgcacacctggactaccaaactttatgacttttcaaaatttgacctaaaatactcaaaattgacacaccatttccttccccccccccacccacccaccttcgtacatcgattatgcaacgggggccctaacgaccccggggccctaaaacgggggccctaacgcgggggcccgaaaacgggggcccgaacgctctggtccctgcctattaacctgcgaagtttcgaaaaatttagctgagaaacgaaaaagttatggccgaaagaactcgaaaaaattgcgttttcctggccgttttggcgcggcgcgccg

SEQ ID NO: 38549 - DNA, 1043 bp, Heterodera glycines
tagtcatttttcttggatataagataaatttaaaaattctcttgagaaattaaatggcgattgcgcaccgccctccctctcacgctcgagcgcttttgtaacgtataaaatttctcaaaagaagagatagtcatttttcttggatataagataaatttaaaaattctctgagaaattaaatggcgattgcgcaccgccctccctctcacgctcgagcgcttttgtaacgtataaaatttctcaaaagaagagatagtcatttttcttggatataagataaatttaaaaattctctgtgaaattaaatggcgattgcgcaccgcacttcctatcatgctcgagagcatttgtaacgtataaaatttctcaaaataagagatagtcatttttcttggatataagataaatttaaaaattctctgtgaaattaaatggcgattgcgcaccgccctccctctcacgctcgagcgcttttgtaacgtataaaatttctcaaaataagagatagtcatttttcttggatataagataaatttaaaaattctctgagaaattaaatggcgattgcgcaccgccctccctctcacgctcgagcgcttttgtaacgtataaaatttctcaaaagaagagatagtcatttttcttggatataagataaatttaaaaattctctgagaaattaaatggcgattgcgcaccgccctccctctcacgctcgagcgcttttgtaacgtataaaatttctcaaaagaagagatactcatttttcttggatataagataaattttaaaattctctgagaattaaatggcgattgcgcaccgccctccctctcacgctcgagcgcttttgtaacgtataaaatttctcaaagaagaatagtcatttttctggaataagataaatttaaaattctctgagaattaaatggcgattgcgcaccgccctccctctcacgctcgagcgcttttgtagcgtataaaatttctcaaaagaagagatagtcatttttcttggatataagataaatttaaaattctct

SEQ ID NO: 38550 - DNA, 1168 bp, Heterodera glycines
  misc_feature (1145)..(1145): n is a, c, g, or t
aatatattaatgagtatttaaaatacaaatattttttttatatccttatttagcatttcataaacttaaagtataatcaataaacgaggagatgcacaatttccgcaccgacttcaacatggaggcggtgcacaacgaaactccatctggaatgccgactcacaaactgaccatcaaagtgaacaaaattttatttgattattgtttaaccaataaatccagatgggtacgcaagtgatgctgtccgcaatctggacgtcacccagggactgtgcaacggcacacggctgcaggtcatgcgcacttcggagaacaaaatcttctgccgaatcctcaccggaccacgagcgggtgcgcagaacatcatcgccatcccccgcatccaattcgagtatggccgcgcccgtcatcaccgtgggctacgattccgccgtctgcagttccccgtccgactttgctttgccatgacgatcaacaaggtgaaataacagaaattatatgcgagtacatacatatgctacaaaattttaaggcacaaggacagatgctgcagcggatggcgctcgtgctcaacggcagacaatgcttctcccatggccaagtgtacgtcgccatgtccagggtgacgcagatggacagtatcagagtgtacgcgccgttctgccaaagtgggtacgggacgcacatcgagaacgtggtttaccacgagctgctggacatggacaatgccgcacaaatgccgcaactgacgaggactccgacctttgggcgaccggacgtggacagtgacccggacgtgacaataccggacgtggacaacgaccggaactttacaatacctgacgtggtccccagagaaccggacatggaaatggacacaaacgtggctgaaccggacgtggcgatggaaaatgaagttgaagcgggtgcgatggaagaagtctcacctgatacttcatttgatgattttttggattgattttgttatttattttgctgctttatttgattaaacttttttaaattgaataaaaaattttaattaattttgctaatttttaatgtacgagttgagcggaagtagggaaggagttgttatgaagttgttcaaaagctgtttggttttaacaagagttgtcgaccanaaacatataaatagtatctttgt

SEQ ID NO: 38551 - DNA, 985 bp, Heterodera glycines
tattagttatgggttgtaaatattcgttttttgcacgctatttgaggaaaaaaaacgaaaatggtcgaattttgcctttttatcgatcaaactgtgcggcgcattcaagctgcttcaggtaagctgaattccggaataaaaacaccagtttgctgtaaatttaggaaatggcagttcgatggaattcttctttgatcatgattaggcggctttctgagcaaagggctgctattgaccgaatcgcatttgaacagaggaaatttgaattgactttgcaagatggcgagtggcgactgcttaattcactggagatgctcttggcacctttggaagaagcatcactttacttttgcaaatcaccgctttcaacccaaataccattttcatgagcgttgctttcacaactaagacagttggaccttcgggtgttatgtgaaaatgggcatttacaaggaattacggaagttgaggaaatgcgttcaaaacttttggttggacttgaggaaagattcagtcacttggagaatgaaaagtttaatttttaaaatttttttttaaaatattttttaaggttgcatgccctttcaactttcttggacccgcggtacaaacacttttttgcaaaggacattgaccatttcaaattaaagtgcatatcttagggttttaagttatctaaaatgtgattaattaagggtgaaattctggctcacggacgaacaacaaaatggcaatgactctgcgctcgttacaactgaagacattgaaactgcgtcgctttttatagttcctcctcctcccaaacaacgccgtacattacttgattccttgtcagaaatggcctcaacaagcaaatcttttggtatttttaaaggatttttcttattacacatacaaaatttaaagtgcaaaccgaatcgacatttgacgaagaattcaaaaatattgttcgggcgatttgattgggccaggaattggacccttt

SEQ ID NO: 38552 - DNA, 811 bp, Heterodera glycines
ctatttgacggacaaagtcagcaagcaaatcttcgccacttcgtcagctgctgattttagtgcccacaacaaaaatcagaaactgttccacgaattgcatgttcaggtggatttaataaacaaaagatgattaacaattaaatattaaggcccacgaaaatgtgtccattcttttcgcggacattgtcaatttcacccaattggctgcacaactcaatgccaaagatttggtgaagacactgaacgaattgtacagcaaatttgacgaggacgcacaagtgggacaaacgaacaaaaaccgggaatttaatttcaattatgttgtcttaattatcctatactcccctcccccactcgcttggcttaattacccaattattataaatatcccgcccaccctcacagaagttgtcgtgcatgcgaataaaattcctcggcgactgttattactgcgtcagcggaatgccggtcaaccgtccctcccatgccgacatgtgcgttctgatgggtaagcttataaaaactggaaattcggatgatggagcaactcccgaaaggccataaaaatctcaggattggagatgattaaaacgattcgtcaagtgcgaatcgccaccggcgtcaacgtggacatgcgaatcggcgtacacacggggtccgtgctgtgtggcattttgggactgtaagagaataaatggttataaatcttaatttgtaaaaaattttttgcacaattaagcaaaaaatggcagtttgacatttggtctgatgacgtgtcctttgccaatcaaatggagtccacggggtgatc

SEQ ID NO: 38553 - DNA, 787 bp, Heterodera glycines
aaaaagggtgtgaaaaatatttttctgggctattttgaggtgctgagcacgaatatgatgtctattttaagtttcataatttttggaattttttaaaaattctttattttttggcaattttttggcctcgggattttggcctaatatttgaaaattcataacaaatcgaagggttgaccaattttgattaaataaagcattaaaaatggagaaaaatcaggagaattttatgggttttatttggcttttgtatcataaatatgaaaaaagttattccagaaattctggaaaaattcggattttcagaaaaaaatttataactcgcttctgaaaagatattcaggaaaagtaaaatgctacaaaaatccgcaatttttagctctattttataaattttatttggcatttttatcacttttttgaaaaaagttataaaaataaaagtgattttgggattcgggaccaaaggggtgagcataggatttttgagtgaaaaatttttttcaacaaaaatcttccaaaaacatgtcattaggggttatttgggccgctgatcacgaatacgtgatcagattttacttttgacatcgttaagccctcagaatccctgtgtgattggggattctgaggcatcattttgagggtggggggcgaagttcggatccgatcggtgtacattatttttctatgattttttaggttaaatttattaaatattcaattgttaattttcaacgttattttcaattaataaatggaggatttaaaaatactacaaaaatccgca

SEQ ID NO: 38554 - DNA, 940 bp, Heterodera glycines
ggtagtaagggtagaagagtaccaaaatgaggtgttttcttttcgcatcactttactgacataggtcttcgttttttgaatcgatgcgtgttaaggtaccatataccataatggataacttatctcattagagataattagggaccgtttataataccaaacattttaagttaaatgggaactaacgcggaaaaggtcaaaagcacagaaaagtagcaaacattgcgttttccgtaattcgcatatttttccaatgtaaacgagaacaaccttcacatttataccgaccaaaaaaaatgtcttccattaaagaataatatttggtgtatgaagaaaaagcggatgaagtcgctttgaaacagatgatgagttaataaaatacacaaacaaaatgattggtacacggtacacagaggtgagaacccatgaagaaataataatttaagggcatttatttgccactcattggacagcgacaaaagtaaaaaaaaaggaaatggaaagaaaaagtggccaaacaacaaacaaaaattaacacaagcaaaacaaaaaggagtggaactgaaggggatggaaggaatatcatgtcgaaagcggaggcgtacgaatgaatgtttaagggacggggagaagggcaaagtcaatttttagcccctccccccccccttttatttgaaaagtcattgtgaagacagacgaaaagctatttattggacattcgaccgacaaaaagaaatttcctttttttgtttgaggtgtcttgaaccatcacaaatccgcgaatgattttgggcgaggaattcggcgacgggtagcgtaatggtgaaaatgtgcacacgagttgaagagaccttttgctgggcaatggttaaaagcagcgccaaagacacgatgaaagagcataatctgttccgggaagggggggggggggtgactcagc

SEQ ID NO: 38555 - DNA, 1001 bp, Heterodera glycines
  misc_feature (32)..(32): n is a, c, g, or t
  misc_feature (91)..(91): n is a, c, g, or t
  misc_feature (103)..(103): n is a, c, g, or t
cgaattttatagcgtgaaaagtactgatttcnactttctatctaatcggatacacccaaaatttgaaaagcatctgtaatttagcctcttntaaatcttaatnttctgaaacccgaatgtagaaagtatgaatgtatttctgcgacgccttctatacttaattcatccataatgggccaaaaatcataggttaagaccaaaagagggattttagtttcagccggaatttctataaaaatgttcgtgtgtaacctatctttgtctattcggataggtaagaaattgaaatattcgtattacttttcctcccttaaagctttataatgaaagcgtcgttgtctatttaggatttgccgtcgcaattctgtaattccactttggaatccaaaggaatttgattcgcttttacaaaatagacagtgccgaaatttgtagatcggctaaaccttaactgaaacataccatatcagcgagacgccatgctgatttgttgtaatcataataaaaaggcccctattgtataattctgcctttcctataagcacaatgtgtttgatgggctctacaaaatattgcttgtgcaaagcaattattttcttggaggctgtaattttctgtagtcatttgatatgcatctgctatttttctagtcacaaacaccaatatttttcggcccgaattttataggcgtgaaaagtactgatttccaacttctttctattcggatacacccaaaatttgaaaagcatctgtaatttagcctcttttaaatcttaattttctgaaacccgaatttagaaagtatgaatgtatttctgcgacgccttctatacttaattcatccataatgggccaaaaatcataggttaagaccaaaagagggattttagtttcagccggaatttctataaaaatgttcgtgtgtaaactatctttgtctattcggataggtaagaaattgaaatatacgcattacatttcctctcttatagctgtataat

SEQ ID NO: 38556 - DNA, 1194 bp, Heterodera glycines
aacttattggggatatccgccaccttactatccacatcccccaccacctatgggttacccaaatcagcaaatgtttggaaatgcgaacactaaggtgccgcaaccgacccaaattcgacagccatacaatcaccaaattccaactcaaataaatgcccagcaaacagctcttaacggcctcgaatgcgttttaattctggacaaattgccggacattaagggcaatgaaggaaatgacagcattaaatcttttttcaaaaaattttcacagtataccagcgattggccgaataaaaagcgcattgattccttggaatcgaaactcagtgggcgcgcagagcgagcatttaattcggctttggccaatgaaccgtttatatttgaaaacataaaaagacacattctccaacaacttgaggcgacggattgtcatgaaatggcagcatttgatgaattaatgcaaggcattcgccgaaacccaagagaaggactgaaagatttgtccaaccgattcgccattttggggaaaaagcgctagaaaaaaacatttttaaaagcaaaaaaatttgtcacttgccttaaaatcgcaaaaaatttggcaatttttggtaaaactctgttaacaaagtgcactcaaattttcaaaatttctccggcggtgccgataggcaacgccagacctcctagtccccaaaagttttttttaggaaaaagcgttccgcggaaaaagtttattgattttttcattcgaataaaaaaattttcttattgatttttgaacatttaaaaaattaattgacccaaatcccgaaatttttctcgtcccgaaacccgaatcccgaccctgatggtttttcggccgacccgacccgaatcccgattcgagaccgaaaatttcccgaaactcttgacagagaccgacttatttgaatctccaaataatcatttaatttcattttcaaaattcattttttcaaatttggcatccgccttctccgtccgtcacacagttgtagcatccgtcggggcaattctttgcgtatttctcctcacaacagtaaaagcagctgcacctcgttttcaatgcgcattgcttgtcgaacacaaattggcacaccacacagttgtgattgccggggctgcagttggcatctgcgaattagtatttgccaaataattttctggcattcccag

SEQ ID NO: 38557 - DNA, 648 bp, Heterodera glycines
agaacggctgcgccatcagcaccatgggcttcataacaccctcctacgccgtgcgggtggtatttacccagcacgtcgccccttttacgggcggatttcttgaatttggcgctgttgttcagccccagctcagacatggcgtagatgatgcggcgttgtaccggcttcaaaccgtcgccaatgtacggcaacgcccgatccatgatgacgtacatggaatagttcagataggcgttttcagtgaatgtgtgcagcggtaaacgctctacaccgtcatgagtcagatcactcattactcaattatcctcagaccgtggcttggcaatccctggacgacaataaggcatcgcttgtcgattctgcccgcgatagtaacccatctgcggggtggctgtcacagttggcgcaaggatcgccggccgaaggcgctgtcgccggagcgtttaggcaaaattccaccgtgattgttgattaagaatcaacactgttgtgcctgccgtcacgtttttacttgcctggccaacgattacactctcgttcagcaagctgtttttgcgcaccgcagcggaaaacggcatctatcttaactctgacgggagccgcaaaagatgagcaatatcctgattatcaacgctaaaaagcaattcg

SEQ ID NO: 38558 - DNA, 944 bp, Heterodera glycines
gttgtttgaaaaattattaaatggagataagcgaacccttattttttaacataattaatgtaaattaatgttttaatattttataatatttataaaaattatgaaatgtttatattttgaataagcatttttaatatattacattttttaggtttgtatcgtcaaatctcgtatacttataaattttttataatactcttttatttcttactatcatgtaggaaaaagatgaatttgttataatttttaaattttgaattatttttaaattttaatgttcttagactaaatttttatctataagcttattttatctatcatttaaagggattaattttttgacttttttaattgtcagatgtctttaattaccaaaatagatatttattttgtttttctttttattaaattttgtttttgtaaatttttcattattaatctgaactaacagtttaagtttattttttctttttaatatattatttatttacaatgaatttggtattttcttttttaatattcggattttaaagattagtttataatcattatacgcgtcaatcattttaatgtatttctttatttttcatttgagattaaagaataattgaacaaaaaataacgaaataaaaaacattattattaattttaatgaaagataaaataagcagaaaaataaatataaaacttaaaactatgaatataacaaaaaaattaatattgtttctttaattggtttttgtattacttttatcgtaaattagttcattcagaattaagaaaatgttgttatcaaactttgaaatgttgcacgtaatacattaatcttttgaacatttttatgaatgctactgttgttataaacgagtatgccttttgttctataatcatcgattaaattaaataattttaatattttttcgattcaacttttctttcgttta

SEQ ID NO: 38559 - DNA, 1729 bp, Heterodera glycines
gaacaattcaaattgaacgagggggtttgttcaacattttgtggatttgttttcgtccaatggccaaacgcggaagggtggacgatgttatcgtcgtccgctttcatcacccatttggcaccggcacagaacaattgttgccatttgaggccaccgtaccactaaaacaaaggcattaacaaatagaatacgtccttgactttttggttcatcctgaattagctcgtgtacaggcccccgtatccatgggagatgccctccctggccccatgcccactccgaaatgaaaattaaaatttcctagaaaaaagggtaaatttttaaaaattttacctaaacctttttatccaaaaatttttctcggcatcgactgaaagtttttgtcaaccaaaatggataatctttgtatcattggaaagccctggaatggacttggaaaataaaaacaaaaaagatatataccctccgactttttctggttacggtaaggctttcccgaaattttattattttgaattttgtttcatattttcttattcgaattacctttaagtgaatgtgcctgtaaatgtcgttgaagccgtgcaaaagcaccaaatcgcagtgctttctctgctcctcctccaacttttgctgtacattctccgcttcgccgggcgatgggtcggccaccaaaaagcgaatcacttctccggacacccaaattattattaaatatttttaatgattcatatattttgtcaaatggtactgagtcgtccatccatgtttgtctgatgctctttctcttctcaaacgcatccctccgcgacattgtcaaaatgatcagttgcgtttcttccggacacgaattggcgaactccgccggacatttgagacggatgttttgaattcaattaggaactcctaatgatcattttaaatcaattaattaattgtttgagtaacgtctctcatcatttcccaccgtctcgaatcccggcccgtccatccacaccggaatgggaccgatcagtcccggcgggtggtcagcgcacgcaggtggcaaatcggggacggaatgccgcgagggaaccgcgaaagtcgaggagacatttggcacattttcagttgcattttcggcactgaaaggacacaaaagaatttcaaaactattttccaaaaatgtgacccgccgctcattaaaactagggttaagccccgacccctcggggggcaaaatgtcgagggccggggactttcggggggcacatgtctggggtcgggtcggggtgagctaaatcgtcgggtcggggtgagctaaatcgtcgggggtcgggtcggggtgagctaaatcgtcgggggtcgggtcgaggtgagctaaatcgtcgggtcggggtgagctaaatcgtcgggtcggggtgagctaaatcgtcgggtcgaggtgagctaaatcgtcgggtcgaggtgagctaaatcgtcgggggctgaggggctcggggcttaactctaattaaaactgttaccgattcgtttttgccttttcagcagaaagtccctcctcttttccatttggttcttttgtcccttccgccgttgtcgttgatgttgtgttgttccatggtgctgaggctgattagtcaaaaatgaacggccaaaagccaaccaatcactgacctaactgctccaacttgtggtaaggaggcgagaagctaggccactcatccgattgaaagcccaaaagccgaag

SEQ ID NO: 38560 - DNA, 693 bp, Heterodera glycines
agggagggcgcccctacaaagtgtccaagcctcgaaatgtccaagcctcgaaatgtgcaagcctcgaaatgtccaagccacgaaatgtccaagcctcgaaatgtccataagggtaaaaaacacgaaatgtccaaaagtcgaaaaagcacataaaaacccggaaaacggatctaatttagggtttttggagtctctgagtacgaatatgacatttacctaacccatttcctaacccaggaccaaaatataaatataaaaaatgaatgaatttattaaacattcaataaaaaattcatcacggaatacgaacaatcgaatcatcaaaattcacgaaatctttcaattttgctgcatatccttcaattgcaattgggaaatggggcgcccgacagatttcttcctcccacacgggaactgattttttttattaaatatgaacaaaaaattcatgaaaaaaatatatgcctgaaatcgctgttgaagtcgatagcgtgctcaacgaatattgaacaatctgtacttgtggagtcacagtggttggccatgtaagagttgatggtgccggtgagccgatgccgaactgtaccggggtagccgcatagctatgttccgagttgatggtcgaaattgttgtcccgagtgcagctaaaaatttaaatgtttggaaacccaaatgcataaatttaaacaaac

SEQ ID NO: 38561 - DNA, 1004 bp, Heterodera glycines
attttgaaaattttcaaattttttcgagctaggcccccctcgaaaatttttcgttttttgaattttattattttttacagatttttctcggaaaacccaagaccactttcaagcaaccgtttttcacgctctatcgattggtggcattttcagaaaaatttttaaaaatttttttggaaatagaaaattttggttgctaggcctcaatttcagttctgacgcaataactcgtcaggagttgattttatcaaaaaatcgtctaagagcttttttgtagagaattttaagcccaatctaatgtgctttatctcatgtttttatcacgagtttaaaaaaagttatgaaattaattgtgattttgaaattcaaaaccataggggggaccccatggttttgcatttcatgaaaaatttttttgctcctaaattagccaaaatgcatttttatggcctaatttaaggtgctgaactcgaatatatactttatttttggtttcagactttttggaaggtggttataaatttttgaaaaatcgtcaaaatttgagccccggaaaatccagtgaaattttgaaaattcataactctcttcgtttttggtcaaatttagtggaataaagtttgaaaaatagcaaaaaattaggagaattttatgagatttatttggaatttctatcttccaaattaaaaaaattattctagaaaatctggaaattttcgatttttcagaaaaaaattcctaactcctttctgaaaaagtattttataaaaatgatatactcaaaaaatccgcaattttttgctctattttataaattttattttagctttttatcacttttttgaaaaaagttatagaaataaaagtgattttggggttcgggaccaaatgggtgtgaccatgatttttgagtgggaaatttttttcaccaaaaatcctccaaaaatatgtctttaggggttatttgggccgctgatcacgaatatgtaatcagattttacttt

SEQ ID NO: 38562 - DNA, 1008 bp, Heterodera glycines
aagggaaagggggagagagagtgggcggaaagagacattgaaacggatgactatagacgagagggatgacaaatttgcaagtgcatttcctcactttctttcgccttttcagtggcttatccaatccggacgcattatcatcgccgatttgcttcgccacgacaaaaaagagccggccgactttttcgctgtaatttcttttttttattcgataaataaacgatgaagggataaagcatttaagtttgcaaatatttactgttttaggtttatgatcgaatgattgcttttctgttggacgataaaaatttctcgataatttgcgaggagctaaaattgcgcaaaatcgacacgacaaatctatgggatgtgctgttcgacatgatcattttggacgcgttcgaaggtaaatttgccgaattgggattgtttttcatggaacatttcaagagcggcgatcttttggaaaaatcgctaggaaaattttccaaaatttttttgaatatttataaaaaatttctgggtttttcattgaaaattttctaattgataattcgttcctgctctaattcatttatttctgtctgtgcctttttagacgtgcaaaaaccgccgtccgcaatcgccgcactgctcagaaacgggttcatctccacgtcaatgaaacagtcgacgctgaacagtttgatttggtcgatgatcaaaacgaagcgacagcgactgcaagtgaccgaaatttgaaaccaaaagttgacacacttttgcaaaatgaatttctcatcacaggtcaaaaacggattcatcgcccatttctatgacatttcccaagtgatcaccggctcactgaccatgggactgatcggcggaagtgacaaagagttccaggaactctgtgtgtactttaaggtcacttattagtaaaaagacattttcaacgacttacccaaatttatttggattaataattaaaggagcaagtttgtggcttttgttgtcgacatttttaat

SEQ ID NO: 38563 - DNA, 398 bp, Heterodera glycines
tgagccatatgccgtggctaccgtttttgctgatcctgctgcccgccaacatcatgaccatggtgatgtatgcctttcgtgcggaacgcaaacacatttccgaaagcgaaacccactttcggaacgcgatggaatattccgctatcggtatggcgttagtgggcaccgagggacaatggctgcaaaccaacaaagcgctctgccagtttctcgggtacagtcaggaagagctgcgcggactcacctttcagcaactgacctggccggaggatctcaataaagatctccaacaggtggaaaagctgataagcggtgaaataaacacctattcaatggaaaaacgctactacaaccgcaatggcgatgttgtctgggcgttgcttgccgtctcactggtg

SEQ ID NO: 38564 - DNA, 832 bp, Heterodera glycines
ttcaatttccaatttgaaattggttaacggtgacggacactaaattggctgtgagacggtcggagaggaagaggcggcgaaattgctcgaaacattccctgccttggaagcgatgcccggcccttcgccattggcaccgaatttgccttccgatgccgacgatggctttggcatgcatcaaccagcgccgttgcagttgcccagccaatttccgctgcctccgcctttgctggtcgttccctcgcccaccttcccctcccaattcgttgtgcctcccctctcccctccgatgggccctccttccgctccgtttaaccccttttcggtgctttcaatttaaaaggccgttaccgctttcttaaaattcgcgcagccaatgtttgagggcattttgccgattgtgcccttacgagacaatccgccgcggcttactgcgctgatggattcgcccattcagcagagagagcgctttcgagagcaggtcacttggacttacaattagcattcaatggcacttttaacaataaataataataataaacagcagcttatggcgccgatgacaacaaaaggaatggcatttttggcagaagaagaggacagagtcacagcggcggaggagccgcagggattacttccgattggcacgaaaactgctgacgaaggcaccgcgcagaacccatcagacgaatcggttgaagacgatggaaaacgacggcatcagctgaaggtccaaatattacggcaccatctccgccatgtctctctttcagcgagtgattcggcctgaatcgcacgttagagaagtttcgacgaacaatgcgcttttatt

SEQ ID NO: 38565 - DNA, 1294 bp, Heterodera glycines
tgggtggggaggggtcgcattggttgggtcaatcgcaatcaaacaaattgatgaatggcacggcaaaaagaagggcatggaaagatggaggggggggggggggagaatcagaggggcaaacgataacgatggcataactaacaaaggagggaaagacaataaatcataattaaggatggcagtgtcgtggaatggcacggctaacaatgagggcatgggaaggcgaggggcaaatgatggcataattagagacgaacgaatgcggcacaattaaggcataattacgtaattaaggaaaataaatctacatgtttccaccaaatacaggtggcggggctaatttgttgattattgtgcgaatttaaaatctaagaggagaaatatataatattgaattgattctataaggttacctttctcctaatttctatcaataatttttcactgattttcccatttactatttttcgttacccctaaaaaattgttttttgtttttttataaaaagcttcgataaattatatactgaaaatcataaataaaagcataggttttcgcagttttgacgccagattttgcttatgcctaaaagtacaatcaaaatatgctttcctttgtcggggtcatccaattttaagaggggtgcgacaattagcaaaataaatgcaaataaattgcgaaatattttgaaaaaatcttgtcacaaaaatgaaaaactctttcatagttcactttaaaatgtgaaataattcatgctaaaataactagagaccggacagggccggattttgccgcgacccgcagcccgggcatggaaaaaggagcggaaaatggcctaattagggagccaaatgtggcaagacaattaaggcgcataattaagtaaggcagtgtcgtggaatgaaaggcatggaaaaactggaaaaatcccggcaggggcctaactctaataatttcactagctttttttcatcattttgatatcatttttccttttaacgtattttttgcataattaatttaaatttgttcaaaatcatttgccttttttctttttttatttacttttttttgtcattaatttttttttaaaattatttgtagattatttttcgttttttagattccaataaatggtcaaatattaattgtaaaattccctatattacagaaataataatttttaaatctgcgttatcatcgatcgcacatgatgtataaaatatagaaggtgtccaagatgtcagatcattgcccttttttggttttagcaacttcaatttgattacttta

SEQ ID NO: 38566 - DNA, 1474 bp, Heterodera glycines
ggaagaagcgaaagaaaaatcccagaaagaagcgggaggaagccaaaaggaaaagcggcaaaaggaaacccggaagaagcaaaagcgcagaaggaaaggggagggagaaagtcaaaagagaggaggaagaaaagggaaagaaagaaaaggaagcgaagacaaatccgaaaaaagaaggcagaaagagaagaaaatgacacaataatcgccaggggaataaagaaaaggcgcttaacagaagcagaaaaggaagagcgaagccagaaggatgccgaggaaaaagcgcgccgagagatcacggatattgtaaaagaagtcgaagaggaggccaagcaaaggcaaatccgaaaccaaaggggcgaacaatggcaagcaattattgatgagtaattaggcggtcaattacaaagaaaagatatttaaatattttgaaaatgtgtcgagatttcgcttaaggcaattttgtattttgtgttttttttgattgccttaggctttctactacataaaagaatgagaggggcccggtcctccccactgcgcctcttcgtcctcctttccttcatctttctctcgcgcttctccgtgcgggaacagttcgtcggcgagctctgaaagcgcgtccgcggcctggagcagtgacttgcggattttgtagatagcttcctccgcgcgttccagtggcatccctttccgaaacggcgcgtatgtcttcctcacggggctcctctccgcgctgcgtgtcgtaaactgcggcactggcgctggagtcggtcttcttttgagcatttcgcgatttaatccctcgggtggaatacagggacggtcatttactgtcccgacggccgatttgagcacgtttgtgaacaagcgcttcccgctcattcccaagttcctttctctgtcccctctttcttctcttcctcttagtttcgacgctgagtccaattcgctttggcactcaaagcgcgccacggcgctggaatagaaaggcctgcgctctcttggcggctccggggggttctcaaagcgctcgttctcctttcccaactcctttgcctcttcttgtcacatttcttctgtgggtttcctctgccagttcatccgtcaattcctcaattttgatttggatcttcctgtgccagacctcctattagagacaccggtcgtaaaaatgcgacaacaaattcaaatagcacatctttgcaaatagcgccggattttggctccattaaatttttataaaaaaatggacattttattcgaacgaacctgtaattgggtgaaccttgccaagtccggcacagcgtccactcgcatttggttgagttcaatgctctaaaatcagaccttgaaatgcttttcgttatccatactctccccattcctactttgtaaaactgacacaaatagcaaaaccatataaaaagtgagtccatagttcgtttttttttcaaaattacccaggcaaatg

SEQ ID NO: 38567 - DNA, 1026 bp, Heterodera glycines
catcggttcggggggactgccccgaaaacaaaaaaatcgattttttcaagtgtccgtttggggtactcaaacatttatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggctcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacatttatggggagcaaaaatccaacgcagaattaaagtacaggctatagggaagctattcccgaaggattcggtctccccataaatctgggcgcatcggttcggggggactgccccgaaacaaaaaatcgatttttcagtgtccgtttggggactcaacattatggggagcaaaaatccacgcagaattaaagtacagggtatagggaagttattccccaaggtttcggactccccctaaatcttgggcgtttcggttcggggggactgcccccaaaaaaaaaaaacagaattttttca

SEQ ID NO: 38568 - DNA, 1162 bp, Heterodera glycines
gagtgggaaacatgatttcaaaattttcaatttttccttttataatctactcaaaacggctcagaattcaataaaaatcacattcacggtgcgaaaaatggggtttgaaaagtttattggggaaaaaagactttacaaaataatacccctgggagaagggagtgggaaacatgatttcaaaattttcaattttttctagtctaatctactcaaaacggctcagaattcaataaaaataacattcacggtgcgaaaaatggggtttgacaagtttattggggaaaaaagactttacaaaataatacccctgggagaagggagtgggaaacatgatttcaaaattttcaattttttctagtctaatctactcaaaccggttcagaattcaataaaaataacattcacggtgcgaaaaatggggtttgacaagtttattggggaaaaaagactttacaaaataatacccctgggagaagggagtgggaaacatgatttcaaaattttcaattttttatagtctaatctactcaaaacggttcagaattcaataaaaataacattcacggtgcgaaaaatggggtttgacaagtttattggggaaaaaaagactttacaaaataatacccctgggagaaaggagtgggaaacatgatttcaaaattttcaattttttctagtctaaactactccaaaacggttcagaattcaaaaaaaaaaaatttacggggggaaaaaagggggtttgaaaagtttatttgggaaaaaaaaatttcaaaaaaaaacccccgggagaaagggagagggaaaaatgatttttaaaatttttcttttttttcttgcttatcttccccaaaaacggttctaaaattcaataaaaaaaacattttccggggggagaaaaagggggtttgcaaaagttttttggggaaaaaaaaattttaccaaataatacccctgggaaaagggggggggaaattttttttaaatttttttttttttttttttttacttttccccaaaagggttcggaatttaaaaaaaaaaaaatttccgggggggaaaaaaggggggttaaaaaattttttggggaaaaaaaaattttaaaaaaaaaccccctggggaaaagagggggaaaaatatttttaaaatttttttttttttt

SEQ ID NO: 38569 - DNA, 884 bp, Heterodera glycines
ccggcgcattgcttcgctcccaaattggtccctctccattggtggctctctcccgtagcattcgtccactatcattagcccgcattgcaaattccggtcgatgatccaattcgtctcgaagtcgtcatcgtcctcacctaaacaattatttctttgccttccgaacattcagctgatttgcgtgcccattggattcagcaaaacttcggccacttttatccatcccatataaaaaaagaattgcaaaatggtcatcagcggcacaattatatcgactttctgtgaaattaagcaaaaagtgaaacaaaataatattcaattaccaagtgatggtctcccaaattccgtccaccgaaatctttgagaaattgtctggcaaaaagagcgatgacaaagtaaagacggacggccaaattgaccacttgggtgtacacctttttagaggagggggagggggggacaaatggacaaaatgatcagacgaaggcaattagcaatgctaacgagaacaagacagttcatcacgtacacatcatttagatacttaatatattttaccacaactcgccaaccaatgggacaaaagagcaacgacaattggtcacttggccttttacccgtaacccagtgatcaatgccaacaaaagagcaaatacaattgatcattggcattttgccaaaggcccaccaaccaatggaatgggcacccaatcgtacagtgtcagcgtcagcacattcacccgatattggcgtattttctgaaaacaattcaattgattcgcttttgccgcttctctttcctccagtaaatccacgtaaattatgtcactttcgatcatcccttgatcccgcgctcttctcgccaacagaaaggcccactgaat

SEQ ID NO: 38570 - DNA, 299 bp, Heterodera glycines
ggctcccggtaaattggacactatttgataaaaaataaatagttaaaaataaataaacaaaaattttaattgaaataaattatgttattattatttgtagcatcagcagcagaaagccatcatacattcataacgaaaaaagtttttatttttatggagttcccattttttgcgcattttttggtagaacaatcatcacgcaattttgcacatttttttgccacatttgatcaatcattgtgcatattgaatgtttaaattcctgggtttatattttaaaagaggaatttggtggccaa

SEQ ID NO: 38571 - DNA, 1368 bp, Heterodera glycines
agtcggtcagactatacaaattcttgaaaacatgtagcttcattgtttgtgaccagttccacaaatccgcaactatcaaaggagttcacacgagtataaacatctttaaatcgaaaaaattaatgaaacgggttttgaggaaaacattgataaaataaatgaatgtattaaaaataattaaaaaaaattatgaaatatattttgaaaaaagaaattaacttaaaaaaattattcaaaaaattgaaatgaattaaaaaaacttagaaaaatgagaataaaaattatgaaaaaattaaaaaattcaaacgatcaaaaagttatgactaaaaatatgcgaaaaacctgttttgtgatttcctttggccataacccctttgaaagttaacgaaatttttgaaattttacaagctaatcatgaactctcttagagttatcgaatgatatcaagaatataaatttgctatttttcagcaagtttatcagtaattttttgtcattttcaattttataaatatgaccatgcgccaagaatttatctgcaaaaacatagccaaaatttccaagccaaaattttattaaatagaaaaactagtatatgcaatcattaattatttggctgattcgtgctggaatggtatcataaacctgaccattaggtacatttcgattaaattaaaatcttttaaattgtaagaaaaaaattttcagttagtcataaatttttattcttaccttgcctaccaagaattttcatttaattgttcaaaaataaaaaaataagcaaatatcaccaggaacgtatttcctgtaggatcctgcttttgggtgatacgctgcaattacaatgccaattaaataatacaatccgtttcgttcaatcatcaaagggccgccacaatcgccctaaataattattacgcataatattattaaaattcacacatttttttgaatcaaaattgacagaaattttaaaagcaaaaaaggcattagtagtcaaacaatgccaaatgtaagctcgagaaaaatcacaaaatgaagaaaaatcacttacattttggcaaccttagtttcaagaaaacaatgagaaaatgaatgttatcaaataaaatttaaaaaatcacacctatacatttggaaacctaaaaaactcggacacttttcgacattaaatgtccagaggattatatgactaactgttgttcaaacaaataaatttacttacgcttgtaatgcccttatttctgctgcttgcgcatacaaatttgcttggattgtatttccaaggcaaaatgttgttgtaaattttgttgcaataaattgcggaccgtattggcactaaagttgctgtctggcttttgtttaagt

SEQ ID NO: 38572 - DNA, 996 bp, Heterodera glycines
acgaatcaattcaagacctgctgaaggagaagggtctctttattttgtgaatgtttcagcattcatttagttattgcagattcggagaaagggaaagtgcccgaaacgaccgacggagcagtgaatgtgccgatttcttctgaaggggaacaatcgccgaagcaacaggtgttgacagacattcttttttgtaatttaagcgaattattattgttgaaacagaaaacgagcgacgaggagggcagcgcaatggcagtcgaagagacagtggcggacgtaaaggtggggaagagaaacgaaagatggaaatagtgacaaaaaaagagggacacaaaaaggagacacaacaaataaataaccaacaaacaacccaacagagtgtggccactcctcagcagcaccaactgcacaaaacgtgttctgtccactttcgaactgtgccggcaaatgctccaatcgctgatttggaaaatgtaattgcgacaattcgtgagtgttattgcttttgccactttcagctgtgtaagcagcaccccggctttcttcggcttgccattggtgacccagtgactgactcgcgcggtgttcgccttcggcctgcctgggccacttaccgaagagatgtgaacatccgagagatttattgggcactccgaagagccaaagtaattttttaaaggcatttaatttgatttattatttctcaactttgagttgatgacttccgatttgggcacccaagtcaaccgtgacctaaagcgtcgaattcgcgtcagcggtgactttgtcccatccgtcgccactctctcagcgttcacttctcccattgactctcaccgtccaattgcgtccaatacgcttcgccaagctgctcggcttgtctttttgttggatgtgcgggagggactttaccgggaagaggcggaggatggtgaagacgaaggcggacggagcttcgacatgggcgaatattaacggagtctatggtaagttctg

SEQ ID NO: 38573 - DNA, 1139 bp, Heterodera glycines
  misc_feature (866)..(866): n is a, c, g, or t
  misc_feature (886)..(886): n is a, c, g, or t
atttttcgacttttctgaaatcccggttatgaattccctttgaagaggggtcgaaaaacaaagtgcgacccttttaaggatgcattttaagcgatgcgtctcgtataaaaactgaggctattgtttacatatacataagaacttgaaattaagactttagggcatcagtttaagaatcctgcaccaaaatgaggggattttggatcggaattttgggatctttggagaggattcggatctacctaattcgacaattcaaatttttcggtagattaaatttttgcactttatttgcacattcataacatacacacatacgatcactgatcaggaggggaacaaaatatacattaatatgatcacataaaacaggggatttatgcgggctcggcgtcttcgtgaaggctgtccatcagttctggcttccagtcgttggcttcgtcgttttcgaagcatctccgcctgccgtgctcggcggctcttcgtagaccgtcgtctgtcctgccgtgctcggcggctcttcgtagaccgtcgtctgtcctgccgtgctcggcggctcttcgtagaccgtcgtctgtcctgccgtgctcggcggctcttcgtagaccgtgagaactcctgtgctcggcgtcgctccattcaccacttcaggggcctccgttctcggctgctggacttctgcatccgttctcggctgctggacttctgcatccgttctcggctgctctttgctggacttcttgcggtcgccgctcttgtcacgcttcttggatgatttcttctgcttctttttgtcgctcattgtcgcctgttgtttgctctggaacaaatcgaaataagtttaaacttaaacaaaaatgagaggngaggacggtgctcaccgcanagcagtgatgaagagagctgatgttgatgacgtggggtgctgacttgacgtgaaatagaaggtgaaagtgatgaactcaaccaaatttctccccttttaaggacccaaaaaaacagtgtgacgaatgtccgcaaaaactttcgcaacgactttcttagaatagttggcattatggtttattttaaaaaatttccattttcagtggaaatgacctcggacgaggttgaggacgcaattcgcaaaaacataatat

SEQ ID NO: 38574 - DNA, 1438 bp, Heterodera glycines
  misc_feature (42)..(42): n is a, c, g, or t
  misc_feature (55)..(55): n is a, c, g, or t
  misc_feature (99)..(99): n is a, c, g, or t
  misc_feature (164)..(164): n is a, c, g, or t
tgaagttaaatttcagtaggttaagtcatctcgcctattcgncggtaaaagagancccgcctttttcggcggtatgaaagcggttcaaatcagttaatnttcgaaacctaaaaaagttttatattctttatgttatagttatataatttttaaattattttgtntaaataacagttatacatatatatttttttaattcttagctgttttgtttcaatcatttcattcttcgaactgcaccacaaaaatatcttaaatgagttattttatcctttattttttcttattagaatttaaaactgattaattcgtgataaagtaaatatttaatttttctattttgaactttttattattcttttaaaataagagatctttatcaacaatttcatatggtaacaatttataactattggctataacgcatatttagaatttaagtttctttttttttcttgtttttaaaactaaactcttcttctaatagctccaaggcgctatccatattttgagtgtcttaaaagtttagatttctggtcagagtacgttttatttaactacagaaatttattactttatttccaaatgtttgtggtttaatgtctttctttggtttttaatattgtattttttgctatttaaaaattattttttcttatttttatatttttactcatctgtgattatatgattttgatcttaattaattatctattttttaaatttgctctttttgtatttatatttttggattttatattgataccttgaaaggtgtaacaagcaatttcgtatggcgattattcattttttttattaatatattataaaatttttctattaacaaatctatcaattgaatattgtttagttcaaattcataaacttaaatactgaccttgcttaacttggtatttgttgaattaatttattcttaaggtattctgatttattcatttttgcaaatttattaattatccatagattattaaagtattttcatttttgaattaattattttaaattctttattaaataaaaaatctttctcttcatttcatatggtaaaagtggagcatctgttgtgatctctttattttaattttatatcatttattttaatttaatttattattattattatttcatttatcttattgttttgtaaattttgcagagtcgttcttattttttatatcacttgtgatcttgaatgaaaataccagtcttaactcggaaaggtcgcaaaaagattatggtttatattgcaaattttaacaacgcattctggaagactatttaaaatataatattttgtatttatatttggcgctttacttttttctaaaaacataaaattaaatttctgtgctttagttataatatctggtataggtgaaatgtgtgctgtggaacataatcatatgttctaattttt

SEQ ID NO: 38575 - DNA, 1109 bp, Heterodera glycines
  misc_feature (32)..(32): n is a, c, g, or t
  misc_feature (734)..(734): n is a, c, g, or t
agcaaaaatccaacgcagaattaaagtacagnctatagggaagctactcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctactcccgaaggattcggtctccccataaatctgggcacatcggttcggggggactgccccgaaaacaaaaaaatcgattttttcaagtgtccgtttggggtactcaaacaattatggggagcaaaaatccaacgcagaattaaagtacagactatagggaagctattcccgaaggattcggtctccccataaatctgggcgcatcggttcagggggactgccccgaaaacaaaaataaatcgattttttcaagtgtccgtttggggtactcaaacaattatggggagcaaaaatccaacgcagaattaaagtacaggctatagggaagctattcccgaaggattcggtctccccccccccnccgcccttcaaaattttgaaaaataaataaaataataggagactcagaattttgaaaattttttataaaaactgatgacaagctaatgtgataaaacaggttaattcttttcctttcagtatccctgcaaagtttggggcgcttctgataagtttctgaaaaaaaagataagcctaaactttttggcctgtttaaaaaggaattaaaaatttttaaaaatttattcattccctttttgatagaaaaagcatcagagtgcctaaactagcatgtaaataaaatttggtgcgtttcagagcattttctgaaaaaaatatttatgaattaattatgcaaagaacaaataaaaacgaaagactcagattttcgaaaatt

SEQ ID NO: 38576 - DNA, 1247 bp, Heterodera glycines
gatcccgaaaagttttttctttttgggggggggttttttcgtttttttttggaaaaagccaaaataaggattaaaatatggtataaaacctggaaatatggaattggaaaggcatcttaaaagcatcaagccaagctaaagacactatttaagtgatttttaggcctaaaaaaactgcaaaaattttttatggaaaccattcaaatccggtccctagtgatcataaaaaaggatatggtgaacaattagtatgtatgccatcatggtatacaacattgagttgtgcacaaaaccagtcattgcacatgccaaggcaagccacagagatggtgacatatcacggcgaaagcggcggcgaacatggcgactactgcttgagcttgttggtggaggggcaaaattttccgaaattttcttccccgaatttcctgaaaatttttcgacagttccaccatttttgttggtaaagctcgttatgattttgttgagcaaaaatgccacaaaatcgcttggcaccagcaaaagttggtgctgatttttcccatttgataacgcttcaactgtttgccggagggcatttggtgcccatttgtccttctcctcagtggacaattgtgccaaaaatgccgtgatcagtgtgctaaattcggacaacattttggcattttgttgcccaatttccttcgctttaatctgcgccaaagtttgtgggccactctcttggaaagtgtgaatcaattggtctgtgaagcttgccgcgcgatttaagcatgcttcattgttgactttttctgcaagccgaccaattaagccatgcttttcctcgttgattttccccaacaattcacatcctttggccaacaattccaagtgatcggcatttgataattcttcaaaaaaataaaaacaaataaaaacaaatatttcggtcacaaatttttttaaattaaacaaattgcctaattaaaaatttttaatttgtttttttttgcagtttttctctaaacaactacaataatatcaaataatgaaaaattcagtattaatcccaaaattttgcttttccaaaaagaattttgcctgtcaaccctaatgatatgtacatttatttgatagcccgaattaaattaattaattttatttccaattaatatgtatgggccgtaatttttgtattaaatttttgatttttttttgaataattgagatgaatatatttcaggatttctcaattaataagtgtttgt

SEQ ID NO: 38577 - DNA, 986 bp, Heterodera glycines
  misc_feature (921)..(921): n is a, c, g, or t
gctgccggttttgctggcgcgttcttcgtgaagatgtcggcgtccatgttcttgagggtcacgtagttcgaatcagtcgctgaaaaggggatgaaaaagaattaaaattttaaaatttcgccattttttcacttggtgtctgtgccggtccgcctcctccatgtggcgcctgtcccgcctttggtgccgctgccggttttgctggcgcgttcttcgtgaagatgtcggcgtccaagttcttgagggtcccgtagttcgaatcagtagctgaaaggggatgaagaattaaaattttaaaatttcggcattttttcacttggtgtctgtgccggtccgcctcctccatgtggtgcctgtcccgcctttggtgccgctgccggctttaccagccgtccgcctccccactgcgaactcatgttcaggtaatccagaggaaaatcatatgtcaaattttgcgatgcggtgcccagtgccgatgttcctccagccggtgccgctgcggtcttctgcgatgcggtgcccagtgccgatgttcctccagccggtgccgctgacttctgcgacatggctcctccggcggctgacttctgcgacgcggctcctccagctgccggttttgctggcgcgttcttcgtgaagatgtcggcgtccaagttcttgagggtcacgtagttcgaatcagtcgctgaaaaggggatgaaaaagaattaaaattttaaaatttcgccattttttcacttggtgtctgtgccggtccgcctcctccatgtggcgcctgtcccgcctttggtgccgctgccggttttgctggcgcgttcttcgtgaagatgtcggcgtccaagttcttgagggtcccgtagttcgaatcagtagctgaaaggggatgaagaattaaaattttaaaatttcggcattttttcncttggtgtctgtgccggtccgcctcctccaagaggtgcctgtcccgcctttggtgccgctgccgg

SEQ ID NO: 38578 - DNA, 771 bp, Heterodera glycines
ttgaacactcattccctccccccccccccccccaaatgtccgtcggttgtcccgcaaacttttgcatttcgtcctcaaagcaatcgaaaaataaatgcacacaaatgcattcttattactcctaataaattatagattaatccaataaagtggaagcatttagttttatttatttggaagggaattaaaattttagaaaaaagaaaaaaattgcagaaaactttttaaatggaccaatggacaggtgtattcggccggcgggaggggcgaacgagaatggcatttgtttgccaaggtttttcccatcccatccatcgcatcaacggcgaacggaagggtcagcaggtgccaaaacaatggacagacagagggaatacaaatgacaaattgggcacttattgggggggggggaggaaaagcaaagacaaacaaatggagaagaagcagaggatatgaacgacggacatggacgagaagaagcagcacactctgaagttgatgaggaagagagggagagaaaggagagagagagagagagagaggggagaaagacaagagagacaacggaggagaagagagacaatgggcgagaagaaaagggagagagaaaaagcggagggagggtacagatcggcacagaaaaccatgctaatagataaacgattaaatggtgctattttcctgtcattccttgcttttgtactcgccctaccaaaaattgttttgttcttcatgcaaaagcggtagccaaagagtggccccgtctcttat

SEQ ID NO: 38579 - DNA, 876 bp, Heterodera glycines
attcatcggagactcccatcaatcaaaacattgggaagcgattagttaatagcacaaatgaccgataagcgaataatatgcattttattatgataaagccggttaatggggggggggattaattaggcattcgaagcattcaccatttatgatggatttttgctgtcagttgatttccatgacaattttagtaatgaatgcgagaatttttttctaagccaacaaaatctccccactcattcctttttttattggggaatgtcacattgccaattagttaatttatttatttcgtttttttgtaactcacattccttgcgcgactgaatggctctgactgtgtatttgcccagcaaaaaggtggagaagcaaagggacagcgcgagagatccgtactgaagaagagaaagggaaaaacggacgagcagagaaagaagggacgaaagtgcggagaacagagaaccaattttgcccatttgggtgaagaagaaagtgtaaatcgtagtaacaaagcgaagaatggaaggaatgaattaatctgctgatttgaaaaagttgggtgaaattggtaataaaaaacagaagcaaaagagtcaacagagtaaatcaaaaagtggtaacattatattagcattcttttatcttttgtgtgatttatgccctttttattttattgtttttttcaaacgaaaattacaaattttgtggaaactgatacagatgcaaacaacggagtaagtaaaacacagatgtttgactctaaaatgttgtgaaatttggaactaaatatatgtaatggaaggagcgtaaacaacaaaagcgaaagtgaagtgaaaagagagtgccgggacgaaatgcggcggtccatcgctgacc

SEQ ID NO: 38580 - DNA, 846 bp, Heterodera glycines
atcatagaattattaaaacatgtacttcaactgaatttttttatttgacctaatccatatgagtattttttccccgagcatatgtcgggccgggagtttttaaaaaaccatgaccaaagatggaaagatggccgagagtgtcaagggccaaaattatcaaaaattcggttgtcaattctttgccacctcaaatatgcgaatgctacatatgttttgaatagaaaatattagagtgccacggaccgggaattttgggcaaaaccgggaccgggacctaatcgggttgaaaaaccgggaatttttggctgggaaaaccgggaagaaaccgggaatttcccggtcccggtcaaaactgttcaaaaccgggacctcggtactcagttgtccgtgttttggtcccggtcccgtggcactctagaaaatatgacatgactgttttatgtcagtgatttttgctttgttaaattaaactgttacaatatccctaatcctcctatttatgttaatttgaattgatcagaggtgtttaaaattcgagatggttcgtgaacaatgattaaaattattcaacaaaaacccaaaaattttacacaagggatgggaaaactgaaaatgtaccgacgagtcaaatccactccgattgatctgattgatgcacttgccaatcagtgccaggtcgcacataatgctggggctggctgactttgtcggtgcaccaaccacaacaccacaacacttgaacagtcagtgttgatgtgggtaaaagatgaaggccgtatttgcctccttttacgggacgtccgtctcccccgggggccgaagggcgcgagaagggggggggggggg

SEQ ID NO: 38581 - DNA, 1447 bp, Heterodera glycines
  misc_feature (1437)..(1437): n is a, c, g, or t
tgttgctgctcctctttggcgtccgttggtcgtttggtttcgttggttcagctcagtcgtccattctcgccactcccttctcacaaatcagcaaattatcgtcggttttcgtctcccaatttgtgcggagactctcttcaaatggaaaattgggataggaagtgacagattgtgacaaattcaaaactgagccaaaaacgatcaatggctgtgaacagtaaattgaaattggaaaggaattggtcggacgaatggagggaaagagagagaagggaattgtaagaggaaagaaaagaaacaatgaaacgattattaattaattaattaatgggggggacggggattaattattgtttatggaaagagaagcgaaggccgaagaaaaattggaatggaccgcaaaagagcagcaccagcagcagtgggcccttctgctgctggacggacgaaattaatccaattttggggtgcgggaattgcatttggaggggcgagagaaggcgggcacagagtgtccgcgaggattatgcaaatttggcgaatttgagtcgagcagagacacttactctgcccacggcgaagaagcatcgattgagcggaaaatgagcacaaatttggaaaagaaataaggaggagacaaatgggggggggacagatggaggacacgcaattggatatggaaatggccggagggcaaaaccaaaagacgcacaattagagggaaaaagcgtccattaaaggggaagtcactctcttctgggacaagccaaatgggctgattctattgttttttaatatatttttaaaaagagaatattgttgatgttgaccgatggatgggcacagcaaaaggacacaacgaaaggcccgagaagccgaagaataaatacgaaagggaaacaataaagaaaagcatgggagagagagagggaggggaagaaagcgtgtggattaaggaggatgagaggaagaggaagaagcaacagcagaagaaggaagaggcgatgagttggggggggagagaatgggagaaggagtcccctctcttagcggtgcgaatctttccgagtaaacactcgtcactccccgggggagaaagtgtttgcctaaacataaatgagggcaacacagaagtgccaaaccgaagtccgctttattattattcggggtataatcaaacgaaatctcagtttcgtcgtctttggctaaaacattcgattaaatgtttaatattacaacgaaaagttaaaaaaggaaagcgatgggttaaaacaatcggagattagcaaaagcagcacaacgaatgaatgaacacattttggaccaacgaatgcgctttgatggtatttaaagtacgggcgaaaagagaagaaaatatttaactgccgacggtcagacggacggacggagggaaagggggaaaagaggggaggggangggggggggg

SEQ ID NO: 38582 - DNA, 897 bp, Heterodera glycines
  misc_feature (63)..(63): n is a, c, g, or t
  misc_feature (877)..(877): n is a, c, g, or t
tcaaagggtgtgcattaagcgactcgctgtgctgcccactgcatttcaaatagctggtaattntattctccggcctaatccagaaaaaatcactatctctttttttggaatattttacgtgtcaaagggtgtgcatttaagcgactcgctgtgcttgcccactgcatttcaaatagctggtaatttttatttctccggcctaatccagaaaaaatcactatctctttttttggaatattttacgtgtcaaagggtgtgcatttaagcgactcgctgtgcttgcccactgcatttcaaatagctggtaatttttatttctccggcctaatccagaaaaaatcactatctctttttttggaatattttacgtgtcaaagggtgtgcatttaagcgactcgctgtgcttgcccactgcatttcaaatagctggtaatttttatttctccggcctaatccagaaaaaatcactatctctttttttggaatattttacgtgtcaaagggtgtgcatttaagcgactcgctgtgcttgcccactgcatttcaaatagctggtaatttttatttctccggcctaatccagaaaaaatcactatctctttttttggaatattttacgtgtcaaagggtgtgcatttaagcgactcgctgtgcttgcccactgcatttcaaatagctggtaatttttatttctccggcctaatccagaaaaaatcactatctctttttttggaatattttacgtgtcaaagggtgtgcatttaagcgactcgctgtgcttgcccactgcatttcaaataggtggtaatttttatttctccggcctaatccagaaaaaatcactatctctttttttggaatattttacgtgtcaaangggtgtgcatttaagcgact

SEQ ID NO: 38583 - DNA, 1467 bp, Heterodera glycines
  misc_feature (17)..(17): n is a, c, g, or t
  misc_feature (1433)..(1434): n is a, c, g, or t
  misc_feature (1458)..(1458): n is a, c, g, or t
attaaaaattttaattntggaaataaaaccaattaaaaatctttggcacctgccctcggaaatgttcaaattcactgcgggcaatgctgggtcgtcttccgatgacatgaacacaaatttgttgcaccgttttgcccatgttgccttcacgtgaatggcccgcttttggtggttctgtttgcccgtcaaaatccagcaataaattcggacccgttctgcaatctcttccgccacactgttttcgcctgaaacgcccgcacaaaaaaataataataaaatttttatataattaataaataaatttattaaaaatattatttaaaaaaaaacaaatttcaataaattatattttttattatttattttgaaaatttattatgctttttcaaagtgacagaattagcaaatcgaaatttatcctgcggcatacagagttttaattataaaaatagaaattttaatttaaaaatgtaccattttaacaaattaaattaattgtttaagaaaaaataaataaattttagcttaaattaaaatatttttaaaaacttaataattaaattgttcaaataaaaatataattaactttctaattaccttcattaacatgggaaccgtttgtgtggaaaaacaacggtatgccaggtgccgctccatgctcatcatcattatcatcgacctcctcctccgtgtgcggatcaaatcgacgacgatgctcatttctatgctcatcaacatgatcatgattatttaaaagctcatctcgttgctgttgctgcacattagcattgcgctgtttttgttggtcttcctttagaaaaataataaattaaataatattcttggtaaattttattttaattgaattaataaattaaatccgattttagaaaatgtaaatgaaattatgaaaaagtaataattcattcatttcaaatgaataacttaattttacttgcaaaatatgttttgcatagctttcatattcctatcattaattttttttttgttcattgctataatttcctattttttaaatgtttttttctatgtaaataaaaaaaagttaatagcccaaaaattaggtagaaacaagaaaacatatctctattagatacaaatataaatttctattttttataaattattttgtgttttttaaaattttatttataataaaaatattctttatccaccttaatcaacaccactggtctggaatatgtaggcaatttgacacttggaaaatcagtggatgggaaaagcgctaatgacaacacaaatccaattaacacaccgatcaacaaattaagcagtgctgatcggttgttagccaacattgttttaattaagcgggagaaaaagctttcaacaatgcaattaaggcgattttcatttgagcatcatattttgttggaattaattttatctannattagagaaataattttacattanaaattatta

SEQ ID NO: 38584 - DNA, 326 bp, Heterodera glycines
taaataaataaaaagggaaaatatagagagaaatagagcaatagagaaacagggtgaggagtgagtcaaggattataaaagaataagagagagaaggaaaaaatagagtcagagaaatagagggagagagagacaaagcacagagaacacaagaaagaacagagttctcgccgatctccgccctcatcggcgccgcctcattagcgacagccgaccgaatttagacagctgccgcgccccgccccgccgaggcgacaaaactctctcccccccccccccaggggccgccgccaccggcgcccctttttcgctgttcgtttggtggc

SEQ ID NO: 38585 - DNA, 462 bp, Heterodera glycines
aaccgaccatgaaggccattttaggatgtatcgcccatgaattgaataacacataaaattgcattgaacgattaagctgaccagcagacacattctaaaacggccttcatggtcggttttctgtttatatcgtacttgaattttggtgcaattttcggaatttcgaagccattttttcaaatagcgaaggcaaatttagccacataatagctcaaaatcggccacagatctcttggatttactattatcacccgttataacgagctatcagcgtgtatttaaggccttaatgctctcgaatgtctattttccgtgatgaagttatattcatagggtattagcgaaatatctgttgttttcaaattcacgtttaacataaaaggaaggtttaacagaatgggtttgtcggtatgatgctggtctggtttttcgtttaatgcaattttctgtgttatccaatta

SEQ ID NO: 38586 - DNA, 1013 bp, Heterodera glycines
cccagtgattgaaatgctgttgggttgagtcccagtgatggaaatgctggtgggttgagtcccagtgattgaaatgctgttgggttgagtcccagtgattgaaatgctggtgggttgagtcccagtgattgaaatgcaggagaattgagtgccagtgattggaatgctggtgggttgagtcccagtgattgaaatgctgttgggttgagtcccagtgattgaaatgttggtgggttgagtcccagtgattgaaatgcaggagaattgagtgccagtgattggaatgctgtgggttgagtccaagtgattgaaatgctgttgggttgagtcccagtgattgaaatgctggtgggctgagtcccagtgattgaaatgctgttgggttgagtcccagtgattggaatgctggtgggttgagtcccagtgattgaaatgcaggagaattgagtgccagtgattggaatgctgtgggttgagtccaagtgattgaaatgctgttgggttgagtcccagtgattgaaatgctggtgggctgagtcccagtgattgaaatgctgttgggttgagtcccagtgattgaaatgctggtgggttgagtcccagtgattgaaatgcaggagaattgagtgccagtgattggaatgctggtgggttgagtaccagtgattgaaatgctgttgggttgagtcccagtgattgaaatgttggtgggttgagtcccagtgattgaaatgctggtgggttgagtcccagtgattgaaatgctgttgggttgagtcccagtgattgaaatgttggtgggttgagtcccagtgattgaattttggtgggttgagtcccagtgattgaaatgcatgagaattgagtgccagtgattggaatgctgtgggttgagttccagtgattgaaatgctgttgggttgagtcccacagattgaaatgctgttggtttgagtcccactgattgaaatgctgttgggctgagtcccagtgattgaaatgctggtgggttg

SEQ ID NO: 38587 - DNA, 1424 bp, Heterodera glycines
cgaagttacgaatctaatttgccgacttcccttacctacattattctatcgactagaggctgttcaccttggagacctgctgcggatatcggtacgatcaggcaggagattcaaatagcttccctcgcattttcaagggccgtgtggagcgcacgagacaccacaggaaccgcggtgctttacgggcgcaacatccctatctcaggctgagccacttccaggcacgcacaccctaaaccagaaaagagaactctggctcggactccacacgacgtctgcgagttcatttgcgttaccgcgcaaaacagctcttgcgaaccgtcatttccctagcctggcgtgggaatgttaacccacttccctttcggcaaccggatggaccaactgcgcaagcacagaaaagtcgtcatccgtagtgtgttacggcgttagccggtgccttaggatcggctgacccacattcaactgctgttcacgtggaacccttctccacttcagtcttcaaggatctcacttgaatatttgctactaccaccaagatctgcactggtggaagctccggccgggcccacgcccaaagccttcaacgcaaccaccacgaccctcctacacgtcatggccagactacgcgacaagcacgtgtacaagccaatgacggtggagtataggtggcccgctccagcgccatccattttcagggctagttgattcggcaggtgagttgttacacactccttagcggattccgacttccatggccaccgtcctgctgtctatatcaaccaacaccttttatggggtctaatgagcgggcactttggcaccttaactccacgtttggttcatcccacatcgccagttctgcttaccaaaaatggcacacttggagctcaaacattcaacgcctgggttcagagtcaagcaaccctggcttcatacccatttagagtttgagaataggttaaggacatttcgtctccaagtcctctaatcattcgcttttccgagtatacctgcttaacgagctccagctatcctgggggaaacttcggagggaaccagatactagatggttcgattagtctttcgcccctatacccaagtcagacgatcgatttgcacgtcagaatcgcttcggacttccaccagagtttcctctggcttcatcctgctcaggaatagttcaccatctttcgggtctcagcgcatactctctgtctccgccccatcgcatgcgatcgagacgggactatcttgctccccaacaccgcagtgtccagggatcacacatcagctccgtaagaagccttcactttcattgcgcctttgggttttgaacacccaatgacttgcgcatacgctaaactcctaggtccgtgtttcaagacgggtcgaacagatgaccggctatacaccgagaagac

SEQ ID NO: 38588 - DNA, 944 bp, Heterodera glycines
  misc_feature (901)..(902): n is a, c, g, or t
tgccaaatgtggaaatcggtactatgaccaagcaacatactgtgccatggtgaagaaaattctctggaaaaaaattaatttaataaaattttcaggttcatttttacgacaatgaacccgaaaaggagccaaatggggacgaatcaaagcgtaaaatattaatgaacattaaacacataagtagagcaagcagtatggagatgaaaaccttcttgatttaaatgcagtaattcctgaacgaactttattaaaaatgggcatattgtaaaagaaaaagtaaattattagagacaggaaaattccaaatttgcgcatttcgctgcgaaaaattggagctcaaaaatttttgcaagacgtaactcccggagattaatcctgcaaaatcccgcgcgggatcccgtcccgcgccgctctcctctataaatgatgacaattcaaaaaagctacgaacggactccaaaattgtgaacctttgatttcatttgttcaaaaaagcaaagccaataataaaaaataataattaaaatccttaattgtcccgtactatcttgccaaaaaacccttttctttgtaggaactctcgtacttttggacggttgcatcaaaacagaaactgctcaaaattgtacagcaaatgtgcaaattgcatatgaacgtatcggcagctcgtttttctacggtaattgcgacgctgaaaagaaaacggtatttgagagcaggtgagcaatcagacgaaacatttaccataattgacttgttatttgctaattcacaaatgagaaagcttccctttttgttcagcacataagtagggatgtcaattttatgtaaaaaaaattgctttttctcaaaaaaaagaagtgaatatgaaaaaagaaattttggaatcataactctgaanngttaattaatgctctatgcattgatcaataattatgtactga

SEQ ID NO: 38589 - DNA, 1209 bp, Heterodera glycines
  misc_feature (1114)..(1114): n is a, c, g, or t
  misc_feature (1138)..(1138): n is a, c, g, or t
  misc_feature (1186)..(1187): n is a, c, g, or t
tgtccgtttggtatgacacaatgccataaatgacttgcatacaccgtcaaccgctgtgcaattgtctgggttgcaattgtgatgatgaatcgtaagaaaatactcgtcaaaacgtgcggacatgactgattcgaagagcaacgaatcggaatgatagcgtggcagcagaggaaggacctgtaaggcataataaataaatcttttatatataataactgacacacccggaatgaagtcaatttcttaaaaaatagtgcatcgtcgactttctgaaacaaccaaattattttttggataaatttgatagggggtgaaactaatgaaaaaaactaaaaatggaagaatgaataggaagagatcatgatgtatttgattgatttgcgccagtctgacggcttcattttgtgattatggtgttatcatattaatgcggatagtaatggtgcgaggagacccgaaatcccatgccacttttctaccagaattggcactggctttcgccaattttgtgtttttttgctgctcgaaattagccggtaaatgagtgagcaggtgagcaacaattgccgtgcctccaattgggtgctcggcacacacaaaaccaactcaaaaatgatttcgtgtgggagccgtcgacgattttcgtgccattttgcgctcgccgttttgctgtccttttttggtgtttcgatggtgtttttgtacatatttgttggttggcaacgagttttcttctgttcgccttttattttgacgtcgtcgatggcaacggttggccaaccaaagttgttgatgacagtccagaaaactgataaacgtgcaatttagaattgactcaaaattcgattaattccgtctgattaattgcgtcatctgatcaatcagtatcacaaatcgattatcattgtcttcagtaagtcggcatgtcaaaagcgtgccgattgtgatgttttcgactgccgttgagcacatcttggtcttcttatgccgaaagcatccgttggccagaatttttgaaacacagactttttgtatgaacaacaggaaaaattgagcaacccaatcaaacttaagagaaaacgccattccccccagaagaaattgagagggttanaacgcaaaatttaataaattgaanattagaatgactaggaaaatttcacaggcgaccataattgattcatgnngaattacataaaaaaaacaggt

SEQ ID NO: 38590 - DNA, 587 bp, Heterodera glycines
tttccgatccgaacgcggttgctaatgacccctcccttctcctgcagcgtaaattgccctaacatcctctcactttctctctcatctatctctctcgctctgttccctcctctttttctctctctctttctctcccctcactctctcactttcgcagcatatttcttcgccttccacttttactatcattaataacacattgtcatcatattatcacatcatttcgatcatttcgctgtcatcctagaagaaagcattcccagcagcggcccccgtcatttagcgcttctttcattcaccgccgccatccgtcgctttgccacctcctcagcctcagttgtccccctccggggatgttggtgggaattgaatgatggatgcaatgaatcaatcagcccctcccgcccccccccgcccttccttccccgaggggttgataagtgaagcaatcccattggtcgatgagggagcatgactatctattgatggtcattaattcggaactaatgcgacattgtgactggggtacctgatagtattgtgtgagtagatgggaaccatttttgtaaagaccataaactgtaaaa

SEQ ID NO: 38591 - DNA, 1114 bp, Heterodera glycines
atgaagtgactaaaatttgagcactctaagtggacttgaaacaatataaattttttcgattttcattacattaactgcttaactccgaaaaatcacataaaaaactactttggagcatcaaattctcgaaaaaattattttcagacagttcattatagaaataatggtcggtaaatgtcggtccacaattttctgctaaccaaattaaaagcatataagaacagggagggcttccatcgaaaaatatcagaacatcaagtccaacaaatcaattttggggtcgaaaatcatgatttccatatttggccatattttggcgttatgtccatatttttgcatttttccataaaaactctattagaacggcccccagcagttaaagtagcttttttgaccggaaaaatttccgaaagaatcatttgcaaattgaatccgcgacttttcgttatgttttgaaaaattatgtcaaaatccattgtttatcctctggggatggaaagggacacgccgacacatttttttttactcattttttctaacccaactcccaatcacttctgatgtgtaaaagtcccaaaaatccaaacaattaaaatatattcaaacaaaaaagcaacaaataaatgtgaggtatgcaattttcagatcaatttccattcataatgatcgatttatctttcatttcccaataatcgttcattttttcttccgctgtccaccaggcccgggattcattttcagacgaccaccttttgccttcattttgtccgtctttggtggagagaatcgcctaaataaaaaattttaaaacctagaaattttttaaaattttatgatttgtcactcacccaatgcaatctccattaggatcgaaagcgattttgttcaaattgtccggctttttgtcctcccactgaaccgtccgcccaatttggcatcacttcaacagcaaatcgatgatattataatttttataatttgtttcttctttctccaataccagcttttcgttgggtcgttcgttcaacaattcaaatgggccaatttcccgtgattcaaaaagttcaagtcgaatttttgtagctggcccgaagaagtggtggcacggggaaat

SEQ ID NO: 38592 - DNA, 1525 bp, Heterodera glycines
ttttagagcatatttcgctcacttttggcaaattttcataagaaaaatgcaataaaaatgaaaaatacaccccctaaggatcgaccttttttagaattttttgagcgatcaaagcagcttatcgggattttttcggatgggtaaaagggaacggattaaaaatcaaagtaatttttttttgattaaaaaaaagtgtttaaaaatgtttttaggtaaattttgtaaatgagaaggaattcgatgttgaggaattgacgaaatttaacgagaaagcgcaagagctgaagtcgaaaaacggaagaagcaatgacaagccaaaagtgatcggaaatgaaaagactgtgcccaaaacggacaatggcggacagaaaagaggtcaaaatggaaaaagatgggcagaaaaaagttggcactggggcatcaacagtgaagaagactagaaaaggaaccgatggcaatagcaaagagtggactgatcacaaatcaaaatgatgctcagagtatattattgttcattttttgcaaattggtaccgtacaaaccagttacagtaggaaactaaatcaatttttactgattttgaatatgatgatgacgacagtgcattaatgatgcctcaactcaacatgctaattgttatcaaaaatgaggcggcgaaatattagctaaaaaatcgcccgatttcgatcagcgttttttcgcttccattttctgctggtccttctccgctattttggtgatgttcatctctattcggatcatcattttgatcagcagtagcagttgtacggctgatcaaacgccaatttgtttcactcagacggatcaatgcaagatgttggtcctcaaattccgccaaatataaatcctcaaaatcgcagagatccacaacaaattcgggcacaggcacaatgggttccttgaatataaaatgataaacgaaataaaaaatattaataaattttcgtcaaagatgattagaaaatacaaaatttcaatttcaaaataaattaaaaaacatgtaaaattattagcgaattttaattttcatttgaatttttaagcaaaaattcaatttaaaaaattattttaagaattaccccattatactagttgtagtcatcattacaacaattttctattttttattatttcattttttataaattaaaaataattttgcctggacccctctgtattcgctgatcagtgtggcgatcaccaaattgaccggttcagctgtgacggcatcacaataatacccatatacggtcaaggattttttcgctgaaaaattgtaaatctgtaaacttttggaagaggtggtaacccattgattttttacaaaaatttttaaaaaattatgagagattaaattttacaaaaaagaaaactttgtaaaacttgaacaaatacaagcaaaatcataaggcaataatttcgatgataagtttagtactttttctaagcacttccgataaaagatcctgaaaaaattttcattgaatttgcgatgattgggctg

SEQ ID NO: 38593 - DNA, 603 bp, Heterodera glycines
  misc_feature (23)..(23): n is a, c, g, or t
ccaaaaaatccttggcgtcgaancattggcttcattcagcaaattcgaattgaactcctttttccatttctgttccataaaatggacgccgcttctgcgattaaaaggcgcggaatggccaaagattggctcgacaattccgccgggggtgccaaactcggggaaattggaggcacaattcagcagaggcacctcgggaagctgagaagagtaaaagcacgcattaacaaatcaaatccgatcaataataattttgtttggttaaactgtaataatttgtaaaaatgcccaaattttgcaccttttccaccgcctccattttcctttccaatatttccattcgcttgtccaattgtttcattctccgcgtgcgtttttccatccaaagcgcagcttttttgaaaatttggtcggtctcattttgaaaagcactcagagaatgggccaattgaacgacgacttcctcttgggaacaatcgggcggaatcaaatgcattttcaagcaaaaacagccattaaaataataaaataagagttttaataaaattgttgaaaagtaaaaaattaaaataaattcttctttcttgtgaataacataaaatt

SEQ ID NO: 38594 - DNA, 1024 bp, Heterodera glycines
aggcaaattggacaattccgtccccccccccccttcatcttgccaatttcccaacttgacaggggtcagcagcatccttcttccaccgctagtctttgggccaaattttggccctctttcaaaatgcttttcccttattttgctttttgtcccgaagcattgactgtttgatccgatcgcattccctccccgccccctcccgcccttcttccgccttcccctttgctggtccgtttttcttaatcgccctttccctccagtgcatttccttttttgtttgtcctattatacgtccatttgggtttcgtcacctcccccccccctctctctccctctcccccctcttccttcccctcttttctctctccctttcttttccccctcttttctctctccctttcttttccccctcttttcccccctcttttctctctccctttcttttccccctcttttctctctcactttcttttccccctcttttctctctccctttcttttccccctcttttctctctccctttcttttccccctcttttccgtcctctttctctctccctttcttttccccctcttttcccccctcttttctctctccctttcttttccccctcttttctctctcactttcttttccccctcttttctctctccctttcttttccgtcctcttttctctctccctttcttttccgtcctcttttctctctccctttctttttcccctcttttcccccctcttttctctctccctttcttttccccctcttttctctctccctttcttttccccctcttttctctctccctttcttttccccctcttttctctctccctttcttttcccccctcttttctctctccctttcttttcccccctcgtttcctctctctccccctctttttcccccttctcccccccttttttctttttctcccctgcatcaatttgtttcttcgtccattcgctcctttctttgctcctttcccctcccttttcaaatggcaaaaattttatgctc

SEQ ID NO: 38595 - DNA, 958 bp, Heterodera glycines
agtgtcaaaagtatcgatgtggcgaagtgtaaaaagtatcgatgtgggtgatcagaagaggcgggtcatttcagtacggaacaaatgattttaattaattaataattattttaaatatattatttttaaatattatttggaggcaaaaaatccatcaatatattttacccattcaatgcattgcacttttataatcacaattgtatttttttatatattttataatttaagcatattattgatagaataagctttttgccatggcattacttgtgaggtggccaatttatctctctttaaatttaaatttaaaaaataattttgagttaaatgtaaagagtgaatccttaacagttttgatctgattttccttgtaacttttgatcagtttcattgcttctcgatttttaagaaagtcctcaaatttcgacttatggtttgacgttaagtcaataaagcaaaggatagtaaaaaaagttaaaagtaaaattttcatttctaaaatcgttttaaaattaaaaattgacaaaaaattaagagaaaattagaagtcaaatattttagaaaaatgaatttgctttattatgagaagacaaaaaatattattttgactaggttatgctacgtattttaatcgaatataaataaagtgcaataactcgctaaaaagtggtcgactgatatggcaaaaagcttattctatcaataatatgcttaaattataaaatatataaaaaaatacaattgtgattataaaagtgcaatgcattgaatgggtaaaatatattgatggattttttgcctccaaataatatttaaaaataatatatttaaaataattattaattaattaaaatcatttgttccgtactgaaatgacccgcctcttctgatcacccacatcgatacttttgacacttcgcgcacatcgatacttttgagacttcgactcaccacg

SEQ ID NO: 38596 - DNA, 951 bp, Heterodera glycines
  misc_feature (7)..(7): n is a, c, g, or t
ataattntcgggtcggaccctgtgtagatgagtgcccggaacgggatggacactttgtagttgccgccccgcgtctccgccaccaccgtgccgcgccgaaccgaaaccatcggtgccagctgagcaccaccaattgtttcagctttggcattgtgccgtccccgtcgttcaattcccatcccattgtcctcttcttcctccccctcttttgccactgtttcttcgccgcccttctgttgatcctccccgtcctctccatcatcattagcatcatcaaatttgccgtcgttctcccggttttcgtcgtcttttgaatgtttggcgtcggtgtgccgcgtgcgcagcaaagtgtccgtgtcaatgttcacacttgcaacagtcactggtgcgcctgaagggtaaaaaatcatggcgaaaaaacgaaaaataaataaataaaaatccaatgaaaatattttttttaattttccaaaaagagttcacagaatttttttttacttttttgttaaaatttagaaaactcagatttttcattaaaattttaaaaaatacattcatttttattgtgctatccttttccaattcaacatattttggtattcaaagtttgaaatgccatttctgggagaagagaaatgcccccatgccaccaaaattgtgtttgtctgtcgtccggcactcaccgggcattcctcgggcgtcgcttcggaccgaaatgggcggccgtgactcgaactgcaggtacacgccacggctctggccctccacataaaccgactcaatttccacgccacgctccagcgagctgaacacgctgaacgcgcgcggacgcaccggcccaccgcccgcccggacgaggccaaagtcgagcagatcgaagctgggaaataggccacgccgacgggtcacctgtgtttggggcaatctgtacataaagcagtgcccggtcgc

SEQ ID NO: 38597 - DNA, 1587 bp, Heterodera glycines
aaaataaacccataaaattacttaaacagcaaccaaatataattcttagttccattcgattagattaaaatattctataccagaaaatgattaaaaaagtttcaaaaataaaaaaaactaataattaaaaaattaatttttttgaagtttaattaaatgaaattctactaattgaaagtataagctttcgatacttagaatgttcaaatttttttactaaaaaaattaaagcaaaattaaaggaaatgtttttcccatttaataataataataataattaatctcatattaaataaatatttttgcttcaacactcgccagagtattaatgtgttaacacaatttgcttggtttaacagaaataaaatgaaaatgaatcatcgaactgtgatttttatttataattcctgcataattttgaatcaaatatttttgaattaacattaacagagaataaataaaataaaaataaaacaaatatttatagacaattaaaaataaaactaaaaatcgaaaaatactctaaattgtcctccaatgattgacatcaaataaaatagtcttttcaaaaaatatagtgtcaagactcttttttatgttctgtctaataatcgaaaatcgaatttttaaaaactgttagggaaaatgagcaatttttggtagtcgattttagccaaagtggagattgtagactcagcgttgaaacggtatttgctagtgatgttcgagagtctcgttcttgtgtcttgtctcgaaaaatgagtcttggcggtttttttcgtcttggtctctagtctagggttttaggtcttcgagactcgtatgcccctactgattggctttagttaaatttaattttaatatatttttgtttaattttttcttcgttttttttcttatttacgtggtccagttgattgtgctcttagttttattctttataattttgttggattaattctgcttcaaatagttttttttaattcaaacaatttttttttcatttgaaaattcaaaataaatttaatattcttttggatttattcaattaaattaaacaattaaactcattttttaactaatctgttgacaaatctcattaaaaattacaaaaattttgccgttgccgcctattggcacctccagacttcaaaatttcacttattgtttaaattgagtcaaaatccgcgaaagtacttagaattgacacatgcaaaacaaaaaattggtaaataataaagttaacgcgaagcaaaatttataaataggctttcaacctctgctaatagagaaaattttagcatttaatttgttcttaataaataaatatttcatccgacggtgccgaggcgcagcagaaaaaaagattttttttttataaaattatatcgcgttttaaaagatttttaaaatgcttagatttattttgaagaaattgatcaaggtttaaaaaattacaaaaaaccaaagtttaaaataataaaaataaaaaaatcatagaattctgatgtgacaaatctctcgaatgattacaaagaattgactgcatatgaacaattatatatatccaccaaagaaaaattcaca

SEQ ID NO: 38598 - DNA, 160 bp, Heterodera glycines
ataacaaagttaatttttgtgttgtcccattcattcgctgccaaatgagtcccctccccccccccccctccccgcccttcgtattactttttgctgcgcctgtgccacaaaatcggctgtgaggtgaaaatgccgattcgcatttgccgcaagtgaatca

SEQ ID NO: 38599 - DNA, 650 bp, Heterodera glycines
aatagaaccccgtgttggattggaattcaaaattgttttacagggatgctatcccacgggattaatcccgcaattaaaaaccttgcttgaaaaacggtgcgggatttttaaaatttcaaaaaatttagaataaaattttaaaattgtccaaaaaaattaaatattaaccaagtttgaaaaagattttaggcattcgcataggctaaattaattttttattccatttttgagaatataccgtagtacaattacataccttgataaaccatcggagaattatttggctgttgggcattaatttgttttttttcttgcaaaaggtttcgcgccctttggcaatccgtttgcggttcaaacgctgcaaaaacagggcgcttattaaacagagaatgccaaactgtagagagagaagatggcaaaatgacctttgtgtttccaatgaatcaatcaatcaaaagtagtgtgacgcatacaaacaaacttttaatcaaaaatggaataaaaaactgattatatctgtatgtgttaaatatcaggtatgtttccaatctgcacaaattaaaattctccaaaaaaaaatcgccggacataaacttgaaaataacattttaaacttactattagtgctgattttaaacttgaaaatattg

SEQ ID NO: 38600 - DNA, 1700 bp, Heterodera glycines
  misc_feature (41)..(41): n is a, c, g, or t
  misc_feature (93)..(93): n is a, c, g, or t
  misc_feature (98)..(98): n is a, c, g, or t
ttttagcaatgcctatggaggtcataagctgagtgcagtancgatggcgagtgatcgcgttaagcatgtaatcaaattgatcgcgggatttgnctgcntgatggatggcccacagagtccagaaaaaatgggctgcctgtaaagtgatagaaaaagcattaaaagtaattaaaaaacagggggcgccatgagagaacacaagggccagacgttagagtgaatataatgcaacgagagagtacatgaccagacgttagatgggtatgccaatgagagagtatatgatcagatgtttggtaatgaaaagagtacaggatcagacgttaaagtaaacgatagacaccgagatagagagacagacagacagacagacacagacagacagacagacagacagacagacagacagacagagggagacagagagagacaaggcggagagagacagtgagagagagaaagggaaagggggaggagaggtcatggtcagacggttagagtgagtataatgcaacgagagagctaatgatcaaaccgttagagtaaatgggaaatatcggaggaaaaaaacaatgaacagttacactatttttgttgtgcttatgaatgtaccgcttcaaagtgccgaattttgcacaacattttgtccatttcacactcttccccaattggttggccaaaatggacaaaataacggcgcagaaaatgccgacgttcgtcttcactagccgaattcattccataatcgggacactcatcaacacctgaaaaccaattgtttaattcattaaaatgattaaaaaaaagtttattttatttattttttaatttttcgatttcaatttggcgttttgccctcgaattttgtggcatttcgtttccctcctcccccagcccctcaccgtaaaatatttctatgattaaaaaaaaattatatttcccccgggtcgtcccccccccctaaatataatttttttttaaatcttagaaatattttttataagaaaatttcaagaaaaaaattttaaaaaatttttcatgtgatttatcaaaatttacaatgaattagtaagttttttcaaaaaattttccaaaaaatcgtgataattttttcaaattttttttcttataaaaaactccaagtttttaaaaaaatttcaataattaagaattttttttttaatttcgggggtagtgcacccgattttgtgtgcacaacctgcgtactcgcaaaagtgatttgcaatgtcgaacagttggtagttttggcccgcatattcgtagtcaatgaaatgcacatcgccagtgccttcctcgtcgataaggactataaattgctgcaattaatttttgtctctaaaactcgagaaatcgatccttaactttttgggtaattaattaattgattaattaaggatcaaatttcattgagtttttgtttcagaatccatagattacccaattgatcaccaaaaaaaaatatcgaaaacagttaacctttgaattgtcactttgactagaccgaccgtaattaacctaattaagctttgttcaaatgttcccaaaagcctaatcacattttttatgtattgatcactaggcaaaaattgatcaaccgtaatttagctttattagatgacaaaaaaaattattcaatttatgtatattaataaaaaaatataatatgtttttgtcttact

SEQ ID NO: 38601 - DNA, 949 bp, Heterodera glycines
  misc_feature (858)..(858): n is a, c, g, or t
  misc_feature (919)..(920): n is a, c, g, or t
  misc_feature (937)..(937): n is a, c, g, or t
ttcgactgaaatgcacaaaaaacatttttagctcggaaattcttcgttttaacgccactattcatcactattttggatctttgccactaaaaagaatttttcgctaattttggcgtttcgccactatttttggcactattttggttttttttttaaatttcccaaaaaatgcaatgaaaactaaaaatacatccctaaacaacaaataagaatcacctaaaaatttcaaaaatacacacctaagatttttgcataatttttggctgaaaattatgtcgccactattcgttaccatttcgggcttttttgccacattttggcattttttttcaatattttgtttattttgggattttttgccactaaaaatccgatctctagtgattagctgattaggaaaacgccaaccaacacactcatttggccaaactttttttttccatgagagagatttctaaaaagaactgaatttttttgagttatctaaacacattaatggcttttttggcgccagagttgaaaaatctccaaaaattttcagaaaatttttagtttgtctttctttatggataattataagccattttctttaaaataaccatgttaatacaattgctagcaatggtgcagaattgtggtacctaatttgacttttatattttggtccaaaattactattcggtgggttttcgagggtgttgatcataatctgaccatagatttgactaattacgaaccccggactcaaattaaaatatgtatactggatttggactcgaaaattcgtaacacaacccaatattcgatggtacacaacacttcaaataaaaatttattttttaagcaaattacatcgantatgtagcgcacagcaggaaaaaatgattttgacagggttagttctaaatttttgaaattnntttaaaattcttttacngcgccaaaaaag

SEQ ID NO: 38602 - DNA, 1360 bp, Heterodera glycines
  misc_feature (62)..(62): n is a, c, g, or t
  misc_feature (78)..(78): n is a, c, g, or t
tggtttttataaatgaccttactaatttaataccagctgcagtcggaattaaattgtatgcngatgatgttaaaattnacatttcgcatgatatgacacgaaaatgaatttactctctttagcgttggctaacttagccaaatggtctaaagacaatggcatagccattgcgcatgagaaatgcgcagcattatatttaggaaaaaataattctagacatgagtataaaattggcgagaaagtaattttaagcgtagattgtgtccgtgatctgggggttttggttgatcaaactcatttaacaatcatatttcaaaaattttaaatgcggcctattacaaggcatatcaaattttaaaaatattaaaaacaaggaatatcacaataccttaatcctagcatataaaagctatataaggcctcacctcgaatacgcaagcgaagtttggaatatctcctcaaaagaacagagtaaaagaatggaaacggttcaaaaatttttcacaagaattgtatacaaaaaatgtggcctcaaggctgcatcatatgaaaaaagacttgagatttgcaaattggagaaattaagtaatcgaaggtcgctcactgatatgaatatgactttcaaaataattagaggcttaactcatttagacccaaaaaatatttcgaattttcaacaagatcgcaacgaaaaacatttaggattcaaaataaaagattcagtaataaatctcggaataacttttttattcgtacaattaatccgtggaattgcttacccaaaacagctatggaaatcggaactttagctaaatttaaaaattttgtgaaagaattttatttagaaaataagtcctgagtggtgattcatccctttttattttttattttatgtatttttactgtattgaccatatcatatttttctaattgtattcattactttgttttctgctataagtgcaactatgttgccttgcggtttgttcaaataaataaataaataaataaatatttaaaatgattatataatagtaatatcatcaacaagactttgtgaatgtttaattattaaaaaaaatttaatttatataatatatcttaataaaaaaattaaaagaaaaaaattttcaattagttgtaaatagagagcaaacaaaaaattaaatataacaattaaaaaatattatagttctctttgtcattacgtttagtgcaataataaacagggtaatattgtttttgttttatttaaacccatcaaaatttattatttgtctcttcatttgaaatagggaaaaaatgtaaataaaattaattaacttcccccatagagtgcacattatcacttttctaaaat

SEQ ID NO: 38603 - DNA, 1261 bp, Heterodera glycines
  misc_feature (1191)..(1191): n is a, c, g, or t
  misc_feature (1255)..(1255): n is a, c, g, or t
gaatggtacgttcgtcttgcagagtcgggatagatttctgcaaaataatagttcaccagaacagtttaagcaatttttatgtctgtgaatacactagctaaaaataatttactttttcgactccaattacaacacaattttttcctttcacggcaacctaaagcaatgcacattactatttttaaaaagcaataaaacgcaccgctgttgagcccttcttcactgcttcttgcgcatagtcaacttgaaaaagtctgccatccggagaaaaaatcgtaattgcacgatcataatgctccatagtttatttgctaaaatcaagcttacaaaaagcggttaggcatttaaaatttaagctccgtaaaaattcaattaaaaatcatcacatttatttttttaatttttcaatttttaaatttttcttttttggcgaactgtctacccttgtaacttctaaaaaaggagttgagaacttgagactgaaatcccgcgccagatcccgtcccgacctgtctctgttttccatagtgaacaaataattattgttgtatttttactctttcgctgctccatacacatctctttcatgaactttagacaaaaagtattttaatgcgtcttgagaagtgttggttttgttcatcaacaatttatccgggccacggaattcaattcgtacgtaacgacgcaacggtgaaaacaatttattgatatagtacataataaattaaaatttttgtttaggttttcaagttttgtaggtcaaaatgcaacaaattatttaaaaagaagaagaacccgcgcaaattgaaatggacgaaggcatcgcggcgaattcggggaaaagttagtgtttgacttttgtttttactcttttacatttattgtaaatttaaatttcttttactctttaggaattggtcaacgatgttactcaagcgatggaaattcgcagaaacgaaccgacaaaatatgatagaaacctttgggaaactgcaggtaaatcgtccatatataccaacagaccgtaacgacgaaaaaaagtaccggaagggagaatccgcaaattctttgctctcggacacttaaacatttttcccgttttaaatttttcattaattggacgaaaaaacatatacagcggttttcgccaaaaaaataataatttgggtagacaagtatgtctaatanatgaattttgatttgggtcaaagaagatttaagggagtgtctatcggtgccttcctattaattncccctg

SEQ ID NO: 38604 - DNA, 917 bp, Heterodera glycines
aatcttcgactttgaagcagtgatcggcccccaccggacagatcacttcctgcagaatcagaaggggattctctacgtggccagcagtggaacgggcagagggtgaaaagacgacgaatttggcactttgactgaggaaatgccaaaccaaaaactgaaagtgatcggaaaagtgatcagtagggaaggggacaaatgcaaccgaaatggcagagactgagacgagaaagaagaggagcagagagacggtgtggggacggaatcggcgggtgccgaacggacgtacgagggacgaagcgccaaaattcattgaaaactgcaaaaaggaaggaatataaaacagaaactcgattttcatcaccaaagttttccggttggacttttccaaatcaatccttgaaggtattaaatcctttgccccctttttcaattggtgtgttggaaatgggtatggttttgctttttggtttcgcttttcgattcgctgatccgtcaatctttccgtttcatcagtttgttctttgtttgttcagcttctccgattgtcccttcgatctcttataataaatatattttattaatagaatttaagatttatagaaaatatacaaaaatttttgagtaattttttttgtccttttggtatttttatccatattttagcgatttttcaatccatattctttgatttatgtgcatataattccgagccataatgataaattttttaattttttgtagaaacggcttttacctgttttctctatttaaaatttaaggaaaattatttaaaaaaaaattgtctctttatttgttgcaaatttattttatacgacttctggcaatttcagggagttgatttttcataacattcgtttacgtttggcaccgtccaaatgcgacaccaacgaatggat

SEQ ID NO: 38605 - DNA, 917 bp, Heterodera glycines
  misc_feature (17)..(17): n is a, c, g, or t
  misc_feature (905)..(905): n is a, c, g, or t
  misc_feature (907)..(908): n is a, c, g, or t
ttaatattctcaatatntggtgaggttaagaatttttcttttaattatacagaattttcgggtgccaatgccggcagaaagtgccgcgaaatatttgtttgcaatttttgattgaaaaaaattttgcgtaggaaactgatcgaaaaatgaaaatatgcaataagagaatccaaaaaataaggacactctgagagaaataaggacacctgaaactctttgaaatcctttaaaatttattcttttttgaaatagaaacaaaaaatataattaataatttcttttttaaaaataaatttgaattcaaataatttaaatttttcacctgtttcagttgaaattcaccatccttgttgatatgtacaaaatagtcctaaaaaataatttaatttttttttcaatattttaattctttttttttccaccgatcgctgaagataaattgccaatggctgtttatgaaatccttgcgcatgcatttcttcacaaaatcccatgaattgctcaattgatgaatttgaagcaatcacatccttatagaccattttcatgaagtccaggtctcgggaaatgcgaaaatagagcaaactcattgcctaaattaataataaaaaatgaatactaattaaaataaaaaattatagagaaaaaatgaaaaaattgtaaaaggaaatttctttaaaaattattattttattaataattataaaaaaatttgtttcaagggaattattttttatagcattttatattgaaataaatacaagaaaaaaacattaaaagaaataaatatttgctttttaaaaaaacaaataatttctttactggaaaaattttttatcattttatattttttgtacttatttaataaactattaaaaattatagagaaaaaatgaaaaacttgnannaaagcatgt

SEQ ID NO: 38606 - DNA, 643 bp, Heterodera glycines
ggaaaattttttgtaatttcgttctgatttgttaacagatttttgtccaaaaaatgaccaaattttgccataaattttatatttttttgttgtaaaatagtgacattaggccataaaattttaaaattatgagtttgtttaagaaatcagaacaaattttggtcgctaccccaaaatcagaacatttctgacaaatcagaacagatcgcatccctgatttaaactaagaagttttattaaaaatttacacaaacatgcacaaatgcatatgggcaatcacatgcacatacaatcggcggctcagcaagtcattttgcctttgtagatctctacattcgaccaataaattttcggcaaagacatgtcaggttttaaaatttgggtcttcctggcaatggtaaaggataataatcctgatttattttattttggctcaaaaatcagttttttgaggtgataattactaattcacactccggttatccaattacgaactccggacccgaattcgaacaaaaagttgagtttaaaaagctatgaattgctttacagcaattaatgatgtaacaatgctccaattattaattggataaaatgcgcatttttgcaaaatttgatttatctccacgataatttggaaaaa

SEQ ID NO: 38607 - DNA, 1503 bp, Heterodera glycines
attaatatatacaaatactattttcagaatttctaatatagtgaattatgaccatctttggcagtataagcagaacaacgatgacttcgtgcttgacgagcagtccggcgtcctgtacgccgtacaaccggtgatttttctgtctcaaaaattctaaaaccacttctctgatcacttaagcgaaaatatttgttcttgtattaatcgaactttcaaaaatccaaaaaatttcgcgcggaaccccgcggatttgaaaggcgggatttgttatatgattacgggactttgttggattaatcgcgcaaatccggtccggcaaaattggttccaatccagcagccaaaaagatttccactaaaaactgccaaatttttgcgatttttagccaggcgaccaatttttcgtttttaaaaaatgcttttttttgcagcgcgcttttttcggaaaatttaatttttaagattttggctaattttttaggaaccaaataggttcttggggggccggcggtgccgataggcgccaccagagaaaattttttaatgcattttgttaagagaataactcaattttctttgatcgactttctcgaatccatcaattttttatcccaaaagtcggtgtagccgtcactagagcccgaccggcgcgggacgggaccccgcgcgggattttgcggatcccatccgcaaaacccgaatttttggaaattatatctcttcccgcaaaaaaatgttgagttccaatcgcgcagcgggatccgcaaatttgataaaaggaagagagacccagttgtaacatgagggagttagttggcgcatcacatttttggcaaaatgttataaattctcaaaaatttgaattttttgaaccctcatcaaaatatcatagaggtgtgtgggtttggtgctaggtcgtttcgtaaaaagtgccaactttacatatttttcgataaccccatataatcttgtgatcatacgaaacctcttggcttgctctattagctggaaaatttgattgttttcaaaaagttagggcaattgttagaagattttgatcacaactttctggaaactgaatgaaattttctgatatttttatgctaatatgtagagcaatccaagagccttcgtatgatacaaatagcgagtttaacacccgagccgatgttgatgagagtcggggtcgcacgcacccttatttggtcatcgtgaaaattgtagaattacgggcgatcgaaaatttcgtatgcccggaggattttccggcgatcgttgatccaagaataatttgttgcatcatttttacggagaaattccttaacccgaactcgaaaacggcacacatacatacaattcgtttcgtcttctacctggcgtgtcacactgagcggccgctatgcacgcgtatccggtcactgttgcaccaggccgctcgccatttcccgtgagcaattgcccttgcgcgttgcaaataaacgtgacacgaccggacccgtaattt

SEQ ID NO: 38608 - DNA, 1079 bp, Heterodera glycines
tatcttatcattaaacaacatttcgtcacaaatacaattttcccccccaattccttcatgtattaccgttcaattttttattaatatatttagatttctttcattttatatgttatttttaattttaattattttatatggcatcggaattataataaacggcgttgtaattttggtcatattaacttttaacaaaatgagaaaatcctcgatgaatttgcttctgttaaatttggtaagagctctaaaaatatatcagtttttcaaatattgaaaaatctccgcatttatttggggtttttctcatatttttttttcttccacaaaatgccactgttgccaaaataatgacagtccctggactttgacttggaaattgtggcaccattcccttccccgccatccaacggtgctgcaatagacgtgccgaagaaaattttgaaattatagagatttgttaacagtttattacaataaaactggctaattttggagtttgaaaattacaaaagtttcctttttcccttaaaaactttctatctcccctatgggaccattagagagtgccaatcccaacaaaatgtttgaaataaatttcatacatatatttttaatttcaaggctttgtccgatctatgtctgctgtcaataaactcgctttatcttatgccaaaattgtttgaacgaccaattctgaagttttcactgatttattgccatttccatatttttatgaccggcgtttgtggcctggtctctattctgacttatatggccatctgtgtggaaaggtaagttcaattccatgtcaaaagtggggaaaattggctgggagggggggggggggaatcccgcatttttgacatgaaatgaaaatgcctagaaattagaattttaatgtggcatttttggttttggtggcgacgatgggggtgtttttctgtgctatatttcaatcttcaaaaaatttcccgtcattttttcgtctcgaatccctctttttttctgcccgtggtaactctgttcgacaatgccattacgtcaagaaaatgccatcaccaaagttctcgaaattataa

SEQ ID NO: 38609 - DNA, 1502 bp, Heterodera glycines
  misc_feature (1405)..(1405): n is a, c, g, or t
atttaattatttttaaatttgccatgtaatattctgatcgccttgttcgctttcttctcctcatttttgctgatcggatattccgtcaaattcttcattttcctttttggcatcaattacatcacgcttcggtcttgctttttcatccaatttgtgcccatttttggcacttcatttgccgttattctgcaattatgcatcggattggaccgtttagttggcgtaatatgtccattatggtaattaattttaaatttaatatttatttttattatttaccgcaggtataattcccgaggccattggacccttttcaaaattttgattggcacttcatccttccgagcaactcttgacatgtttatcgtttactatggaagttatcagcactgggacaagtaatttttttgttgttgtttttatttcattgatcaaagatttacgaaattttactgcgattttgatcattgtacctttacaattttttaataaatggttttaaattgcctaattaagcaaccaattaacaaaaaaaaaacctaaaaactccgcctaccaaatgactttttatattacagtatttcctaaaatacagtctccggcgggcggtttattttccaaccccctcagcagaagggtggctttatttcagagggaaggctctaatttagtgggagattttttttcagcccccctaaaaaggacggttttattttacgggggggggggctctattttaaggatacggtatttaactttttttaattttaacgataaaaatgataatttttattaggccagtatgtgcacgcttagcgacccgacaaatcaaccagaaatttttttgctgctaagcaccgcttcgttggttttatattgtggcgaattcgagtgctatgcccttatttggctgctaacttggtggagaaattcgcagagtgagaaaattattatttaatttaatttttattttaaatttaaattttttcattagtttttgaaaaatataatttaatttaatttttattttaaattttaattagtttctgaaaatggccgacgattgatggtttcgttgagtgtgatcatgtcaatgggatttgtatgtgacattggagtaagcacatttgaataatttattcgggatttatacatcaaaaaaatttggaaacacatttttaattctggtttttttcgaatttcaattcatttttgagaaatcgcacagattcctacttttaaattttcgaatttgaacaaaatgaactttttcatttccgatgtcatttggtacaaatacgattcatgaaaaaaaaaatcttgcaaccctgtacaagatcttacaaaattttaaaaatctttataggacaggtcctgaataatatatatatatatatatatatantttttttttatagctgtaaaaaggtataaaattaaagtttttaactttcccttttttaatctttctattttataaagattttttaatagactaaatt

SEQ ID NO: 38610 - DNA, 954 bp, Heterodera glycines
  misc_feature (938)..(938): n is a, c, g, or t
actgattgcagttacaaatgaggtaaatttcctttctcttcctttcttaggcaaatattgacattttaaatcaaaaattttcaccattaccaattcggagactgcaaagaaattcaaatgattcacaaagacaccgatagatcgcattgagccaaaataaaaaattaaatcaaataaaaaaatatggcgaaaagtaatataatttgagaatttgaaagataatgacctaaaatttttttcaaaaaatcacaaatggaatgtaatttgtacaagaaacattaattaggctccattatcgacaattcttaagtcctgctgatagtttccagcagttttatggataagatgattatgaatagaacatttccagacaccacgctataaatcacccccccccccccctcacctccttacatctgtccctttatttgttgtttttatatattttattaattcgcaagggcgggattttgagtaacctacctaaatctgcggtcgctgatcgaattccagtcaattcttagcccagaattcggacaaaaacacagaaaatgacagttcgggcggcaaaaataattaggtatgtatgtatgtatgtatgtatgtatgtatgtatgtatgtaaattaaaaattaatgaatcgcggaaatcttgatggatttatttgggatcaccaaactgtgatgtttgtgaggtttcagttttgagggacccggacagttcggcacgaccgtttcggtatactataatagaggtttcaaaatgcctacttaatacataacaacaaaattaatttttttttttaaatttttggtcgcttaaaattcattctaacttatgtacatacctatttaactgtacaaaaaaagataaaaggtcttaaatttgctcggggccgatatgactgtgcccgaatatacatgacctaattcctttanaaaaacagtactcttt

SEQ ID NO: 38611 - DNA, 958 bp, Heterodera glycines
gagcaaaaatccaacgcagaattaaagtacaggctatctatgaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaataaatcgattttttcaagtgtccgtttggggtactcaaacaattatggggagcaaaaatccaacgcagaattaaagtacaggctatagtgaagctattccggaaggattcggtctccccataaatctgggcgcatcggttcagggggactgccccgaaaacccaaaaaaaaattttttggataaaaattatttaaatgaactgactagataatatttaaaataggttatttctcttcctttcagtatccctgcaaagtttggtgcgcttctgatcagtttctgaaaaaaaagttaagcctaaactttttggcctgtttaaaaaggaattaaaaatttttaaaaattttattcatctccctttttgatagaaaaagcatcagagtgcctaaactaacatgtaaataaaatttggtgcgtttcagaaccctttctgaaaaaatatttaagaattaattttgcaaaaaataaataaaaacgaaagactcagattttcgaaaatttttttgagccagctagctcggcgctcatttcagtgtaagttagtcctttaccggggagtatccctgcaaagtttggtacgcttctgctcaatagcaaaaatatgagtgatcgaattttcactaaaaaagttaagcctacattttttgcatatttaaaaagaaattaaaaaatttt

SEQ ID NO: 38612 - DNA, 926 bp, Heterodera glycines
cattctcagaataattacgccgatactaattagttctgccatcccgtttctcggcgcgtttgtttgggaaaaatttggaaaattggctatctctttttctgctcaacagtaataggaattccaaccgcattctcagaataattacgccgatactaattgttctggaatttgtttctcggcgcgtttgtttgggaaaaatttggaaaattggctatctctttttctgctcaacagtaataggaattccaaccgcattctcagaataattacgccgatactaattgttctggaatttgtttctctgcgcgtttgtttgggaaaaatttggaaaattggctatctctttttctgctcaacagtaataggaattccaaccgcattctcagaataattacgccgatactaattgttctggaatttgtttctcggcgcgtttgttttggaaaaatttggaaaattggctatctctttttctgctcaacagtaataggaattccaaccgcattctcagaataattacgccgatactaattgttctggaatttgtttctcggcgcgtttgttttggaaaaatttggaaaattggctatctctttttctgctcaacagtaataggaattccaaccgcattctcagaataattacgccgatactaattgttctggaatttgtttctctgcgcgtttgtttgggaaaaatttggaaaattggctatctctttttctgctcaacagtaataggaattccaaccgcattctcagaataattacgccgatactaattgttctggaatttgtttctctgcgcgtttgtttgggaaaaatttggaaaattggctatctctttttctgctcaacagtaataggaaattccactgcattctcagaatattacgccgatactaatttgttctggaatttgtttct

SEQ ID NO: 38613 - DNA, 1125 bp, Heterodera glycines
  misc_feature (995)..(995): n is a, c, g, or t
  misc_feature (1051)..(1051): n is a, c, g, or t
  misc_feature (1061)..(1062): n is a, c, g, or t
  misc_feature (1067)..(1068): n is a, c, g, or t
aataggaattccaacggcattctcagaatattacgccgatactaatgtttctggtattgttttctctgcgcgtttgtttgggaaaaatttggaaaattggctatctcttttctgctcaacagtaataggaattccaaccgcattctcagaataattacgccgatactaattgttctggaatttgtttctcggcgcgtttgtttgggaaaaatttggaaaattggatatctctttttctgctcaacagtaataggaattccaaccgcattctcagaataattacgccgatactaattgttctggaatttgtttctcggcgcgtttgtttgagaaaaatttggaaaattggctattatctctttttctgctcaacagtaataggaattccaaccgcattctcagaataattacgccgatactaattgttctggaatttgtttctctgcgcgtttgtttgggaaaaatttggaaaattggctatctctttttctgctcaacagtaataggaattccaaccgcattctcagaataattacgccgatactaattgttctggaatttgtttctcggcgcgtttgtttgggaaaaatttggaaaattggctatctctttttctgctcaacagtaataggaattccaaccgcattctcagaataattacgccgatactaattgttctggaatttgtttctcggcgcgtttgtttgtgaaaaatttggaaaattggctatctctttttctgctcaacagtaataggaattccaaccgcattctcagaataattacgccgatactaattgttctggaatttgtttctctgcgcgtttgtttgggaaaaatttggaaaattggctatctctttttctgctcaacagtaataggaattccaaccgcattctcagaataattacgccgatactaattgttctggaatttgtttctcggcgcgtttgtttgggaaaaatttggaaaattggctatctctttttctgctncacagtaataggaattccaacccgcatctcagaataattacgccgatactaattgntctggaattnngttcnntcgcgcgttgtttgggaaaaattggaaaaatggctatctcttttctgctcatcagta

SEQ ID NO: 38614 - DNA, 1570 bp, Heterodera glycines
  misc_feature (21)..(21): n is a, c, g, or t
  misc_feature (56)..(56): n is a, c, g, or t
  misc_feature (127)..(127): n is a, c, g, or t
gcagttgatgaccacatcctnccggctggacccgtttcttcagagaccccatcttnggatggtcacctgttcatcaacaagtctcgctttcctcttcgttctcttattcactcaaattacctctccncctgaatagtcccggcggttctattcggaagttgccaattttctgtttgtatccgtccaacatggcgaacccgtacacctttgcctcgccttccttctcctctttctccgcctttttctcctctttgctgcgcgctttgcgcttctccgactccgacacgtaaaaagcgtgcatttgcctttcaatggatgtaaagttacaaaatctctcgtctttttattttttgtttacctaaaatcgcatttggccaaatctttaatttcggctcgctccgcctttgtcatcactttgacccaatccttgaaaaagttctggttgaacaccggttttgacgtgtagtcgtggtcgagcattttcgcgtaaaaggaagccacttcttcggccggcaaagacaaatccatctccttaaaaaactcccatatcaatttttggttttaaaagttgtaattccaccatacctttccgtcgtatttgaacttgatgtgttttggcaatggcacataggccggtgcaaagacgggccctttgtggacaagcgtttgccatttgatggacccatcggaggcgcccgcgttcgactcgtcctcctcccaccagcgccacacttcctcttcttcctcctgtttcttcacacgtttcttggacggacttccctgggaagaggagggctggaaatgtccaaaaataccaaggttaaatatataatattccagggaaattagaatgctttttctcttccattttagtgtcccttccctcccattgtttcccttcgcttcttcttccgactgacctcttccttcacttcaactttcgttgtcttccgtttcttgtgctcaaccccagcgccgctctcttccttgacctccaccttggtaacttttgttgttttcgttgactttttgctgtcgcttttcttcgccggggatgggtccgacttttgtttctttttctgaagtatgtcatcctttttcatccgttttccttctcttcgccttacctttggctgatattcctcctcttccccgtcggagtcgtcgtcaaagtcttcttcctctccgctgctttcgttcttttttcgactttttgaggtcgattcctttgactttttcggcataacttcctcagcttttttcccctttttcttctcattgctggtttcttcttttcttaaattggtttgttttcaaatgatgttaccataaaaaggcatttcttctaatatataaaaaagcgctcaaaatgttcgttaccgttttccccgtgggtgtcgcgtatccgttcgccccatggaacattgtcccaagtcggtcccctcactttgtccctccttttggtgcaggaacattgttcccaccattttgctggtgctcattgttaataacagcaccttcagatgaggaattggacaactaaaaatacaataaaaatccggactcaaaa

SEQ ID NO: 38615 - DNA, 656 bp, Heterodera glycines
ttttgacaaattctagttatcaaatctagactcaaaatttctacacttttccggcggcgcctatcggcaccgccggaccctgctcgccccaatgttccaaaaaagttttttgaaaaagtaccacaaaaagagcgatttaaaaaaaaattaagagatttcaatataaaaataccattaaataaaaaaatactcaatcatttacatctatgcattttaataaaaatttttggattttttcaaaaaatttttctcttataaaattcctggttgtccggtttcccggctttttttttgcggtcccggtccctatatttcacgaaaatatttatataatatttttaaagtttaagcttttattttaatgaaaaaattttgaaaattttttttggattttttcaagacccggtttaaaaacaaggaccctgacccggcctttctggacccggtaatacctggacccggtttttgcccaaatacccggacccgtaaccctaatttaatataagattttgaagtaaaaaataaggctacagaaaatttgaaaaactctcgcctctcgtcctctcgccaactctcgtctttttggggactctcgcctctcgccaaactctcgctctcgtcttttctgagacaagtcacacccctggtacgtaccc

SEQ ID NO: 38616 - DNA, 255 bp, Heterodera glycines
atttaaaaaacgggcgcaaagcgcccgtccaaggccgcgaagcggcctaacaagctaaaaaacgggcgcgaagcgcccgtatgtgttcaacgaatttaaaaaacgggcgcgaagcgcccgtccaaggccaacaaaaattgaaaaaccggcgcgaagcgcccgactgaggccgcgaaacggcctaacaagctaaaaacgggcgcgaagcgcccgtatgagttcaacgaatttaaaaaacgggcgcgaagcgcccgt

SEQ ID NO: 38617 - DNA, 96 bp, Heterodera glycines
tgatcttgtcgccggacacgtgcgcgtccaccgccagggtcatctccggcttgatgtgctcgtgccacggcagcgcacgcacgccgtcgtacaggg

SEQ ID NO: 38618 - DNA, 1511 bp, Heterodera glycines
attgtcccccgctttaccgtactctctccccgtaggacggttgcactggtgcgctgtatagtgcccagaacaaaagttgcattttgggctacgaggacaaacaccactgctccccggggcccatcatcagccgatttcggcatttggccccgctgagaaatgtcactccgttgtggattcattgcgtcaattgtcgtaagggacatactttgaaattaaaaaacactaatacaaaccaggtccggaagtgaatcgccaaacgggcgaattggagcgaaagaaagcgggcatagccgcgggggttggcacgtccagccaaggcacagccgcgggggttggcacgtccagccaaggcacagccgcgggggttggcacgtccagccaaggcacagccgcgggggttggcacgtccagccaaggcacagccgcgggggttggcacgtccagccaaggcacagccgcgggggttggcacgtccagccaaggcacagccgcgggggttggcacgtccagccaaggcacagccgcaggggttggcccgtccagccaaagcatagccgcgggggttggcccgtccagccaaggcacagccgcgggagccagccaaggcacagccgcgggggttggcacgtccagccaaggcacagccgcaggggttggtccgtccagccaaagcatagccgcgagggctgtcccacccagcttcaactcggtcccatcggtgccacagcccaacccgggcccaattaagcagcagatgtccaaccaaggaggtaaaaaacaaccaacggattcgttaattagggcgaagtaccgtaagcctatcgtaggccatttccagcggatgcatttctgttccttcaattctaagcttaccaatccgttaatcgttcttcagctgatcccattgtcgtagctttgctggccaattcatcttcatcccctcccactgagtcgccttcatctgctgacattcgtccgacttcgcttggtcaattgcttctcccctcctcttcccctcccccttcgtcctctgttgctccaatcactgatcagtcgcccactgtccctggcaaaggcactcctccgaccattcgagtggacaacggtttgtccacttaattgggcgtcattcatcctaattcgttccctccccccccccaggctgcttcatcactttccaagcggaatcccttgcgcaacggccctcccatttcaaggctccgttcgagctgaaattggatgtcgagtcggtcgaagtgtgtgccatccgctgcttccaggcactgtccatggctttcccgttaattgctgttaatgaatgcccctttttccaggacgggtgcacaagtgcgctgttccatcgcgagtcgcgcagctgcgagttgagctacgacgacaaacacttctgctccaatgcgccgatcataagcaaattcgcccacttggccaatctgagcgacgtgaatccctggtggattcactgcgtcaattgtcggcccgaagtgaac

SEQ ID NO: 38619 - DNA, 1038 bp, Heterodera glycines
tcctttttgtagtgctcaaacagatagtcgagcagttcgcgctggtggcgactgcacagcaccagcacagcctggaccaggggtgttttccgggttaagacaatgtccaaaaagtaggggttttggattcggggcccgagcgtaacttggaccgtcccggcttctgtgtatcaaccaatgatcgatgagtgatcaacaaattaggcaaaactctcagcgaccaatctattttgatcatttgatcggaaattaagcttatgaaaaggttggaaccgaagcaaaggactaaactaacaataacaatttggaacacacaccttttggcagaagaggaacagaagaagcgtaaagcttagcaacagcaccggcggaggggcgaaacaaagcgtttttttggaagtgctaaagccgcgacagcttttcatttccaattcactttttcacaaataattttttgaaatgagaaagggaataatggaaaatggaggcattaaattgtgcaatggacggaattttgaattttgagagtgcttaaacgctttctgaagagggcttattgggcaaaagcggaggaggggggggggacgaaggggcaaagataaaatggggccaaagggacggaagacggaccaacggccgaaaagcagcgaaataggaggaaaatgaagggagacaggcgcaaaaaatggggtgggggtaatgggataattagccaataaaaaaatggaaaatgcaccggaagtgaaaagccaaacgacggagacagaaaagggaacgggtaagtgtgaagagaaagaaaaccttttaagtagaatgaaattccaaaaaaaaaccgaaggatcttcgagagtatcggcactctttggggtcaaggtcctaatgaaaaattaagaaacttgggaataagcggaaaagaagcgatgaagcgaagaaggggcaagcagaagatgaatgaatgggatgagtgatgactcatccattcattggccataaccccgggggcgggggggggggacacggtacccattgaaaatgcaa

SEQ ID NO: 38620 - DNA, 1028 bp, Heterodera glycines
caaagagagcccaatttcttaccacattcatttggtacagatacgtctcgacccccgaaggcgacgtggtaatgatgtcggacgaaagtgaaatttcgtcgctgaacgaagcggacgttaccgatttgagggaacgttacgaaaatgtgtgtttcgtgtggtacgttttaaaatttcatccacactattacagacacaaagacaagaagtacccaaagaagtgatggtacagcgcgaaatgcaaatccgcgagttggagtcaatccttcggttggaggaggccaagctgatgatgttgaagaagttgcagcagagtcagcagaaggctgcgcagaaaacggtgagttaaagccgaacaacgaaaaaattcggcggagtcgggggcatggactaattgcaacaattgtttcaccgacttccgccgcttaatgcgctttttatgaccgagtcattttcattaattaagaaacatttacatttagcagcaacaacagaatcagcagcaacaacaacaacaggaaaatgtgcgaaggttagccccaggcgttgtgcagaattcaacgggacaagcgtataagccgaaagtggccgtggtaaacccatcgcaacatcagacgggaaacaccagcaaaacgaacggcacgacgccgcagcacgggaagaagggtaagggaagaacacggagagagaacgggaaacagagagagtgagagaaagagaggaaaataagggcacagtttggtaaatatccatcataggttccaaactccaaattgcataaaaatacttttatgggttttcttaggtgctgaatacgcctaaaccatcaaaaaaactgcgcggcaaagcatttaaaccggtttttgaacggtttaaatcacgaaattttgagtgaaaagggaggcacctgacctttttaatacggtcaaaatcgcacaaatttggtatcattcgaaaactcttgatgagctaagtctaaaaaacaaggtataaatttgaaccaacgccatcagatcacttggactact

SEQ ID NO: 38621 - DNA, 787 bp, Heterodera glycines
  misc_feature (34)..(34): n is a, c, g, or t
tttatgggttgctcgagaaccttgggcaaaaaanagactcttcttgccttcggaatatacataaaactttataaaatattttactgctcgaaatcaatcagtgctgaaaacggttaccccaatttgcgccccagacattagcacctatactcaaaatcgggttcaaacttaagtttttcaatctctgatagtctaaaaagcattataaacgtgttgcgctgcttacatttatttaagaaccaattcattaaaaatgctttttcgtttttccgtttggcaaattccatgacaaccattgctaatgcctagaatacctaatgaggaaaatgtcttttcagtcaatttataacagcctttattttcgataatattttgtgcctttcacttagcgtttttcctaatatatattttttcttttaaagaaaaatttcaatgataaattcaagttaaagccaaattctggcacagcacatccaggcccagggccaagcataatgtgttagcattacttatcaaaaatgaatgtttttattttttatttttcctttatatttctattttttctaacaataattttcatattttttccagggaaaatttatcataaaaagaaagcgtcgtttgcggtgccaaatgaagcaaactaaaaagccggtaaataaaattttgaattttttatgaccgattatgggggggggggggggggtggaaaactaaatttcaaaaattaatagatttatctcaacgatttaagacatgattgaataatatgcttgacatatgggaa

SEQ ID NO: 38622 - DNA, 1134 bp, Heterodera glycines
gggcaaacgccaacccaccccccgctcctccccccccaccgttaaacccttacttttgcgccggcatttccattctcttcgggtttacttttttcggccgacagtgaattcacctgaacattcattccgtgccaatccttccccctctctccccgcccactttctgctcggatggccctggttcagctgctgacacagcactcccttcgccgcttttctgttgtcgttcgcctttctcttcgctgtgcccaacggcggggggaggcgaaggcgaagaagtggtcggagattcggcgggagttgtgccttcaatgggtgaaaatgaaaggggaacacagagaagagaaataaggaaggaaagtgcgaatttggcatactttctgtcgattgatcagcagcaaaagcaaatgccaacagagagaagaaaaggaaaagattggcattcattgtgaagaacaaatgaattgaattggcaaatgaacagtgattaaaaggggggaggaaaatgaaaaatgaatggggagagatgggcgaaaaggggcggagaggagggggaaattgagtggaggtgcaaagtgaatgttggcattgcgcaatcgctgctctcgtcggtgccccccccaccccacgcgtccgccttttcctccaatgctttttaataggagagaagattgaaggactggagattaaattggccatccatcctttcatccgccccctctctctcactctctctcactctctctcactgtctctctttatctctccctctctctcttcgtccccctatctctcgcctaatccaacaaatgatggattacaataaaaaaaaaagtatcagagaaaggaaaatccgacgacagaccaatcatccaacaatcagtctttcgtctctccgtttgccccccttttgtcatttcctttgctttgccatttgaccccctctctcccctccctccctccctcccccctttcattcgctcccttttttcgctttccctcccttttccattgtccgtgaacaacggaagaactgcgcatttgttggttggttggaaaggtctctatgattttttgttttactgcttttacttttaccgatcattgaattgagtgggggcgtcggcgagtgat

SEQ ID NO: 38623 - DNA, 943 bp, Heterodera glycines
gccaaaaatgtaggcttaacttttttagtgaaacctctatcactcatattttttgctaattgagcagaagcgtaccaaactatgcagggatactccccggtaaaggactaacttacactgaaatgagcgccgagctagctggctcaaaaaaaattttcgaaaatctgagtctttcgtttttatttattttttgcaaaattaattcataaatattttttcagaaagggttctgaaacgcaccaaattttatttacaagttaataaggctctctgatgctttttctatcaataatggaggtgaataaaattttaaaaattttttaattgctttttaaatatgccaaaaaatttaggcttaactttttagtgaaagtttgatcactcatattttttgctaattgagcagaagcataccaaactttgcagggatactccccggtaaaggactaacttacactgaaatgagcgccgagctagcttgctctaaaaaatttttcgaaaatctgagtctttcgtttttatttattttttgcaaaattaattcttaaatattttttcagaaagggttctgaaacgcaccaaattttatttacatgttagtttaggcactctgatgctttttctatcaaaaagggagatgaataaaatttttaaaaatttttaattcctttttaaacaggccaaaaagtttaggcttaacttttttttcagaaactgatcagaagcgcaccaaactttgcagggatactgaaaggaagagaaaaacctattttaaatattatctagtcagttcatttaaataatttttatccaaaaaatttttttttgggttttcggggcagtccccctgaaccgatgcgcccagatttatggggagaccgaatccttccgaaaagcttcactatagcctgtactttaattctgcgttggatttttgctcccc

SEQ ID NO: 38624 - DNA, 504 bp, Heterodera glycines
acttccgcagcttatcggctgcaaaaggctgctaactccggactaaaagaaagggaagagcaccaacaaaagtgaaaaattcaaaggcagatctcggcatcctgattttatatgcagtgagaattattcagttgtccttgaaaacttgacagaattttctcccgttggcccttaggaaatgcgttttctttttttataataaaataaaatttacatttattattttttattgtatgtcctcaaatatccggtcctctaatgtcaagtctttaaatccttaaatgtcgaccacgggcaagaagaacggcaaatttggtcgttgagattgcaggacgaattttgggcaccagaaatttgggcaacgggaagtttgggcacttctatattaatttaaaaatcagaaaactaaaaaattcgaatatactcgatttcatcaataaatattcaaaattatctttaaaaaaattgtttttgcttgaaaattaaaaagaaaaatctgttaaa

SEQ ID NO: 38625 - DNA, 643 bp, Heterodera glycines
ttcatttatttggaacgatggtccttgaaatttggccaatttttgcgccaaacatttgccgtttgagtttagcctcaaggtcgcaggttctttcctgaacggacgattcgaattttgagaaagatcatacataactttatcagagcaagctaattttgtgttattcaatagcgctaattattctctattggcctacagtttaggggtttcaggtcggaaaacggattatttaagtcttcttgatacagataatcagggacggatttttaggtggctaaaaaccactaacttgttgctaaaatagttgccaaaaatatttgaaaaaacagtttttaaaatttcacaagccaaaataattgttaaaaaaggtactttgctgtcatgtaggcgcaccccattttaaaaaaaaaagcaacagaaagcgtcaaatcagacttattttggaggcataaagccaatattcggggtcgctgatcaatgatcgtggtatgacatccagcccgtaaatccctattttccattccattcggtgtatttgaatcggttatggacagtaaaggcggattttggtgaaaaatgaattttggatttttgttcgagttcgggtccggggttcgaatatttgccgaaatggatgacatat

SEQ ID NO: 38626 - DNA, 515 bp, Heterodera glycines
ggggtcgctttgcgcggggaatatggagtctgtcacaaagtgcctcccttcacttctcggcatctgtcattggcatgttcaaacaaatccaactcagtaaaaaataacaaattctgtgcccaatgtgacggacatccgcttgaccttcatttatttatttgacaccttatttttgtaaatatatttaaattatctaattattatggtaattcaaattccgtagctttgcctcaaattccaatttttattttctttttttcccttaataaatatgaaatttcatgtatttatttacacataacaaagaaataaatcttctcaaataaattggagatgattaattttccgtcgctatcatttttctgtccatccacgcgaatcgctttcgtctctttttgcaatcattgccattgccattgttcgattgcaacacacaacaaagttgagtgagcaaatcgcaagcgaacggcaaaggacaagtgttggccaaacaagcctaaaaaagtgggaatgat

SEQ ID NO: 38627 - DNA, 626 bp, Heterodera glycines
tggcattttcgtgagagaaaaggcaaaaaaattacaaaaatttgaatttttttaaccattttgccaaatttttattaaataaagtaatttgcttttgctgtcaaatgtagtggtggtgtagtggttagtgcttaacactaacactacttttgtcacgagttcaatcccctggttgactttttctttttaatttatttttttgtgattaatagggttttttaaataaacataactataaaaatggtcatcattggcataatttaaattaaacccaattttcctttcgttgaattaaaaaatttaattttccttgactaaaatcatgaaaagtaaatatttttcaaaatatttttgacaaaatataaaaaaataaataaaaatttcacggaaattcataaattttttgatgaaaatctgttagaaaataaagcttaaattttaaaattcgcccggcgctgcctatcggcatcgccggcaccccaaaaaccctaaaaatattgctcaaaatcgaattataatttttagacaaaatctgttacatatctatccaaattttcaaaaaaaatttcccggcggagcctatcggcaccgccggacccctttctcctaaaagactttagaaaaag

SEQ ID NO: 38628 - DNA, 1435 bp, Heterodera glycines
  misc_feature (145)..(145): n is a, c, g, or t
gggggggggggggtggggggggccccccccccccccccccccccccccccccccccggctggtatccgtcctccgccccattttcccccgctttcctaaacttttcatattcgaatattcctcaaaaaacacctttgaatggctnggataactaataaaaaatatggactattttcatttgttttgtttcttctccgtattttttcattgtgcttttttcgaattcatttgtatacatttccaaaatgtcagaatgttgtcaatgtttcttcatatatccctcctccgttcacaagtgctaaattgaccgcgttcaccaatgatcggccgacctcaaaaaattcggacgggcatttgtgggggattggcggtgacaaggcctcggcatccgcaacaaggaggacgaaggcattttgtaatggacggaagagagtccgttcagcagagtactgaaacggggggaaggggatttagcagaggaattcatttccgatgcgggcaaacaaacacctctcggctgaattctgtccaagtgatgcaatcgacgagagtcgctttggcaagaattacgtttctccgttggcatgaaacgccgtccccttcccccgttgctgcaattatttcccatgcgtttggccaccccttcggacacaccttcgctcttttgtgtgtcctctccattaaaatattcaatgggcgcgtcgtcttccaatgcggcgatgagaagcggccctttgtgttgcacactttgaagccaaggaattgcactgcaataaaacccattatttggtttatgaagagagaatcccacgaccaaagggagtcttttgaggacaaagccaacgacaacaaacgcccagcgaaaggctgtttcagtgccacacacaagagtttttgtcgcgacggtttgcccaattgttctgctgccacccccgacacttcagtactgcccttactgtcctcgtactgttggggggggggggggggggtgagatgcaatttctgattctcaagtcaattttacgccctgggtaaaaagttgtcaatcagtgaagcgtgctcctcccctttctgctctttgctgtcctcatcagtgttttggtgtaaattccgcgccgccgaattgaggagaatcgcctggaggatggggtcgtccaccgtttcgatgggtttttgctaaataaatgccgttcaaccaaaacagacaatggcattgccttttgctgatgcattgctccggtagaaatgtccaaatcgacgagaatattccttttgacactcaaactgagctgtctcaattcctccttccgattgccaattgcctctctttcggctgctgtcaagtacggattatgctccaaactgaagtagtccgcttgcaagtcgttcacccgcgtgacttccctatgtaacaattcttaccattcatggcacg

SEQ ID NO: 38629 - DNA, 1157 bp, Heterodera glycines
ttattccaatttactcataaaatgaaggcaattaaaagccaaaaattaatcgtcctttttaatttatttgaataaaaattctttcgacttcttttaattggtgggtaaattcaactcatattttaatcattttttggtcaaaaatgtataaaaataaatatacaaaaatataataaaaaggctcaaaaatcggactccaactcgcgcacttccatgtaagagaactcagcggcaccccaatctttgatgaacaaattgctgacacaattttttgcgtattttaccgccgtcagaacggagaaggactgaaggtaaagcataagactgttcagcaactggagaatggtcgaattagggggaaattaaagggggagagaccgcgaagagaaggccgggcaattgggcatcgacgatgtaaaagtgggaagagaagagcagggagaggaaggagaagccgaggctggccaaggacaggcaaatgtcctgaaaagcacaaaaggacaatcaaagcattgaggagaagcttcgcaaaaagagcaccaatttggcccagaagaacttttgcagcataaaccaagcggcgattgcggtgaaaagaagggacagcaaattgcaaatgggggcccatcgggcggaagttgaagccgaagatgaaagcttaaggggggggatggatattgagaggggaaggaacggaccgaaggaaacgaattaatggttgaggaaagtggcggaggggacgaggggagagacgaagcgacggaagaggcgggagacagcgactggcgatgatcccaccacaaaatgcactgaaacacggcacagagctgaacatggacgaagccattagggaacaattatgaagaaacgcacaatgagcatgcatttgacgatgatcagctgtcggtaggggaagtggtggatgtaattgggaattggcacaatttgaaacagtgccattctcagccgtcgtgccttaagggcacattgggaattggaattgcttaaacaacgtaaaatctgtcaaaatggacatttttcgctttacatttaagcattgagcgaggccaaagcattgcttcgcattgattgcgccttttgtcagccaacgaattgaataatttcagcccatcccttcacttctccccccattatta

SEQ ID NO: 38630 - DNA, 956 bp, Heterodera glycines
  misc_feature (797)..(797): n is a, c, g, or t
  misc_feature (842)..(842): n is a, c, g, or t
  misc_feature (852)..(852): n is a, c, g, or t
  misc_feature (912)..(912): n is a, c, g, or t
  misc_feature (916)..(916): n is a, c, g, or t
  misc_feature (925)..(925): n is a, c, g, or t
ctggcctcaaatggcatgactcatggcaattaacccaaactaaggtaaagacaacgtgtcataattaacagagagctaaacacacaaatagttggtttatctttctttataattggccatttaatcttagtcaatatcactacaaccgagagcaaagaagtgccgagttttcggtaaaatgtcttgcgcggaaagtggtataagatattcaagtaaaagaataattgtaatgaaattatttatgcaagtcggtcgaggtttaccagttactttagtaaatggaacattttcttaaattgctttggcagaacgcatcaaatatactaatatttgaattgaagaatgaattattagtgaatgcatattatttttaaaaggtgtcggaggttcataaaagaatgctggcctcaaaatggcatgactcatggcaattaacccaaactaaggtaaagacaacgtgccataattaacagagagctaaacacacaaatagttggtttatctttctttataattggccatttaatcttagtcaatatcactccaaccgagagcaaagtagtgccgagttttcggtaaaatgtcttgcgcggaaagtggtataagatattcaagtaaacgaataattgcaatgaaattatttatgcaagtcggtcgaggtttaccagttactttaggaaatggaacattttcttaaattgctttggcagaacgcatcaaatatactaatatttgaattgaagaatgaattattagtgaatgcatattattttaaaaaggtgtcggaggttcataanagaatgctggcctcaaaatggcatgactcatgacaattaacccanactaaggtanagacaacgtgtcataattaacagagagctaacacacaaatagttggtttatctttctttnatantggccattntatcttagtcatatcactccaccgagagcaa

SEQ ID NO: 38631 - DNA, 1132 bp, Heterodera glycines
  misc_feature (166)..(166): n is a, c, g, or t
ggtgtgtgaatttcaatgtattttctgaaattcgtttcgactgtagacgatgaaaatactcggtgctatatatactttcactaatcgatcctgggtcatcgacgacgttaactattcttaagagtggggccatctggttgccgataattgtgttttcgattaaatntggtgcataaatgtatagctgccttacgccgccagtcaaatctggcatataattcgcttcttccgcatgaaatagccttgtgttcttaaaaccgagcacataggcgaggtgttttgacaaatctatgtgggagacagcagcggaaagatagacaataaatttttgatcaatgctgtcatattgaaattgaacatcctcattggctagtctttctcttttttgtggtcctttctcagcttcagatacttgtatattttcaatatctttacgtttaatatgctcaccgagcgcctcattaagcctattcactatcccgctaaaacccttttccgatttatcattatatccctcgagagttgatgtatatttggtctttgcctgtctggcgattccctttgcgacgtcggctgatttctttgcttttttcaagtcattcttttccacatgctccaatgttatgtttttggctttatctacttcttcttgaaaagccttaagttcatttcgtgatgtttgaatttcggttcccatctcaaccattttgtcaaaccaaatttttatatcaggctcttctaaaatttgaggatttgtttctcttagtgtgtttagttgggtttggatggaattcgagatattgttgatctgattaaaatgtctttctacgtctctcccggcgcgttctgcggccctctttgcgacatcaatttttgagtctttggtatcttcagccttggcttctctccttccacgttgttttttgattttgtaatgatggctgaatgcctcgttaattttatttcccaggcccccggcggttttaaaattcatgtccggtaaataaacttgagtcgggacactgctgtcgttttcccatactttaataaactcttgaccgtttatatcgagtgcggtgaatgagcaggggtaaataattgatgagagagctactgaccaattctgtgccca

SEQ ID NO: 38632 - DNA, 985 bp, Heterodera glycines
agtggaagaggatcagtcagtggaagagaaagtggaagaggatcatcaaagtgtaagtgatactgcaagtggaagagagactggaagaggttcagaaagtggaagaagaagcggcagtggaagagaaagtggaagaggaatagaaagtggaagagaaagtggatgtggaagagaaagtggaagagaaatagaaagtggaagagaaagtggaagagaaagtggaagaggaacagaaagcggaagtggaagagaaagtgaaagaggaagagaaagtggaagagaaagtggaagaggaacagaaagtggaagagaaagtggaagagaaagtggaagaggaacagaaagtggaagagaaagtggaagaggaacagaaagtggaagaggaatagaaagtggaacagaaagtggaagagaaagtggaagaggaacagaaagtggaagagaaagtggaagaggaacagaaagtggaagagaaagtggaagaggaacagaaagtggaagaggaatagaagaggaacagaaagtggaagagaaagtgaaagaggaacagaaagtggaagagaaagtggaagaggaacagaaagtggaagagaaagtggaagaggatcagaaagtggaagagaaacagaaagtggaagagaaactggaagaggaacagaaagtggaagaagaagtggaagaggaacagaaagtggaagaggaatagaaagtggaagagaaagtggatgaggaacagaaagtggaagagaaatagaaagtggaacagaaagtggaagagaaattggaagaggaacagaaagcggaagtggaacagaaattgtaagaggaacagaaagtggaagagaaagtggaagaggaacagaaagtggaagagaaagtggaagaggatcagaaagtggaagagaaaaagaaagtgaaagggaaagtggaagaggaacagcaaggaaggagaaatagaaagtggaacagaaaatgaagagaaagt

SEQ ID NO: 38633 - DNA, 1334 bp, Heterodera glycines
gcgtcaatgcaaagtgaaaatggttgtgggcccaactcattttttcagagttccatgaaaacgggctcagaactcctttgttggaattcaatgaaaattttgattttcaaaacctttaataatttgtgcagtttcatctttgccgacccatatcgtttcgcaatctcagaatcagagaaaacttcttttattaacacgttgatgaacaatcagttgacgcaaacgattgatgatgattacacacatggtaagcaaaagtgcctaaaaacaaatttttacacttaaaaaagattaaaaatgaccctcagccgttgcaacttgaaggtcaattgaattaagcgtcgatttggatcgaacaaaattctcaattgttgtgcttttacgccgttcctctttaatttgcttatgttctttgttttccgtgtgcgactttatggccgaaactcccatcgactcgacattgatgtctttttggcaaaaagcacaataaaaaaatccattcccttttcggcttcttttgacaaaagtatattgcttttcccaatcgggattgaaagaacatttgcgcttatttgggaacattctaaaatataatatgtcgcaaacgcgaaaaattgcgtaacaaattcattcacaagcatgagaaaatttgaaaatttgcattttatttacataatgccataatataatcaaaatatcgttgaaaattacaaagatttctcaaatttctttgaatttttttaaaacttttctaaatgttcattttcaaggacgtccttggcatccaaggacattttttattttcaagaaagagggcccaatttcaaggacgtccttgccattcaaggacggatggcagccctgagttaaatctttgacaaattaattaagctactgcgcaaatcatatgtgcagtcctattttaccatgactaatttacccaaaggctttgattcatctaatttcgttcaaaatttcttgagttctgacttgacattctttgagaaaaaaaattggcggattaagggatatttttccaatttattaaacaatttctcaactttggttcattgccttgctgttcagaagcataaaaattctttaaatgattatcttcgtttcaatacattgcctaagtgtgtctccaagtcttggttaaattaaaaaaaaatcttcgtatgtgacattgacaaaaacccattgtaggaaatgcccataagacttgtaaaagtttcaatggaaattttgaaattgtctttttggaattcaattaaagttgcaattgcctgctttatatgttggtccttctcttgactaatggccctaaaagcctt

SEQ ID NO: 38634 - DNA, 1031 bp, Heterodera glycines
tctttttcccctcttttccccctctttttgcacttttgcctccccgttttgccattttattaattcttcggattgtgtgcacattgacttatctgataatcatgtgcaattcattctcttctctctctctctctctttcattttccttttcctctctttttctcttttccctccccacttctttctttttttgattcgtttcgccgttgggcgtttgttttggtggaaatgtaaaataatgcaaattgtttcggatcactaaatgcatccgatcgttgttttgtgacgtatttaattttggtctaaaatttgttttcgcgtcaaaacagaaaacactttttataaatacaaagtgcataaaattggtagagagatcaaattaacacaaaagggtcaattaattgtccttttttgtccttagtattttttaaaattttattttcatgctttgcattatatttttccctttccttttccctttccgctttttgttgcttttggcgatacaaaaataactgttttttatcgcaaagcaaaaatggacagtgaaaaagcgtcggaaatgcgaccaataaacaaaaatggaactgatggcaaatgaatttcacaagtttctctcgcccatcattctttcccacacattcctttatgttttttatataaaaaataaaaggcaaaggaataaagtgcggtgaatgtcaaaatgcactcatttgtccgttatttatcctttaatttgtccgtttatttatccgttttatttgtccgtcggtgtctttttcactttttttacaattaaaattcggtgactcatttctccgccattttttaatttccttcaaaacaaaatgaattaaaggagaggaacaaaagcttttctttttttccttccttaatgatgtgagaagctctgaagcaacgaaagaaattcattaaatcacaaaacttttctaaagtacacacgaaattcattgctttccaactaaatccattttattttttaatttataaatttaaatcctttgccactt

SEQ ID NO: 38635 - DNA, 1243 bp, Heterodera glycines
tggccatcatttgctgagtttgctgctgatgactctgtccggtgccgttgttgtgcgggtgctggtgacggatctgcacaatttgctggtgttggtgaagagtctgccggtggaaatcacaaaaattgaaaagccaataaggggggggggagtggaaactcaatcgaattcaaatcatttccaaatgacccaaattcaattggccatgccattcatttccctccccccttctccataaccctaccgtgtgctgctgctgctgctgattgggcggactgccaatgttcacaatgtgttgctgttgctgctgttggtggtggaattgggcagcggcgcccaccgcttgttgcgggtgccgttgcgggacgaaaccgccggcggatgggaagtgttgttgcagcacatctgcggaaaggcaaagaaatcagcaggaaagcgtttggaatggtcaaatttcccctctgactttgttgccgctggccaagtgccgaagttggcggcgtcgccgaccgaatttggtgatgcatttgctgctgctgattgtgagcggcggccgccatgaaattggcttgctgctgctgatgctaaattggtaataacaaaaaattttgcttttacttcaactccctctttttctgaatgtatataaatagggctaggatttttatgttttaacatattttttttgcggcttagttatggcgagagaagcccaaaaatagcattttctccgaacaatttttggtttagagcgacttataaaaacataaaaacacatattttggcgttttggcacataaaatatgttagcacatattttggggtttggcacatattttgcacatattttggcatttttgagaaaaattgcaataaaaatacaagaaaattgaaaaatacacccctaaaaatcgacttttttcctaattattaacataattttcaaattaaaaaattttttcttcgattgtagaaactaatgaaatctcgaattcattaattcgtcattggatttcgaagttctctgctggaactttcaatttatagaaatgatttatcaaaaaaagacaattttaccccaaacacttcgaaatgtatttgatttgcgttgtatgggctaaaaatgataaagaatgagatttttgggaatttttatgcaaaaacacacttattttttcaatttttaacacatattttagctaaatgttttggcatttttgggggtttttagcaccatatttca

SEQ ID NO: 38636 - DNA, 1640 bp, Heterodera glycines
  misc_feature (1479)..(1479): n is a, c, g, or t
  misc_feature (1505)..(1505): n is a, c, g, or t
tataaaaaattatgattagaaaaattcgaataaaataatgaagtaaaattataattaaatatattaactccgaaacccgggcccgatttcgatcaaaagtcgaaatttcctttttatgcaaatttatataatgcacaaattactaaaatgttttttagaaaagtttgacggaatgtatttgaaaaactgaagtgtgtgtataaaatttgaattttgtcaaaaattatttttaataaaagcaaatggattatactaaactcgattcgattttccaatagcgtttaaagagttcatgtttaaataaattataccatcaaatctatcaattacacattaataagtaataaaaaccaacttaattaaacataaatattttgataaaaattattgattgttaaggtcacaaaacatttaataattttatccaagaaataataatcgttttaacaaactcttaaaagacaactgaattttttcaattatcaatattattgttaatactttacgcaaaattagcagatatttgttgacaacagaaaggaaacagtgtttttagtacagcacatattttaaaacatagaacatctttttattatttaatttctcaaagttataaaaagatttatctttttatatttttatactatgaaaagtttattttaatttaacttagtattttaataaatattgtaaacaacttgttaataaattatagcgccttctattaatttcagctacgttttttaccatgttcatgcaaatataattataaacatttttaatttcacgtcattaaaatgatttaagtcaaaataaatttatattcgatagctctaagaattctatatttatggttaaaaaatcaaaaaattcattgatttctggtaaaataattttgatataatatttaaaaaagaaaaactttcttaataaaatattgtaaacaacttgttaataaattatagcgccttctattaatttcagctacgttttttaccatgttcatgcaaatataattataaacattttaaatttcacgtcattaaaatgatttaagtcaaaataaatttatattcgatagctctaagaattctatatttatggttaaaaattcaaaaaattcattgatttctggtaaaataattttgatataatatttaaaaaagaaacactttcttaataaaaatttttctttgttaatcaaattaatacttcgtatttacattcctttgaatcattttatttatttgaatacaaaatcgtatatttaaatatttacattgaatgttctttattttcgtaatttaatcaagtcaccaacagactcattgttttaaattttttatcacttttagttatatgtaaattataatttctctattatcattatagtaccttataaattatgtaataaattatattctttttttaaatcctattaaaagcactatcatatcttttctagtttcaataaattanagtttaaaagattaatgtattattanataattttgaaagaatgcattattttgaaaatacaaatttagagttttcttcagtaatttcacataatattttgttgaattgatgagttatttttttatttttaagcataatatgcatgcaaaaatttactaatt

SEQ ID NO: 38637 - DNA, 969 bp, Heterodera glycines
agctttaaatctgcaagaaattagattggcaatatgtggttgtaaaaaacttttgggtatggaattatttttgaagtgagtcaaacaccgtattagtgctttgctgtgccgagaaccggcaggcaatggatagctttcaatctgcaagaaattagattggcaatatgtggttgtaaaaaacttttgggtatggaattattttttgaagtgagtcaaacaccgtattagtgcattagtgctttgctgtgccgagaaccggcaggcaatggatagctttaaatctacaagaaattagattggcaataagtggttgtaaaaaacttttgggtaatgaattattttttgaagaaagtcaaacaccctattagtgctttgctgtgccgagaccggcaggcaatggatagctttcaatctgcaagaaattagattggcaataagtggttgtaaaaaacttttgggtaatgaattattttttgaagtgagtcaaacaccctattagtgctttgctgtgccgagaaccggcaggcaatggatggctttaaatctgcaagaaattaaattggcaataagtggttgtaaaaaacttgtgtaaggaattattttttgaagtgaatcaaacaccctattagtgctttgctgtgccgagaaccggcaggcaatggatagctttcaatctgcaagaaattagattggcaatatgtggttgtaaaaaacttttgggtatggaattattttttgaagtgagtcaaacaccctattagtgctttgctgtgccgagaaccggcaggcaatggatggctttaaatctgcaagaaattaaattggcaatatgtggttgtaaaaaacttgggtaaggaattattttttgaagtgaatcaaacaccctattagtgctttgctgtgccgagaaccggcaggcaatggatggctttaaatctgcaagaaattagattggcaatatgtggttgt

SEQ ID NO: 38638 - DNA, 308 bp, Heterodera glycines
agcagtacaaggagtgtttgcaacacaaagttcgaataacgtggcccaatcggggaataatccatcattcgctcgatgttgtcgatgatcacacagctaaggggcgatttgtacgcgtcttcgaaaacctgacactggttatttagttctctatgctaattgtcacactcaccttccgaattttggcacattttgccgtctcgctgtacccaaccatttcttcgggagtacaaactttgatgaatggaaattccgagtccttggcaatttgtgcagccaaataagacttgccagtatttgggggacct

SEQ ID NO: 38639 - DNA, 703 bp, Heterodera glycines
agaaaaaacggtactcaggacggggaatgatcatttggaaggcgaattccatcgatacccccgaccttagcaagcaacggaatgccaaaagaaggaaaaaatgacgaaaacttcaaattttcgccccgaagcaaagagtactgtccgccctctttgagttcgttgacagccaaaaaaaggtcatcggcacaattggagaagaagatgagcaatcctatgcagcagagagagggttttgaggaaaggaaaggcaaagaatggcaccggtgcgaacgatgtccgaattggttttgaccaaagttcgaatgtcgagtgcctgggtcagtccctggaggcatcggacggtgattttggcaacactgccgaaggcgtggtttttgatgcgaagaagggcagccaaacgacagaacagactgaaattgatggagagggaaatgccaaaacagaggaagcagcgggggacaatcgggcggaaagagtcatttgcccgggggcaaaagttagccaaaaaatgatttgcccatttgccccctctcacctggccaccatttccttttctttgtttgaggctgtccccgtctgaacgatggaactgctggccatgaaatactgcttgtgtgcgttgaaataagcaaacatcagcggaagaacctttagagattcaattataggagcagctctctccccccccccccgcatcgtt

SEQ ID NO: 38640 - DNA, 1251 bp, Heterodera glycines
  misc_feature (1117)..(1117): n is a, c, g, or t
  misc_feature (1154)..(1154): n is a, c, g, or t
acattgtgccacactcacatggggcaacgcggcacgcacatcgtccgacgcacccgcgaggcattcgtcgatcactgctcggggaggcaaacatccgcctgcagccagtgctgtctggcgaatgtgacgcgtcagtcgctgtgccgcacaacgggctgggcacggcgcgtggttgtgcggtttgcccagctccaccttttgacgggagacatatatagcattttttggtttcataaatttttggaatggggggttggaatagcacaaaaaatttatggaggggagtgccaagttgttgctttgcggatttgtgccaacctcggtgccctccgcttcgcccactgtccgcgccgaaccggcacagcggtagcgccggttttggtcacagcgccaataaatgctgtcgccccggtgccgactccgtcgatacaaatggccaccgcactccaacttttttccaccaagttgggacctgaaaattgaccaaatcactcggtaattgtcggctaattcggtgtaaaacgaattgcaaaaaaaaattaactcgaaaaatgaggcaaatagcactggttgatgagcatcggacgcaagaggagagagcccagatgaaaaagaagcatctgaacacataaacttaggcaagccgaccaaccaaattctattttttaaaaactatttcaattgacaccattttggtgaacaaactctgaccatccatcgctgtcccattggtctgttgctgctccatggcttggctttgctcgtcgttctcttccgctgctgggaacggtccgcccgacaacaatgccgtcacaatttccttcacaatagcgtcgtccgcctcttcttcatttgccattccgtcggtgtccccacaaatgtcgtttaaatcggcactgacagtggacgggtcaacggcatggccactgttctgtgccgatgccatcggcgaattcggcgcttccactggaatgaatggaaaatattcaaattagcaaaaatagataaaaaaaaataaacaaaaattaaatggcaagaaaagcccgaaagaacataggaataatgtgtaaaatcagtgactattcattcataaaaaacaacgaaaatacacaaaatnttcgggtcggtcattcattcttcgctgatcagtttanatgtgttggacatccgtcgtggtatcacgtttgaggtcagcttgtaatggtctcaaaagtcgcggtacgcgtactgcgcgtacatcactcgttcttc

SEQ ID NO: 38641 - DNA, 1305 bp, Heterodera glycines
tccggcaactctcattttagccttcccttagcttctctctcctcgtttatcacatcggcagcaggtctaacccgtcaatgccttcgggttttttctcagcgaataagtcgtccctttcgcccgtccttagaatctattcgttgtttagaaacctgaactgcgcaacgggtcacatccatcaattaattaattaattgcttaattttggcttcaatttgttttttttaattcaaattccatcagcagaagaaggggacaaaatctgttcattctgtgaaatatttctctttttttaaatttatttccgtctttttttacgaatttttcctttgtttgttttcatataaatttttttgatccaaaacaatacaaaaataaactcaatttttcgcccaaatgactcattacggaataaaacgtttttctttcacaattcccttaatcatcgcacagcttttcttttacatttttccgctaattattcctgtgtttgttgggaatgataatttggcgatttcggcgtctgcgaatgatttgaggagattatttccgctgtttgatcattttgtgttgtgatctgttaaaaatcccttgtaaatctgttggctaattagtaaatgaaattattcattcattgtccattattttaagacctaaaatatttctccaatttaaaaaatgcgtaaaatcaaattaaactacttttcggctctgtgagtcaagactctcgcgcttgcgcacctttggtaatgccaatgaatggctctgcgcctcccctcgtcccatttcccccccccccccccattccatggcccacctgctgcttctgttcctcctcctcctccttgtgctccttgtcaccgttctgctgctgctgcttgtccttcccctccccgacttggcccctctctttgcccagccttctgtccagcccctgctccatgaccatcagcagttcctcctcctcccgttcgttcagatacacttccccccccgaggatgagtaagtgccacttcgtctctcttcctcctcctcctcctcctccgttccctttgccattttaaactcctcttcttttctgccttcgttttcttcttttctgccttcgttctctcctttttgtccatttgccactcttttctccaactccttttccgagtgatgcttctttttctgcttctttcgccttttcttttgcatttctttcttttgttttttggcggaaggtgaatgagaggaagaagaagaggacgaaaatgaagaagagaaagaggcggaggaggaggagcgcgaggaacgccgcg

SEQ ID NO: 38642 - DNA, 855 bp, Heterodera glycines
  misc_feature (461)..(461): n is a, c, g, or t
cttcaatgttatgatacaccttttctccgcgtcagcatgatgatctgatgttcctccaattccgttggaagtctacagggatgatcgtgtcttcacatatgacaggaggccccaatgttttcgtgaactcattgatgcctatggtcggaacttggataaatatgacaagtcgcacatactgttcaattatttggatgcgatcccattgcgtttgtttgagtagatggaagatgcaatgacacagcggtttgttttttctaaagccactcttcatgttgacgctgtgctccgctcagtccgagactatatcaagccatcacacgttcacatttcgcccataagactgcacctacggtgaagtgattttctaatcacttgttgtgggtctccaattgagatgtcatctcattctccctctattccgtctttgcagaacgctaaacattacccccccccccccntggatacgcccttgctttattatgaggggaatcaaaatcagaattattttgagttggaataaaacataggcatagaaaaggcgtataaaacgttgatatttttagggtcttaaaagagaattagaagtgttttttcggtgctgtaaaaatttttccttatcctttttcaaaaaaaaaaaattcttttaaatgcccatttttgtcgaaaaaattggcactttggagatttcagggccaaattttggccgccaaagttcaatttttccacacagaacccagcagtttagtggtactaatataatccatcaccctttacattgggtttgtaatgcttcttacataatggcactcgcgtccggcaccgtgccaatgaaatatccgcccggattcagtc

SEQ ID NO: 38643 - DNA, 983 bp, Heterodera glycines
  misc_feature (62)..(62): n is a, c, g, or t
  misc_feature (123)..(123): n is a, c, g, or t
ttttaccaagccaatgatattttaaagactctttttaaaaaataacaggaaaaagcaagacnatagcaaaaggcctagagaaattcctcttgtaagttgtactgagtttgtgcaattcccatntaatggaatttttaccaagccaatgatattttaaaggactctttttaaaaaataacaggaaaaagcaagaaaatagcaaaaggcctagagaaattcctcttgtaagttgtactgagtttgtggcaattcccatttaatggaatttttaccaagccaatgatattttaaaggcctctttttaaaaaataacaggaaaaagcaagaaaatagcaaaaggcctagagaaattccacttgtaagttgtactgagtttgtggcaattcccatttaatggaatttttaccaagccaatgatattttaaaggactctttttaaaaaataacaggaaaaagcaagaacatagcaaaaggcctagagaaattcctcttgtaagttgtactgagtttgtggcaattcccattttatggaatttttaccaagccaatgatattttaaaggactctttttaaaaaataacaggaaaaagcaagaaaatagcaaaaggactaaagaaattccacttgtaagttgtactgagtttgtggcaattcccatttaatggaatttttaccaagccaatgatattttaaaggactctttttaaaaaataacaggaaaaagcaagaacatagcaaaaggcctagagaaattcctcttgtaagttgtactgagtttgtggcaattcccatttaatggaatttttaccaagccaatgatattttaaaggactctttttaaaaaataacgggaaaaagcgagaaaatagcaaaaggcctagagaaattcctcttgtaagttgtactgagtttgtggcaattcccatttaatggaatttttaccaagccaatgatattttaaaggactctttttaaaaaataac

SEQ ID NO: 38644 - DNA, 1101 bp, Heterodera glycines
aataaaaattttcagtaaatttttttgaaattttaagcaattttcttatcaaaattgattaaaatactcaaaaattttcccggcggcgcctatcggcaccgccggacgacccccattttaccatatttgtaaaaaatggagaacaaaatggcaaaaaattgtaattttttggcgaaaaacgactagaatttttgtaaaacacaccccataattcaggatttcaaaaaacgaaaaatacacccctaaaaatcgagtttttgacttgccccttccgaagccaagggtctggctacgcccttggctcctaagcctggccttggaaaattttaaataccaaatcaataggacccggaaattcgaattcgaaaccaccgggctccattttcaaaaaagttgaaatttaaatgaactacggtaatgggaattacagttgttttttttccattgcctaccaattttcacgcttacattccgcagagaaaaatcatacgtctaccgtaccccaatagtttttgaaatactgtatcagtcactgatagaattttcaaattttcattttaattttttgaaaatttccaacaataggcgagaatatataaaagaaattgtgattaatgtccatgccaaccgcgcggcactgcgcggcacaacaattttggcacttttatttcaaaaaggtgtgacaggcaacggcggaacactaattagtgccattagctgccggggtgggcggcggagaagcagctaattagtgcgccattagagaaaagtgcaaagagaatgcgcgaaaacggcaaaaaagtgcggcggcgatggcttcattttgtggcacatttgccccccgattttctgttgcaattttttgctctcaatttttctcattttgccctcccccgggcccattttttcccatcggcggaagggaaaaagtgcaaaaaagtggcacttaaaaatgaggcaaaaagaacaaatttgatttttctcctcctttttgtgtaaaaattttattttttccaccaaaatcattttgttatgttttgctaattgttttattttaaattgctttaattacaaaaattaaaatttccaatttttccattt

SEQ ID NO: 38645 - DNA, 1802 bp, Heterodera glycines
  misc_feature (61)..(61): n is a, c, g, or t
aacgacctgtgcccatcagcggacgggggcatttggtggtgccaacgctagcccacagtancagcaggtaggtggtgaataggaatcactggagtaatgatccagcagcaggttcacctacagctaccttgttacgacttttgcccggttcaagccactgcgattaaatcggttccagtctgcataccgaccgaagccggaacactaaccgtccccgaatttctcgaaatggctcagtcccgggcagcgacgggcggtgtgtacaaagggcagggacgtattcagagcgagttgatgactcgcccctacaaggaattcctcgttcacggacaataattgcaatgtccgatcccaatcacggcaaattttcaccggtttaccaacccctttcggggaaggacaagcacgctgattttgccagtgtagcgcgcgtgcagccccggacatctaagggcatcacagacctgttattgctcaatttcgtgcggctgaacaccgaaaatccctctaagaagttgtgcccacagaagcaatgagccaactatttagtaggctagagtctcgctcgttatcggaataaaccagacaaatcgctccacgaactaagaacggccatgcaccaccatccaccgaatcatgaaaaagctatcaatctgtcaatccttacggtgtccgggccgggtgagtttccccgtgttgagtcaaattaagccgcaggctccactcctggtggtgcccttccgtcaattcctttaagtttcagctttgcaaccatacttcccccggaaccggaagactttcgtttccgggaagctccccaccagggcgaataaatccgccggcggatcgctagttggcatcgtttacggtcagaactagggcggtatctgatcgcattcgaacctctgactttcgttcttgattaatgaagacattcttgcccaaatgctttcgctgtagtccgtcttgctacggtccaagaatttcacctctcacgtagcaatacgaatggccccgtttgtctctgttaaccattatctcggtcagcaaaaccaataaaatcggaccgaaatcctcttctattattccatgcacgaacattcaagcgaaacgcctgtttgaagcactctgatttgttcaaagtaaactcgccagcccaccgacgccgaccggtaaaggccaacgccggggagagaccggcagaaaagccaaccaaaccagtaacacacaaagtgtgcaccggacggctagcacagatccaactacgagctttttaaccgcagcaataattctatgcattttgagagctggaattaccgcggctgctggcaccagacttgccctctcatagatactcgttaaagggtttaaattgtacccattccgatgaccggcctcataagagatcggtctcgttatttctcgtcactacctcctcgcgttgagagtgggtaatttgcgcgcctgctgccatccttagacgtagtggccatttctcaggccccttctccggagtcgaacccttatcctccgttacccgtcatcaccatggtagtcagatacactaccatcgaaagttgataaggcagacacttgaaagacacgtcgccggtacaagaccgtgcgatcagcttagttgttctgagtcaacactggacgcccggagggcgcttggttttgtggcgaacaaatgcgctccgctctggggagattggagctttggtgcatgtattagctctagaattaccacagttatccaagtaagaagtcaaggtcaagtaaattatagctggtgtaatgag

SEQ ID NO: 38646 - DNA, 1744 bp, Heterodera glycines
tgtataaatggtcattttccgttcaaaaactgcattatgattattgttattattggcattgtgcagctgctggttaccatccattttcggacgtaaaaacttgaagacgaaaagtgaagccaaattaagcaaaaggcaaatgatgccaaatgcgagggcggaagaagcggcccttagactgtaactcggattctaaatatccaaaataataaaaaattatataaaatttctcatttttattttatttctcacatcattggcagtgcgttcgttgttgtcaagagtgaatgtgacattatccttttgaacatgaataagcatgtccaagttcaaaatttggaaagtgaatgccaatgggaggacaaatgtgataaacagaattgggaccagaacataacgccataactaaaaagcaaatttaaatacatatttaaataaaaaatgtgcccttaagagacttaaaggttaatttatccataaataaaaaaaattcaacgaaagtattgtagaaatggcctcttttactaaattgtgggcctaattaaacttattgtattttcccatttttgatttatcccgagcaggattgttccgagtcaccctgataccgaaaccttaatccagaaacccgacatgtttctcgtccggaagtccgaaacccgacacgatgattttgggtcgtgtttcgcggcaaaaaaaattaggtaaattaggtaaatagtaaggctgctgccccccccccttttcgaaattttttttgtgttttcaatggtcatgaaaacatgtttccaaggcttttcggggtcgctgatcacgaatccagcatccatttcgaacaattccgaatcccaggatcccaaaaagttggaaattcaaattttttgatttccttgaaaaatttgaattcgactttttttttgccggattcgtgatcactgatcaacgaccccgaaagcacttggaaacgtgttttcatgacttttgttaacaaaaaaaaaaatttcgttcacctccaaaagctcggcaatttgttcaatccgggtccgaacatactcctccgtgtccaccgtgcggggcctctgcggaatttgctcagtgtccatcactgttcgtttaattataaatcaatcaaaacgggacttccaaataaaaaaaaaaccctaaaaaaaattgcatccaaaatatgtaaaaagttcacgacggcgactgttggcaccgacgaattcccctgcatcattaactctctaaaaacaataatctatttctgcacacttgtatagttttgtgaaactacttccttaatatagaagtatttcattaaaagaagaaaagatctgaaacatacttatgaataacaataattacatattcctatttatgtaaaaccaaaaataaaaaacagatttgtcgtttgacactgagaatatctataaggacgaatcaatatggattataaaaattataaatattttaaaaatcaatatgtgttacttgccacttccgctttgttatgcgctcaaaaacacccattttcgaaattttatttaaaattacatttatcaacagaaaaaacaattttgcttgccaacaaagtagaaggcgggtttccggttcctcggagtaattttcggatgggctgatgatcggctcaatttcaatggaaccttgatcggttgagttactgaattttgaaatttaaaagtattttaaaaaaaaatcttttaaaaaatgaatttgacatttt

SEQ ID NO: 38647 - DNA, 1016 bp, Heterodera glycines
ttttatttggcttagcatattaattttaaattttctataaataattttgaattttaaaagtttaaattaaaattaattattattctctctccatttctcgtttcatagatatttatctcagtgtttttttcagcgagaaaaaatactccaaataatatgtcattatattagtcatgataatacttcaattttaaaatcaattttataaaatgtctaaatcgcttttccaatttatcaatttccctaaaggtagaaactaaatatatgaatatatattttaatgtatattaggattgaagttcgaattccttcccacccacaaatcataatagaacacataatatgtcatccaaaatacttaacttttattcaacagatatagtatagaaatactagaataataactaattacaaatcgtatcaatcattcaaaaaccgtaaaaaaataccattagagtcactttataaataattaattcactgttctgatcgaaaagagcaaaaaaaagaaactgaaaaactgaggggggggggggggagggaagaaaggtgtgatgttgggaagaatggcatctgtgacggatgaaaacgccttctttggacgaacggagcgatcgatcggtgccacagaaaagcgatcaatggcaaacaaaacgcaaaaccgaactgagcaaagtgcactttgaaattggctggtgctgttcccagtgtgcttctgttcgccctttctcaccatctgctgccaattggcttttgtcgcgtgtcccttcggcacttttcctttcggcactttgcccttggcgttgtccctctctcttcggcacaaaagagttggcccagtggcgttggtcgttctcccgatccgagtcttctccaagacgccattttcgaccactctttgcccctgattatttaagaaaatcgtcaatgggtggggcattttaacgaaaatgcctttttcgtttggaatttattgcgaattttgcgcaattgctaggagttttcggcggaatttg

SEQ ID NO: 38648 - DNA, 884 bp, Heterodera glycines
  misc_feature (746)..(746): n is a, c, g, or t
  misc_feature (826)..(826): n is a, c, g, or t
  misc_feature (832)..(832): n is a, c, g, or t
atggaatatggagtcgcacagaatggtaataatttgaaagatacgccaaatatttgccaagtgaatttccgtgccctgacggagaaattcggcaaaaaccccgggcgttttggctcctttttcgaactcgggaaaagaccttttcgtttaaattttcctaattatttattttcccatacttttaatttgcggccaaatgttatttgtgcgcttaatggagcagagaaatgattttccatttcttagcagttccggcggatggaattagcaaattacgttaacttaaataaatttgcattacaattttttggtctttaattttacccatgtccgttattcggtattggtcttgggaattgcccggtcatttgcaactttcttgtgacgggagcaaatataaaaaacattcgacagaaagctaatgccaatgccaacgaacaatttaagagagacaattaaagtcatgtggattgtagaatggactggcaattaggttttaaattgtttttgcttttttgttttaaattgggaggaaaaaactccggcacaaaaattgtcattttattaataagggctttattagctatttattatgaatttcttattgttaattaaattttttattttatgatgtaaacttaacgtcaaaagtacatatttttaaaataatttgactcaaaaaataataattaataattatcagatacaaagttatttaaaaaagaaatgatgaccagaatcattanataattatagtggcaggcaaaaaaagaagaggaagaaagtgttcagatttcactcggaaaccattcatcattaattctantagctntctgtaattcaaaagatagcgaaaagtttgaaaaacccatcccttttaaaaa

SEQ ID NO: 38649 - DNA, 1434 bp, Heterodera glycines
aagcatatcagtaagcggaggaaaagaaactaacgaggattcccgtagtaacggcgagtgaactggaaagagtccagcgctgaatcgcagctcctctggggttgcgaggtgtagcgtatagaccgtgagcttgggttggcccgcttgttcaagtttcccttgaccggggctccagagaaggtgcaagacctgtccaactggcggtgcctacccatctttacgtgtcttggagtcgggttgtttgggatcgcagcccaaatcaggtggtaaacttcatctaagactaaatacggccacgagtccgatagcgaacaagtaccgtgagggaaagttgcaaagcactttgaagagagagttaaagaggacgtgaaaccgatgaggtggaaacggacagagctggcgtatctggtctgcattcacccgtttgttgctgtacgttgggctgctagcctccagactggggtttgctgtccttctttctgttcagtggcgaatggggcatttgcaggcggagtgcgctgagatgctcggagtagctgcgtgagctcggtcttgaggccagcctttcggggtctggtacccggatcgggggagtgctgtttactctgggtgaattgtgcaatggtttcgggtccgtgttgactcgagctgggggtcggtggcggtcgcgtgcgacacgtaccagcaaccagttcggtccagctcgggctctcagttgtgcgttctcggtgtaaaagccggtcatctgttcgacccgtcttgaaacacggaccaaggagtttagcgtatgcgcaagtcattgggtgttcaaaacccaaaggcgcaatgaaagtgaaggcttcttacggagctgatgtgtgatccctggcactgcggtgttggggcgcaacatagtcccgtctcgatcgcatgcgatggggcggagacagagcgtatgcgctgagacccgaaagatggtgaactattcctgagcaggatgaagccagaggaaactctggtggaagtccgaagcgattctgacgtgcaaatcgatcgtctgacttgggtataggggcgaaagactaatcgaaccatctagtagctggttccctccgaagtttcccccaggatagctggagctcgttaagcagttatactcggtaaagcgaatgattagaggacttggggacgaaatgtccttaacctattctcaaactctaaatgggtatgaagccagggttgctttactctgaacccaggcgttgaatgtttgagctccaagtgggccatttttggtacttgcgctgaacggagttgtttctgctgaaactatccgtctttacaagacggctgtaatagcggcgcttggcaacgctcgctagcagctatctggttgatcctgcctgaactgatgtgaaaatttcaaagattaagccatgcatgtgtaagttaacc

SEQ ID NO: 38650 - DNA, 981 bp, Heterodera glycines
  misc_feature (841)..(841): n is a, c, g, or t
  misc_feature (855)..(855): n is a, c, g, or t
  misc_feature (906)..(906): n is a, c, g, or t
  misc_feature (934)..(934): n is a, c, g, or t
  misc_feature (936)..(936): n is a, c, g, or t
tcatcagttgttatgctctaaaaatgattttcgggccgtttgagtatatgtgaggtatggacggtccaaaaaaatggctatctctttttttggcaatctggtaatagaaatctctttggaaacaatgacagtggctgtcatcagttgttatgctctaaaaatgattttcgggccgtttgagtatatgtgaggtatggaaggtccaaaaaaatggctatctctttttttggcaatctggtaatagaaatctctttggaaacaatgacagtggctgtcatcagttgttatgctctaaaaatgattttcgggccgtttgagtatatgtgaggtatggacggtccaaaaaaatggctatctctttttttggcaatctggtaatagaaatctctttggaaacaatgacagtggctgtcatcagttgttatgctctaaaaatgattttcgggccgtttgagtatatgtgaggtatggaaggtccaaaaaaatggctatctctttttttggcaatctggtaatagaaatctctttggaaacaatgacagtgcctgtcatcagttgttatgctctaaaaatgattttcgggccgtttgagtatatgtgaggtatggacggtccaaaaaaatggctctctttttttggcaatctggtaatagaaatctctttggaaacaatgacagtggctgtcatcagttgttatgctctaaaaatgattttcgggccgtttgagtatatgtgaggtatggacggtccaaaaaaatggctatctctttttttggcaatctggtaatagaaatctctttggaaacaatgacagtggctgtcatcagttgttatgctctanaaatgattttcggnccgtttgagtatatgtgaggtatggaaggtccaaaaaatggctatctcttnttttggcatctggtaatagaatctcttngnaaacatgacagtcctgtcatcagttgtatgctctaaaaatgattt

SEQ ID NO: 38651 - DNA, 1092 bp, Heterodera glycines
  misc_feature (97)..(97): n is a, c, g, or t
tatttttaaagctttaattcacttaaattgaccagccctcactggagttatgaattttcaaatatttggccaaaatcccctagggacaaaaaattgncaaaaaataaagaatttttaaaaaattccaaaaatcatgaaacgaaaaacaaaggtcaaattcgagctcagcacctcaaaataccccagaaaaaatttttcaccacccttttcaagcctaaaaaaattttcgaaaatttctagggggcctagctcgaaaatttttgaaattttccgggcatatagcacaccgttcgatagagcttaaaattctctacaaaaatgttctaagacgatttttggctaaaaccaatccctgacgagttatgggcccaggactcaaatgtcccgctgaggccaaaatttttttctatttccgggaaaaaatcgaaaattttccgaaaaaaataccagtcgatagagctcgaaaaactatgttttggaagtggtcttcgtttttctgggaaaattcgttaaaaaatcctaaaattcaaaaacccgaaaaccgttttttaggcctagctcgaaaatttttgaaaattttcgaaatttttaaaattcagaaaatcgagcttccaaaactctacaataagtctgctgggcacctttccctcagatcaaaccccaactcggtattcgcctggtactgaagtgtactttttgagcacgcttcagttgccattttctgcaggccagggggtggctctattaaaaaaataaaaaataccagcatgtagaggacactttggcggggtgccctcgcagcggacattttttgattcgagttttagaaaaaaagttacgggccatcaaacgcaagcaaaagtgagaaattagccgccgggactcagttggccaccggagagaaaaacccgtatttttcccagatgcgcctcaaaatgttgtaagacccttccactactttcagggagctcccggccttcggccgggagattttgttttttaagacgagtccccctttttctctatatatatataaactagcgtgtgtgaattgacgggggcgcggtgcaggcagttgacttgcacgcgcag

SEQ ID NO: 38652 - DNA, 994 bp, Heterodera glycines
tttttaatatgcgaaaaattttaggcttaacttttctttttataaactgatcagaagcgaaccagattttgcgagggcatcaaaaagacaaggaaaagcactgctatgatgcttactccagtaattctgaatttaaaattttttattaatttttaaagcttcactattttatttttttagcaaaattaattcataaatattttttcacaaactgctctgaaacgcaccaaattttatttacaagttattttaggcactcagatgctttcactatcaaaaagggagatgaataaaaatctaaaaatttttaattgctttttaaatatgcgaaaaattttaggcttaactttttttttataaactggtcagaagcgaaccagattttgcgagagcatcaaaaagacaaggaaaagcactgctatgatgctaactccagtaattctgaatttaaaattttttattaatttttaaagcttcactattttatatttttagcaaaatcaattcataaatattttttcagaaactgctctgaaacacacaaaatgttaattaaaagttaaataaggctctctgatgttttttctatcaaaagggagatgaataaaatttttaaaaatttttaattcctttttaaacaggccaaaaagtttaggcttatattttaaaaagtttcatcgaacctagcgcactaaaatcgatataatctctccaaatgttgcaggccttctccattgtaaaggactaacttaacctgaaaaaatgccaacgcttgttgtttttaaaatttttcgaaattctgactttttcattaattatttattttttgcaaaattaattcataagtattttttcagaaagtgctctgaaacgcaccaaatgttaattaaaagttaaataaggctctctgatgctttttctatcaaaagggagatgaataaaatttttaaaaatttttaattcctttttaaacaggccaaaaagtttaggctta

SEQ ID NO: 38653 - DNA, 1169 bp, Heterodera glycines
agaagtgtcattagacaaactcccaagcattccgctggagagcttctttgcccgtcggattcgggaggcccaactcatcatcattgatgagatcaccatgcttcacaacacggtgattgaggtcatcgaccgagtgtgcaaagagatggcaattcgccagcacaaggatctcctcttcggaggaaaaacggtcattttcagcggtgacttcaaacagtcgctgccggtcgtgcctcatgaaggcttaaccgctcaggtgacagcctgttttcaaacgtctccgttgtttggtcaattcaccacgatgaaattgaccatcaaccagagactgggccaaggtcagcaagcgtacttgcaaatgtgccgccaaatcgggctcggagaaaccggagagcacttctggattcctccgcagttcctcgttaagagcaaggaagagctgatagattatgtctatcctaacttccaacaactccttggcaatgacaaagagctgctcaatcgtttgattctcgctccgcacattgacacgtgtgatgaagtcaacgagatcatgatggcgaatgtgccaggtcaagtgcgggaatacttgtccacggataagccccttgacgaccgcccactggacatcgatgagatcgagtccgaagtggctgcgttgaaccggcgcacagactcgggcatgcccccgcacagtctccggcttaaagtcggatgcgtcgtcgtccttcttatcaataaaagtgataaggaaggactgatcaatggcacacgcatagttctggaagaacttggcgatgatcgcctcattggtcgtgttatcaatagcaatgctattggcggccaagtgagattctttcttgaaagaacacgaaatgtctatgaagacaaatcgcctggcggcataaaatatgagcgtttgcagttcccaataaagcctgcattcgctatgaccattcaaaaaggtcagggccaaacaatccgcactgtcggcattgatctggaaagggaagtattttcccacggtcaattgtatacggccttctctcgggcaaccgacggaaacaatgtccgtgttcatgctcccaaccgggaaattgatgcccaaggccgagccaaagtgctgaatattgtagctactaatatgctcaagttacaataaatggctt

SEQ ID NO: 38654 - DNA, 891 bp, Heterodera glycines
attgaattctgaaccggtttgagtagattagactaaaaaccttttgagtgatcaaactttcactaaaaagttaagcctaaactttttggcatagttaaaaagcaattaaaaaatttttaaaattttattcacctccattattgaaagaaaaagcatcagagagcctaaactaacatgtaaataaaatttggtgcgtttcagaaccctttctgaaaaaatatttatgaattaattttgcaaaaataaataaaaacgaaagactcagattttcgaaaaatttttttgagccagctagctcggcgctcatttcagtgtaagttagtcctttaccggggagtatccctgcaaagtttggtacgcttctgctcaattagcaaaaaatatgagtgatcgaattttcactaaaaaagttaagcctacattttttggcatatttaaaaagcaattaaaaaattttaaaatttaataattttcctgcaccgaaggtactcactcggcctcttcgcggcctcgtggtgggccttcgccccccccccctcccacgcccttcagagcacgacaaatatttcaacaaaaattttgaaatcatgtttcgcaatccaacgctaacggaggtattattttgtaaagtctttttttcccgaaggagaaacttaattaaactccatttttcgggggaccgtgaatgttatttttattgaattctgaactggtttgagttcatcacggctaaaaaaattttgagtgatcaaactttccttaacttgttaatcggacgggtgcgcatgactttttcccaaaaatagttatgaaacaataaaatcgtttattcaagtgtccgttattgaaagaaaaagcatcagagtgcctaaactaacatgtaaataaaat

SEQ ID NO: 38655 - DNA, 1166 bp, Heterodera glycines
  misc_feature (10)..(11): n is a, c, g, or t
atgcctgcannggtcccttgccccaacaaataaaaaaacaaattccgatcatttttacattttttttggcacattttactttatattattaagaaaatttgaggaaatgttatttaaatcattattatttcaaaatttattattttttatttttgttgtgaatttgattatacgaattttcgacttttttgaagaaatgaaatttttagggataaaataaattttgtcggatttctatttaatatttgcgacaatccaaacaaaaagcattatttaagccattctatcattttggcatttttgttggctgttttttgcgcatcaattttttgtttccattccattgtttggcattctgtcgcaagcgcaacattttatagtttttgagcttttcacaattccttcgtcaaaatagcgctgattttcaatgtctacaatcacctccattctatgtatttttgcttttttgtggacacaaaaagcataaaatacacacgcacaatcacaaaaattgctttcttttgctttcccccgcttttcctttggcctttgtccgtccaccgattgccggcgcaaatcggtcaaaaatagcaaaaacaaaaaaaaacataaagcagtgtgatcattactgacgaatgttgtattagggctgaattggcttcttgcgatttgacgtcgtccgtctgacggcggccgaccatcgcttccccccaaattcacctccaaattgagcatccactcaatgatttaacaacagcaagaaagtaaagcatgaggaggaagaagaagcttccccgagaggaagagacaaaaagcattgacaaacggaagaaagaagcgcaatacgaagagaaaaagacaaaaaggagtgacaaaaggagcaaaaagagcgacaaagctcttcaaaatttgtctgtcggacatgtacgatgacaaaaatcattccgcttcaccagtcatcagcagcagcagcaacgaaaacaaaatgggccgaggggagggggacggaggcggcgagtcaaaatctcgagggtgtcctcggccccgcccccgaaaatcttctggactttgtgtccgtccgtccgtcgatgcccccgccgcgctccggaaacacccttccggaccggtcacgcctctcacctcatcaaccgcagcagcacatcctt

SEQ ID NO: 38656 - DNA, 784 bp, Heterodera glycines
gactcaacccaacagcatttcaatcacttgaactctccccccctaattccaatcactggcactcaattctcctgcattcctatcactagggactcaacccaccaaaattcaatcactgggactcaacccaccaacatttcaatcactgggactcaattctcctgcatttcaatcactgggactcaacccaacagcatttcaatcactgggactcaacccaccagcatttcaatcactgggactcaacccaacagcatttcaatcactgggactcaacccaccagcattccaatcactgggactcaacccaacagcatttcaatcactgggactcagcccaccagcattccaatcactgggactcaacccaacagcatttcaatcactgggactcaacccaacagcatttcaatcacttgaactcaacccacagcattccaatcactggcactcaattctcctgcatttcaatcactgggactcaacccaccaaaattcaatcactgggactcaacccaccaacatttcaatcactgggactcaacccaacagcatttcaatcactgggactcaacccaccagcatttcaatcactgggactcaacccaccaacattccaatcactgggactcaacccaacagcatttcaatcactggtactcaacccaccagcattccaatcactggcactcaactcacctgcatttcaatcactgggactcaacccaacagcatttcaatcactgggactcaacccaccagcatttcaatcactgggactcaa

SEQ ID NO: 38657 - DNA, 1497 bp, Heterodera glycines
  misc_feature (891)..(891): n is a, c, g, or t
agaaaaaggaaatacaaaagcaaaattggctatctcttccttgtgaacgaatttttcgtcaatacaataaaatttgaccaaaagaatttgctatttatttactgctcattggtcatttttatgtatttttacaatatgaatatttttaaattagactttctcaaataaggctttttgcaagcaaaagagattttcgactttgtattctttaatcaaactaacaattccaattcgatacaaatttttttggaaaacaattagctattgaatgataccacaaaatattaatttgatttaatttccatctcttttctctttttttccttttcacgctgttttttttttgggggggggggggggtgcgctttgaactaaaaattgacaattttggaaaaaaaaatccaaaatttgtacaaaaatttttcctgctgttctttggtgtgaccacgactcggagtgttgttggggtctaccctaccccaatttgtagatacattttcggcaaaattaatcacttttaattcgcaaagtaaacgagtcgacggcaaaaaaggaaccggccaaaaacaatcatgagattattatttttgttcatttatctattcattattaggtcacaattttgctgaaattattgggaaattcaaatatgaatgatctctatgggtcatcattttgccgcaatttattcttaattgaccctaaaaatatgtaagcaaaatcaggcagaagaatgaatgctcatttatttattcgatccctttttaacgaaataataattatctataaaaaaattaaaatctgaaaatgatttaaggaatttgcattttcttaacttattaaatgtcaatctcaaccaattctacaaatggcgattttacaccaacaganaggaggtaatgagaaaaagagaaaccgtaggaagttaaattgagttttggaaatgttaagataaatattaatttatgtttgcgaattaaattttataagattttcagaagttaattgtgaatcaattagtttggacaacgatggacaatctgatggaaaagcgactgatccgcagcagcagaaagtgagcaattaatagcatttgtacgagaaagatttgaaatattttgacataatatttttaaaggaatttgttgaaaagtgtgccaagatggaaatggacttcaaaattagcacattggaacttgagaaagttggttttcatagataattaatttatattcttgtcctgacctatgcacaaaatcgataaattagagaaatttcgtttaaatgttagaaaatggaaaaactaatttactattttgtgtttgcgaaaaaaaatgggcgtttctttacgatatttttacgtttttcgagaatattctgcgtataaatatgtagaaaagatttattatacacatttggacattttgtaaagattttgaggtttttgagaaattaaatgagggaaaatcgaaaatttttgaaaaaagcgcccccccc

SEQ ID NO: 38658 - DNA, 989 bp, Heterodera glycines
  misc_feature (967)..(967): n is a, c, g, or t
ccgtaggcggaaaagtcgcgcaattggtggatgaaatctttggagattgcctaattcaaaacgggattttcaagattgaaacgcaaattttaagtaataatttaatttgggaatccgacaagcgcaccggaatgccaaatgaatgcgcggattatggcaagtggaaaaaataacaatttagtgccacccaatttccttcttgttcaccttcaacgccgtattcgaagcgttgcaatttgcacattttgggcataagtccgagcagtgaccgaaagtgcgtctttatctgatcgttcaatagccgttgggccaggcccaacaaatcgaacagaatggcagaaatgccctggaaattgtaataaactaaatgttaaattcattggccttcgttaatattttatttattttcttagtttttatgttttaaacacctgatagccaaccaatttggccaccacacgaaaatggggcacaccaacgaaaccgccgtacatcatcgacaagttggagaaggaggagttcaacgatttggaaccgaattcatactgggccgcaacagcgggcggacgaccacgggacggcttacgatagttcaactgaacagggaacattaaaaaaacaatggctaatttaaaaatgattaaccggatcagaacttcttagaggtttaattcgacatggtgcatttccgtacaggtctgcatttatcatcatttccggttaaatttttaaaaacacgggacgtggcgggaagcgatccaacgccataataagcgaatggacagcaaataaccaactgagccaccaaaacgaaattaacaagcgaatttgcaatgtaatatgacaatcgtttattaagctcaatcacctttccgcgaacaaatcggcgcgtggccgtgttgaagcagaagttgaccaacacgtcgtccgtcagctgggcaacgcgtgcaagtgatgcgtccgttgngggcggacacttggcgatttgc

SEQ ID NO: 38659 - DNA, 1921 bp, Heterodera glycines
  misc_feature (842)..(842): n is a, c, g, or t
  misc_feature (928)..(928): n is a, c, g, or t
tattcgatcacttgtgaagtggtgtccccgggtgtcttcctagtcgccgcaaagaatgtgaccgatgaaatgtgaacacttcggtgaatcagcacaaatttgggattccatctaaacaaaacaaacaatgtaaatgtgtttcataaggtcatgattctcgaccatgcaattgaatgccttacttgatgcatggagccaagcagataggccatctgtgccagtttaatgtgcccgtgcttcatgttgaagtaaatgtgagtgtttgaaatgcaaatggcacttcgagtgccaacaattgaaaatgccaaaacttgtccttaggatgggaagtgtggtgcttaatttttcaatagataattaccgaccaacattgtccttttccattcccgtaactcccaaattgtaatagaccgaatttgatttgatcagtgctaattgcgttgatcgccaaaaagcggcacacccatccggcatatcgatgcctttccgcggtgtgaacaacgcgttgtaacctcctaaagtatcaaatttaaacagttaatccatttaaagattcgaacacacgggctgtaaaaaagggaagaaaatactgcttaaaatgaatgtcttgcacttcttgcaaacagaagacatcggcgtcgaggcggtcgaattcgatggacaaacttttcttaaaaatcgaaactaatgaatatctacatgaaaaaattgggaccgatttccccgccccctccctcaagcctcaaattggtgagcacagaaacgaggtgggaaggggacggggagaggggaaattttttttaaatctaacaataaaccatttattttttaaaaagcattanaatttgttgaaattttcacggcggtttgtataaacctttgattttattattgattttgaacatcctagatctccaaaattctgatncaatgtgaccaaatgatgcacccttttcgaatgaggcacccatatatgagcagcactattattagtcatgaaatgatcataaaacaatcgcaacaaaacataacagaaaaatatttttttgggtggagcccagcttctccttacccatgaccagatacaccttcgcaaaaatttcagttgactcttccacccttttttcttcatgtatgaataaatataaaatcgaatcgctaatttaaggagatttaactaaaattcatcgcattttgattaaaataccaatttttttcttttaaaaaaaagacttatagtgaccaatcttgacactgacctttctctgctcccattctctacagcagtggttgcgtcgcaaatgcatataaaggtgtggcattttgtccattgttcgctggcacagcacattaaacgagacaattttcagtggctttttttcatattcgaacgtcggatcggtaccgctcccgcgaaggtctttgccctgaatttttgaatctttccactttgggcacggaaagggaccgcaatgtcctgaaaatagcgaagtccgttcaatttatagcgcattcgcagatcaatggctggtgcccgagcatcgaaacgggcacggctaattagtgaatgttcgctgtgattgggcggttgaacattgacgggaacggaagaggaggcgccggaactggacgggagacagtgctgaaaatgggggacaaaagtcaaaaacagcgtgaatgggaaaagccaaaaacatataaattttcaatctaaataagaaactttctggaaaatggagcatcgtccgagacaaaaataagagataccatttaagcattaaaaaacctgcggatcgtcaaccattcgcaaatccaagtctgtcaaatctgtcttattggccaaagaattcgacaaatccatgttcataaccgatccgttttgtttgggagtggtacgtttggacatttcttttggctaata

SEQ ID NO: 38660 - DNA, 971 bp, Heterodera glycines
  misc_feature (925)..(925): n is a, c, g, or t
tacaaccacttccaagtacgatacaaccacttcccctaccagactaccacttccaagtacgacacgacaacttcaaagtacggtacgactactcaaaagtaccgtggcaaacgctttgcggtaaaacttaattttgttttataaaaaaaatatttcttataaacaggatgccgtgctcgttcgggctgctcgcgctgagtacgacgccgattgcccggccggtcccccgggagatgccggcattgccggaccgcccggcccccccggcgagccgggcaaatgctatggcagcgggtccaaagagtccaaagaaaaggagtacaaacccagcaagcgcagcattgacaacttcgagcatggcttgcgcgtcgccagggggtaaatttaaaaattgaatttgaattggataagccggcattttaaaaaaccaaaagactgattttttgaaatgaacaaatctccgtattttctaagttagtcccccacttttgagagtttaattataagcctcctccgtggctttatcaaatgccaaatgtttcccatttgtagctacaagcaagaagtcggaccccctggccccgcgggaccgcccggccctcccggaccggacggaccgcccggagaatgtgaatgcaaatactgaggatgatgctgaagatggtccacgatgtgagctcaaccgttttgttcctttgcctgattatccatcgatgtgtgaaactgtagcattagtagtactgtattgtcgatggaataaaaattttattaaagaatatttttcaatgtttttttttgcgaaattaatgttaagtctcgaagcgtaaataaagcaaaagctcaaaattatttcaaacatcttcatcattcatggccttgataaatcatgtcatcatcatcaacatcttaatggaaacttgctganaagtaaaagtcatgacataccgtaatcatgagtccataccgtacca

SEQ ID NO: 38661 - DNA, 799 bp, Heterodera glycines
tttaaaaacaattcaaaaggacaaatgaacaattaaatctttataattaatgggttagatcgttcattcagaccgaagaaggaaaaggtgttgaccgtgtgccgtttgagctcaaccctttgctttcgttttctctatcggccaaagaaagggtattttttccttttacgctaattgcccgttaattgaccttggttattttgtgtttccgttcgccaatttgccccctgttccggattggcactcgcttgaggcaaaatatgtgtacgcttttcggttggagcgtgagctgacttcgccacgaaattgaagagaaatttggcacagaatcctatcgactgttttgattgtctttcgttacaataggctttttctaccaaatattttgtcggttgccatcttcgttagctttcttttcttttgcacatttatccctcttgaattcgacttacccattttttaaaaatatcttcgaatattatacatttatttcgctgacaaatcatttctgctaatttgttggcaccaatcattccttttttcgccctttcctttcccattttctcccccaatttgttccatccattgacaatggatgaggttaaaaaagggcacttcaatgactgttttttgcaccttttggttggggaatgccgacacaaataggcggcacaaagcaatggttttgttgattgaactgtttggggtgggcgattagtgggggagggaaagggaaagagggggacaaattgacccgcagggaccattttgggcaaagggatttggaagaggagcaaaa

SEQ ID NO: 38662 - DNA, 983 bp, Heterodera glycines
ggtttgaaaagctcaggtcccggtcccggtcccggtagggcaaccgggaaccgggaaaaacaagcactggtaagaatggggtctgagtgaaaaattagtgaagaaaattggagtcaaagggaaaaataaaaaataataattaatatattctttaaaagtaacactgctcaagtgtgcaaatggcctaatggctagtctccttgactttcccttctttcccctggttcaatccctctacagaaattagattattttcaattttttttttttttttgtatactcgtgggtttcctataaagaaaatatgattcctcatagtttttttttaaattgatacatattttatcattttttaaatgaaaatcctaccaattgagcttaataatcgcaaaaaccaaccttttttgttgaaaatctgttaacaaattgcacccaaatttttaaaatttcccccggcggcgcctatcggcaccgccggaccccttctttcccaaaagttttttgaaaaagcgctccgaaaaaaagtgatgtgaaaatcaaatctgaatttctattaatattcgatgatttagtccaaaaatgattaattgtttgaaataattgaagaaaatttgtttgaaaattttcattaatttaatttattaaataaaaaaccaaataattttgtattattttcacttgatataaattaaaatttgaatttgtttttaaatttttaaaatttttttgaatttttaaaattaacaaatactgttcataataaatttatctttaataaaaatacaaaataattagataaacaagtctactaaaaaaatattatttgataattgaaaaaacaaaagacattaaaaaggaaataatatacatgaagaaagaaaattaatataattatttaatacacctaaataaaatataaaactgaaaatttttggtaaaatctcgattatttcattatagaatgaactttatttgctaataag

SEQ ID NO: 38663 - DNA, 840 bp, Heterodera glycines
ttcataattattcaagtaagaccacaaaaattagtttacttctaaaaaaaattgtttcaccgatttaaaaaaaatatacttttcttcagaaaaaaaaaaaattaattttcccaaatgtattctgtaaaaaaaattttaatttcgtcatttgtagcacaaaaaataaaaaatgaacgtggtcaattttcatattcattttaaaatgacataaataatttaattgtcataaatcatttgattatacacatatcaattacataaataatttgatttttaccaattatcaatttaccattcgtgctcctattaaatctgacctttattaaattatttttgagacagaagataaaaataatttatatattttattagcgtttgtgaaggaaagaccaataaaattagcttaattgacagtttgactttaaattaaattcataattatcaaattatttctttttttatatgtctaattcagaaaaccaaagctcgtcgaatggcaataatttcattctattttatattaccattccttagtgtttgaattttcctttaaacaatcatttaaatctgtctttctctaaaaaacataaacaaatctttactaatttttaaattactttgttcaatccttttaaatacttttctagctaaatatcaaaagttttaaaatttcccgacaagaaaattcaaattttcttaaaaatatctaaaacatcttcaaatatcaccaaaatcaacaacactgtcattttcactgcttatgccatggcatttttggaacttggcacactcattccgacaattccagtcctggcattctgctcttcaattgttacaaaa

SEQ ID NO: 38664 - DNA, 767 bp, Heterodera glycines
ttttacagctgattgcatgcggtttggcgaagctggcgaactttggggcagtttttggggttgccagacattcacttgcaaagacggtcagcaaattgaatttgtattaaatttgtggcatttgctcatgaaataaggcataaaatcatttagtataaaaagttacaaacaaattataaccacgattttttttattaaataaacgtgaagaaatttattatagcgtaatagattaaagttttcttaaaattttgatttttatttttgtcaaattttcagtttttaaaaattttcgatccaatttgtaataaaaattaatcacaaaaatatctttagttttttttttcttttgctgaattataaaatttaaaatttaaatgcccgttcttttccaattgctttgcggtgtttgttacgatgctaaaataatgttatttattattatttatagagcatggtaaagacattttccgcatcaatggatgcgctgaaagaaaggacagaaaatgctcgaaagtgtactacacacactgtatgaaaattggtggcctttcgtactgtagtcattgtgatgatttggtcgatggcaaagtgtgcaacagctttgatcagttgatcaaccttgatcagtccgatgatcagctgaacagcattttgaaatcgaacactaacagcaccagcaaagccgagaaacttggcccggcttccgccttcacttggatcagcagcaatttgttgctgatttttggtaatggggaaaaatgaaa

SEQ ID NO: 38665 - DNA, 751 bp, Heterodera glycines
gtttatcaattgattggactcaaaaaatgcgattggacacatagtgctatagagtcaaaaataatttataaaacgctaaacttatgcagttcaattgtttgcatttagttggtcaggaaagaaagattggggcgtgggagaggcgtcaaaaaggccattaaaatggtcatcgacgaagccaccaacagcgcaacggaattcttggaggcgaattggccggcttttgaaaaggttaataatttgttagctgtgctttaaatctaaaaaggtaatgcaaaaaagcgccaatgtgacactttcaattctgaaatttaatgaaccaaatgcactaaaaaggtggcatcataaaaaatgatgaccataattaatgattaattgtgtgcgttcctttttttcaattcaaaaaaatattctcacattaattgaattacctattttagttggcaattgaactgcttgacagtttctgtaggcgagccgggtccgtataggaattttttgttgtgtgaaggcatttctcaaccaacaaccaatggtgcaaaaccttctttcaaaaaagacaaaggcccatttgctgctgcaccattttgttcaattttcgcgccaacaccaatttttggggcttttggatgagcagggttgggccataacattttgggggttcaattttaaatgttgtgattttcaggagatgaggcactgcactcctggtggcggcgacttgagcaactgtggaagacaatgccggacg

SEQ ID NO: 38666 - DNA, 878 bp, Heterodera glycines
cctaattggttttgttgtcgcagcggtccccctccctaatgatgatgattatgctgatgatggccacatgtcacatgcattcattcatcactcactcatcccgaacaccttatggtgttgtttacaaacaaacattttttcttttgccttaagcggcgcgaagaacagattttggcagcagcaggtggttgttgtggtgttagtgattagcactaattaatgcgcgtccgtctaattgatgggggaagggagtgctaattgctttttatcggcgccgccaccaccgccaacgccgccccacgcaatttttttttttgtttggcacaccggcgggcgcgcggggggcggcatgggcacacgcataaacaccatcgcgattatctcattaaaattttcaatcgccgccgggaatgccgtggtggtgttttgttattaaggcggcgacgccaagaaaaaaaaaactaaaaggattaattaatagtaaaatacataaatgagacactcactgtgtaccatgtgccctcggggataaagatccttttttcgccccgggggcgcgggagggatttaatattttctttttctgttaattcgtttatgtaatggcatttgccaccgcgacacaacaactttttttgcccccctctcttttggcttccgacgggcgcggcattttcgtcaattttcaaatgcttaatgtttaaatgatttgtttaattgtctttagattatataaaaaatcaaaattttcatattaaaatcaaattatgaaattattaaaatatttatctgtttaagtttaatataagaaaacaaataaatttaatccttaatttttaatatatgaattattatatatatatatatataaataatta

SEQ ID NO: 38667 - DNA, 1333 bp, Heterodera glycines
aaaaacatttcataacaccacacaaattcaaaccatggacacataatacaaacactcaactttattatataggattatcgatcacttcggtctctcttcactttctaatttacttggttcgttttttcctccccgtgttataaattaataaatccttctctcttttgtcgtcttcatttgcatcgatttattctacaagtcttcgactttggcacaattcgacaacttttggactacgaattctcctcgccattcttcggctcttctcactttgttgaatccctacttgtgtattcccgattatttcccctaattgtatttccgacaatctcaaatttcccaaagccccataaagctgcaattcggtcggaattaccctgttggaccccaacaaatattcttgttttcctttacgatgataggcaccgaagaaattttgaattgcgatctgttaacagatttcaccaaaatagtcaattttatgtcgattttaaattcaaattttaagggatatttggggcaggcggtgccgataggcacgacgggaattcgagaatttcgaaagatttggtaacggattttatactaaaatacaaatttttggattttgatgaaaaatttaaaatttttttaacattggaaatggtaagtttttgtgtttttaggatatttttaatgttttaaatcaaaaaacaataagttttcaaggcatttacatttcaactcggctggcccaattcgaacgcaaaatttaaacagtccgaagtaatttaatattttcatttttaaaccgtatttattcctttttaattttcgaaaaatatcttccaaaattgttttgttttgaccgaaaaatgaattaaaacaaaattatttttaataaattactctgaaaatttttgtgccaaaaaagatcagtgacatgaaatggaaaaagagaattgccaaataattaaagaatgaaaaggaatgggttatgaaatgaccaatttggtaatttgttcacatgtcagtttttgcctttttccttccgcccgttcattcctctaaactaattgggtcattagaggtgccctcgcggccatcgctttttgttttgccgccaccaaaattgcccttactcagttcattaaacatttgcaattccttctggacacattgacaatattctatgtttttttcatccaacatttttatgcatttttccaaaaatgccaatccgtcctccttttcttttgctaattttgtcttttcttccgacaattttggcaccgaaatttctgcaaagtcggcactctccaattcctctttaatttgcttgaaaatcgcggaa

SEQ ID NO: 38668 - DNA, 1101 bp, Heterodera glycines
cggtgtcggattttccagtgtcggattttccgcttgtgtcggatttccatcggtgtcggattttccgcttgtgtcggattttcctagagccgcgttagccaagttcccatcagagcacagttggtgctataacgttactcaaaaacaatcaaatggaaaatttttgacagaaaattattcgtaacttcgcccaaaatgaataaaatttaaaaaattaggtaatatttcgatagtccgaagtgtcttctatacaattgcaaagtttcaaaaaaattcattaagtttcaataaagttatgactagggctgcaaaaaatatgcacgaaaactgaccaaaatccaaaatttcgcaaaactctcttttttaggtatgttttttaaaaatttccaaaaaaggtgatctatgtgtgtatttttcgctttttttgcatttttattgtgaaaaaatgccaaaaatggccaaaatatgtatgaaatatacagcagttttttgtcggaaattaagtcagttttatcacgccatttttatcaacgattattcacaatgaattaattaaatgtacatacacataaaatacaatgaaaatggacgaatttacggcaagcaagcaaaggtcaaatacatacaaataaattagctatacacaataaaaatattgaaatggcacagtgccagcatcaattttcatgggaccaaatggcattttatgagtagggatcggatttttagtgataaaaaatcccaaaataattaactaaatagtgagaaaaaaattccaaaatagtggcaaaaatagtggcgaaaaagttccaaatttaggggtgtaattttttaaatagctgttttttaaatttgaaaataatttaaaattaaggaaaaagattttattcactgattgcagttacaaaatattttcttagaaaatattgaacaagaaaaaaaatttgggggaagaatttttgtgaaattttccaattcttagggatgtatttttgaaaattttaggccgattcttaggggggatttttgaaaaattttagggcgattcttggggggtatttttttcgttttaattgcattttttgggaaattttccaaaaa

SEQ ID NO: 38669 - DNA, 1131 bp, Heterodera glycines
acctaaatttcctcctttttaatgtctcatttcgccaaataaatttttgggaaatttttatgcgcttatttgttaatccttttaattttgccagccatgttgttgttgctgtttttatggtcttgacaaaaatgcaatttttgttttcaagggggtttacgagttttctcacaggaaaaataaaaatagagtagcttactctgcgcctaaatttttcatacaaaaacaaaaaattgtgtctcatctttattgacattccgtttatttttattttttcgtttttatttgattttttcacaattttttcttgtaaaacaaaattgatcctctaaattttttgctaaaaattgaaaattttgaatgctttttgaataccaaaaatttttgctgtggacgaaaaatgcataaaaatgctgaattttctgtgccataaaaatgcaaatttatttagcattttgctcgataaataaaggaaattaaatatgcacgatttgctatgtgttttttgcctgccgtcccttcccagtttttttacatatcagccaaagctaacgctttttttctgccaatttccgacttttcggctcggaattccgattggcgaaatttaggaataggtcggaatgccgattttcaacatttttagccgtcggaattccgatttccggaattttttgacggcatccgcacatatccctggtatacctatatatacattgaatatttcagaaaattttccagtcaaattcaattaattttggcccaatctttgaagacaaagcttttcatgcggcggagattcgtccttgaaaggcaaccggggtgtccttgaaaattggattttgtgataaattaacccaaatgtacaattgatgttgattcaatcaattaattttttcaatattttgctttgactctgattttatggaatttcttcaaaaaaaacatactctgccgtgattttcaaatattgaaattattggtattttgcgggttttctttcatcccttatcccctcggcctgtaaatgaatgtgattgatagggcttaaagaccgaaaaaattcccgaaaatttttttttttagcaaaaatgttctcgagagtattgaatatatttaaatttcttaaaa

SEQ ID NO: 38670 - DNA, 738 bp, Heterodera glycines
  misc_feature (5)..(5): n is a, c, g, or t
  misc_feature (25)..(25): n is a, c, g, or t
cgttntggggtactcaaacatttantggggagcaaaaatctttcggagaattaaagtacagactatagggaagctattcccttaggattcggtctccccataaatctgggcgcatcggttcagggggactgccccgaaaacccaaaaaaaaattttttggataaaaattatttaaatgaactgactagataatatttaaaataggttatttctcttcctttcagtatccctgcaaagtttggtgcgcttctgatcagtttctgaaaaaaaagttaagcctaaactttttggcctgtttaaaaaggaattaaaaatttttaaaaattttattcatctccctttttgatagaaaaagcatcagagtgcctaaactaacatgtaaataaaatttggtgcgtttcagaaccctttctgaaaaaatatttaagaattaattttgcaaaaaataaataaaaacgaaagactcagattttcgaaaatttttttgagccagctagctcggcgctcatttcagtgtaagttagtcctttaccggggagtatccctgcaaagtttgttacgcttctgctcaattagcaaaaaatatgagtgatcgaattttcactaaaaaagttaagcctacattttttggcatatttaaaaagcaattaaaaaatttttaaaatttaataattttcctgcaccgaaggtactcactcggcctcttcgcggccttcgtggtgggccttcccccccccc

SEQ ID NO: 38671 - DNA, 1281 bp, Heterodera glycines
  misc_feature (102)..(102): n is a, c, g, or t
ctatagtagtaactcaattttatgtagagctataatctacactaggtttctactaattataagttaatttttaagatgcttaaaaaaatctttaacatcagncggactgatcagattacttactccttggaggtgatcgtgacaccccaaaatacactgaaaatcaggaaatttcgagaaaaattctaaggggttggaaaatttttctggaaaattgagtaggcatatcagaaaaaggacagaattctctacaatatacaaaagaccgaaagtctctacgactaatatccgcatagagtcatagggtgtcaacattgcgtgctttaaatagatcaatttttctatcattttcccttgaaatacggtagaaatctgtcattgttgaattgtcctatatatcacaaactgttcctctgttaacccttcatttaaaagtctattcggtagagaattttgtcaactctgataggcccactcactttttcggaagtttttccagtttcaactaattttaggggtgatgaaggagtgatctgaccaagttagtgttaaaaacttttgattagctttaaaagttagctttcgccgcaaattagattcaaatagtggttgtaaatatatgactaggattatggtaacaaaaataaaattttggagtgatttgggaaataatggcgccatttgtgctgttttgtgtatcactttgagtgccgtttgaagaagcattttgtgccgtaggagaaaaatgccttggggaaaagcaaatttcaaatggtttaatttgataggaaataaatcccgagtcgagagaaccactaattagttggtgccaatttgtacgtacttatcgcctaactgtaattgttggcatccgccgcaccccgcgcaaccacaaccgccgcaacattcgcatccgccgttgcattgcgcaacaacgcgtggcatcgatgggaaaagcaacgccggcaaaaacaaaggcaaaagaacggcgagaggcagcgtggaaagcagctgctgatggaatggggaaagtgccaacattttgcagagagatgagagacaaagtgcaggagaagagaagtgacggagaatggcaaaggcagaggcaatcgctgctgatcaaaatgacgatcaaaacggacaatttaggcccaatgtttcctaattacctaaaaatcgctttggggaagagaacccgtcgcgtgaccgggcataatgctgctgttcttcagtttctgcttatggttgtcctcccattgtttgcttggtttttaatccggt

SEQ ID NO: 38672 - DNA, 1233 bp, Heterodera glycines
  misc_feature (49)..(49): n is a, c, g, or t
  misc_feature (1215)..(1215): n is a, c, g, or t
gcacattttgggtaaaaaataataaaaataaaaataattaattaaaatntaagtgaaattgaatacagtaggacagattttgatgaaaaactggagagattgtggaaattatttgggggaattctgtccaatgcgacggagggatttttggacaatgaaaaaagcgaaaatgaggcgaatttggcgaaggcattggccgatttgagcggttatttggagagggaatttggcaaaattggcgaaagtgccaaaaattacactgtcaattttacagtgaccacaattaacagctttttactgttttgcttaaatgaaaataatttggaaaaagtgcaaaaaatggcgcaaaaccggcaaattttgaaggaaattttccaagaagtaggggaagggattgaaaattttgaaagaattttcggacgcttttggcagtggctagaagagaaagcggccgcggaaaatactgggggtaattaattaattactatttattaattgattttataaattgagttgaacgaaacagtttaaattttacatttaaaaatttctctttttctcaatttttatgcttttttgtcatttgatacattttgccatttttaaaataaataatttaaataaataatttttatatattctttttaattagaaaatgacagcaaaaaaataccaatagaatttgtaattgaacaaaaagccaaagagaaaaaattagaaaatgcaaaaattataaaaacttacgaacaatgcccaagggcaaaaatgggaatcgaagaaacaattaaaatggacagaatagaaatagtgaaaggtgagaagagaaacgaacgatgggaataacaaaagcaaaagcaaacattaaaataatttaattaatttgaaaaaataaaaaataaattaaaataattaatattattttctttctcacaataagatttggctgcgtatgaattgaccattggatacagccgaatattaacttccgacgatgaattgtaagtttaaaatttaaaaggatggtcagggaatggccaaaagaaaaataaatcaaaagacaaaaaattaaaattgaatttaaatctgaagaatatgagtgttttggggtctcgagacagaaaatgactcataattaagcgaatgaataggaaaaagcaaagccaaaataatcatttctcattttcgatagaaacattaaaaaagtgatggccattntaatatttatttgcttaa

SEQ ID NO: 38673 - DNA, 1214 bp, Heterodera glycines
  misc_feature (18)..(18): n is a, c, g, or t
  misc_feature (32)..(32): n is a, c, g, or t
caaaaatcacgcgcatcncatgctgagacccnttctgtgataaatgaaataacgaatattttaaaatgatccgaccagaaaacatgtaaagaactcgatcattatcgacaatgaacactttggcatcgatgtgattgttgtggaagttcgacagccataacgaagaaattttgtcggtgaagtctttgcttgttttacccgcagatttttgatccttcaccgacacaaacatcatcacagtttgaccacttttcgttaattttaataactcatccggagaatcagtcttcatgaaatttacgtcttatttattaaatccaaagattatattgtaagaattactctttgctgaagcgattcgaggtcaatttggggcctttttcgttggcagggaggtttctcatcttctgggagttcgtcttcatcattttcttcccattgatcatataatttttcgatgtcagcgtccgtataatcgcgaatgtctttgtgtttatttggacaaatatattttgttgatgacaaaattaaaaatagaaaaacgaatggcttcaacattattaagaccaaaaaatacaaaaatttaattattttaattttgtcatattttatttaatatttttttaaatttcccttgttattttttattacattctttgattcattgttttcgaatatttgcagacattgcaaattaaaataaggaaaaggctaatatgacgaacccctctactcactccaatgaaatcgacacaacaattagcagaaacaacaatgattttgtagtggatgattgcttcgcggacgacgatttgcttacaccgacagagggtcttttacaattagtcttaatgacggaatttacttttacaattttcatttttaaattaagctgatggttctttttccttcaaaaatattccttctactgaaatgacaaaatcatttcttgagagggacaattttgagagcgaattgggtgcaacgcagcaggatgacccttttggcgaggatttttgcgatatttcaagtaacgaaataattgacgtgttcgctgatggggatttggccggaaggtggtaataaaaattacaaattagaattgcaataaattttagacctgtcatcgtattttacgctcatcgattgccttctaataaaaatttccaccattacaaatttcttcggtttggttttacactgtatttttaaca

SEQ ID NO: 38674 - DNA, 905 bp, Heterodera glycines
ttagcataaaattaacgacacataaagtgttggccccagtgccgtacagaggctgcaaaggcgagcataatacttccttgcttttatatttccgcacgagttcttagaaaagagccagaattagcataaaattaacgacacataaagtgttggccccagtgccgtacagaggctgcaaaggcgagcataatacttccttgcttttatatttccgcacgggttcttagaaaagagccagaattagcataaaattaacgacacataaagtgttggccccagtgccgtacagaggctgcaaaggcgtgcagaagacttccttgcttttattttccgcacgggttcttagaaaagagccagaattagcataaaattaacgacacataaagtgttggccccagtgccgtacagaggctgcaaaggcgagcataatacttccttgcttttatatttccgcacgggttcttagaaaagagccagaattagcataaaattaacgacacataaagtgttggccccagtgccgtacagaggcttcaatggcgagcagaagacttccttgcttttatatttccgcacgggttcttagaaaagagccagaattagcataaaattaacgacacataaagtgttggccccagtgccgtacagaggctgcaaaggcgagcacaatacttccttgcttttatatttccgcacgggttcttagaaaagagccagaattagcataaaattaacgacacataaagtgttggccccagtgccgtacagaggcttcaatggcgagcagaagacttccttgcttttatatttccgcacgggttcttagaaaagagccagaattagcataaaattaacgacacataaagggttggccccagtgccgtacagaggcttctatggcgagc

SEQ ID NO: 38675 - DNA, 1429 bp, Heterodera glycines
cttctaaatttgaggatttgtttctcgtactgtgtcttcttgggtttggatggaattcgatatattgttgatctgattaaaatgtctttctacgtctctcccggcgcgttctgcggccctctttgcgacatcaatttttgaatctttggtatcttcagccttggcttctctctttccacgttgttttttgattttgtaatgatgtgtgaatgcctcattaattttatttcccaggcccccggcggttttaaaattcatgtccggtaaataaacttgagtagggacacagatgtcgttttcccatactttaataaactcttgaccgtttataccgagtgcggtgaatgagtaggggtaaataattgatgagagagctactgaccaatttgtgcccaattccaaagtctcggggagtcgaactgtgaattttgacgtagtgttctcctgccctgatgtgttcgaaggtagtacaatgtaaaaatcatccatctgttttcactaattcctggttataaaatatgccttttattaaatttccttccaaatcttcgatcctgtatgaatcgggtgtcgtcgaattggcaacaacgattttaaacaattcttcggtaaagtttgggaggtatccctttgaaaattttcccttttccttggtaattcgaacgatatcgccaattttaaatttgttctttttcgaaattttaaattccttctccttatataatttttcccagagcgcacgggcattttcaaaattaattgaagacggtttggctcccagtgttctattcacactgttgttaatgtttgttattattttgtctattacgtcgacccatcgaagagtgtctttctttgtaaaatatctgtacaagcgctcctttattgtccgatttgccctttcaacgactccggcgtgcagatcaggactatacattacatttttgatgatgaatttttcctcaaaatattttttcatttttcctgcttggaattcaagcccactgtcactatatattttcatcgggataattttagacttttcgaacacatgatcaaaagcttcgatcatgtcctcactcttctttgacttggccggtgcactgaagatcattcgactcagcacgtcgatgcagaccaataaatatttataaccgtcgttatgctttttcaactggtcaaatatgcacaaatcgcactgccaatcggtatggaagccgctcggtaccgtctttagtctcaggaatcttttcctgatgggcttgtgaatcgtgtatgttttctgcttttctaggaatttattaacctcatcggtcgtaatttccgggtcaatcttttttggcctcatttaaaaattttttgaattccagcaaaaactttgccggggattttaaattaaaaaaaattttttggaaaaaattttctctac

SEQ ID NO: 38676 - DNA, 972 bp, Heterodera glycines
  misc_feature (39)..(39): n is a, c, g, or t
tataaataaatttttgtttaaagaattaaataataaggnaaaaataatttaaattgagttttatttttaatttagttccaagaaactttttgtaagttgaatttgaaaagaacaggagagctcccttttctctctttcaatttaaacttatttaagtatttattttatttttaaatattttaaatataaataattgctaggttaattcgtgagttattcaagactataataatagttaatagtcatttacataacttctcaaaaaatatttaaataaatttaattgtccgtaattttttatttaagtaaaaaaaattgcttcaatgttagtgaatattcattttttaattttttgactaattgaatatttactttataaattaatataaaagtaataataaaatttaaaaaataaaaaataaaataaaatcagtaacaattaagttattcatatttgttatttagagaagttaatcatttttaatcattgattttgtagcttttagatgcttttggtctttatcatttaaaataatcctatcaattagaataaatatctcatacttttaatgaaaattcttaaattcaaataaaattattaattttctcgtttgatgataaatatgcgtattataatattattcaaggcttcacttttaaaattaaaatattttctttcaatctcaacattttcttttttatatttattttttatttagatatttcttcatttgaatttcaaaataacattcttaaaataaaaacaaacaaattattttcctcgttaatttaaaaattattgacggcgattaaaaatttttatgaggttaattctcatgggctgcaatattctaataatataaatttaattacgactgataaaacggtcatttaaagaaaaaaacgtcaaattaaagttgaaattatcgagatagataaattttattatattgtgttgtcattagctcttta

SEQ ID NO: 38677 - DNA, 654 bp, Heterodera glycines
  misc_feature (50)..(51): n is a, c, g, or t
  misc_feature (57)..(57): n is a, c, g, or t
  misc_feature (63)..(63): n is a, c, g, or t
  misc_feature (68)..(68): n is a, c, g, or t
  misc_feature (70)..(70): n is a, c, g, or t
  misc_feature (536)..(536): n is a, c, g, or t
  misc_feature (574)..(574): n is a, c, g, or t
  misc_feature (601)..(601): n is a, c, g, or t
  misc_feature (621)..(621): n is a, c, g, or t
tgaatttttcacaatttatttaaaaaagccaaaaaacctcacaggggttnnaaaaangaaaanagggnanaaaaagaagcgcctcacggtggggcttaaaagtattgtacatcataattaaaagcgaaaaataattttttcgtatattttttcacaatttatttcaaaagacaacaaaaaattgataaaatgttgaaacgaaatagtgcacaaaaagggagggatggttagacgaaaagaggaatttttaggatgggacgcaccccatctgatattcacccttttctgctccataagaggtcagaggcgactgtgttcattgacgcgtagttgtccaattaaggtacttggactttccacagtaaaatgtggtgcaaattttggaactgtcccgcctcacggcggggcttaaaagcatttgtagcgcaataaaaaagtttattgttttgaatttttcacaaatttatttaaaaaagccaaaaaattgggatgaaattttaaaaaagaaaatagtgtataaaaaggaggtgttttanggtggggtttaaaagtattgtagatgataattaaaagngaaaataatttttgtatattttttaanaatttatttgaaaagagaanaaaaaattgataaaatgttgaaatgaaatagtg

SEQ ID NO: 38678 - DNA, 1179 bp, Heterodera glycines
ctccaatatttaactaggctgttgctcatccagtctcacctgagcagcaacagttacaagtcttcctgcacaacttgtgtctcaagtagtcaccagcagcattactcaaccgtcacagaaacgaaaacagtataaaattctgaaatttttttgaattaaaaaatgattatatttaattgaaggtgtaccctgtgaagacgtactcatggtgcacgggtactgcttgcggtgctcaggcaagagaccacacatttaattaattagtttcttcaaataattgtaaacggatttaaccgatggattaattaattaattaaagtattttctaaagcaattaatgaaggaaattccaaaaatcaatagggtatatcgtttttatcatattcagcccaatatattaattaagatttaatcttttccagccaaacacagtatttttttggttattagactccattagatttgaagacgcccacccatttgcgaggggttgaacaatagaagacccggacctaataataaaaaaaatcatgcattacttactgtacgatagtacaaaaatggtgcaatttgtgatactgtatttgtccattttcatacggcaaaaaatcgttaggctcaacccgttcaacccgttgccccggcagcaagtggtggtggcaccagtattagcaccggcagttcgtgcagcagcggaacatgcggacaacaaaaacaacaggttggatagaaattatattaatcataaatttaaaaaaaaaattggcattatgcaaaaaacaggttcaacctgttgcccctgtccaaccggctgccccggctagcaccagctcgtgcagtggtggcagttcatgcggtgccacggcacaagaggtgttcaaattcgctttgccaacaaaaaaaaattggttttccagagttatttttaaaaatacagcttcatgggggaaaaccaaaacattttaaacaaatttattaacaattaaaaatgtcaaaatcggaattccgtgccatccatgttgcatgggtgtgccatttgggcacatttcaagataaacattttatttatttcgctaattacttccttagccaattgcacgtcgaccagctcagtctcatcacgagaatgtctgagcaaagggagcaacaaattttgaaatgggccgcttgtttttgctt

SEQ ID NO: 38679 - DNA, 1076 bp, Heterodera glycines
acaaaattacaaaaatgcctttttcgattgcccccctcccccattatttgcctctttccccttccaattaatccttgcaacttttgttcactttttagcgtttgtccttcaacgatgcctaaattggcactttcgtctcccctttaattgcttccgttcgtcgcaatttttcccttataaaaattcaattaaaaattgtcccttttaattcattggtcggcttccaaaaggattaataaaattcacttcccgcgcaattttttacgaccttttcctttgtctttgtcttctatgtgattcgttgttcacttctcttacatttttttgttggctcatttttctgccatttctccgatcggccggcccatctcccccccccccccctccgtcgatcaatgcgatcgttttaaatcactccgtccgatcggccaactgttggtccaattaagtgaaaaaacattttatttcctttgctaaccgactaatgctttcatttccttcacttttcatctgttggccgattggagcaaaatgggaccattggtcaaaaaaagaggggagagaataaacaaaaaatcatggccaaaaagaaagggggggggggggcatgggggagggaggattaattgtgttgaaaaaggattttgacgacagaaagaggcgcatattttgaggcaaagtgataattaaaatatacatttgttttccctaaaatacttacattaaacattttaattaattaaaaaaaagctaagaataacaaaatttaactttaaaattgacagtgatatttttccacaaaaaaagaagttttcatttaaaggttattatcccattcttctgctcactacgccaattcgctgtgttttctattccggccgagataagaatcttcttccatttctccgcatcatattggtccgaccatttctcttccccccccccgccccttttgttgtgtcattccattcccgcaatttgcatcctctggcaattgattgaattgaattgtatcctaaaatcgagaataataccatttcagacaacggaatgacttcacacctttatcatgcttt

SEQ ID NO: 38680 - DNA, 971 bp, Heterodera glycines
cttattagattttgcaggcttattgctgcatgttctttgacacttcttcaaaataacctatgccctttattcgttcaaaacagcatctttgttgtttcgctttggattgacaagcccgatgataaatagctcgagcgcaaaacgcgtgcatgtttggaaagtatcgttcataccaataattgagtgtttatttttaaatgaaattttatgataaaccttattatctcagaagctatttaattgattcgaatgtttttatcgcggttaattagagcaccgaaaactggtttgaatcgtgaagtttatcatttctaactcacttctcaaaattgttgataaattgcaaataaatttttccaaaagtctgtagacactttctgaaaataaattctatactcatgtattttccacttattagattttgcaggcttattgctgcatgttctttgacacttcttcaaaataacctatgccctttattcgttcaaaacagcatctttgttgtttcgctttggattgacaagcccgatgataaatagctcgagcgcaaaacgcgtgcatgtttggaaagtatcgttcataccaataattgagtgtttatttttaaatgaaattttatgataaaccttattatctcagaagctatttaattgattcggatgtttttatcgcggttaattagagcaccgaaaactggtttgaatcgtgaagtttatcatttctaactcacttctcaaaattgttgataaattgcaaatatatttttccaaaagtctgttgacactttttgaaaataaattctatactcatgtattttccacttattagattttgcaggcttattgctgcatgttctttgacacttcttcaaaataacctatgccctttattcgttcaaaacagcatctttgttgtttcgctttggattgaaagcccgatgataaatagctcgagcgcaaaacgcgtgcatg

SEQ ID NO: 38681 - DNA, 1220 bp, Heterodera glycines
  misc_feature (8)..(9): n is a, c, g, or t
aggaacanngacgcaggtacaaattggtcctcaaataatttatggtaatcaaactcaaattttgttgttttaaacaaatgggggccaaaaacattaacaatttatatggaatttttttttaaaatatggataaaacccatataaaactttcggtacttgttaagtttacagggccaattctacatacatttttagaagccaataaattattcattttacattgtttttttaagcatggaaattttaaaagaatttaatattcatgatttatttactcttctgcaaaaatcagacgctgaatttgaagaatggctccgagaatgcaaattacttcacacaaaaagaatttgtgaatgcgggaaagacatgcaactatattacaacaaaaaagaagctaaatgtcctctatggcagtgcaattctcgaaaaaccatggaggaaaaaggaaaccagggatgcggtcgaaaatttttcaaaatcagaacatcgggctcaaaaaatcagattttggggtcaaaaatcagaacatttttattttatcagatttggaccctcaaatcagaacatttctgataaatcagaacagatcgcatccctgctgtaaacttaacaagtaccaaactttcaattcaatttttttttaatatactaaatttgccaaattaaatttttatttaaaacttggttaattttttaattttaaattttataaagcgacccttagggtgatttatttgttgagtaaattttgtataaaagtgtaaaaagaaagtcaaaaaaaatggcgacatggactttttcccgaaatccaaaaactatgaattggtaattagttaagaatgttccccacctttttgtgaaaaaaattttcaaattttttttttcgagaaaatggcgtttttagggttttcagggtcgaggaatccgattctgacactcaattcgacccattccgaactctcgaacccggattcgaacaaaaatcgaaaattcgatttttcaaaaaattaccatttactcaacaaaatcgaatgaatgtgtgaatgaatcaattattggcacggataaaattgggaaacatgcaacctaaaaattataaaacacattttcacgttcccgcgaatcgaactcattgtcttctagcgccaacttttcatgcaattttttaatattgaaattttgaagctcttcacaatgcatgcctatactacacataataa

SEQ ID NO: 38682 - DNA, 906 bp, Heterodera glycines
ccaactcgtactggtaccccgactcgtactaatttttctcaactcgtactgccccaactcgtaatggtaccccgactcgtactaagtttcccaactcgtactggtaccccgactcgtactaagtttcccaactcgtactgccccaactcgtactggtaccccgactcgtactaagtttcccaactcgtactggtaccccgactcgtactaagtttcccaactcgtactggtaccccgactcgtactaatttttcccaactcgtactgccccaactcgtaatggtaccccgacccgtactaagtttcccaactcgtactgccccaactcgtactggtaacccgactcgtactaagtttcccaactcgtactggtaccccgactcgtactaagtttcccaactcgtactggtaccccgactcgtactaatttttcccaactcgtactgccccaactcgtaatggtaccccgacccgtactaagtttcccaactcgtactgccccaactcgtactggtaacccgactcgtactaagtttcccaactcgtactgccccaactcgtactggtaccccgaatcgtactaagtttcccaactcgtactggtaccccgactcgtactaatttttcccaactcgtactgccccaactcgtaatggtaccccgactcgtactaagtttcccaactcgtactgataccccgactcgtactaagtttcccaactcgtactgccccaactcgtactggtaccccgactcgtactaagtttcccaactcgtaatggtaccccgactcgtactaagtttcccaactcgtactggtaccccgactcgtactaagtttcccaactcgtactgccccaactcgtactggtaccccgaatcgtactaagtttcccaactcgtact

SEQ ID NO: 38683 - DNA, 924 bp, Heterodera glycines
  misc_feature (902)..(902): n is a, c, g, or t
tttcgagaaaagctgaaaaattttgcacttgcatctgaagcagactcaaattcttcaacacacaatataaaaatattacgcaagaacttatttttacatcctttttagaaatgctacataaatttttattgtaaatagttacaaacaaactttttttcacttccaatttctaccagttgccaaacaaaaaggcgatagttaagcattgagatataaaaaaatcgtctagaataattatctcaacaatttgtcgggaaagctgaataaatttctgttgcaataggcatattggcacaagacataaatgtagagcaggcacaaaatagaggaaataccaaagattaaaaaattcttgtttatgccccactctgctttggctggccatacctcgccagagagtggagatagaccctttgttgatacatttggaaatgtcgagcccgcatagcgcattcgaataacacaaaatttgtttgtatttgccaccaaacaatccgcttatgacgcgccgaataaaaattcacaaaaatttggcaccggaaaaactgcattttttcatgggccagcataataaagtaaacccaaaatgtaaggaaatttaaattggtcatgagagatgtttagttttttatttgtcccatcctttttctgggaaaaaacttttcgagaaaagctgaaaaattttccacttgcatcagaaccagactcaaattcttcaacacacaatataaaaatattacgcaagaacttatttttacatcctttttagaaatgctacataaatttttattgtaaatagttacaaacaaactttttttcactgccaatttttaccagttgccaaacaaaaaggcgataattaagcattgagatataaaaaaatcgtctagaataattatctncacaatttgtcgggaaagctga

SEQ ID NO: 38684 - DNA, 1020 bp, Heterodera glycines
  misc_feature (979)..(979): n is a, c, g, or t
atcactgatgaaaagctgatgcaatgcgcgaattggtgtgctttcattatggaccaaaattgctccatttggcgcttgagtaaaaaaataataatattaaaaacctaaaaatcgcattcttaattatgaaacaaagtttttagtccatattcggacatttccgggctttttagtcagtattttgggcttttttattccatataatttacaaccctaatgatcaattaattctgagctgggatgatcacatggtcatcaagatcaagatgctgctgctgctgctaatttgatgataacaaaatgaaggaacactggtgatcaaaaaaacaaaaagcacaaagcctgttcaatttcccatatttgttttttttaatttgcttcgccaaccgccgccgtcgccgccgcaatttttgcgataatccgccgccggcgccgcgccacacacgcggaagtaaaaagcgtttaacacaaacgcatatgttgtgtgtgtgtgatgcgcagttaatatgtatatactattaaatcaacgcgctaattagccattcattaattgaaaaaaataataattatggaatgcggcggcgaaaacagttagaaaaaggggtaatttttggcgcgtcaggaccagtcagcttgggataagtcagttgatggatagataactaagccttacgataaattacaaaaattacaaaaataattaaataaataaaacattttaccattttttaacagattttcattaaaaatagtaattttatgatttctgggaaaatttagcaattttttttttcaaaattgaatgaggggggaggtcttggacgtgcggtgctaataaggaaaatcgaaaacagtttcaacagcatttttcccttaaaattacgctgcccgcgcacgccgtgaatttttcttttttgttggcaaataaaatcattttggcttaattaatacctaattaaattaattcatccattctttnaatatcatacacacagtttataaaaaatggtgctgctgcat

SEQ ID NO: 38685 - DNA, 969 bp, Heterodera glycines
aaataattaataatttccttaattaattcgttttccctttcttctcctccctttttacgcgtcattttccgtttgttttttacattacaaaatcaaattgttctttccctttgaatctttgatcgtttgtccgatcatttggccatatgttttccattttttgcttgcctttatttccctccattttccttttctttttcagaccatccaacaagaattgatggacacaaatggccaactccaacttcttcaattatccgctgaagaattgtgcacaaatttgccgccgtctctgtgtgatcagcgaattggtgacgatgtgctggacgagttaaatcggcaattgaatgaaatcgaatcgcgcgttcattccgcgctgatttttgcactccgagaccaaaaagcggaaaggggagaaagtgcggcaaaacggggcagggagggggtgggcggcagaagggttgaaacaggacgagaaaaataccgggattcgggttcaggatgccaaattcggtcggaatttgggattcggacgagaaaaaaggccgggattcaggcagcaaccctggagggcaggggacgaggaggggtgggattttgatggaaggaagcccaagggaaggcacaggcgtaaaataaagggaaattttaatggtcgccaaatattctgaataaacatgattcagaatcagttatcaaaaaatttgttattacatttgtctttgaagatgagaattccatgtgatttatgactaattccccccaaaggcgaacgacggacagacgaagaaacaccggcggagatagcaaaagggaacgacggagagggcaatttgttggcattggacgcgtacggaacggaggacgaaaagggcaaagggacggagcagcaaaaggagggagaggaggaggaggaactgttgatgagcacattcagcacgagggtgacaatgcaaagtcggcctttgc

SEQ ID NO: 38686 - DNA, 1257 bp, Heterodera glycines
  misc_feature (1229)..(1229): n is a, c, g, or t
tccaaaaaaaaaaataattggaaaaaaatttatctgctcagaatcacctgatctcgagccttggcaacttcatcttccttattttgtttctttggattgccatcctttgcttttgccgacgagatactaattgttgcattcagttcaaatggtctggaagtataaatttggcaaattttaaaaatttgcactaatttaaagaaaatttatttaattctaaaaatcgatattttaaacaaaatttgtcaaaatatttataaattttctgcaaattttgaatggatttccttaggtttcaaaaactgtgaaaaataaaaatttttttaaaagataaattcgatagtcctaaatgttttatttttcctggaagttttcaatgaatttcattagtttcaaaaaagatatgaaaaatttttttttcgaaaaatagcctttttagaacttgacgaatttttttgcgaattattacttacgaataaagaattcttcaaataccgaaaaatactaaaaatattaatatttgattgcataattttccccaaccgcgaaccccccgacatttcaatcacagaattgtcgggtgattgatatcaaattaaagcgaatataaaaataatattttttacgtcggcgtgacggatgcttcaacgtccggcacaggtgtcacatgaacaaaaccgacccgttgcccacccggacatcggctaatcgaattgcccacttcctacaaaaaattgttacaaaaaattattaattaaaaaaagattttaatttggacctgaataaattggtcaatacgggcatttgtgtacaaattgttctcgctgccggtgtactcgcgaagctcttcgactgagtacttctcggacaatgtcacagcataaaccttaaatttaattaaaaatttataaagtttttattataataaatattaaaacaaaataattaagcgatttatattttgcataaaaaagtcacaaaaaggcataaattccctaatattcctttatctttttatgatagactaaatttcctttatggtaagcacaaccacttctttttttttggaggccgggcttgttctattagaggaattgaaaatcataaaattatgtacataaaagattcaaaaatatgtgctgcatataatatgtaaattgatccataaaacttgttaaattgggttattaccatcattatctattagagatcatgtgataagtagccanaaaaataccgaaattcatgaaattctgc

SEQ ID NO: 38687 - DNA, 983 bp, Heterodera glycines
  misc_feature (87)..(87): n is a, c, g, or t
  misc_feature (125)..(125): n is a, c, g, or t
  misc_feature (153)..(153): n is a, c, g, or t
  misc_feature (161)..(161): n is a, c, g, or t
  misc_feature (167)..(167): n is a, c, g, or t
  misc_feature (180)..(180): n is a, c, g, or t
  misc_feature (195)..(195): n is a, c, g, or t
  misc_feature (207)..(207): n is a, c, g, or t
  misc_feature (217)..(217): n is a, c, g, or t
  misc_feature (238)..(239): n is a, c, g, or t
tagcaaagagatggtgatcattatagtttcgaaaattggatacggtacatgcagtggattggtagctcaagaaagctacagtattgnaaaatatttggaaaattcgtttttctttttcggaaccnaaaagttttcgaaagtttgctggcaaantatagaancgattnaggattatcgaantgatattaaattcanttcaattagggncaactatgangctatattccaaaaactgggnnctgggcccagtttgagggtgccccagtttggaccccccccccccccccccattcgactcatttccgggaaaaactcaaaaatagagggtcagtcattaatttttgcatgaatttttcagttatagctaagaatttcgaaattcccgacgacacggcacttcgcaattggcttgcgcaccacaacattgacgagtatggcattgtgcagttccgggcccaggtgcatgccgtgtatttggagctggtcggcacggggaacgacgaattgatcattgaggcggcggaatgtacgtttatctgttgcgggaatagagcatgggataagcggggatttccgtgtttgtccttcattgacggattgtccttcatgaaggattgtccaatgtaattcattgacggtttgtccagtgaaggattgtcattcattgaatgtccaatatcctcatacggattgtccagtgaatgactgtcctccattgacggattgcctagtgatggattgtccttcactgaaggattttcaaacgaccgatagttgaccgattgaccgtgctcatttgtcagagaatcgtcttttgaatttttttaaaatttataattcataaaatgtttagattttcgttcaattgaagacttgatttcgcgtaattaccactgaacatgccaatggatcatcggggaaagcgagaatttaaaaatgaatcattattttccatgttgaaacgcagttgcatgaatttcttt

SEQ ID NO: 38688 - DNA, 1049 bp, Heterodera glycines
aggcgaagaaattcaacgaaatttttattaggattttgactttaatgttgagaggtttaacaaatttgtacactgaatgttggatcgtcaacaccaatgagaaatgactaacagaaaagagggagaaaagggcgttggcttaggaaaatagcttataataaaggagagacgagcagacgatgagtgagagaaaaatagtggtaaaaatggtcaactgctgcattggcagagtcagagaggggtcacaaagagttcgcacagcatcgaatatttccttcattttgggcgtcattcttccccactgcacttctttcttcggtttaattacccaagtttgaggtacttggcgtgtcctgcccataatatctgtggcatggaataaattttggaactgcgctgcctaacggcggtgcttaaagtgcgctaaaaatgatcaaatgattatcaatttttatttttcttaattccaaaatgaattcgaaacgcaaaaatttaatcataattcatgtggtaaaaaatgcatttaaaaataaaaaaaattattgaatttgcttctgaattttttaattttaaatagaaaattactttttcgaaaattttgcacaaataagaggcgaagaaattcaacgaaatttttattaggattttgatttaaaatgttgagaggtttaacaaatttgtacactgaatgttggatcgtcaacaccaatgagaaatgactaacagaaaagagggagaaaagggcgttgttggctttggaaaaatagcttataataaaggagagacgagcagacgatgagtgagagaaaatagtggtaaaaatggtcaactgctgcattggcagagtcagagaggggtcacaaagagttcgcacagcatcgaatatttccttcattttaggcgtcattcttccccactgcacttctttcttcggtttaattacccaagtttgaggtacttggcgtgtcctgcccataatatctgtggcatggaataaattttggaacagagaggcctaacggcggtgcttaaagtgcgctaaaaatgat

SEQ ID NO: 38689 - DNA, 1451 bp, Heterodera glycines
  misc_feature (531)..(531): n is a, c, g, or t
tcctcctcgttgggcagtgccggcgggtccagcgagtacaccatccgggaggagatcgaacggcgcgtgatcaccgtaagtgaacggtgggaatgggctgacgtccctatcgacaattgcacactctgtgccgatcggtttggtgccgagcggctgtaaactttttagtgtactttagaaatggccacgcctcaaattgaactcattctaatcatgggcttagacccgatcagatcacttgtctgatcagagttatttctttacggacaacacacaaatttttttttgtctaatcttagcgaatcactgatcagttttggttttgtcagacaggtcaaagaacacttgctcaatttaaatcacactcactgatccgtggctaaagcacgtgccgcaggattttagtattaactcagaaaacgaattaaggacgtcactcgtacggaagagattgtgacggatgtcgacgtgcacgacgaatcgggcggtggtggcggcgccggcgggcacaccgccgctgccaccccccanccgtcagtttcagtccagcggcggcggcggtgccaaagcgagcacttccgtgaacatcaatcgaagcggcgatgtcgtcggaggcgaacgacgacgcgtagatgagcgggagcgagacgaaagtgtcgcggagtttgccaactcgcgcggcgctggcgcatggggtggcacgtcgacggcaacaaacgctggtggtggcactcaactggacgacctccatcatccccagcaccaccaacgacggcacggcggacgaaacggtgcgaacggaggcgaaaggcataaccgcgcatttgccatggtcggagaggtgggaggggaagggacctggggagaggggcaaattgcgattgggtgactgactgatcagtttttgacgcaggaggagcgatcattgggcggcgaattgtcggcggatgacttgagcatctacgacaagaacaccatggtgggtgtagcgggtggtgaacttttcattcattccacccctcccaagccatttctcctcgtatttaaaattttatttaaaaaacaatttgggaaaattttgggcttggcgttatttgttgaaagaatcattaactgaccggggattcccggctttcagtttaatctcaaaaaaacttttttctgtattactccaatacaaaaaatccgagacagttcctgaattaacccattttcattatttaaattatcgataattggctggccaagagggatcactcactactgatcagttatcatatcataaaattatcattttcagtcaaaaatggctaattgataattaattaaataattaacaacattgaccatccgtcacgctagccgcgatcattagactgatcacttgacacataaaaatgatcagaatgccttctctttcgcagatgtcgcgtcatcgcgaattccatccg

SEQ ID NO: 38690 - DNA, 885 bp, Heterodera glycines
agcggttacagaaaatagtgggaaggattaataggctaacaaataagcttcaggctttcttcagctttcgctttgattcaatcaatcactcttcaagaataaaagatattttcatttttttttaaatatgacaaattgttaaaaattttaaatttcaacactaaattttatgcacgagaaaagtttttggaaatttaaaaactttattccgatttcctagtcccaaaattattttgcgtctcggaattgcattgataatataactacaatttttttctcccctgttaacaattctttaaaataaaaattcggtcaatttgtaaaagaaaattaaatataaattgatttttcttattttaattgctttttttctgagttgattattatagtttatctttttattgtttggaaaaaaatcttaaattcggtttttatctttaatttgtactatctataaactaaagaatccgttttattgctgcttaattgtcattttgaagtccatttttgaattctctataaaaattgattaaatttcgcattaatttaaacagaatttaaaataagaattcttcccaaaaccattttccaatgttcattaattgaatgaaaaaaaaacaatttttaggctgcaaacagttcttccgccgttctgttgctaagcaaattcgcttcacttgtttcggagaccaaaaatgtcaaattaacgaaggtgagaaaattttaatttctcaattttaaaatttaataaaataatactcttaataaatgaaataaattaaatgtttcagaagggatccgatgccgcgggtgtcgcctggaaaaatgtcttatggccggcatggacccgaagatggtcaacgcggaacagaacgaagccactca

SEQ ID NO: 38691 - DNA, 1232 bp, Heterodera glycines
tattcgtaaggcagttgtagtgaatttatacgatgaaaattgaacaaaacaagacatgtaataaaaacaaaaattaaattaaaaaaaagaaacataaaaattttaaataaacatgttatatacattttaaattaattttaatttttacatttcgttaatcataattacaaaaagcataattaaaattcaatataatactttaaacaaaaggataaaatgtttttaatatttttgttattgttaaataatttataacagaaaactttttattagcgttttaatatgaattaaaatatataaattttctaatttaacactaattgaaatagagtatttatgaaaaaatgatattaaatttttatttttaaattacaatcaaaaatttatcgttaaaatgaatacatacttttatgttaaattatagtagtaaaaggaagacgagataaagaaatatttaaacagatccatttcattaatatttatattgaaatttttaacttttatttcttacagataaaagcataataaattaaggtcacgatttttgatgaaaaatatagctttatacacttttgaaaaaatactgtcaaatacaagtatatttgcaaatatttaaaataattagatttttttaaataaacatgtagaatcaaaaaatttgatttcatttaaatatataaaacataataattttaacgtaatcatttattaaaattaattcatgaaagcattatttaaatcttaagattacaataatttatagttataattataaaaataaatctcttaaaattcaaagtgagacaatatctaagatgctccgaaaatgtaggggtgaaacaattaaagattttttaaagtttgtgatttttaggccgcttcgcggcctcgaacgggcgcttcgcgcccgtttctaatttttgttgagctcggacggacgcttcgcgcccttttctaaattttaatgggctcagacgagagctttgcgcccttttctaaattttagtgagctcagacgggcgcttcgcgcccgtttttcaaattttgtttgactaagacgggcgcttcgcgcccgtttttaaaatttgttgggcgggcgcttcgcgcacgtttttcaaattttgttggactcagacgggagcttcgcgcccgtttttaaaattttgttgggcttggacgggcgcctcgcgccagtttttcaaattttattgcgctcggacggcgcttcgcgc

SEQ ID NO: 38692 - DNA, 963 bp, Heterodera glycines
  misc_feature (844)..(844): n is a, c, g, or t
  misc_feature (917)..(917): n is a, c, g, or t
tagcatcggggttacgagatagaaaattgtcctactttgagatagccatttttctgagaattaattcacaatttccgcagctcttagggtaaggaaaaaattttgaagaggctctccggaacggattagcatcggggttacgagatagaaaattgtcctaaaaagagatagccatttttctgagaattaattcacaatttccgcagctcttagggtaatagaaaaaattttgaagaggctctccggaacggattagcatcggggttacgagatagaaaattgtcctaaaaagagagccatttttctgagaattaattcacaatttccgcagctcttacggtaatggaaaaaattttgaagaggctctccggaacggattagcatcggggttacgagatagaaaattgtcctaaaaagagatagccatttttctgagaattaattcacaatttccgcagctcttagggtaatggaaaaaattttgaagaggctctccggaacggattagcatcggggttacgagatagaaaattgtcctaaaaagagagccatttttctgagaattaattcacaatttccgcagctcttacggtaatggaaaaaattttgaagaggctctccggaacggattagcatcggggttacgagatagaaaattgtcctaaaaagagatagccatttttctgagaattaattcacaatttccgcagctcttatggtaatggaaaaaattttgaagaggctctccggaacggattagcatcggggttacgagatagaaaattgtcctaaaaagagatagccatttttctgagaattaattcacaatttccgcagctcttanggtaaggaaaaaattttgaagaggctctccggaacggattagcatcggggttacgagatagaaaatgtcctanaaagagatagccatttttctgagaataatttcacatttccgcagct

SEQ ID NO: 38693 - DNA, 1288 bp, Heterodera glycines
atatttggccatttttgcgtttttagagcatatttcggttattgtttgaaaattttcataagaaaaatgcgaaaaatacaccctaaggatcgactttttggaattttttaaaaatacacccttaaaatcgaaaaaaaattaaatttttgtcagaacttttggaaaaaaatttatgtatataaaaatgtaatttgttttagcatataataaaaatttataaatttggaaattcaatatttttgcaattgtctaaaaaatgctccttagccattcgtgtgcgaggaatggcatgaaaaatgcttatgaacaaattccatgtgttttttattagaaataattttcggatgatataataacttactaacatgaattaaaaaagactaactaatagaagctatttttatatatgtaatagttaattgacagtcatttttaatttctttttaaagtttcattttttagtaagttaggaattgtcatttcttacattattaattaaaatgtattttataaatatcttatattttatggtcatgatctcaaaattgtattcaataatgaagttttttcatcttacaatgtgtacaattattatcaaactcttttcactgtcgagaatataagaattattaaaattaagaaatatattgaattataaatttttaattttgtttaatatgttaaaaactgagcaaaaattactgcacaatttttgttcgcatcatattagggctttataagaaaaagaaatatttataaaggtacaaagtttcaaaaatcatctaattttgcataaggttggaatttaaagtttgtggaaaaaattattatttttgtataccgtatatactctttttgtatgccagtctccattaatctgccggtctccaattatttacccccttctgagaaggttgaaaaataatataccagtctccatttatgtgctagggggggggataaatagaattttttaataatttatttggcaccttttccaaaaaaattaaaataaattcaacagtaaaacgggctcaaaaatgaacaattcgtcgtcatctccgactccatccagccctcatcatcgtcatcagataagccgtcttcttcgtgatcgtttcgtccatctttccccgtttcatttggccttaactttgcgaaaaaatttgatccctatcggtccaattgctcctttcggcttggagccaagcaatttttttggcctcctgttccggccaaatggccgttggcaggcccacaaacttaaaaataaaagccatttttcctg

SEQ ID NO: 38694 - DNA, 1236 bp, Heterodera glycines
  misc_feature (1177)..(1177): n is a, c, g, or t
atggcattttccccttggaattttaccgttgccacccccttttaaggtttggctgaagtgatgtgtaccgcggttcgtttgtccttttcattacctctgcctatccttcgcttttccctttcgatctttgatcaattcccccgtgtccgtccccaccgtgccaaattgaccgtcgccgtatgtaccgtactctttttggccggtctgtgcatgtgcactcgagtacggtagcgcttttatgggaagcgatttcgaagtgtttgccatctttttaccgtggccttttcagtcgggcattttttatttcactattttcaacgattactcggccagcttctcgctcattttaatgcttttgctcgaaattgttctggtcatttatgtttacggtaactcatggtttactgtaacaacttttccgtcgttccttttattactgtatttccctattctctcccaaaggcgttcgaaattatttggcggaccttcggctcatgttcggcacaagtcggcatttgctcggcaaaatctttgggcccaccggctattgcattcgcttcgtttggatgtttttggccccgttccaaactttggtaagtgggcaattaccccccccccccggcaaattaataccactaattagtgccaaattgccctcccctgccaaggtgatcttcttcttcgtgttactcactcaaattggacacaatttgacctacggaaaagagaaaaggctttacgcttttccgaattgggcaattggcgttggatgggtaaaaaaaacggacaaatgaaaaaagggcatttattttgtggtcgattttggcacttttcgtcccttcttctctgcagcttatctcgtctttgccgcttcttttgcttccgctttttgtccttttcaatctttggaaattcgcgcggaaaggaaaggtaaaaaataggaaagaaaccaaaaccaacacaaaagtggcgaaaagggaaaataaaagtgccaccaattccttacaccccggagggtttcgactcgtcccaaagtccgacttttgtgtcggccattcattcgacgggcaatgcctttcccaactccgtttcccattctcttaagagttggcgtgagctgttccggctacaaccgaaatggccatcctacggccgacatagggaggaaaatgcagtnggaaagctgaaaatggacgatggcaccaccgaaagacggccctcgtgccatcacaggcc

SEQ ID NO: 38695 - DNA, 537 bp, Heterodera glycines
gggatgttgatgatgatgatgatgctttatttaagatgcctttaaacatcccatgggcaacatccatgagggatgttgatgatgatgatgatgctttatttaagatgcctttaaacatcccatgggcaacatccatgagggatgttgatgatgatgctttatttaagatgcctttaaacatcccatgggcaacatccatgagggatgttgatgatgatgctttatttaagatgcctttaaacatcccatgggcaacatccatgagggatgttgatgatgatgatgatgctttatttaagatgcctttaaacatcccatgggcaacatccatgagggatgttgatgatgatgatgatgctttatttaagatgcctttaaacatcccatgggcaacatccatgagggatgttgatgatgatgatgatgctttatttaagatgcctttaaacatcccatgggcaacatccatgagggatgttgatgatgatgatgatgctttatttaagatgcctttaaacatcccatgggcaacatcca

SEQ ID NO: 38696 - DNA, 998 bp, Heterodera glycines
  misc_feature (970)..(970): n is a, c, g, or t
aaaaacatttgaatcaattaataagttctgagataataaggtttatcataaaatttcatttaaaactaaccctcaattattggtatgaacgatactttccaaatatgcacgcgttttgcgctcgagctatttatcatcgggcttgtcaatccaaagcgaaacaacaaagatgctgttttaaacgaataaagggcataggttattttgaagaagtgtcaaagaacatgcagcaataagcctgcaaaatctaataagtggaaaatacatgagtatagaatttattttcagaaagtgtcaacagacttttggaaaaatatatttgcaatttatcaacaattttgagaagtgagttagaaatgataaacttcacgattcaaaccaattttcggtgctctaattaaccgcgataaaaacatccgaatcaattaaatagcttctgagataataaggtttatcataaaatttcatttaaaaataaaccctcaattattggtatgaacgatactttccaaacatgcacgcgttttgctttagctatttatcatcgggcttgtcaatccaaagcgaaacaacaaagatgctgttttaaacgaataaagggcataggttattttgaagaagtgtcaaagaacatgcagcaataagcctgcaaaatctaataagtggaaaatacatgagtatagaatttattttcagaaagtgtcaacagacttttggaaaatatatttgcaatttatcaacaattttgagaagtgagttagaaatgataaacttcacgattcaaaccaattttcgttgctctaattaaccgcgataaaaacatccgaatcaataaaatagcttctgagataataaggtttatcataaaatttcatttaaaaataaaccctcaattattggtatgaacgatactttccaaacatgcacgcgttttgcgctcgagctatttatcatcgggcttggtcatccnaagcgaaaacacaaagatgctgttttga

SEQ ID NO: 38697 - DNA, 903 bp, Heterodera glycines
tcttaaaacaaatggaataaaaacgaaaaaatacctctaagaattgaactttcaaacaaaaaacagttccaaatcgcactttcctataactttataaaagtatttttaattgcatttgcagtcagtaaacaatgtttgcaccgatttcattatttatttgctttcaatatgttaacagtttcaattaaacaaaaaattttgtcattgtccaattttactcgtaaatgccacgagcctattcaaacactcaaagatataattcgtcagcttttgtcttcatcagaagacgcatcccaaagctcgtccatttgttgcccaaagttggatgggccagatctttggctttcaaggagctgattaatttcttctaaaaatggaaataattcgatggcatattgcgagcatctgttataaaaattatgtagtttttgttacgaaaaagccaaaatattaactaaaaagcagaaaaagccattctcaaattgaatttttaaaaattttttaagacaaaaaagaacatttttgtatatttaatgatagcaggaatgatacgtcatgtttgagttcgggtttcgagggatatattatcaaaaatttgtgattttttttcgtgatttatttttttagtaatttttatctcttaatctcacctctttgtttgggacgatgctgaatttcagccaataaatcctggcctgaatttgcctgatcttccgcaatcagttcggccaccgtctttccacgtcccacgtgttgtggtgtcatatcataaattggcattttgccatacccctgcccaattactgtatttgttgatcttggttttaggatgctactttcgtaaacagttttaatagaattttctgttgctttttgatcttgatgataaactgaaatcaaacc

SEQ ID NO: 38698 - DNA, 1006 bp, Heterodera glycines
  misc_feature (847)..(847): n is a, c, g, or t
  misc_feature (873)..(873): n is a, c, g, or t
  misc_feature (905)..(905): n is a, c, g, or t
  misc_feature (987)..(987): n is a, c, g, or t
ttctttaaagaatcattaatagggaacggatttttagatgctaaaaatcctgaaataggtactaaaacaggtgccaaaaaagtgcaaaataagtggtaaaaacaccaaaaataccaaaagtgctaaaaatgcccaaaatagctgcgaaaatgggtgttaaaaattggaaaaacccagtgtctttatgcatcgaaattccaaaagtgtctaatttttatcaatttcgcccgcacaattgcaactggccaagaaagtaaacaaatacattttggagacgaatttttgtgaaaatttttcatttcttggaatatttactgaaatcttggtcaatttttaggggtattttttaaaattttctgtgatcgattcttaggggtgtattttccgtttttattgcattttactatgaaattccgttcaggacgatttcaaaatcgctttctcagtacctaaaccaattgtttcacctttatttgttttattttttaaatttattctgcattattttcacggtttcagtctttattttttgcttataggtaggaatgagatttttaggcataacaatcgcagagaaggtactcaatcagcaaatggccgaagtttttgaaattttggtaattggtcgaaaagtgttagtatgttaaaaaaatttttgattggtcgatgccacgataaatttggtgaatgaataaagaaagtccaaccgaatgaaaatccgctacattagtcaacaaggtaacaaccaatcctggagacggcgcatcatacatgccacggctcccggacttttcgacagcaaaggacttttcgacagtaaaaaaaataatggactgttcaatagtanacataaaaacaaataatttttattanaataaattatattgcttgtcagttttagtaanatttatttaattaacataaaaaatgtattgctaaatcttattactagagatacgatttttacattttttactagaaaatttncgaaaacataccttaaaaa

SEQ ID NO: 38699 - DNA, 942 bp, Heterodera glycines
  misc_feature (38)..(38): n is a, c, g, or t
ttaattttatgctaattctggctcttttctaagaaccncgtgcggaaatataaaagcaaggaagtcttctgctcgccattgaagcctctgtacggcactggggccaaccctttatgtgtcgttaattttatgctaattctggctcttttctaataacccgtgcggaaatataaaagcaaggaagtattatgctcgcctttgcagcctctgtacggcactggggccaacactttatgtgtcgttaattttatgctaattctggctcttttctaagaacccgtgcggaaaataaaagcaaggaagtcttctgcacgcctttgcagcctctgtacggcactggggccaacactttatgtgtcgttaattttatgctaattctggctcttttctaagaacccgtgcggaaatataaaagcaaggaagtattatgctcgcctttgcagcctctgtacggcactggggccaacactttatgtgtcgttaattttatgctaattctggctcttttctaagaacccgtgcggaaaataaaagcaaggaagtcttctgcacgcctttgcagcctctgtacggcactggggccaacactttatgtgtcgttaattttatgctaattctggctcttttctaagaacccgtgcggaaatataaaagcaaggaagtattatgctcgcctttgcagcctctgtacggcactggggccaacactttatgtgtcgttaattttatgctaattctggctcttttctaagaactcgtgcggaaatataaaagcaaggaagtcttctgctcgcctttgcagcctctgtacggcactggggccaacactttatgtgtcgttaattttatgctaattctggctcttttctaaaaacccgtgcggaaatataaaagcaagggaagtcttctgctccccattgaagcctctgtacggcactgggg

SEQ ID NO: 38700 - DNA, 994 bp, Heterodera glycines
  misc_feature (916)..(916): n is a, c, g, or t
acaaatatttcaacaaaaatttttaaaaattgactagacctattgaacgctaacggacgacctaatggaaaaaaatccccgaaggagagaatttaattaaatccattccttcgggggaccgtgccgggtgccgcggggtaagcagtgctggttcgtttcatcacggcaccgaaccttttggctagtcagcaatcgttgcttaacttgccagatcggacgggtgcgcatgattccactgttccaagcaccccaccaaaagcaaaacgatataaccaaaatataaggaaaaattttttaaaaaattttttctccatcttcctttttgatactaaagcatcagagtgctaaaattaagttgtaaataaaatttggtgcgctttagagcactttctgaaaaaaatatttatgaaacaaaaaaatcgattttttcaagtgtccgtttggggtactcaaacatttatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggctcggggggactgcccccgaaacaaaaatcgattntttcagtgtccgtttggggtactcaaacaattatggggagcaaaaatccacgcagaattaaagtacaggctataggga

SEQ ID NO: 38701 - DNA, 1188 bp, Heterodera glycines
aaaatgaatcaaaattaattttttatgatatttttttaaagttgaattaattaagaatgccacaaagtcagccgagtggaatgtgaccgaaagtcaaaaatcactccgacaaattcaaattggcgcaagtcgcagattggtcatgttgagggatgatgttggcgaagcgccaaaacggaggaaaaatgacaaaaaacgtcggggacggaagaaaaacaaagtgtgaattagaaaaaaaacaattaaacgaaaactgaaacaaagagtcaaattatcgattgaaatctggtagaggtaccgtatacatacatcctgtaagagttttgacgccggttacagtaactggttttaccgttattcttttcggacatttgtcattttaccgaactgggaatttgtatttcggtacataccgtatgtatgtatcgtatgcctgaaatatagttccccccccctggggttctctatctatcaaatgcaggggggtgtattataggaaatgacggtaaataatgcaaataaatatttcagaaaaatgatggcacacaaaatcatcaaccgcttacaacagacgacattttcggcacaggagcagtgaatttgccgaaaactgaacattcccagcctgcaaaagagctgtcggaagaaacaattcttgacgaggaagtaaaaatcaataatttttaaatatttaaaattatttttcaattttaagttacccccggccccagccgatttgccaccatttgatgctttcccatcgccaccaccttcatcatccaaacgacggaacacaacaattggcacccaattaccacaattgcctgattatggaaaacgtaacttaataattattcgggattttctcgatgcccagtccccgaatccccgattttggtgccgctggagagattgattatattttcaaagtttcgagaaccgtatgcctagaaataatatccgcaccaaaaacaaggaaaatttatcgactcgagaaccgtttccgagaatcacgagctgccctagaaaattaaacatactttatttgaaaaattctcatttacctttctcgaatagtcaaaaaatttctaagtaacggaaaaattcctgtctttccaccctgacaattaggccttgcgattgtcgggaaaagatgtgattcagggttacccagtgtcgataatattg

SEQ ID NO: 38702 - DNA, 501 bp, Heterodera glycines
agatgagagggcaatgctgtagacgagttgactgatgtaaatgcctatccatgtgcagacgtagcgcgcctccatggcgctaagctgaatgaatatattaaattcaaaaattagaggacaaaaaatggatcaaaaacactaactggcacattgctatatagaaatacaatctttttcataaatattctttggcacggattgtatcataaccattttctcatctccaaaaccgtataagaaacaaaccatgaataaacgcgacgaaagaaagaaaagggtaaagaatttctgcgcaaagaaaattcgtatgattcaaataaaatttccatatgtcttgagttttacagaaccaatcggcaatctgaataaatttattaacaggaaaaattggaattaaaatctggtacttttccgacagatatgtgggaagaccacaatccttccactaatatctaccctatagcgctgccactttaattcagctacctattattgatcccc

SEQ ID NO: 38703 - DNA, 852 bp, Heterodera glycines
aaaaattgttcaaaatttcaaaaatttcaatattccccccttggtggatgaattaagtcttaaatttttacaacgctcggggtccccggcgccccgaatatgtgtcggggggtcggggggcaaaatgtcgggggtcgggaaccgtcgggggacgacatgtcgggggtcggggaataggcccaaaaatgtcggcggtcggggaccgtcgggggacgacatgtcgggggtcggggaataggcccaaaaatgtcggcggtcggggaccgttgggggacaacatgtcgggggtcggggaccgtcgggggacgacatgtcgggggtcggggaataggcccaaaaatgtcgggggtcggggaccgtcgggggacgacatgtcgggggtcggggaccgtcgggggacgacatgtcgggggtcggggaataggcccaaaaatgtcggcggtcggggtcgcgggccggggggttcggggtcggggcttcatatatttttttaaagacacaaaaaatgacaaatttataattattcaaatattatagaaatactatgaatgtaatggataaattttcttataaaattatttatgttttaaaaactggttaattcttatattttataaatcattgtattgtatttggcttggcatgttttttttaaaataaagaaaagtaaacaaaattttttccattgattttattatgtgaaaatttgatttatcgaaaatatcaaaatgtcatgaattttaactatgttctcattcgcaatccaaatctttgtaagacggtgaaaatatacttatttttaaatgcataaatgagttaaaagagggttgcatgatcagctgagttttgtaa

SEQ ID NO: 38704 - DNA, 963 bp, Heterodera glycines
agcttttgtagagctgcattgaatgctgcagtcgccgctgctgtacgcccacccgttgctgagttagggccgagagcggcatgaaaaaagacaaaaaggaggaaaatgaaacaaattcgcggctttgccctcgcgttggagaaagcaatgcgcagaataactggggagacttagggttagcgcatcaattatttttttcagaatgtgatcggggtacaaaaatacgggtccaaaagtgggtgtaactccgcttggagatgcgttagaaaagaaagaaaaatatgttcggacagcttttgaagagctgcattgaatgctgcagtcgccgctgctgtacgcccacccgttgctgagttagggtcgagagcggcatgaaaaaagacaaaaaggaggaaaatgaaacaaattcgcggctttgccctcgcgttggagaaagcaatgcgcagaataactggggagacttagggttagcgcatcaattatttttttcagaaagtgatcggggtacaaaaatacgggtccaaaagtgggtttaactccgcttggagatgcgttagaaaagaaagaaaaatatgttcggacagcttttgaagagctgcattgaatgctgcagtcgccgctgctgtacgcccacgcgttgctgagttagggtcgagagcggcatgaaaaaagacaaaaaggaggaaaatgaaacaaattcgcggctttgctctcgcgttggagaaagcaatgcgcagaataactggggagacttagggttagcgcatcaattatttttttcagaatgtgatcggggtacaaaaaatacgggtccaaaagtgggtgtaactccgcttggagatgcgttagaaaagaaagaaaaatatgttcggacagcttttgaagagctgcattgaatgctgcagtcgccgctgctgtacgcccacgcgttgctgagttagggtcgagagcggcatgaaaaaa

SEQ ID NO: 38705 - DNA, 1481 bp, Heterodera glycines
  misc_feature (43)..(43): n is a, c, g, or t
  misc_feature (73)..(73): n is a, c, g, or t
  misc_feature (120)..(120): n is a, c, g, or t
  misc_feature (160)..(160): n is a, c, g, or t
ctcgtttagtcaatcggtgatttaattcattggaaaataaatnttgtttggtggttttgggtgtagttagccncagtaaatatcgtcactaactttgattaactaatattttcactattntaaaatcagtacgtaaaagggatctgaataaaaagtcatntaattttgtaaaataaaatacaggcagtgagtgcacatttgttttgaaattacaggcagtgagtgcgcaatttgtttgaaataggtccgagaataataaggcactgagggtgcgcgaccaagaagtgatcagattttgttaccaaggcacaaatagacagagagtgttgtgaaaattgaacagaattgtggcaattgagacaattggtcagagtgatcagacaattgatcagagagtgatcagacaattgatcagagagtggtcagtgagtttatcagtgatcagtgaattaatcagagtgatcagacaatcgatcggagtggttagacaattgatcaaaagcgatcagatatttgatcagaaagtgatcacagtaaaaaacgaaccaattgatcagagattaattagggtaaaataaattaataaatttcctaaaagttgtcaaacgagtggaaatttaaaatttctcatattgcccaaatttacgtcatttttgccggtcaataaatttgattacggaaatcaaaataaaccaccctaacacccctgagtatctgggactaagcgatcttgagcgagaaagaaggaaacttgaaggagaacgaaaaaggaaaagtaaagaaaagttaggagctaacagaaatatggctgatgatgatttagaagataaatatgtggcattaaaggcaaaagtccaagacttagaggatcgcttgtccaatcgggtcccgaattatctcccccctggagttaaagtcccaaaatatgatgccagaggcgacttttttaaatttttaaaggaattcaatgttttggcgacagcaagcaactggcacccgccggattgtgtccgattcttacctttgttcttagaaggggaggccaaagaaatttaccaaaatattccggcggacaaaaaaacaaattggagaaccctaactagtgaaatcgcggagctcactaagaaacttgacggacccatgtgggcgaggaaaatgctaaataagacaaaaatgggagtaaatggttcagttacggaattcgcgaacaaaattcgtgaattagtagagcaggcaagcccggatccacattatacagacgaagcaagagaaggtgagagcatccattactttttaaatggattaccaacaaaactaaaacggaaattgttttttatggaaaaaccggatagtttagttgaggcaattgcgcaggcaaaaaaagttatccaagtgaatgaggaaattgagaaagatgaaaaaggggatgaaatgaaacaacaaatagctgagctaacggaacaagtcaatgcaatttcgtt

SEQ ID NO: 38706 - DNA, 1512 bp, Heterodera glycines
  misc_feature (23)..(23): n is a, c, g, or t
ttcatctccgccgactgtgggcnttgtgtgttcgatctgcttccggcttcacaacttggccttgaattgcgctgatcagccaccgttttgacttttacgtggacgaacacttcaaaactcgcaaatgggcgctgaaacctattcaaattggaaacaatgtcatcaaggaaatggaaattgtcaattcccatggaaaatcattgccaatttcgcgaaaaccgttgccaaagaaaatcatcggattcaaacggatcaacatcttgtgagatatggccaaatgaaaatttttaggcaacacttcccattcatttttcagtttcatcgacaaaaatgtcatcacttttctccgccgttttcgccaacttttcgccgtctgtccaatccatttgaccatcattacgcacaatgatcgcattatgcagttccttttgcgcaacatttggccaatgctaacgaaaacattcatggcttgcgattgtacgccgtaattttctatcgtttgcgtcaattcgtcccgtcaattctcaacgattgtccatcacttcgctttgtctctttcaattttgccgatctcttcgccgaatttccatgtgatgacagtgccgcggcatcggatggacaagcattggccaaatggctgttcactccacttcaaaacaatgtgccaaagatgctcaactgctcgttgaatacggatgatggaattttgccgtcgaatattgaaccgttcaaagcggtgctttcatttatctttggtttttcttaaccaaatttcccatattttaggcttttgcctcggcttcttcccccgccaatttcatcatttacatttcgtttgcgtcgtcttttgctgcttccgttgtgccatttgaactgaccaacgaaaagactcgggaacaattggctttgaaaagggctaacgatagcgatcattttctgttgatccgttgtccaattgcgcgagaggcgagcaaatggacaaaatgggaggaggaagcgattggctgggaaattcatgatcagtggaatcgaattagcattcaagtgtatcacaaggaggaaatcggggacgggtcagcgaatattactcaaaaattatttatgtttaaatttttaggcttctcgacgaaattcccggcccaagtgaccagcagaaatgaatgaatgaattgtggaaaaatgaccgatcaatataattttttgagttgaaaaatgaatttgttgctttttgatgtgctctcataaatgctttttttttgttataatgatcaacatggattttgttttttttaaatcattttaatttggacaccccaaaaatcacagagaaataaagcccaaaaattttgaatgttcagaggtcatcaaaactctcttactcacttctcttcacatatcatttagggtttttctaaaattctttaaatgaataaaaaaatgattaacaccgtcgaaaaatgcggtcgctacttgcaaatttgcctttttaatgaagaaaggggctcaaaaata

SEQ ID NO: 38707 - DNA, 1193 bp, Heterodera glycines
  misc_feature (31)..(31): n is a, c, g, or t
  misc_feature (74)..(74): n is a, c, g, or t
  misc_feature (110)..(110): n is a, c, g, or t
  misc_feature (1121)..(1121): n is a, c, g, or t
  misc_feature (1148)..(1150): n is a, c, g, or t
  misc_feature (1157)..(1157): n is a, c, g, or t
aaactcacatttcattttcattccatttttngctgtataaaattgctactttttgagcctgttttttccattgnaataaatgtgcataaaattctgaaaacatttgcatntcatttgaaagtccattaaagaattagttaaaaaatttcgaaaaacaaataagccaatgttccatcactttaaaataaatgaaaaactatttaatattacagtcagcgggtcaaagtgaaaaatgatttataaataaatgccatagatttcataaattagcaattgaaaagtgaataatttaaatgctaggccatttattatcgccagaagagtgaggtcatccgatgttttttgtccgcatttcgcctcttacgaaaagctgtccgccctcggcgcaatcactcggcggagtgcaattcgttgccccggcatcagtgccgtgtataccccggccaatgggcatttggcggggatcagtgccgactcggcgccgcgcggactgtccacgaacagtcgcaattcggagatggcatccaggccaagctgctggcggtactgcgcttttgagggtgacgagggggcgtcacgcgcgggccgaaggcggcagtcggcggagacaaacgacggacgactcatttggcacagcatttggagcacttcggcacagtacgtccgccgagaaatcagcaccgatttgtagttgctctaaagggaaagacaattatgaacgatcatccggcactaattactaataaaattgctgatcatttatcaactcactgctgatcacattgactcagctcattactctgatcagagtcactcactgctgaccacactgatattaatcactctgctgattactcgggtcaaaacactcgcttttggtcacattgatcagtcacttactgccaattactctgatcaaaataccaagtactgatcattgggatcataaagcttactgctaatcatgatcaatatttattgttgatcactctgatcaaataatcaatgttggtcactctaattaatattcttgctagtcaatctgatcaaatactcgctgctcatcactctgaacagagccactcactgaccacagccgatcactttgactgacggcttanaactatgactattattctttttgattnnnagtgatngagctgtgttcattttgttttctcttttttgcatta

SEQ ID NO: 38708 - DNA, 1062 bp, Heterodera glycines
  misc_feature (50)..(50): n is a, c, g, or t
cctttgttcagtttcggcaaattttcaaatactgatgcaaatccaacggngtcgacaaaaagcacggacagtccggcactcgacgctcgcgccgttcgcccgctgcgatggatgtaactctaacagaaaaggaaatgaacccggaagaacaacacatccaactctttctcacttccgtcgttttcgggcattggtaatgaacgatattttgcactccataaaagtccaggccccgggcggcgacatcggtggcgaggagaacggaatcatccgatgctgaaaggcatggaaatttaagggaaaatatatataggaaatacgacgcccttttctgaatgatttgttagtttcgaaatggttttgtctctttgttttttaattcgtctttccctctgtcccgtgtttgtttgcctttgaatttgtccacactcttcaaccgttccttttccttcatccgtccgtgcagcagtgccgtgttcggaaatgccaattttttcagcagcgaatgcattcgtcgaatggccgaaatcgaattggcaaataccaaagtgcgcccgccgtgccgcttaagcaaatacatcaaattcaaatcctgaaaatataagcaaaatgaactttttgtaatgagattgggaaatataaatgtttttgtgccttttggagtaaatcggcacaattcatgcgacattcggtccgagtctgtggcgttttctgcggtggcgtcagatcaatcactgaaagattcgcagcgccctttcgcattgacatcgaaagggcaatccgacgcacctcaaaagagagaccaaacaaattaatcaaattgaattggtttaaaatgccaaaacaaaatgcatataattatcagatcgctaataatgaataaaatgagaagatttttaacaattaaaataaataaattttaaatttctttttcttgaaattctcaaaatggccttgctccaacatccgatcaatttcatcaacaaccaaaaatcgaagtgcggacaaatccgccaaatgttcgttgccctaaaaggcattttgggactaaaataaagcgaa

SEQ ID NO: 38709 - DNA, 892 bp, Heterodera glycines
  misc_feature (48)..(48): n is a, c, g, or t
ctttatgaatttattttcactgacgaatggtccaatactgtatatatntgagcaaaatttttatttggcgaaaatatttcattttattgagaaaatgaaaggtagcgccgatgagcgcccccgggggaaaattgtgaactttggcccattttttaaaaagattttcaccaatatttttttagtttttttctttacggaataatgctttatcatagaaaaattttttggaaaaagaagcataggcctagtataaacttgtcttacctaagatcaacgtaaaccgaattcttcataggtaataaaaaaaattctaaatctatttttctcctccaaaattttttattaggacaagagggttcaagagaccaaacgctcacttacttaactggaaaatttaatgaaacgaatttaaatgtatttgtaagatcaaaaaattaaaaaaggtagctaaaactgattttgcgtaggagtctcaacattaaagtgaccgctttttttgttttttaaaacgcttttttcttcactttttctaaaaaatttttggggaacatcggagtccggtggtgccggtagggcagggtttggatcaaaatttatcaaaataagaacaccaaacaaaaaataagaatttagggttaaaaataagaacatttcgcaaaattgatttaaatcggttatttttacaatttattgttattcgattaaaaattgataacagattttcaaaaaggccaatttttgcatggcaaattttatgtcaacttttggcatcttaggggaattttgtgacacgtccgcgccgaaaatggatttacaaaattattcttaataagatgagattagtaaaataatttatcttccttttgcaattgcttttttttgttttcccacc

SEQ ID NO: 38710 - DNA, 838 bp, Heterodera glycines
gtgcttttaaggcagcgcatgcgcactttcggacactctttcccccgtctttttcgccctttcgccccctcaaaaattcccccggcgcagcctccccaaaaaatcactcaccgcaataaaaaaaaccttcaattttctttctccagccaaattttccctgtgccccttctgaccgccgtgcgacgacgacaaagtccgagcaaaatccatcatcataaaattaaacgaaaatgaaagaaaatggctcaaatgagtccaatcggcgcgaaactctgttactttttctgaaagggacgtccttcgaaaaggcatcatttgacgcaaaacccaaaaatatttttaaattattccgttcgtttttgacgattacttaaaccattaaaatgccttttattgcgtttcccaaaattcgtccgcgcgcgcttcagctgctgggcagtgggcagttcggttgatggctcatcggcaaattttttcttgtgggcgtgcttttgggcggagtcgtttataagcatcgggcgaaagcgattgggggacattcgacgggggggagacaaatctctcccttccctttccttggtcgcccaccttcgagtatccttttcccccttgtgactgtcgtcaccacttcattcgggaggggggacaagccaaatacggacgacgtattgtgacgaagatgaagcggatgacggacagacatttgggcggatggtaagggataggttcttcaaactctccccccaccgcgccccttcccgtgggcggagtaacggaaaatagaaggggacggggatgagaggtgacggcagcgatcgaagcgagggggcaaggtgga

SEQ ID NO: 38711 - DNA, 889 bp, Heterodera glycines
attcgaaaaatttgaattttcgactttttgttcgaattcgggtccagggttcggaattggacgaaatggatatcggattcgtggttagcgacctcgaaaactccaggaaacttgttttcatgtcttttgaaaacaaaaattttttttcaaaaaagggtggagggcaccagctttactattaccaaaaaaatgtgctaaaattgaaaaaatttttttgttgttgctattattaacaaaaattgtggatatacgagcaggatatttatgaaaatgctaataaaaaaataaaatttgccctccctctaaactttatgagtttttttttgaagtttttttcgggggaaaatgtcggggcggggatgaaatacacccccaaaattttacccccaagcggctgttcttgtcctgcgtccgtgccatttgctgcccccccagaaacgccttgcagttgtccaccgactgaaattaaaaggaaatgattttgggaacatcatttttccataattaacccccccccccctcaaaaccaaaaaaaaaatttttttttgaaggtgtgaattaaagtttctatgaaaaaaatctgctaaaattgaaaatcttatatattttttgctattattatgaaaagagttgttttaacaacaacaaatatcaatcttatacaccagaaaatgtacctcctccatctgtttgttccgtgccgaccactgcgggcattgtcccctccgccgtctgctgctgctgttgctaaatgagacaacgaatgtctttttgacggaaacattgattgatgtttaagagcaaaaaattggaggatgggactgaatttgtaaatacaatacccttgggactgaagaggccaaagcccagttaatcagccaaaatacaa

SEQ ID NO: 38712 - DNA, 1053 bp, Heterodera glycines
tagactcacaattggcaaaatatttcttggccaaatataaatttgtcaactgttcgatttcaggtcattttctcgaacgaaacgattcaatttgtacgtccctgacggttacgcctactattggcgtgatttgcaggaggagcagcgcttttccggcactcgttggtggatgatcagtgatagtgtgtgccggacctacggatttggaaagacgcctcttgtgtttatcgatggtggaactactccaaaggctaccaaaaagttttggaagatgagttgctgccgtacgtgggcccgttttcccgccatccatttcacatttcaacaaaacaatgcctcaattcacgtcagccgcaacaccaccagtggctcgagtccattgaacccagttattttacaatttattcggtcaaaaatgtatcaattattatatttttcacctcccattatggatttgaactattttgtagagtgaattagcaaaacgtattccagtgcaatcggaccaaaaaaatatatcagattttttaacaattttttgcggcgcatttttccaaaaaaagtttagggaaccgtagggggggggcaaaatttttgaaaatttgagtgcaatttgttaacagattttgtcaaaaaattgccctattccaaatatcaaaaacaaacgaccaacataaatattgatattttatctttttacatccaatggccgaaaaattttcaaaaaattaattttttggggtatttcttgaaaatattaaaaaatgtgactttcaaataaaattaatttgtgccaaaacaattccaaatataaaaaaaaatgtggctaaaaacttatggggtaatctctagttaaaaatttcattttatggttttttaaaggtcctttttgatgcctttttaataatgatatcggaccctcaatttttcttcaaaattaatatttttgtatttttgtttctaaaatgatttatattcgagatttttggcaaatcattttaacgaattcgaagaaattttgagaaatttaaacctcaatttaagcctcgtcaa

SEQ ID NO: 38713 - DNA, 1807 bp, Heterodera glycines
  misc_feature (817)..(817): n is a, c, g, or t
attttttcatccaagaggtcataaacagcattaaagaagtgatagaaagtgactgtattcgatagtttgattgtcagtaaatttttgaaaataaaacaattacaaaaaattaatgccgctaaaaaactagaaaaaacatagtttttcttatctctaattctgcttatgacctctaggattgaaaaaactaaaaacccgtttggacataggcgcaaatgtctggagtgaatttgtccgcaaatatggggtaactgaaataagtggtttttggaataaattgccattaattccgattttctaggtagagcaaagataaggcacaaagatttcaaaataaaacggtcattctatacaaatccaaaaaatgtttgaataacttgaatttccaaaaaatttactcatttttggtctctgttcataattattcacctgaaagcctttgcgttcacgtggactagtcgcccatttgaatattccgcccttagcactggcgtcgcgttccttcccggcacaacgtaaatggcacagtatgggttctccgtcgcaaatttagtcaacgaatgttcgatgtaattgcgcatgccaacacttgtctcgctttgcttgcaaaatctgtggaaaaagaaacggaaattgcaagtcaaacatcccttgggatgggtgttcgtccctcactttattgtaatccgttgcagttgcggttggtaggcggacaccccattgaatgctggtgcgattggatttgtggccgacagtcgaaaagcaaaattcagtgccttcgctgaggaataaatggttttcaggcgatccgcgcggngaatagctggcatttcttttttgattaccaaacgagaataaaataaaaatataatgcaaaacaaacggaaagatacaaaacgaatggaacttcgtttactaaaaatgaatgcatttgctttagtttttctgattgtgatcgcaaatgtaatatatgatacagtagtatttttccttccttctcatttggtccaagacacctaaagattgatatgcctcattaaaaattaatgggtttttcggccaaccaacctttgggatgtcgttgaattccgtcagttcctccatttgcttgttgaacttctccactttctcccggtgactgatttgggccctctttgacaaacggtcgaacgccgtctcctcctgccgtttgagaaatgccaattcggccttcgtcttccgcgggccctcttgttccttctttatggtcagatctattgttttcgggtcaacatttcgcttcttcttgaagagagtgccacgcttcagtttcagtccggtcctcaccagcaacatttgctcatttgtctgcaattattcaaaaagcatttaaataaaatgaagcgaaattaacccaactttatgatcagtcttgtcctctttggcgctttgagtttcctccgcctcattgttatgatttgggcttttgctccgtcctttgtccattatcagagctatttgtggctaaaacaaaataaatttgtaatgtaaaaatagagagaggcgggctaggtttttaatgggcccggtgatttttgggaaaacccaatttgaccggttgggaaaaggcggacaaaggaattgtctgctttcgaagatccaaccccaccctgcccgggaagatttgaaatcatggtctcttaaaatggataaaaatagaaaatgaaactaaaacattaaaggctggaagaattttttcaaacaaatcaaaatttaatatttaggaaataaaaaattaaaatggaggcagaaatcgttaaataaaaca

SEQ ID NO: 38714 - DNA, 997 bp, Heterodera glycines
  misc_feature (956)..(956): n is a, c, g, or t
tgccactcggggcggaatagtcgacgattgagaaagccgacaagatgacaagcgaacggactgtagaccaattaattaaaattgacgaataaataaatgcacacaaaatatttagagagaacagtgtccttagtaaaatgtaccatgaaaaaagaaatcctcctggagacatgcggggaaatctagcaaaggaaatatctattgaaaataacaacataattagcgaaaacaacaaaaagaaaggaaaacataattataggtaggtcagaggtcggagagaaaaataacacaatttatagaaataaattaagcagagagaggtcaaaatattcaatttaacacatcacaacccctaaaaaaggcgtccctgccgttaattcggcatccgttatgtggtggcccgagtaagctaatgtcggctgcctcttgtcagattgttttggttaaattttttgaagagtatcgacgggcattgttctcacggcgatgaaaaggcgatcgggaacgagaatacgggcggcggtcgcatagacccaaccccccacgagccgaagtagatgacgaagtccctgggcggtcgaatagacccaacccatggacgttgttcacggaagaaacgctggagcggagactgcggatcccaagctggagattgtttggccactgcgggatttgggtgttgatccattccgacagtgtcttaatgccgttttccgtcagccatccgtccgaattgattcgacttcgatcgaatgactctccgtatctccaaatctcgacaagacttcgtcctgaaggagtcacacaaacgaaccaattgcccaacagctccgccagccgagtgttcaattcttggcaggccaactcgcatttgcggacataaggcggcggcaaccaatgaacgacacggatgagaaacgtgagcaaagctggtggattcgctggcattgctcgancatttggtcaaccgtttcgtcctttgacagtgagtcacgcc

SEQ ID NO: 38715 - DNA, 1450 bp, Heterodera glycines
aaacacgttatccatatccagttcaaatgggtaattgggccaagcaactgggccttgagatgcatcaagtcaatgtaattagggaaatgaatatttaaatgaatcaaatatttgaatatatattttaattatttaaaaataattaattagttctggttcctaaatcgacaagcacaacacagacaagaagaaaaaaaagccaaggaaaaatggttggaaggtcgacgcgaccaatggaaactgcaaataccaacagaaggaacatattagttaattagcttatacaaaaataaaataaattttcaatttacacagtgtccatcataaaaagcaacaattagtggacaaaacggagccaattggacaaaaagcggaacaaaaggattatgttaggtaattaatgagagttgccccttaaaaatcgctaattaaatttatctaaaaattcagtgacatgagcgagcaaaaaccatcacaaaatgtgggaaaaacggagtcaattggacaaaaagacaccatggatgggaaacaacaaaaggcacaacaaaaaaacactttggaggacattggcacgacggcgctggagtcggagccgacgagtgaggagctgaagaactttgccaagatgttcaaacagcggcgggttcagctcggcttcacccaggcggaagtgggacaacaactgtacgaacttcgtggccaagtgttctcccaaacgacaatttgccgtttcgaagcattgtatcaaagggcggggggggggggggggagaagctcccggacaatctgtcagtggacaatccgtcagcaaaatttattttaaaacaccatattttatttaaaatcagtttgaaaataaatttaaattgctaaaaaagagaaataataatttgtattactttataaaaaattatgaaataagatattaaattatattgaagtattaagtaaatagaaatactgacggattgtccttcactaacggattatccactgatggattgtccgtccgtgccccgggggagggacgcggaacaacggccaaaaggttttatgggtggggagggagacggatagaattgacagaatttgctgataaaaattgtgagtctgtctctttgaaggcaattgtccttcaaaaacatgtgcaaaatgaagctgctgctatccagatggctcgaacaacacactgacaacgagaaggtcatccagcaaacggtgagacaaaccgcaaaaaaatgggggaagaaaacgcaaaatgggagaaagtggggggggggggggaatgggtgcaaagcaatgggcgacaaaatggttttgggagaaatattaaaaatattcgtttacacagtaatagaagcaaaattttatcttttttgtttgcttttttataaaaaaatttatttacctatttttctacctatttcaggatttttgtacctatttaata

SEQ ID NO: 38716 - DNA, 1495 bp, Heterodera glycines
tttgaataaaaatttgtcacgcttaaaaatcttttcaaatattggcatgcagcttctatttcttccaaggcaattaatcgaggatgtcggcacttctcactgaggaagcgcggtcgtttaggctcgtctgcacaatctgttgccgctcgtttggttttttttgcatgtttggcttcacttcatcagcatggtttggcttcacatcatttgacgacattttttaaattgaaattaagaaacggttgggaaaacaaaaagatggctttctgaagggtagagctagagctttaaggcaacggtgataacatgtcctgataaaggttctccaggttgcactggtaattgaaaattgtgtgccaaatagggttttgccatcaaaaaaaaaactgtcaatttggaaacattttgaaaaatgaccaaaaattcacgaaggtttttgttccaaacatccaaaagcaggaatagattccaaatatattattgattaacctcaggttatcatttgggaaaagtttgtttaagacaaagttggaaaaaagacaagggtcggatatttttcactgttaatggaaaatctgaaaaacggcaataaattcaattttggaagcttattcaaaactgccattatttttaaattttatttgccaaaagatcctactaacagggaggagatttattttaaattttcaatgaatttgagtttggcaaaaggcacctgaaatttgtccatcaaagtctggcctgaaatctcaagattttgaattaaaaatttctctttttgcttaatcagaaagaacatattgaattttacaaactggccaagtttaatgttatttcactagacattcattacgttatggtcattggtgtaaaggggtagtcaaattttctcaaccttatcataatattcgtacaagttttaaaaagtatcctagaaacgagaaaaataatcattttgaagtggaaggttagggctttcaaaaaaaaaaaaaaaaaagtttttaatgtaagtaaaaatgctttttttgtgctgtctggtaataggcctacgacgggagagagagagagagagagagagaggagagagagagaggatagagagagaaagagagaagcaacagaggaaggttggacggggggagggggtttgagtttagggtggaaatttgaaaaattttatgttaggggagtcctacattttaaatttaatttattttttttaataatgaatcaaaatttgaaataattatttcaacatttaaatgaggacaaattaatggcttatgacgggaaagagagagagagagagaggtaggccatgtgaatgttcagcaggggcaccggacgggtgggattgtcttggatggagtgatgtgtgaatggattttggggcgccttatatacggcaatatcgttgccgtgtatccagttttttggcataaaaatgcatacggcaaggcaaattacccaatgacagcctcgacaattgtgccat

SEQ ID NO: 38717 - DNA, 1520 bp, Heterodera glycines
tgagttgagaagcactgatcaaaaaatagaaacgatatttgagagagattcgagaaagtagggggggggggggaaatttccaataattttctacaagattatacaaattgatattttcatttttgttttgtctgagaaattagaattgttttcaccccccccccttttacctgcgtggtttttccacaccccgtcccgcctgtgataagtgtcaccggactgctctcaatggtgtttaaaattttgtcacgaagtgcccaggtgggcaattggcgtcgaaaagcgtccatttgctcggagaggcgtggcaatggcggaatatgaccaacggaacgggaaaaaacagtggacgaatggtgggaggaggaaggggacggagacgacgaatggagaagagacgaaggggagccatgggaactaagggaacaacagattctcgtgtaaaataaaagagaacgcccgaaaaacagtcagacccgtactcagaaaattccggtgggggaaactcaaaaacaattcgtgttagctctaaatttctaaaaaatttgcaaaacttaacgaaattattaataaaaaagtgacccctgtttaaaaaataattttaatttatgaggtagggagggaattacatccctctggcaaggtacacgagagtagtttaacccaaaaatgagcaagaaaaattaggtctaaacgaaaagaattttgttcgaacataaagatgatatgtaatatatagacgactttatagacgtattacctcgtcgtcgtcacgtgtctttgccattgtccctcgccctctttgctgttcagtagctgtctcaactgcgttgggttgtaacttcggttgataaaagtccgtggtgccccgcttcgtttcgttgtcccaccgcccctcgttgctgcggcggtgcttttcccatttgcgctgctcaaatttgggtgctcgctgcaattggccaacgcattggtaaactgttcttcgatttgctttgttggacaacggaaaatgaaactgagcggcgaaggcggcgattgtttgtcagttttgttgcccgattcgacggcatctgacaatatgaagaaaatgtcaatggcaaaataaatccaaaaatctatggaagttaggacatttttgatgaaaattaacaaaggaaagtcgtatttagtcaaaatgtaaggctataaattccaacaccattggttccaggcactttcagatgcttttccacttcttcttgagtaatgggcgcggactcaacaaaggcagaaataatccggcgtatttcatcagatacagaaagagagtccgtctcgtttacagaatattgggtcaattgggaattcatatgtcgtacagataataaacaatcagttaaaaagaatattcttgaaaatgagtaaatatgtaaatgtacacataatgtactttttcaaaacatttatttttttaaatttccttcattttttgccttcactagttaggcaaataaggttggtctccaatatgtgaattcaat

SEQ ID NO: 38718 - DNA, 692 bp, Heterodera glycines
aatttcgagtcttagcttaaaaatattcgctctatttctttttgtcccatttgccattcaatgctgtggaaaagattccaaaaatttctccgccacgcctaccgacatgattcaacaatttaatgagtttgatgtaaaactatttgctttttgaaataaattgaatgtaatataaattgaagttatcaatacaagaaaaagtcaatttcgctggtgatcaatcattaccgtactgttccggctggtgttcgttgctgtggaccaattattctgttattggcattgttcacggcataatttggtgtcatccatgccatggcagttggcccatttgtcaccgaattgttgttgcaattgcgcaaaaaacggaaaatggcacggccaaagttggcacaatcatttcgaattcgtttgttcagcagcaaatacaccacgggaggacaacctattgaaaaagcaataaaaattagtttattttaattttatttcatttaaagaaatacgcaaaccattgctaaaaacccatgcgtaagtgccaacgatgatgtaaatttcaccgattctgacatattgcattaaggtgtaaattacggcggtaattgaatgtatcaaacttatgataatcacttggagaaatgtctgaatatttattttaaaaatatttggaattactcaaaattaatgttattttt

SEQ ID NO: 38719 - DNA, 904 bp, Heterodera glycines
gcccgaaaatcatttttagagcataacaactgatgacgtcactgtcattgtttccaaagagatttctattaccagattgccaaaaaaagagatagccatttttttggaccgtccatacctcacatatactcaaacggcccgaaaatcatttttagagcataacaactgatgacagccactgtcattgtttccaaagagatttctattaccagattgccaaaaaaagagatagccatttttttggaccgtccatacctcacatatactcaaacggcccgaaaatcatttttagagcataacaactgatgacagccactgtcattgtttccaaagagatttctattaccagattgccaaaaaaagagatagccatttttttggaccgtccatacctcacatatactcaaacggcccgaaaatcatttttagagcataacaactgatgacagccactgtcattgtttccaaagagatttctattaccagattgccaaaaaaagagatagccatttttttggaccgtccatacctcacatatactcaaacggcccgaaaatcatttttagagcataacaactgatgacagccactgtcattgtttccaaagagatttctattaccagattgccaaaaaaagagatagccatttttttggaccgtccatacctcacatatactcaaacggcccgaaaatcatttttagagcataacaactgatgacagccactgtcattgtttccaaagagatttctattaccagattgccaaaaaagagatagccatttttttggaccgtccatacctcacatatactcaaacggccccgaaatcatttttagagcataacaactgatgacagccactgtcattgttccaaagagtttctattacagattgcaaaaaa

SEQ ID NO: 38720 - DNA, 812 bp, Heterodera glycines
caaaccacatctccgcgaatatcaaaaaaaaaatttaacgccaataatatttaaaataaatattacaaattttcatgaatagttacgggagggttaatgggcggaaatttatcttgtttaaaaattaaataattgcgctgcccttgtttagtacacgaaatttagtacattactgtaaaagcaaatgaaagaatcgattaaagtaatgaggcaatggaaaaaaataaaatgaaaaaattctgaaagtgcttttgggtgacgaaatttattgaaaaaagtccattcatagctaattcgtaaaatttaatgtttcgttggggttttgagtggaagattcgttttgtagtcacaatttttgtaaaaagtgattagggtttcttttccatgtttttttaattcaggacaaaaaacatgccgataggcgccagcgggaaaaattttcaaaattttaaattgttactaaaaatttttggctaattttttaagaaaaatagtagtcttggtgggccggcggtgctgttggtatatacacaaaggctccttcctaatgggcatatacccaatgactcccccgttgggcatatacccaatgactccctcccaatgggcatatacccaatgactccccccattgtgcatatacacaatgactccccccattgggcatatacccaatgactccttcccagtgggcatatacccaatgactccccccattgggcatatacccaatgactccttcccagtgggcatataccaatgactccccccattgggcatataccccaatgactccccccccattgtgcata

SEQ ID NO: 38721 - DNA, 296 bp, Heterodera glycines
ttttggggtcattttcccgaataaattcttacgccaaaaattgctcatttgtcagggcaaaacattcccaacaaatttggccaaataaataaaacactgaaaaaatatttgtctttttcatttcattggccctttgttaaaatgccaaattcaaaaggaccgtcggacgaccatattttggctgatgaactgtttatggtcagcaaagtcggcggaaggatttacacactgccgaaaaaaagtgtccgaagatcagtcgcatattttgacggatttataacactcagaaaagggca

SEQ ID NO: 38722 - DNA, 67 bp, Heterodera glycines
ccgtaagtgtcctctttgcccgtcgccgtcgtccttcctgagctactcgcagccttagaacatgcgc

SEQ ID NO: 38723 - DNA, 1054 bp, Heterodera glycines
  misc_feature (968)..(969): n is a, c, g, or t
  misc_feature (1008)..(1009): n is a, c, g, or t
ggggaaaaaagacttacaaaaataataccctggggagaagggagtgggaaccatgatttcaaaaattttcaattttttgtactctaagctactcaaaccggttcacattccaataaaaataacattcacggtgcgaaaaatggggtatgaaaagtttatggggggaaaaaaagactttttacaaaataatacccctgggagaagggagtgggaaacatgatttcgaaattttaaattttttgtagtctaatctactcaaaacggttcagaattcaataaaaataacattcacggtgcgaaaaatggggtatgaaaagtttattggggaaaaaaagactttacaaaataatacccctgggagaagggagtgggaaacatgatttcgaaattttcaatttttttgtagtctaatctactcaaaccggttcagaattcaataaaaataacattcacggtgcgaaaaatggggtatgaaaagtttattggggaaaaaaagactttttacaaaataatacccctgggagaagggagtgggaaacatgatttcgaaattttaaattttttgtagtctaatctactcaaaccggttcagaattcaataaaaataacattcacggtgcgaaaaatggggtatgaaaagtttattggggaaaaaaagactttttacaaaataatacccctgggagaagggagtgggaaacatgatttcaaaattttcaattttttgtactctaagctactcaaaccggttcagaattcaataaaaataacattcacggtgcgaaaaatggggtatgaaaagtttattggggaaaaaaagactttttacaaaataatacccctgggagaagggagtgggaaacatgatttcgaaatttaaattttttgtagtctaatctactcaaaacggttcagaattcataaaaataacattcacggtgcgaaaatggggtatgaaaagttattgnngaaaaaagacttttacaaataatacccctgggagaaggnnagtggaacatgatttcgaaatttaaattttttgtagtctaatcta

SEQ ID NO: 38724 - DNA, 1287 bp, Heterodera glycines
  misc_feature (1075)..(1075): n is a, c, g, or t
  misc_feature (1200)..(1200): n is a, c, g, or t
  misc_feature (1234)..(1234): n is a, c, g, or t
taatttacttttccccgtgctagaaatgaaaaaaacttaaatgtttatttgtaatatttataaaaaaaacaattattagaagagtaaaaaatccaaaagcaacgtatcaacaattcaataaattgcacttttatttttattattgttatttttaaaatttagcaaaaatttattaaaagaggaaaaaatttactgttagtgattttatggttatttattttaaaaaacattttcacataaatataaataatcctaaagatagttttttaatattttttattttataataataattttatttgttaaattatttttgggactgaaatggcccatcctcggccttatccaaaacctcaatttgtcacttcggctcaacacgaaagaaaaaggcaaaaagtgtgggaagaaataatggcaccttcctgttctgtgaacacagaattaattatttttttttaaatccccctctttttaaataaatggctcttaacttcataagcctttagcaaaatccaaaatgaatcccaagctgatttattggttcaagaaaggggcataattcataaagattttgcaaaactgcgcgtaattaaattctgtagtcaagaacagaaagtaccgaaataatttaaaaggatttgtaagagattgtgccgtgctgtcgtgtcttatgttggttttgtcaaatgatttaattttatgtgttttattgaagcctatgaaaaaataatttaaaaatatattttggccatttgccactttttaccggatgccgtgcagaacattagcatttggtgggtgcttcccgtgccgctggccgtcccgtgctgctggtgacgcccgtggtggtcgcggctggtgccgcccgaacagattgcgctccgccgttccgagtggtaaccgcttgccgccgccagctctccgccgttcgtcggtccacccccgccttcgttgatgctgccgcttctgccgccgcttgcgcatgccgccgcttcgtccgcgccgatgtgtccgcacgagttggacagtgcgcaggcggtgtccgacgcggagacgcgcatgtcgatggacttgngcaggaaaatgaccgattggtgatgggaaggggaggaaggcacaaaaaagtcggatttgccggtaatttgccaatcggcggaaaaggcgccgaaagtttcaatttcaaaattaaatgcacagacntcataaatcaaacgacaaatgttttgtccattangtatcccccgggggggaaagcaaaaaaaggctttgaggaaaatgccggggggg

SEQ ID NO: 38725 - DNA, 962 bp, Heterodera glycines
  misc_feature (880)..(881): n is a, c, g, or t
  misc_feature (918)..(918): n is a, c, g, or t
ttaattatttgttgacctgctgaaaaatgggaattattcgttggcacataaaaagttgtgtgtagcttcttacaattctctcgtgtaatttgatgttaattcgtcgagattaattttaattcaaatgagcgtgagaaaagggttgcaagacaccgggaacgagccgggaatttccggtcccccacaggcactggtagggcaaccagggctggaaaaacagtagcgatttgttagaaaattttgaaaattccccgttccccactttacgaatttccatttctgggaggtcatcctcgctctcctcgttcctcggattgactgtagatcccccaccggccgcggccctaattaaaaagcttatttaaaaaatatagaaaattccttagaccaaaaagaagaatttatcaataactcttaggttggcaaactgtatgaaatattattgacattcagtggaaaaatggtggttgaatgaaacaaataaatttttataaattttatttggtaaatcttaatttttagcttttatttgaaaagaaaaattaattaattttacttttaaatgattattttgaaaaattaagtaaattacatgaaaaatttaacatttgttttgtaagtagtgtcgcttagtccagtaattgtaccgttacaaaatttccgattttatccaagctcaaaaaggtcccagaaatatattaaacttacaaaactatttaattttaacaaaagcaaatcattaggggtgtaaaaatgtctcggtctcgagtctcggaaatcgagaccgagacttaaaaacacgagagcaagaccaaaaaacgccgagacttttctcgagtcgagactctcgaacaacactactaattattcgattggttannaacatttcttatatcctttacatgatcgttttaatanacatcagacatatccccaaagttggtttcgtctttagaaaataa

SEQ ID NO: 38726 - DNA, 1620 bp, Heterodera glycines
  misc_feature (1515)..(1515): n is a, c, g, or t
  misc_feature (1521)..(1522): n is a, c, g, or t
ccccccatagggggggggggtgcaagaccactgaacgccacccatttgagcgccgccaagtgagcgcgggccatttgagcgccagacttttcagtactgaagccaaaacttattacgcgacttttttttgaaacccaaacctattgcgggttgcgcgactttttttgactgcgcgactttatgcaaattattttattaatttaaattaattttaaattaaattttaaacatcttaaaggtcaaaacatcttaagaacatgaatttaaattcatttaaaattcatcaaaaattccccgcaccaagcggatccgaaccccagggggggcggccagactgacgcactaaccactcggccacattggcaatggatgataaacattaatttgctctcataaagggaaaatttgacgtcaccagcgggggcagggggggggcgagagcgagcagcgagagaggggaggggggtcaaataaacaaatcaattattgaattcacaattttctcttttaaaagcaaaaagaaatgggggaccgtataataaaatataatttagaaattaaaataatttaaaggttaattaattaattattttcctaaaataaattttttttattacttctaaaataatataaatatttttcagtgaattaacaaatacatttaagtttaattattgatttgtctgttaattttttatctcctcaaaaataattacagcaccctttcaggtgttgggcgtttgtttatttgaccaataatttttaatttcacatctttacgttgcccctccctcacacctgctcatttgtgtaatttgacaccgtttcttttatcttttcgttaaaaattaaaaagattgtctggaatttgtcttgcgccacaccgctgtgccattcatttatgtaatttgacaccagtctgataataatttcgccaaaatttatttattatttgtccatttattacgaattattttgcatctatcactccaaattttgttaaaaaaaattttttattgtcccaattttgaccattttgtgttttttcaacaaaataaatatttgttcaaatttaaagaattaatttttaaaattttagacacaaaaacaaatcatgagccaaaaccgtgacgaaaactcgcagccacctgtacccgatggaccgtacccgctggcacaagagcgcaatgagtttgtggaagatgaagcaccggtgctgcttgagatgttggatcgtctgtcacaaggagtgggttttgttttgaattatttaaattttttaatttttccattatggcttatgctaattgttgattttgtttagggaatttgccaagccatgggcctgttttcgtttgcacttgccgactgtttggccacatttcatacatttgccatactgttcgactgtgagacacctgtgccatttgacgagcagcacaagcgatacgtgttcgaacacagggacaaaccgcggctaatctacgtttcggaagatggtagcgttatacaggnttgacnngtgtggtgaagcaaggggaaatttgtgatgagcatcgagacgatgtatctcgataagcgaaaacgagttgatcacttttgcacattcctgcgcacttt

SEQ ID NO: 38727 - DNA, 906 bp, Heterodera glycines
caaaaatcccatttctgcgttaaaatttttttatttggtgaaagtttttaatccatacaaatacatatttagggggttttcgggaataaatccatatttcgccatttttgcctttttagtccatatttcggccatttttggcaaattttcacaagaaaaatgcaaaaaagcgaaaagtacacccctaaagatagactttttggaaattttaaaaaattacacccccaaaaatacaaaaaatttgagttttcgtcggtcattttggcatttttaataaatattttttccattttttgcggttttcttttttttaaatgagaatttttttcgaaattttggcaaacttggacaataaaaatttacattttaagttttaaatccatttttttcttgtttattgcactttttaagtttatttaagcaaatattgaatatacacaccttttttggaatttttgaaggtttaaaacaaacattttggcagtttttagtccatatttggcatttttgagctttttagtccatatttcgggcatttttatatgtccatatttgacgttttttatccatataatttcgagccctagtaaaattgtttattgttttagaatactttttatttttaaacttctttaaaataaaaataaaaacattacgtcgttggcatataattaaaaaacaaaatttaagaaaaaaaaaagtaaatatattttgcacttttatattaagcaagaggttatttttggttagcaactaactgataaataaaattatataaatttattagttgtttatgatttaaaatgttttaacacgttcgcttgtaccattattatttttattaagggaatttattgcactttttgggatgagtcaaatcattcaaatttaaaaatcttttatttt

SEQ ID NO: 38728 - DNA, 1283 bp, Heterodera glycines
  misc_feature (46)..(46): n is a, c, g, or t
  misc_feature (54)..(54): n is a, c, g, or t
  misc_feature (120)..(120): n is a, c, g, or t
atcatcagcagacacagcgaagtgaggggggggggagaatgtgggnaatggaanaccaaggggatatggaaatggagatcgggggaaatgtggaaaatcagagggtgaggaatgtgaaanatagggggtacaatcataactaacttatgttttccagggatggctttctcaggatgaactggtgatgcgaagctcgtcagacgagttggacaagctgagcacgtgccttagtgaggtgggctttcaattgcttattgattgatcagtccgtcctatcaaatagtgattattcacgtcatattaaatattgactgaccagtctatcctgtcaatattgatccatcagtctgtcctattgaacaattattgatcatccgtcttattaatattattgatcaacctctttgatcagtccatccatcaaatagtcaccttttaatattgattagttaatttgattgatcagtccgtctttgattgatcagttcattctattaaatattggttgatggtacgttctatattgatttattagtccgtcccattaaatattgaccagtccgttctaatgattaatcaatccgttacattattgattaatcagtccgttctgttattgattgataaacaaacaaatcgttttgcaaaattggcttctcttatcgaattgtcttgtcaaatatcaaacaatcagtgccttttctccgttcgttttggtttttcatgtgaattcactcgtccgtcccttcgttgagtctgtcaaaatggcattggcatttattcattcttttggcattttgttttcctttttccctcccttttaggcttcctccgaaactcaggagcgtcgtcgtccctctctgatcagtgacattgtgcaggcgcagctcgccctttggactttggtgctcaccgttttctattcctacgcttggcagcagcaccgcaaaaagtttctcctttctctggtgagaatcgacagcagaaaagggtcagcggagcgatcattttcaaatacattaaaagggtcaacgatttttgacaaatctaattctggtctttggtgttgacaaatcccgaaaatgattcgatcagtcagtcagtgttgtctgtgtctgtctgtctgtgtctctcgcgttgatcagtccctttcacctgctatttcgctgattctccttctcttcccctcagtttgtcgttgtgcctcccgtgttcctgctgatctgcactctttcctcccctctgactgccattgtcattttgggccgaatcttctcttctcc

SEQ ID NO: 38729 - DNA, 824 bp, Heterodera glycines
  misc_feature (782)..(782): n is a, c, g, or t
  misc_feature (795)..(795): n is a, c, g, or t
tgttcagtttcacatctaatagaatcagcacgttcaatcagtggctaaaaaaaattaaaaaaacaaaaaaattaattaataaaaaaatagctcacaaattttctcttcccgactccgcttaatctttgccaacaattcggttgtgcgcttgcgcaactcttccgcccgctgtttccgctcctcatttccgccttctttctcttccaataaagctagaactttgtcgtaagtggactgaaattaaaaaattaattatagtaggcattattaggtgtttcataaaaatgatcctctctgaaccacatttaaaaataaacaaaaaatttaatttgggaaagaatttgataaattaattttcggaaatccgaaaacccatgccaaatgcataaaactaaacagcagactgatctattttttcattgttacctcccgcccccttaaaacccaagtagaaaatcttggggaccgtcccctgatttacacaattaaataattttctatacatatcattttaaattgtttctcaccttcatcgcattgtgtttttgttcaacttggtccgcaatttctgatgcaccggcggcgctttggccggccgcctttgtgttggacataattttaatgtattccgctttgagatggtcttaaaatgaaaaaagaaaaattgaattttttgtttttcgcttgatttttcaccagtcatgttgatcaatttccgagttcgatcggttgcttcgtcaacacgcgactccaatgatttgatctcatcttctgtcaatganagggtggacctanagaaacataaattttcaattatatatata

SEQ ID NO: 38730 - DNA, 895 bp, Heterodera glycines
cagctttgaatgaaacttggccattcacgccgacaaaacattaaattaggccatcaaaacaaccaacagaattaaatgagtgccgcaaatgagaaggggtgaaaaaacggaggggaaaacgggagcagatagcccccaccacccgtcatatagcttaccctcaaaactcaaaaaaaaaaaaaattttcaaatagaaaatttttaaaaatcttataaaataaaaataattttggaaaaactagaaatattttggattttttctctttttttaatgtttttataggaggacaattaaggaagaattaagagaattttgcattcttttatgcctgtaaataaatgcgtaacctgatacttttttttaaatttcttgccatttgcccaatattttttgcaaatgcgcagccatcaatcaataaaataattaaaccaaaaaattttttgtcgacaccccccccccccttattaatgtatgtaagcgttaaaaaattcaagtctaacaactgctagttaatgatagaattgttttatttttttaagttattgggtaaatgctttaaattttaatccccaaaactgtgcccaaatgtgcacaataagcctagatggtctcaccggaatcggatgaaagttttggccttttatgcaaacgaatcatttaatcggaccatcagagacaattaaggaagtaattagttaaaacaaattaatgtcatggaatgagaatttttatggctgtagataaatgcgttttttttttgttaaccattttgccgattattttttgcgaatacgcagccattaatcaaaaattgaaagtaatcagaattttaataattgtacaaattgataagagacaaaaaaaagaagaaatgaatttgtcaacaacagaatg

SEQ ID NO: 38731 - DNA, 1005 bp, Heterodera glycines
tccaagtccatcgccaattgactaagtgaaccgaaccctgcaaaaacccaaacccgagccccaacggccctccctcgttttcctgacttggcgctcctggccgacaccgaactgcaccgccttttggaagactccgaattgctctcgccgattgcacacaagaagcaaagcgtggaaaagccgtgctgttcgccgtctctcttcaattcgccgaaaatggaagaaaattttggtcagccaagtgtgagaagcagaatgttggcacaaggccgtgcactgcgagaaagagttggccgtgaaggcaaccaaaatcagattttggctgaaaaggcattccgttttgaatttgaaaggcagtcagcgcactcaagttcggatgagaaaagtttgggaagatccgggtatgaaggccgagcagagcaagagcaaactttggttgaagggctaaaagctgaattgctgagagtgaaggacgaacgagacgtggcagaggcaaaagtcgaaattttgctacaaaaattgtcggacaaagaacaaatcttcaatttcctaaagaccaacaacgttaaactgctggtggaaagagagcaaattcgttgtgaattcttgtcaatggaagatgagttgaagacggtaaaagaaaaattggaaatggcagaacaggaaaatggacatttttcaattctttctgtccaacaaaatttgatggcgcaggagcagagtcgaaaaataatggctttgatggaagaggttgaagaaatgaaggctaaaaacagcggtgaacaggaggaatttcttaaaaattccgaaaaccgaattgctgaacccaaaaaatccgtctccaaattgccactcaaactaaacattgtcaagaaaaggaaccccaaaatcgccaaaccaaagaaaatttcccaaaaaccggaggctggaaaatgcaattttcttccactgaattcaatcattttccggaaacctcctccgcaattcaaaccaaattaccgtccg

SEQ ID NO: 38732 - DNA, 1130 bp, Heterodera glycines
  misc_feature (133)..(133): n is a, c, g, or t
  misc_feature (150)..(150): n is a, c, g, or t
caaatttttttccttttttggattgggttcaaaaaaaatttaaagggaatttttgattattaatttgaagtctgaatttatttgacaaatccaagacttaaaactgggagagcaaggggctgtgctgggggcntaaattggggccacatnggagaattaattctgatttctgaaaagtcccagaaatacttatttttctttccataccttcttgtagagctcgagctgctctttccaatggtcttatcccggtctcgatccgtgccgaactcacaaagttatggagtgaaatgtgaaatattgttttcaccacaaggcattttttctgaaaaccggattcaaaaatctggggtttggtataaccgttttagaaatagcgtaaaaaacagcttcgatatcaagaaaccaagtcaagtccagaaaggaatattttaaaacgatttcgttttgttttggcattatgataccgaataactttcggaaattatggaaacaaaattggagaaattcgaataattttttgactgcaaatttttttccttttttgaattgggttcaaaaaattttaagagaatttttgattattaatttgaagtcttgaatttatttgacaaatccaagacttaaaactgggagaagcaaggggctgtggctgggggcctaaaatttgggccacattggagaattaattctgatttctgaaaaagtcccagaaataactatttttctttccataccttcttgtagagctcgagctgctctttccaatggtcttatcccggtctcgatccgtgccgaactcacaaagttatggagtgaaatgtgaaatattgttttcaccacaaggcattttttctgaaaaccggattcaaaaatctggggtttggtataaccgttttagaaatagcgtagaaaacagcttcgatatcaagaaaccaagtcaagtccagaaaggaatattttaaaacgatttcgttttgttttggcattatgataccgaataactttcggaaattatggaaacaaaattggagaaattcgaataattttttgactgcaaatttttttccttttttgaattgggttcaaaaaaattttaagagaatttttgattattaatttgaagtctt

SEQ ID NO: 38733 - DNA, 914 bp, Heterodera glycines
attagaagcgcctgagtgtcgacatttatcctccaaaacatcgctaagccggtttcggcactccccgccaagatacagccctttttctgagagccgttcaaaaaatttccgaaaattttcaaaaattttctgaagaaacttttttttgtttggttttttcaaaaaatggttttcaccattcgatagagaatccttaaaaaatagttgtactcttttgttcggagccgatccgaccaacttgaagagagttattaaaaaaattgccggaaaacctacattttcctcttatatagagaaccagggccccaaggggccctgtgaaagcgccacgggcgctttcaacaccggggccagccggggccattgggttttccccgcgcttaaggtactcgctcggccgcttcgcggcctcgtacgggcacggtaagcgtttgaataatagcaaaaaggtggtgtgacttaaaactaaaggttaactaagaattacacataaaatttttcagacaaaaatttattaataataaagcaaaaaagcaaaaatcagcaaaataaattacaaaataatcaatcaaaaaaatcatcaaaagaactatcaaaatcatttggttcttgatcgtttgcacccgctgcgtttccattatctcgttccacgtccgggtcattgtccacgtccggtactcttgggcccacgtccggtattgctgcgtccgggtcattgtccacgtccatcagtccacgattcggtgtcctcggctgctgcgtctccaagtccaacagctcgaggtaaacgacgttctcgatgtgcgtcccggacccactttggctgaacggcgcgtacaccctgatgcaatccatctgcgtgactctggacatggagacgtaacacctgggccatgcgaaaagcactggcgccc

SEQ ID NO: 38734 - DNA, 843 bp, Heterodera glycines
cgtaattacgatttttacttagaccattttttctaggcttatatcacatgcgattttcggcactctgataattttagcgctcataatgggatgtataaaggcgattgtagaaggaattggaagcgctaaaattgtttgagaagctttttgagcgtaattacgatttttacttagaccattttttctaggcttagatcacatgcgattttcggcactctgataattttagcgctcataatgggatgtataaaggcgattgtataaggaattggaagcgctaaaattgtttgaaaagctttttgagcgtaattacgatttttacttacaccattttttctaggcttagatcacatgcgattttcggcactctgataattttagcgctcataatgggatgtataaaggcgattgtagaaaggaattggaagcgctaaaattgtttgagaagctttttgagcgtaattacgatttttacttacaccatttttttctaggcttagattacagcgattttcggcactctgataattttagcgctcataatgggatgtataaaggcgattgtagaaggaattggaagcgctaaaattggttgagaagctttttgagcgtagttacgatttttacttacaccattttttctaggcttagatcacatgcgattttcggcactctgataattttagcgctcataatgcgaatgtatagaggcgatttgtaaaaggaattggaagcgctaaaattgttttgagaagcttttttgagcgtaatttacaatttttacttatacccatttttttctaggcttaaaacacatgccactttcggcaccctgataatttt

SEQ ID NO: 38735 - DNA, 1551 bp, Heterodera glycines
  misc_feature (1477)..(1478): n is a, c, g, or t
gagtacttttggcgcagaaattgttgttcccgtacgaggccgcgaacatcccaagtcacacaaaaagaaaaggagatttgagtcccagagattggaatgccggagaattgagtcccagagattggaaagcttgagaattgagtcccagtgattggaaagcctgagaattgagtcccagagattgaaatgctggtgggttgagtcctagagattggaatgtcattgaaagttggtgggttgagtcccagtgtttagaatgccgcagatttgagtcccagtgtttggaatgccggagatttgagtcccagtgtttggaatgccggagaattgagtcccagagattggaaagcttgagaattgagtcccagtgattggaaagcctgagaattgagtcccagagattgaaatgctggtgggttgagtcctagagattggaatgtcattgaaagttggtgggttgagtcccagtgtttagaatgccgcagatttgagtcccagtgtttggaatgccggagatttgagtcccagtgtttggaatgccggagatttgagtcccagtgattggaatgccggagatttgagtcccagtgtttggaatgccggagaattgagtcccagagattgaaatgctggtgggttgagtcccaatgtttagaatgccgcagatttgagtcccagtgtttggaatgccggagatttgagtcccagtgtttggaatgccgcagatttgagtcccagtgcttagaatgccgcagatttgagtcccagtgtttggaatgccggagatttgagtcccagtgtttggaatgccggagatttgagtcccagtgtttggaatgccggagaattgagtcccaaagattgaattgcttgtgggttgagtcccagagattggagaaaaagccaagaaaatgatgcgaggccgcgaagcggccgagccagtcgattttatcattcataattctataacacaatcgtactacctagcgggggatgcgccgaaggcgctgaccccgctagtattaggaaacttctgcatcaatttcttcgtcgctttttatggataattttataatatttatttgttattttaaatacctacttttaaaacacaaaaattttctgaaaaaaatagtatttttttaaaattcataaaatattttagaaagactgtacaaacgggacccacgcgtttcggcgctcgcgtttcggcgccagctctttttccacgatagcttttttctttgacatccaaatacaacattgttggtatcactcgaaagctcttaacatgctctattagccttaccaaaagcgaaaagattttcaagcctggaaaaaattttattttattacaaaaaacttcaaaaatttcgacttttcacaattttcatgtataacttttttggaaattgtctaatagcgaagcaatagcttagaaaaaatttctggtaataaattgcactggaaaagattnntgatgaaatcactaaaaaattttcaaatcaatatagaaatattatacccaatatatttttttgttgtaaaaaa

SEQ ID NO: 38736 - DNA, 966 bp, Heterodera glycines
tttttgatcgaatggtaggggacgattgagtgcaggcactctcgactgccaataaaattgattttgccttctcattttttaaattatttttttttactttttctaatatttattcccatttcagtgcagaaatcgtacgtggcaacaaaagcgggacagtaaacaaagaaaagaggaaagattgaacgcagcacgtgcgcaaattgatgctgatgtttataatggaaaatttttttttcgcagataacttttttgattttttcgcattattgatcaatttaaaaaataaattcattttaaattatgagttggataataaaattaattttttcaaaaaatttaattcttttaatttaggagttggataataaatttaattttaaaaaaaaaataaattgctattattatcaaacagaaattattgtatatttttattatcaaacaatattagagcccaagtttaaatatgaaaaaaattcgtagaataggatcaaataaattataacaaaatgtcaggagaattaaatgaaatattatgagtataaataaattacagtactattatcaatcagaacttactgtattcttattatcaaacagtgtcatagtcaaagttttaaatatgcaaaatttgtattaaattgcaacaaaaatgtaagacattaaatgcaaaggcaaaagagtagaaaaagcgaaaaaatgatcgtaaattcttttctttttgatccaatttctactctttcaatttttcatatattccaattcggaaatattttgaaaacaaatcaagcacttgggttcatcgcttgcaatgattgggatcgagcactttggacaagaaaaaacatgtaaacactccttagccccaaatgtcaccatattttcattccctaaacaccacagacaccgttcactgacgatcagatttttccccttttgcttgttttccttcccttctttttcacc

SEQ ID NO: 38737 - DNA, 757 bp, Heterodera glycines
gagccagctagctcggcgctcatttcattgtaagttagtcctttaccggggagtatccctgcaaagtttggtacgcttctgctcaattagcaaaaaatatgagtgatcgaattttcactaaaaaagttaagcctacattttttggcatatttaaaaagcaattaaaaaattttaaaatttaataattttcctgcaccgaaggtactcactcggcctcttcgcggcctcgtggtgggccttcgccccccccccccccctcccacgcccttcagagcacgacaaatatttcaacaaaaattttgaaaaattgactagagcaatcgaacgctaacggacgacctaatggaaaaaaatccccgaaggagagaatttaattaaatccattccttcgggggaccgtgccgggtgccgcggggtaagcagtgctggttcgtttcatcacggcaccgaaccttttggctagtcagcaatcgttgcttaacttgccagatcggacgggtgcgcatgactttctgaaaaaaatatttatgaaacaaaaaaatcgattttttcaagtgtccgtttggggtactcaaacatttatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaa

SEQ ID NO: 38738 - DNA, 1634 bp, Heterodera glycines
attttatcagaattttacggaatgtgatacgcatgttatacaaaaatgatgccgttaggaatgtttaatttaagcggatttttgtatacatatatttcgagaattatcagtttttttttaatttccgcgcgttgtatgccgatttttgatccaacaaaaattgatttttctaattgcaaattatgttccgtttcgacaatttatctagaaatcaaataaaaccgtactcaaattaaaaaaaatgtccaattacttatacataattagaacttcaaataaatttataagtggaaataatgaaataaaagatggaataataaagaaaatagaaagccctttaagaaaaacaaaatgaaagaattcccaaagaaaaatatatcctaacaacttgatcaaaatatatcttaacaatgtgatcaaaataacttcaaccaacagataaattatgagtgcacacatctcatcaattttcatgtgttctcattactccgcctggttaagaaatgtttatttaaacattaaattgtttgaattttaacaaaaccttaaatgcttctttaatagcccataaatgtttgttcatctcatcaacccacaacaaatcacataaaagggtaaaatttatatgcacatcaatcgtcagcaaatggttcagctccgtttcgtaaaatgtttggacaaattccgaagtgtgttctggcatttgtttcctaatgatttggtcgacttcttaaaaatagaagaaaaaatagaggattatgtatttatgatattgtttttggaaaacttttaaaatctaaactcgaaaaatgaataaaggtataaaaatttaatatttgccagtcagactcggcctttttaccaagagaaaacccacttggaattttaatttaatttagaaaacaatcataaattttagaatattttttttaaatatgaattccttaatgaagttgataaaaaggttagtattttatgcaaaattaaagaaaaagttttaatatttgaagacttcttaaatgatttaattattttaatcacaaatcatttaaaaatttaattactattttcttaaaaaaataaactttttaacgtttttaatcaattagaaattaaggcagcaatttgcttaacttactttttcttatttgagtccgatattcgatgatttgatatgcatttctttttaaataattttcagcgcgaacttttcggcttcccttttcaatttgtcaaattctttgaccatcattaattggcccatttttttaaagagttttgtgtttaattacttccaaaatgtgattttttgttttcttaaaacaatcaattagacaaaacataaatcatttataaaaaaatttcaccttgtccacattgaaatggtcagaattgactaattgcttaaatttcgcataatttggtcgaaatattttgcctatggcaattgtctcatccatatccatttcattaataaattcaataatggcattcaaatccctttcgtaaaagccttttttcaccatgaggagcgcatcaacaaaagctggattgaactcagcacgttttaaatcattgccatcctttagggggcgggggccatttttcctcagctttatgaacaacgataatcc

SEQ ID NO: 38739 - DNA, 1019 bp, Heterodera glycines
  misc_feature (903)..(903): n is a, c, g, or t
  misc_feature (948)..(948): n is a, c, g, or t
cggcactgaatgggccggctccgattttattcactgatgcatttttgttaataatttttggacaaaacgccaaattaagggcaaaaaacttattttaagggcgaacaactaaaatatggattttttaagggcgaacaccaaaaataaggatttctaaggtcgaataagggcgataaaatgcaaaattttcgaacaaaaaatgtgtttttcgtgcatttctcgtcgagttaaagccgaagaaaaaataagtaaaaacttagaaatcctcgccctagtaatagctgaccgaatcagaaactcattgaatggggggcatttttatttgtctgtttgtttgtttattttgtgcccttaaatgcgccgaaaactcagattgatcaaaaatggaggagcagagctggggaggagggatgtgttaaattgatcaaaatttggtgggagaaggacggagtgtttgatcaacgatcaaagaattttgggtaatcatataaaaagattagaaattgagaatttcatcaaaatttgtgggagggattgtttgatcaatgatcaaagagttctgagtaataatgatcagagaattttgtttgtcaatcgaaccaaactgaaaaattgaaattgatcaaaatttgagggagggactgtttgatcagagagtcttgagttcatcagataaagtttagaaattgcttaattggttgtcaaaacaattttaagaccaagtatagaaagtaatgatcaaataaagtgatgtaaattttagcattcaaacttttttagagattctttaatcagtaatcaaagttttgtatcgtatgtttcttttttaattttgaaaaactttttgatcaccgatcatagaaagtgccgcctacttgagcaacatattattctgctgattanataatggtgaattgtttttccgtatttattttgttcaaggcttgncgattgtttggccaatgcaaaagttttgtatgtttttctgatttaatcttatgtgtcaatttgtaaaggga

SEQ ID NO: 38740 - DNA, 1164 bp, Heterodera glycines
  misc_feature (1104)..(1104): n is a, c, g, or t
ttaaaatttaaaggtgctttttaacaacaaaaagtacttttgtttaaaatttacattaaaacacggcaaaagattccatattatttaagtataataaaatttacataaaaacaacatgatgatagttggtcaaaataatcatatcacaagtcaaagaacttctccaattcttttcgggcgactaacgaccgcaattctaataggtcaaaaaggtcgcgtcggggctcaaattcctctaacccgttcaatgtgttgttattggtcgatttttgcaacatatttccatctaaaatagtcaattcaaaagaacaaaatactaaaagattatcaaaaaaggaaaaaggccgaataattcgtgtgaaatgactggtgaaaaacttactttgagttgatgcgatgccaacgtgcaaagaattggacgaactcttcgacattgggactggctttagaagtgacgaagaggcaaaatgtggcggttggttgggctttgaaacattggaagagggcaaggagtgcgattcaattttgaaacattctccgtttcgatactcagggttattcaatgtgttatctgaaatgaattgggtagaattgacggtaatagtgacgatgttagtctccttttttcgaaaaaaatctaattttttcattttcacatttagcattttttatctaaaaaatggtttaaaagtcttctttattgaaacttagatgattttgtttgtttccttacatttaaaccattttaagagcaaaactgcgaaactcaaaaaatttgaagtttcgacttctttaaatttttcgaaaaatattttcagggttaatccgaggcacttagcacgaatctgactttttcggctcaatttcgaaccatgtacccaaattcggacatttttcgaaaattctaattgctcatattattgtacgattctgtcaatgccttagcaataattacaatcggcactattaccgaattgacttgtgttcatggcctaccccttcgcctttctgtccgtctctgtccctcatccgctctttccctctccccgtcctttttcgtccctttctcttccatgggccttttgcccgttgttttctcatctngctgagttttgctctgtctcttcttcgacccgttcgcttcgtctttcttttcccatctga

SEQ ID NO: 38741 - DNA, 1031 bp, Heterodera glycines
aattcataaatatttttttcagaaagggttctgaaacgcaccaaattttatttacatgttagtttaggcactctgatgcttttactatcaaaaagggcgatgaatacaaattctaaaaatttttaattgctttttaaacgagcgaaaaactttaggcttaactttttttttataaactgatcagaagcgaaccagattttgcgagggcatcaaaaagacaaggaaaagcactgctatgatgctaactccagtaattctgaatttaaaattttttattaatttttaaagcttcactattttatttttttagcaaaattaattcataaatattttttcacaaactgctctgaaacgcaccaaattttatttacaagttattttaggcactcagatgctttcactatcaaaaagggagatgaataaaaatctaaaaatttttaattgctttttaaatatgcgaaaaattttaggcttaactttttttttataaactgatcagaagcgaaccagattttgcgagagcatcaaaaagacaaggaaaagcactgctatgatgctaactccagtaattctgaatttaaaattttttattaatttttaaagcttcactattttatttttttagcaaaattaattcataaatattttttcagaaactgctctgaaacgcaccaaatgttaattaaaagttaaataaggctctctgatgctttttctatcaaaaccgacggtgcaggaaaatattaaggaagagagttcattatttatttgttttttgcataattaattcaaaaagattatttttcagaaagggttctgaaacgcaccaaattttatttacatgttagtttaggcactctgatgcttttactatcaaaaagggcgatgaatacaaattctaaaaatttttaattgctttttaaacgagcgaaaaactttaggcttaactttttttttataaactgatcagaagcgaaccagattttgcgagggcatcaaaaagacaaggaaaagcactgctatgatgctaa

SEQ ID NO: 38742 - DNA, 948 bp, Heterodera glycines
  misc_feature (934)..(935): n is a, c, g, or t
ctgtatctttttcgttgcttataatttaaaatatttttaaacagcattttttatggatgaaaaaaaattactgcaaagtctaaacggcagaaaggcgtcacaaaagcggcaggagaagcgggagaaaaagcgtttgtgcgctcagtatgccggcaaatttcgatgggcgaagcgaagtgaatgaaccgttttcaatgccaaaattcccttttggaaattgccgttttagaggctttggaagtgtcagggggagagcagccgaccgccgtggccattggccatccaacgccggcggcatttgcctcgacgccgttgaagcgggaagtgccacagtctgcgaagccggcggaatttaagtggccggacgccatgttgtcatcctcacccgcagatacccctttggagctgaacattgtgaagacagaggaggaggacctgtcgtgttcttcctccgccgctgtgccaatgccttccgcagcagtgccgaacccaccagcggcttcatcattgtcatcgttaccgtcatcatcgttagcattgttagccgccatcgacgaccaacaacagcagcgcattgaacacctcgagaaacagttgcaccagcgggatgccaccatcagtgtccttcagcagcagctgcatagtcgagaagcagtgattgccgaattgcagcgacatttggcggcacagaggggggaagggcaccactaattaagtgatggagagcaattggcacgcaatgttttgttgagtgatgtgtcaagttgattggattcaatattccggtgctgttagttttcgacagtggtgatctcgaccagggctgggcgaaacttcgagcttcgaaaacttcgcggtttttgggcttcgagcttcgggtaattacccgaagttcgagaaaatacacccctatgattagcttatagtgaatttnnaattaatctcatt

SEQ ID NO: 38743 - DNA, 1456 bp, Heterodera glycines
catcagtatcaataaagtaggtcaaccttcaccaatttattcaccagtggcgcctgcttacttatattaattaacattttattctttttttttatcatcgcaattgctatctttccacatatcttttaatattatttcttttgataatatataatttttattattctctcaaactgcacgatagtcattctttagtttatttttgtttgagctatttattaccatctaaagaatttctaaattcctttgtttggttgaatgttttattacttaaattataattaacagggttttcatttttatattttttacaatatttatttttattactttcaatggatttaattttaatattttatgcatctgagcgaaaatacaaactagtgttgacgagtcattcaattttccacgctttagcttttcttttatttattttttgtttaagtattctcattagtgtgatattcttattctctgcaggttatttgaatttttacaaaatgtttattaatttacgaagatacaattttattaattcataatgttattagctttttttaataaaaatttatagtataaaataaaaattagtcctttttttaattctgtgtgttttttttaaatttatttaatatcatgactatagcattccgttggcctggggccaatacccaagcagaagatgcatgccactcggttgcggccaccaggcccggcattcttgtatgacgggaattcattctttttcttatattattgttttattaataaaaaaattagttagcttaccactttttttattttaaattttcttttctcttaattgcataaaattttattattattattattagagtgcgccgggaccgggaattttgggttaacatttattatttgatttatttttagcagagataattgtttaaaatattattttcatgatcaaaataaaaaataagtgtcaaattataaatgttttcttttaatttaagtttagtaagatatataatttatttaattgtttagatgggaagaatttttttagataatagtatatatcataaaagtttataactttgaaaatgtattttttatggtttcatatcgattaaggcatttatttttttgaaaaatttattcataattttaaaaacggtgggaataaacgtactgagaagaacttaagatagtctcagttataataagaatggtcaaagttagatgttataaagtgagttgatttaataaaattatggtgagtaagaagtcatatttaggtccatactcagattatgtcacataaatagattatgattaaggaagttgggagaggaattaaagtgatttgtggtaggaagattcgtcgatgataatatttaaaataataagcactcgtttattattttttttgcatatattcattcaatttttaagtttgtagggagataatactttc

SEQ ID NO: 38744 - DNA, 1342 bp, Heterodera glycines
  misc_feature (23)..(23): n is a, c, g, or t
  misc_feature (33)..(33): n is a, c, g, or t
actagagcccggaaattcaattnttgcggatcncgctgcgggattggtactgaaaattctttgcgggacgggatcccgcgggattaatcccgcaaatcccgcatttaaaatttgcgggatcccgtgcgggattgcgggattttggaaaattcgaaaaaatttcaattaaattcaaaaaatttccaaaaatcaaaaaatgctgaaaaataaatttttaggggctgtcgggatgcattaaaaggggctgatgggtcgactaagatttttcgattggatccgacggtaaaaagttgatcggaaatcaaattattaacggttcataaattgactatttttttcttttcaaacccacttttttgcggtgcaatttttcaaaaaactaggaacagagggtccggcggtccttatcagggatggcattccgaggccccaaaaattttcggaagtcggaaatcggaattccgaccccaaaaacgtcggaaatcggaaatttttcaaaaaatatacaatataataaaaaatttctaaatattttaattggctaaattttttaattcttaaccaagtaaaaggtatttcacaaatgtttttagtatattcgcttgaaaaaattattcaatattttatcaaatttttttttgtcatttttcattattttagaacatttttgggaaaaggagtgactatttttacacgttttatacagcgcgattttttcaaaaactttttgggaacttggaggagggtacggcggtgccgataggcgccgccgggaaaattttgttaacagattttgtccaaaaattacaaaattttgcgattttgagcaaattttgcaagaaaaatagggatttttagggtccggcggtgccgataggcgccgccggggaaaattttaaaaatttcagttcaatttattaacagaaattgtacaaaacttgctagttttttgaaaagaaaaatttaaaaaatttccgacttttcatcaaaaatttcggaagtcggaattcctaccccaaaaatgtcggaaatcggaagtctttccgcgccatacctggtgcctatcgacatctgcgagaaattttatgaaatttaatgcgatttggtaacagatttgtctaaaattgaccaaatgacgcagtttttgactcaatttctacaggattattaagaaaagcctatcaggcggtgccgataggcgccgccgggaaaatttcacaaattttaaatgaaatttgcgatgaaaaatgagttaactttaattaaatttattatttaatttatttaaaaatatttggcattctgtcttagaaaaattttcaaaaaaatcaataaaatcccg

SEQ ID NO: 38745 - DNA, 1047 bp, Heterodera glycines
aaaaaaatgaaaaatcgcagaaagacactaataaaatggaaaatttcaactcctatgaacatgcaaatttacttttctttcttattttaagaattaaataatattcatttaaataagttttataaggatcaataatgaaaatagccaaaaaagcgcgcaaatcgctgaccgcggtcacatcacaccgttagcacttaactgctaatataaaaattacccatactttccgctgagattttggacaattttcgctcatgtcgttgatgcatttgggtggcttaaagcgaaaatttttaaaatatgcaaattttcacttttttttaaatttacctcttctcaacaccatttttcgtgctcgaggataatccgcaaaaacaacactgaccgcgtcacggctcagcgtataaaccgtggaaaagccaacggaacggagctgaagagttaattagggaaagaacaaattaattgttcaattaatttattgattaaaataaggtaatttaatttcttaaataggatcttatttttatgttttacatgtttttatctataattattgcatgagaagcccaagcaataattcttataaattttatgaaaaatatttctgtttttagtaaatttcggcgtgcccgaattgttagtgacaaatgcaaaactttagtaacgttttttgatatgcaagaattgtttgaggtttagaatatcagttcgaatttttttaagattactgtgtacggatggatatcctgcgccgctgaccaaagcccaatcgccgtacaaataatccacggataattggcaaaaaaaaaatttttttaagtaataaaataatttatttattaaaaaaactatttatatacatcaaataaattattaataatttaatgatgaatttttctctttaaattataattatattttcaaaataaaattaaattacaaaaaagttatttttaaccgtatttataagttaatttattaaattattatttgtaattagaaagataaaaaaaattttgggatatattttctgctttacctttc

SEQ ID NO: 38746 - DNA, 71 bp, Heterodera glycines
tgcctttgttatttattagggcgtttattctttggtaaatattgttttaacaggcaaaactcggtcatttt

SEQ ID NO: 38747 - DNA, 960 bp, Heterodera glycines
ttttgtttaagtcgcgttgaattcgtttccgcgttaattatcccttcatccgtccgttcagtaatggtgccttcctccgtaaatggcgtgttggtgtgccggcgacgggggcggcaacatttgcatttgcttcatgtgaggagcaccacgaaaatgtggctgaaaaacatcgaaaaaagggggtgaaaaaagctaataggctgtccaaccggcggtgatggcataattgggggcaaagggagcacccccggagggggaggagggggcgccatccaaccgggcggcacaaagggcgacgggggcgtcggcgagggaacgccgccctgaaaagttgcgaaaaattgggaattttttaatttaaataccgccaagaatcgttgaagttcctgttccgtgtccacaattagcacgaagaaaggagaacctatgagaaacaaataaagttttgtagaaatggaaaaaaatgacagaagggaggatgccgaagacctaataaattttaccgaggtcccagcccggtccgtttttttaggggggggggggaatacaaggacttggagttcccgtaaatgggtctattgtcactaatttgcacccggaggcaaataattgtaaatgtaaaaaatgccaaaaaaaaaaatcctacccggcacgtgatgtccatgccatttgacctcaacttggtaatcgccaggctcacgaggttcataccttagaaagaacagcagagtaatataatttatatttttaattggaaatgccaaaattgcccacttgcaatggatggtccgttcctgtgccgagtcccgctgcatttccacattaaatgcccccttagggcccctcactcgcacagtcagttggccggcacccgcgcctgaaaattcagaaatttgcaaaaaagaaaaaactgagtttttctaaccctttgtgtcaacaacaaaatttgatttgaatgtg

SEQ ID NO: 38748 - DNA, 961 bp, Heterodera glycines
tgctgcccttctccgctggcgcataatcccttcctcccctttcggcttcttcatcaaatgcttttcttccctttccttcaacttttttacatttacagcattgcgcacataaataaaatcccaataatcgctgtactatttttatcttggctaattcccatttcgaaatcccaaactaatttgtgtcctccccgtcgcttcgctgtcccctgcggtcaatccccgaaatccttccctccctcctccgctttggcttttacactttcgcttttcctccttccctttattctccccctccccgtaaccacagctcatatcacaaaaattgacgttgacacctgctactgcttctgctgctgctttttctgctcgtggcattgcgatggaaaggtaaaaaaaagtcagtcgaattgcggcggagtgagtgaattggatgggttgggcttgggcttgggtttggctgagttgtggtcagtcccccctttgcccctcccttcgcttttcattttcaacaaaaacaacggaaatggccttctgctgctcctctgtctctctcaaaaacatatttataagctaagacttttcgcttttcattttcgggaagcgtaaaatttgattgggaagagaaagcccttcaatttatgctgtccatccctttcccgcaatcccttcaaattgctttaaatgagaagctttgagggtgcgataggcgtcgcattggccatgccctccggctttgccgtccattccatcgctttcccacggctatcgttcctcgagaagtgccaaaggaatgagaaaatgtgtggctgccttaccttatttaattaggttatttagcacccaattagaccaatttatctgttgaattattttcgagatttccgttgggctttccgtggctttgctaatgcaaaattcttatgggcaattgcctatcaatggcacacttccgttttaa

SEQ ID NO: 38749 - DNA, 731 bp, Heterodera glycines
gccgccgggggcaacggtggctcaagaatgtcccggtaacggctgaccatcaaaacggacagaaagtaaacgacggccaacgcgaggaattgggcctgtttagtctcctccttgaaaatggaattattgaaatatttatttgtttttccctggattaccatgtccctgtaaatgacacctttcagcctttgcaagtcaacattttgtaacagtcggtcaaagtcggagattggcttcgacgactcgcactaaatgagcaagagttttaaacccttaatctctttaacggggacgggacaaaacgacgccattaaagaaattttcaaactatcttggaaagtttttttgatttcaagaataattttaagaaaaaacgctagaaaaatttttcattttttcttgaagaatctctacataaaattttaattttttttaagatttcggctagaagttttgccttggcgagattacgggtggtgagattttggggtgcaaccccctaaacttacaaattttcgaattgcaacaaattttggcgaattgtcggtgttgtacagtccatctttgtgcattgaacacgccaaaatgttacgaacggttacagtggaaactgcgtgaaagaaattggagtaaaaacattaaaaaatcagtaccaagtctcagcgattggcgcaaatgccacccgatggcatgtttttctcctgctccactgaaaatggaagggttttttt

SEQ ID NO: 38750 - DNA, 1088 bp, Heterodera glycines
  misc_feature (1016)..(1017): n is a, c, g, or t
  misc_feature (1043)..(1043): n is a, c, g, or t
cacttcaaaaaatcatttccttacacaaaagttttttcaaacacttattgccgatctaatttcttgcagatttaaagccatccattgcctgccggttctcggcacagcaaagcactaatagggtgtttgacccacttcaaaaaataattccatacccaaaagttttttacaaccacatattgccaatctaatttcttgcagattgaaagccatccattgcctgccggttctcggcacagcaaagcactaatagggtgtttgactcacttcaaaaaataattccttacacaaaagttttttacaaccacttattgccaatctaatttcttgcagattgaaagccatccattgcctgccggttctcggcacagcaaagcactaatagggtgtttgactcacttcaaaaaataattccatacccaaaagttttttacaaccacttattgccaatctaatttcttgcagattgaaagtatccattgcctgccggttctcggcacagcaaagcactaatagggtgtttgacacacttcaaaaaataattccatacacaaaagttttttacaaccacatattgccaatctaatttcttgcagattgaaagccatccattgcctgccagttctcggcacagcaaagcactaatagggtgtttgactcacttcaaaaaataattccttacacaaaagttttttacaacaatttattgccaatctaatttcttgcagatttaaagccatccattgcctgccggttctcggcacagcaaagcactaatagggtgtttgattcacttcaaaaaataattccttacacaaaagttttttacaaccacttattgccaatctaatttcttgcagattggaagccatccattgcctgccggttctcggcacagcaaagcactaatagggtgtttgactcacttcaaaaaataattccatacccaaaagtttttacaaccacatattgccaatctaatttcttgcagattgaaagccatccattgcctgccnngttctcgcacagcaaagcactaatangggtgttgactcacttcaaaaaataattccttacacaaaagtttt

SEQ ID NO: 38751 - DNA, 1022 bp, Heterodera glycines
tgctacgtgagaggtgaaattcttggaccgtagcaagacggactacagcgaaagcatttggcaagaatgtcttcattaatcaagaacgaaagtcagaggttcgaaggcgatcagataccgccctagttctgaccgtaaacgatgccaactagcgatccgccggcggatttattcgccctggtggggagcttcccggaaacgaaagtcttccggttccgggggaagtatggttgcaaagctgaaacttaaaggaattgacggaagggcaccaccaggagtggagcctgcggcttaatttgactcaacacggggaaactcacccggcccggacaccgtaaggattgacagattgatagctttttcatgattcggtggatggtggtgcatggccgttcttagttcgtggagcgatttgtctggtttattccgataacgagcgagactctagcctactaaatagttggctcattgcttctgtgggcacaacttcttagagggattttcggtgttcagccgcacgaaattgagcaataacaggtctgtgatgcccttagatgtccggggctgcacgcgcgctacactggcaaaatcagcgtgcttgtccttccccgaaaggggttggtaaaccggtgaaaatttgccgtgattgggatcggacattgcaattattgtccgtgaacgaggaattccttgtaggggcgagtcatcaactcgctctgaatacgtccctgccctttgtacacaccgcccgtcgctgcccgggactgagccatttcgagaaattcggggacggttagtgttccggcttcggtcggtatgcagactggaaccgatttaatcgcagtggcttgaaccgggcaaagtcgtaacaggtagctgtaggtgaacctgctgctggatcattacccagtgatcctattcacacctacctgctgtccctgtgggctagcgttggcaccacaaatgccccgtccgctgatgggcacaggtcgttcgagatgacttgtggacgctgcccaaca

SEQ ID NO: 38752 - DNA, 1022 bp, Heterodera glycines
  misc_feature (29)..(29): n is a, c, g, or t
ttacgaatactttcccattagcttatatntcatttgtcctttcaatgaatttttgatttgtactatttgcgtttttgaattccaagttctttaatcatttctaatataaatgagattcgtctctaagtttttgttattttactatcaattttatcccattcttttgttgaatgtttttttctttttgctttattttctcttttattttaaaaatttttcaaatatatagataattatttcttttttttcttatcatttcgtagtttttcttcattttcttcccatttttctccaaatatttcttcaaatgttttttgctctaattttttcttttctgatgatccaattttttcaatttgcgcgataatatacaaaaataaaaataataatggatataataatataataatttactaaactaaaataatgaaatttaatgaaaaaacataattttaaatatataaaataaattttttgttttcataaaaaatcattatttttcaattttaaatgccaaaatatttccaaagttcatcctttgccgatcagatcgatcaaactctgaccacagtaccttttttggcattcatttgctgatcagagccgatcagatcacatacatcgccgccattgcttgcgctgttcgtaggcaaacaatgggctgtaaaagctttctcttcctaatggctcgttattggaaaggaacaaaaaatatataaaaagcgtgttcaaatattgcgtttaaaatttataatttatcaacctttcatattttaaaaagtgtttccttaattaagaaagcaaaaaaaaaacaatcaaaattttttattttgtggcaaattttttaatttattgcaaaaaataatttttaacttccaaacctattaataaatgtatcacaccacggaattaatatttttaaaaatattattgaaaaatttaggtaataactatgttccttgtccagcataaataaaaacatatacatatttacacattcatttaataaaaatattttaaat

SEQ ID NO: 38753 - DNA, 1032 bp, Heterodera glycines
  misc_feature (88)..(88): n is a, c, g, or t
gcataattttgcttaaatatacaaaaggaattttcattggtactttcgattttttctctattagcatgcaaaaaatcaataattggtntaaagcaatgttatgccatattttgttgagaaaaaagtgccaaatggcgtatttttgacgaaacgactcagtagggaatcgttctaaaaaataaattttttgattttgtaataataaattattgaaaaaatatgatgatagcaaaacaaattgcaaattttatacataattaaattgaattaaattgatgaattttatttttaaaagccatttaagtaagcacctgagtgaataacaacgggaatagcagtgagccaaattcaaccgagatcagtaagccaacaagtgaagaaaattgttcattttttctgcctccaaataaaatttttcatttaattttgaataataaaatgccaaaaattcggtattacaattttcgccgcctgtcatactgtcatggaaattgcaccattgtgccaacactgtgggccaaaacagtgctaatgatgcgccaaataatgtgacagcaacggtacgcaaggacggcacattcagcgcgcaaaaagcaagtccggagccgaacttaattggaattttaattttaatttaattataaaaagatttgatttatacaaaaaatagaaaaaattccaaaaatgtaagtgaaaaaaaaaagttttccataaaaccataaattcaagtctttatttttacatctatttagagcatttccgcttttttgttgttcgcttattaacgcactaaaaattgagtaaagttccgatgatggaaataaaattttaataaaatataagcgaaaaataattatgtaataaaaataaataaataaatttatattgaatcaatccaaaattttgtatttagttatatgaaaatttaaatataatgagcaccaaaatgaaatgaagcataaaaattccgaataatttaactaaaattttaaaatggaataaatttaggacgatttaaattcatttttaatt

SEQ ID NO: 38754 - DNA, 433 bp, Heterodera glycines
ctctggaaattgtgcggatggcctagtggctagtctccttgctttcccttctttcccctggttcaatccctctacagaaactaacatattttgaattttctttttgtatattcatggctttcctatcgtcaaaatatgattactcataattttattttaattaacacatttttatcattttttgaggaaaattcgaacaaattgagcatagtaatcccaaaaatcagcattttttgtagaaaatctgttaataaattacactcaaattttcaaaatttcccccggcggcgcctatcggcaccgccggacccccttcttccccaaaagttttttggaaaaagcgcgccgaaaaaaattatgtaaacgttctgaatttctataatattcgatcatttagtccaaaaatgattaattgtttgaaataattaaagaa

SEQ ID NO: 38755 - DNA, 307 bp, Heterodera glycines
tttggttatatcgttttgcttttggtggggtgcttggcactgtggaatcatgcgcacccgtccgatctggcaagttaagctcgattgctgactagccaaaaggttcggtgccgtgatgaaacgaaccagcactgcttaccccgcggcacccggcacggtcccccgaaggaatggatttaattaaattctctccttcggggatttttttccattaggtcgtccgttagcgttcgattgctccagtcaatttttaaaaatttttgttgaaatatttgtcgtgctctgaagggcgggggagggggggggg

SEQ ID NO: 38756 - DNA, 733 bp, Heterodera glycines
tacatataatgttttttaaaaataggcacaaacccatttattggcattcacagttgccactttatgccgtttcggttacagtatccccttctcccatttagtggacatcaaaagcaccacaatacggtattcaccaaacatgggcacagcgaagaagatggtggtgatcaacagcagctggaggacggcgaaattacgctacacaacgaatgctattttcgttatgccgaaacggatcaccactacgcattcttgcgttggttacaccacaaaaatgtgtcccattacacacccatttcgccgtcatatgagcaaattttgcgcagagttcaagtacagcaatttaatttgattagtggttttgccaccattttttttattaacttgtcaatagtcctcttgacaatttcgattaatgagattttgtgcagatgattttacacacacacttttcagcccgatgacataaagaacggactacagataaccatgggaacacagcacggacaacagccaagctgtgacatcagacatcggagaatgaaggtgcagaatattaattaaagtttttgtataattttaagaatttattttcaaatgttatgagagggactcattattttataagaagggtaaaaaataaaactaaatttttgggcccattggtggcaggccagcattaagcttgggaagggcgccgaaaatccaccccacccccaaataaaaaggtaat

SEQ ID NO: 38757 - DNA, 839 bp, Heterodera glycines
tccaatcgcttccttttcccattttgtccatttgctttcgtctcgcgcaattggacaacggaccaacagaaaacggcagctgaagtcaatccttttcaacgtcaattgttcccgagtcgattcattggtcagatcaaagggcacaacggaagcaaaaggcgaaggaaacgaaaggtaaacgatggaattggcgggagaagaagcattggcaaatgcctaaagcatggagaaattggttgagaaatacgaaatgataaaagagccaaataaatcgattcgaccgaactcaccgctttgaaggcttcaatctttgacgccaaatccccgtcatccttgttcaaccagcatcgcaacacttttggcacatcgtccatgcggggagtgaaaagccatttggccatcgcttgtccatccgacgccatggcattgtcatcggccggaaattcggcgaaaagatcgtcaacataggagacaatgcgaagagatggacattcgttgagaattgacggcacgaattggcgcaaacggtggaaaatttagcttcgttagactttgtgctttcgaatgataccaaaaagatagagtttgttcgaatatgaacaaagcgtgcgggggttcgaaggacaaaaagagcaaaatttgctaagtttttgactaaatccactcataactttttctcagacgcaaccaaattgtacaatcttggtatcatacgatagccctaagagttctctattaacttgccaaatttcaaaaaattttattaagtttttcaaagttatgacaattttttcatttttttggatagaactttggaaaatcttaaaaaaaatttttga

SEQ ID NO: 38758 - DNA, 1075 bp, Heterodera glycines
gtaacaaatagaagaagataagttctgatcaagcacacacctttcattatttccggttaaatatgtgttcatattttaacaaaaagcagtcttgaatgtcgtcgaaatttgtggtaattccatggctatagccccgaccaattgcgctggaattttgccatgaggcttattttttgtgctggtttcgaatttacaggcgcccatgcaattggagctcattaaattttttgtcgatttttcttcaatacccactttaaacgataagcatttcctcgcacaccgctctatttgctctgttttaaacaacaaaattttcccaagcattcatacctactttcttaattgcactgggatcacatctaaacgactatgctaaaaacggggaactaaactgtattaatatttttaacaaattgcagtccttttcgcctaccctgttaagagaaatcttaatttcactaataatttctcaattttcttctataacagattatctcttctatggtcagtttttcaatttctatgtactttattaagtaaacaataattatcaaacatttttctatgattgcaaagcatttaaaaaatcataggcttgtttattttcattatgttttggaaaaggtcaattaaataaacaatttttttttgtaattttattaattgtataaatcttatgcaattttctataagcaatcgatagtgtaacaaatagagaagataagttctgatcaagcacacacctttcattatttccggttaaatgtgttcatattttaacaaaaagcagtcttgaatgtcgtcgaaatttgtggtaattccatggctatagccccgaccaattgcgctggaattttgccatgaggcttattttttgtgctggtttcgaatttacaggcgcccatgcaattggagcgcattaaattttttgtcgatttttcttcaatacccactttaaacgataagcatttcctcgcacaccgctctatttgctctgttttaaacaacaaaattttcccaagcattcatacctgagagcttaattgcactgggatcacatctaaacgactatgct

SEQ ID NO: 38759 - DNA, 948 bp, Heterodera glycines
acaacagcgatttgtttttttaatattatatttaattattttcatttttttaattaagatctcccgagaatggatgcgaatgaacggcgcaatcgctccgttccgcaacattctccagcaggcgtcgtccgtgacaagcactccgtgcgtttgttcatatttctataattaaagtaattagccaattaattagataatcagttaattgtctctttgctcagtttgccaaaccatcggccaatggctcagtcgccggccgcgcccgccgcagcggcagccgccagcacagcgagcgcaattctcagcgcaaaagcggccgccgccgctgctgtggacgacgaattgggcagcagcggcggaagcggcagtcaaacgctggtggaagccattcaggtgaagcaaaatgggagaattaattagtcattttatttatttatgcaaaagagaaaaaagtccacaaaagggagtaatccacttactctgcggacatgtcatagattaatgtcgtcctcgagtaatatggatcaacaattaaacaaaattaaggaatcacaacaaaattaaataaaagaatgaggtcaatcaatcaataaaaccaaatcacatataaaattataaatagctttaattaattaatcaaaagagacaattcacttttccggtcattttattcgttaaggagtttaattttagttttaaattgatttaaagaatttattttaatgatttctttatcaagttgattccacaattttgtagccctccccgcaaagggaataaattttttgcctaatttatattttgtgttaaacctataaaaggggacattaaagcgtttagaaggtttgaaaattttaaataaatctagatctgttcggccataaacaaatttatgcgccatgaacagatcaaatagctttcgcctattctcaagtgctggtagttgta

SEQ ID NO: 38760 - DNA, 1073 bp, Heterodera glycines
tttcccctccttttccgagtgaaaataaattttgcccattttgcgccaatttgaaaagaatccaagcgaatgttccctatactgccgctgtgaacagaattacatcgatggagtagtatgccaaaatgccaagctcctcttcccatggcaaattcaattcgttcagattggggaattcggccgcgaattccgtccatcggattaatttttctttggccccaaatgggctcaaaccgaactttcgcttcaacaatttggcattttggctgtaagaggggtcatttagcacctgaaaagcatttcatttaatccattagatccgtcccgattaattaggtaattgccctgtcaagtccttcaatgatcagttgctcggccccctccccattgagttggccaacgtccaattggatggcaattcctttcactcgtgccaaaatcgcattgtacagttggtcggcaaacagcggaatggccaatattggcaccccaaatcgcgctgcctcactgacactgttcaaaccgcaatgggagacgaaggcgcgcattttggggtgcactttaatttaaaatatgaaatttaattaaaaagaaaaaatacagtcaaagacaaaatggcaaaaacctaaaataccttactacccctgaattagaagctctctctcaactcttttgtgcttttcgactcactcactcagcaacgatttttggtccatccatttcaccgggtgcacatttttatatttggcaaacattttggcttcttcttcggataattcaattttccaaataaattcatagtccggaaagcgggcaaatgcttcaaaaaatgccaatttcatttcgcttttcattgttttgatgtcgaccatagtgccgaaggaaataatcactgcgccggcctgcgaattgtccacgacggcttttatttcctaaacattttcttatttccttttaattgtcatttaggtagacgattttaccggctccaattctttcgctttcatttccacgagtccgccaatgtttatgattttgttcgaaattggtctcggcatttcgaagaactaaaa

SEQ ID NO: 38761 - DNA, 369 bp, Heterodera glycines
tcgccatttaatttcacagagaatttttaaatttatcttatatccaagaaaaatgactatctcttattttgagaaattttatacgttacaaaagcgctcgagcatgataggaagggcggtgcgcaatcgccatttaatttcacagagaatttttaaatttatcttatatccaagaaaaatgactatctctcattttgagaaaaattatatacgtcaaaaaagcgcctcgagcgtgagagggagggcggtgcgcaatcgccatttaattactcagcagatatatttatttaatctttatcttatatcacaagaaaaatgactaactcttattttgagaaatttttatacgttacaaatgctctcgagcat

SEQ ID NO: 38762 - DNA, 562 bp, Heterodera glycines
caaaaaaatcaaatcattccccccccccctctcccatcggccaattaatcacttcccttcccgagtcagctgcacatgtgtgtcatcttcaacaaaagcgtttgtcattcatcaattagtgccatttgcttgtcctttgcctccctcctcagacaatgtaccgttacgcagtgcgccactggagtaagccggcgcacagttacttagtgaacaacgcgggccaaactccgctcactttggccacaaaacttggccggagggaaattttcgacgaaatgctcgaattgatgaaggcaagcgaaccaagtctgaattggtaaaatgatcatttgtcaggtggaattttggcgcttctctgacatgacatgcagtgcttaccctttggaagcattggacaccatccgattggacgggaccaccagtcattgacaccctttgaagtgccattaacgaacggaccaccctttgacacagattttgactcggcacttacgacggtggtcaacggagacagctcagatcacttggaaatgatcggcaacgaagtgatccaacgactgct

SEQ ID NO: 38763 - DNA, 1027 bp, Heterodera glycines
  misc_feature (37)..(37): n is a, c, g, or t
ttttattttacttacatttattactgtttttcttttnttctttaattatatatattctttctactgtttttctcatgcccattcaaccatgtatataaactagcattttcatttttcgctaacatttattgattgcgtttttcttaagaaaaatgatttgatttaatatttttctatagagttatgatttaaatttgagtttttttccactttaatatgagaaaattacgttcaaaattgaagaacttgctagttctcgaaactaaacgtttctcgatgtcttgctgtcccttgtgagtgttttaaatttgcatggtattaggacgaattgacaaaagtatcaatgttcgtaataattaaattaattattattttaatttaatttactaaataatatcgtcaattagcttaaaactagtcaaattaatgaaatttagtatttagctagagctccattgcaaaaaaaaatagggtcaaaattgttgagtctaaatttttcatactattttggttacaactttttgtaaagctacgatttataggttctaaaaaactcccaaaataggtgctaaaaagttcagaatttaaggatgtaaaatggaaaattttcttcaaaagcaaaaatatttgccaaattattaagggcatacctacataattttcaaaattaaaaattttcgtaaagaaaataaacaaataaattttagaggtgaattttagagaaatttttcattttttaagggtgtttttttttttaatttttgggttgattcttaggtatgtatttttcgtttttattgcgtttttgttaacaaatttagggaaaaacgccaaaataggtgaaaataagttttaatttaaaaattttttttaggttttttaggtgctaaaattaaaaacctagaaaataggtgctaataactcgaaaagtagcttaacaacaaccaaaaaaaaacatgttttctgcatttcagaccatagggagctcaggaaaaaaatatgtaaaaacctaaaaatcgtagcccta

SEQ ID NO: 38764 - DNA, 1111 bp, Heterodera glycines
tggccatttcgtcatcctccgttctcctcttttccagcaaacgccacacgttttaggacattccttctccataaatgccctccaaatagggtcaatgcatcgccttttgtttgccgggcattcggactgtccgtttgggccaatgccatcgcggcacactgaaaaagacgagcaattggcactgatcactcattctgctgctcttctacctgtctgttctgtctctatttcacctgttatgcttcctctctgttggccaaatgtccttgtccattcgccgcatcgtccgcatgttttcgggcactgttccgtcatcaaatccctccacaacggctcctcacagcggtatttattcgccggacaatccgacggccgtcccggcgctgccaaatccgcgcattgcgtttccgtcgcctccgaagtgccgctttgggcttcgtccctttgcttttgcgttatcggcttgtccccgcagcatcggtcctttccgcttttcgtcgcgtcgtacggatgcgtttccggacaccggggaatattatccacggccaaatacgcttaacaaaacgtggagtggtttgatcggaatgcctttcgcttacgtccgcagtatttgcttttccgcccctttcctttcgttggctttccctcgggcgtataaccgtcgattggcgacgaatagccgcagcaaacttcgcggccatcgacggttttaagtccgctggaagaggcggggcacgcgttagtgcctccgggcaaaagaagcggcgctaaaggaaaagcgaaagttaaaaaaaggatggaagaggaaaagcagcgattattacgtccgcaaaactccaagcagaacaaaattggagcggacgaggcccaaatgagaagagagagaagcgattgggggaaccgagagaacatttgaacgattggcggtaaaggaaaagggaccgaagggacactttaaataggaggtaattagaggggagggggtaattagggagggaggattggcacattggcaaagaaaggatggggacaaaggaaagagttgcaacggacggctgaccaaacatggccaagagaagggacaaagcgaccgggggggggggggggacaa

SEQ ID NO: 38765 - DNA, 215 bp, Heterodera glycines
cggtgtcatctatgttactagatcggggatcgatccccgggcggccgctcgagcaggacctgcagaagctagcttgatggggatcagattgtcgtttcccgccttcagtttaaactgtcaagagtatgagtatgatggtcaatatggagaaaaagaaagagtaattaccaattttttttcaattcaaaaatgtagatgtccgcagcgttattata

SEQ ID NO: 38766 - DNA, 895 bp, Heterodera glycines
tgttctccgccgcattattattttgccaatccattcgcctgtataataaaacatgtttatttgtgggaataatattaatgtttcataaattcaaataatcatttcttccattatatttttatttttttcaattaattaaattttacttttttttctcccttaaattgccaatcaattttaagttgtaatattaaaagtgactttttataattctctctaaatttgccatttaaagtgttaaaaggggcgaaacggtggctaatttttggaatgcatttggcgattgttggaaaagctcgaatttcttcttctgtttgtttgttcaaattgtgtgtcatgtcaaatgacccaattatcctccgatcacttctcttccccccccccccccaattttatattttattttattttttgcaattttttacgcctctcaaaatgctccccccccccttttcccccattcattcgccccttttgctttgtgtcgtgtaagtgtctctccccccttttgccaccaatttttgcgcacattttatggtcagcgccacacataatccaattttcgcgcgacgaatgtttttttttttgcgcgcgaaaatggggcggaaagccaacgaatgaatgaatgcccgcggggctttcatttggtcgcatttttgctttgggcgtctcttccctcgcttagatgtgatcatatcatccattgtaagcagatcagcgccaccatcggctgcagcatccgatcaccttcccatcccaactcaaatattccatttttatttatttaatttattatttatttccataattacaattaataatcacagaatgataacgaagccaattaaacctaatatatcacaattagcctttttacttctcattttcatttttg

SEQ ID NO: 38767 - DNA, 962 bp, Heterodera glycines
aaacaaaaaaatcgattttttcaagtgtccgtttggggtactcaaacatttatggggagcaaaaatccaacgcagaattaaagtacaggctatagggaagctactcccgaaggattcggtctccccataaatctgggcgcatcggttcggggggactgccccgaaaacaaaaaaatcgattttttcaagtgtccgtttggggtactcaaacatttatggggagcaaaaatccaacgcagaattaaagtacagactatagggaagctattcccgaaggattcggtctccccataaatctgggcgcatcggttcggggggactgccccgaaaacaaaaaaatcgattttttcaagtgtccgtttggggtactcaaacatttatggggagcaaaaatccaacgcagaattaaagtacagactatagggaagctattcccgaaggattcggtctccccataaatctgggcgcatcggttcagggggactgccccgaaaacccaaaaaaaaattttttggataaaaattatttaaatgaactgactagataatatttaaaataggttatttctcttcctttcagtatccctgcaaagtttggtgcgcttctgatcagtttctgaaaaaaaagttaagcctaaactttttggcctgtttaaaaaggaattaaaaatttttaaaaattttattcatctccctttttgatagaaaaagcatcagagtgcctaaactaacatgtaaataaaatttggtgcgtttcagaaccctttctgaaaaaatatttaagaattaattttgcaaaaaataaataaaaacgaaagactcagattttcgaaaatttttttgagccagctagctcggcgctcatttcagtgtaagttagtcctttaccggggagtatccctgcaaagtttggtacgcttctgctcaattagcaaaaaatatgagtgatcgaattttcactaa

SEQ ID NO: 38768 - DNA, 282 bp, Heterodera glycines
tataataacgcttgcggacatctacatttttgaattgacaataattggtaattactctttctttttctccatattgaccatcatactcatactccccccacccttttcttcttccggcacccacctcccccgctacgcgccgctccgctcccctccctctcttgatagtttaaagtgaaggcgggaaacgacaatctgatccccatcaagctagcttctgcaggtcctggtcgagcggacgcccggggatcgatccccgatctagtaacatagatgacaccg

SEQ ID NO: 38769 - DNA, 910 bp, Heterodera glycines
tctgtaaattgggttgtagtaagtcgatgggacagagtggctgaatgccatccgctccctctgataccacagtgattggccgatggttgagagtagcctcaacttcggccacaaaagtgttaagctcatcgtaattgaggatttttctccccaatgtccgtttaaagcaatttttgcataattgcacgaggcgttcgtaaacgccaccagacccacggactgatttgagcaataaatttccacttaattttattaagtgtaagaaattcatctttgttttgctgaactccctttggagttgtcaatttctcaatcgttttttgagataatttaaatgaagtggcattgtcactccaaattaaatctggtttcccctccgactaatgaatcgtcggaggacatttaagaaagattcggccgttgtgtcaagcatggcttctaagtaaactgctctcgttgtgaggcaagttactataataatccatgctttgaccttctctcctgccaatcgtgtctctgttggccccaaaaagtcaatgcctattgacttaaagggcatttgtcggcagactcgttcctccggcagtggaggcatttttggtaaggcaaattgatatgccttcatccttcggcatcgacggcagttttttataactctttttactgccgttcgagactgaggagtccaataattgttgagaaattctgtaagggtgctgtccacccctaggtgatgtcgtttctggtgacattgcaaaatgataagatcccggatttccgagttctttccaagaagtatgggatgtgaaaacccataaggttgatcactccttgccaatctcgttttcagtctcagaatcccttcactatcgattagtgagggaaattttgtgaattcatctggatcatt

SEQ ID NO: 38770 - DNA, 1448 bp, Heterodera glycines
cggcttaaaacaattaagggccataatttgttatccaactaataaaataaatttcttttttggttaaactgtacggcttacgaaacctgaaggcattcaaatttatgtggtggtttctaaagcggccattttttttgggggggggggctgctaattttccatatgtttaataaagcacaaacacctctgaaggtgtgcgaaatcaactcccttctgttggtgaggtacgttttgcatcttcgacctaaaacccaatcagaatttatctccgctgtttaattgcgagccgaacgcacatgagtaatattttctgccgcccatatgctctagaaaaggtcgccccatacagtgcacaattcacagcgaacttttgaaatgcaaaaactatttaattgtggcaaagtaaaattgacgaattgaaaatctgacagatatatatgaacaataacttgtggttaaatggtttgataatcgcgactttattattctcagaagacaacgaattttgatgcacaaaggaaatcagtttagtgaattttgattttcataatcacttaaatacaactttgttgatgttttctgtttcatttgtccttttcgcattccttccccgtctctccttctccgtctgttttgttgttctccgttttcgatttgtttgtcgtttccattttgttcactggacatgtcgggtaaagcaccgagtcaaaccaaatacgccatcgctgaggcataaaacgcaaaatgtatggctgaacaaatcgaaggtaaatggccaacacgacgggcagaattatgcatggaacgcaaaccatcggcagaaaacgattaaaaacagttaaatttcaagacaaaaacggaataatcggatgaaaacggcagacaaaaacggataaaatcacaaattctttgaattcttatcaaatggagcagtttttctgcgtattacaatgtgaacaaaattgtcagggtacacaaggtttctagccagccaaatgagcggagtgttgaggggcaacagaatgccatgggtcaccgcttcaaagtctgtttcaatggcataatcgggaaacactttgtgcagcgcgtcaatcaacaacacttcacccatattgccatcgtcaagttgttttttggaatgtaaaagcaattgacgaaatgaatatgatgactgaaaagggtaggaaatgtgcaaaaagattaaatgaaatgactgacggatgccttccaatatttaaatggagtggactttgttacgttttttttttggaaaagttgatgtaaaaaattaatgactagacgaaaagataaattgtatatcatgagtatcggtccaaaagatcattccaagtaaatttggctcaataaattagcacctcataaaatcgggcgggaatagtgctaaactgttcttcgcctgatgatgaacggagtcccatcagtttgtc

SEQ ID NO: 38771 - DNA, 957 bp, Heterodera glycines
gctatagaggaagctactcccgaaggattccggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaataaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagtgaagctattccggaaggattcggtctccccataaatctgggcgcatcggttcagggggactgccccgaaaacccaaaaaaaattttttggataaaaattatttaaatgaactgactagataatatttaataaaggttatttctcttcctttcatatccctgcaaaggtttggtgcgcttctgatcagtttctgaaaaaaaaagtaaacccaaatctttttgggcctgtttaaaaaggaattaaaaatttttaaaaattttttttcattccccctttttggataaaaaaa

SEQ ID NO: 38772 - DNA, 412 bp, Heterodera glycines
ttgagcaatttggcccacaaaaaaaaaaaaaattagggctgatcgagacaaatgttcacaattgatgaaacgggggaagaacggtactgattaaatttgcgaaatctgatcagtaaaaaaatgagacaattgatcaggtatgggtgtaccatttgatcaaaatgggtgaggatggcactgatcacgtgaattgggacaaatgatcaaagggaaaaatggggaaacggcaaaaaataaaaaataattttatctgatcaatgacaattgggaggagtgacattgaccaaaagaatgcgcgcaatttggtcaatgaacaaagggaaaaattgggaaaaattggatcaaaagagagaaaaaaaaggtgagtttgatcagaacaaattgtgtgcaatttgatcaattggggaaaaat

SEQ ID NO: 38773 - DNA, 1320 bp, Heterodera glycines
tccctgatcggcattgccattttcgagttttcagatcaccatgaaagagtgttctgatgaacatggtgtaattgacttttttttgataagcttcaaaacttaagctaaaatgaacaattatttcaaactttttggggcgactttttggatataatgaagttttcaaagttgaaaggatttttgaaaattgggaattaaattttcggaagatttttgtaattgtggatttaaatgttttcgagttttcaggacttgtccaattgtaccaaaacggatgatcatatgaattgtgccgccgaattggtgatcaagcctgatcagattggacaattacagcgtctgccaaccgtggcaattagcaaaacgaccaaaataccgaaaagcaatttaacagaaaggcatcgacgacgattggatgagggtaattaaaaattgagctcacatttatacacttaggcaatttttttggctcaagtacagtttatggatgcaatcgctttttatgtgtccaatcaataccccgtgtatgcatgacaatatccacaaagatttgctagaattcttcaaaattttgaatattctcataattaactagtcatattcacgtcatagctacatagatttgttaatacaacgaaatttgtcgtagtttttgttgtgttaggacaaattccgcaaaaatgtcaaggcctcgatcttcaatatccgattttgtcactgattaagccgtgtcatcccacagcaggtcaaccgaaatagagagttatccgaaacatgaccaccggatgaaactaattgattggacgcacaaaagtcgattgaacgcataaactgtacttgagctattttttatcaactcttttggacggatctattctggcattttgccgaaatttccttaattttgaattgtatacaaaaaaaaatacatggataattggaaatttaaaattagaaaacacaaaaagggtaattcaacaaatgctaaaaaattaaaaaacggggccgacggcacaaatttttcaaaccattttaacgctaattaaaaaagcactccctaaatgctaaacaaatttcaagaaggattcaatactggcgtgtgcactttcccaccatcacccagcagccaattggtgccggacacaattcctattacaacggttggcacaaaaaattgaaaaaaaacatttaccaacaaaatcccaaccaattataaagtcctggcaaaaaacatgataatcaggtgagtaaaagtacaattaagcaggatttttcttcttggtggtctgtgagttagtcaccaaaaaagggtcccaggtt

SEQ ID NO: 38774 - DNA, 1162 bp, Heterodera glycines
  misc_feature (7)..(7): n is a, c, g, or t
  misc_feature (17)..(17): n is a, c, g, or t
acgtccntgtctatacntgcttaacaatttcaaatgccccctttgcttcgtcagctaattctttacacattaacacatcttttcggtctaaacacttgtccatttcttttctaatatgcccaattttctgctattcttcatttaatttttcggaaatgctttgtacttttctcaccccttctaaaagtcgtccgaaccatattttcatacccgaggcctcgggatgacgagacttaattttttctgcttccgtaattgctctatgagaagcagccgcgaaatctctggcttcgttattaaaataatcaaaatcttacgaaaaaattaaatatttaggttatcgaatgatacatattataaaatttgattcattttggtcaaatttttcagtttcttagattatgacttttttgaaacttaacgaatttttgaaattttgcagaataatagaaaaatttagtgctacgaaagatttcaaaatttgaaaatttggttcatttaaggtgaagttatgaataattctcttgtcgcgactgaacgttagccgtgaatgtccgtcgagcagacaaatggggaagacggtgaggattgaacgaagtagcgaacgaggagtgattgatggatgaaatgatgagaaaattagggcaaacgggaaatgatgaaggaaagaaaggggtgaagggaggggtcggctgacggcgggcacgtgaattaggggaaagaaaacgataaaaagcggatgcggcgccttccccgcgtgaaggacgcccgaggcagcgcaaaaacgccgatcggaccaccggcggagcgacggacgaaataacacatcaccaaagcggacagccgacgaaaatcggcggtcatttgatggaaactagcgaatttgcgggagatcaaattcgccctgacccttcccccccccttttctccggtgatgtgccccctccccgcatgtcaccccatatttgtgccccccatttgtgccatttttcactagcttttacccctcccattttgtctctattgacacaatttccctcctctttgtatttctcgcacatttattggaagtgtaggggataattatccaagtttgagtttgagaaaaacttgcggagtatttttggggcgaatttttgggcgggaaattgggaaattggcg

SEQ ID NO: 38775 - DNA, 921 bp, Heterodera glycines
tttttctttcgtaaataattccccttcaaaattagttcattaaacgctcctgtctgggactaacaaaaatggacgggatttttactggattcccagtcctactcccggaaaatttcggaataccgttaattatttattttttaagacgctctatagtatttgcttctaaggtccgaatccacccattttttgacggcaatgggcgcaccgcccggctgtttatgaacttgattttgcgccgcgggatgcgatgcgcgccggtcacgcttgatgaggggggcgacaggagtattaccgctgcttgaggcaaagggacttcgaaagctttgaagccgaaatacatagattgatcaatctgcagggaggaaatattaagaatttttagaaatttttaatgggaaaaattgttgaaattaaataccccagccctggatttatttaatttatgataaaccatttattcacatattttgtattgttatttgtttcaataaagaactttctctgatcattgtattttcatcacacattgagaattttgtgaaattaatgttggcagtatttcattaattcatatgttgatttattaatgaaaattttttcgtttcttgggcattgttccattttcggacataattcaatataatattgcaatgttaaaaaaataaataataattataataatgatggtgggagaatgtgcttggcaatagcctaaacaatgatggaaataccccattattcattctccaaacgctcagtttttcgtcctctcgtcaaaatcgactgtttcttgtccgtcgcccgggccggggtcacttcatcgcgctcaactctgtcgcaacgcgtacagtcagtcggcatgcaacgcattagtcatcagtttcaaattgcaaaatttaatgaaaaagggggggcatg

SEQ ID NO: 38776 - DNA, 1437 bp, Heterodera glycines
catcgcaaaaatttttttgtgaagagggcgagtgggtctcggtggtgtcgtaaaaaatgttaatttacatttttagaaaagatttcagtttttaaataatccttcaaattctcatccatttctcccctgttttagcttcccgtgcgctgctttccgtcagatggaaggcggcgaaattggtacgacaacgtgttctttgacccattgccaaagctgcgccaggacgacggcccccggggcgcagaaacggaaaataacgtcaaaatttgaggggatttacactcacccgcccccatgttactgttttaccggaaatttttttcctaaaattttaaatttgtaaaaaatgtatttcagtcgggtgcacaaaaatttaaataaattattattatttttgctatttttcgaaattttatgatgaattactaagttgtttttttgggtcaatagcagttcgtacaaaggcgtttcgtacaatggcagttcgtacaatggagtttcgtacaaaaaaattcttatttagtaaaaaataatgacgggctaacccctttctgcaaaaaaagattggggagtggaataaaatgttatgtaaatttaaagtttgtcgaaaacttcattggccaagttcagttgaagtgatgcaaattctccgaaaaagctcgaatgaattattattgttttggttattactattgttatttttataattattagctcattacttatttataatttgctttatttttgttattttgatgaaattatgtgtcactatcactttttttttttaatttgattattgtacgaaacgcaaaattgaaacgttgtacgaaccggcttttgtacgaaactccattgtacgaactgcaaattgtacgaactgcccattgtgcgaactgcccattgtgcgaactgccatgaccccgttttttagcttttccaaagaatcgctgaatttttttcaacaaattaattttgaaaaaaatattttccggcggtgccaatcgccgcggcggatgagtgaattccaataaatttacaaaaaatttatccaaaaagggatcattgttagaattaaaaatctggggggttctaattttttaggtgtggaaaaacctgggcacgataaatttacaaaaaatgattcccggcttttcgaattgggtgagaccaattccgactcgaggcccaccaatttcttaatttcaccaatgttcatgttgtgtttaaggatgccgaatgcgagggcagtttcgccattgagccaattgacggtgccgaactgaggggccaatgtttggccaaaattgcgaaataccaaacgaagcgaaaggcattggacaaagcagtcggccaaaacttttttgttggcattcagacgaaactgtggcattcagacgggccaagcagaaacaggtgaatgcaacttttaaattg

SEQ ID NO: 38777 - DNA, 88 bp, Heterodera glycines
taggcgtcgatttcctgcaacaacgcgattttttcagcaaaatcaggcgcggccaaggggtcatcgtcgccgtaaagcgcccgattag

SEQ ID NO: 38778 - DNA, 1045 bp, Heterodera glycines
cactgaaatgagcgccgagctagctggctcaaaaaaatttttcgaaaatctgagtcttcgttttttattatttgcaaaattaattcataaatatttttcagaaagggttctgaaacgcaccaaattttatttacatgttagtttaggcactctgatgctttttctatcaataatggaggtgaataaaattttaattgctttttaactttgggaaaaagtttaggcttaactttttagtgaaagtttgatcactcatatttttttagtctaatctactcaaaacggttcagaattcaataaaaataacattcacggtgcgaaaaatggggtttgacaagtttattggggaaaaaaagactttacaaaataatacccctgggagaagggagtgggaaacatgatttcaaaattttcaattttttctagtctaatctactcaaaccggttcagaattcaataaaaataacattcacggtgcgaaaaatggggtttgaaaagtttattttgaaaaaaagactttacaaaataatacccctgggagaagggagtgggaaacatgatttcaaaattttcaattttttctagtctaatctactcaaaacggttcagaattcaataaaaataacattcacggtgcgaaaaatggggtttgaaaagtttattggggaaaaaaagactttacaaaataatacccctgggagaagggagtgggaaacatgatttcaaaattttcaattttttctagtctaatctactcaaaacggttcagaattcaataaaaataacattcacggtgcgaaaaatggggtatgaaaagtttattggggaaaaaaagactttacaaaataatacccctgggagaagggagtgggaaacatgatttcaaaattttcaattttttctagtctaatctactcaaaacggctcagaattcaataaaaataacattcacggtgcgaaaaatggggtttgacaagtttattggggaaaaaagactttacaaaataatacccctgggagaagggagtgggaaacatgatttcaa

SEQ ID NO: 38779 - DNA, 1620 bp, Heterodera glycines
gtatcaatggctacccgacatatgaggatttgacatttgaggacacgacatttgaggacccgacatttgaggatcccgccttttgaggacccgacatttgaggatcccgacatttgaggacacgacttttgaggacccgacatttgaggacatagacattttcaaaaaaattaaatcgaaattttattttatatcattagaaaaagaagaaaatgcctttcccaaaggcaaacgggagcaaatgtggcaaaaattcttctagcacagccgaataattccaatctttcttctccacgtacagagtataggatcaggatgccaatatctgccttttgaaattttccttttggttataagataatcccagtttccaaaatcattgcgcataagtcgtttatgcaaagatctgagatattgtaaagtagatttctagtcacttcccctttggtctgggatcttttctccgaaattcctcacgatatttcccaggtcattatatttttcattcttttcccatttcgatcattcaacattttctctcattttctgcgatcctgggaatggccagcccgtttatgtatgaatttctgtcaaatcctcaaatgtcgcagcacggtatcaattgatacacaagtaaatattaattttcctatattagaattttctgtttgtagtgcaaatcatttttttaaatctaattcttacaatagaaaaaaatttttagttcattgattcaatctaaatatatttttatttaataaaaaatttttaatatttcataaaaaaatttcttaagtaatattacaatcacaaggttactatatatgttatattgacaaggagtttcgttgctaaaaccattttctcccggccgaaggccgggagcgccctgaaagtagtggaagggtcttacaactttttgaggcgcatccgggaaaaatataggttttccggtccaagggccaactgagtcccggcggctaatttctcacttttgtttgcatttgaaggcccctaactttttatgtaaaactcgaatcaaaaagtgcccgctgtgagggcactccgcctaagggtcctctacaaggaggtattttttaaaaatttttttgagcaaacccctggcctgcaaaaaatggcaactgaagcgtgctcaaaaagtacacttcagtaccaggcgaataccgcgccagggtttgcactgagcggagggtggccagcagacttattgtagagttttggaagctcgattttctgaaatttaaaaatttcgaaaattttcagaatttttcgagttaggcctaaaaaatggttttcgggtttttgaattttatgattttttaacgaattttcccgggaaaacgaagaccacttccaaaacatagtttttcgagctctatcgaatggtattttttttgaaaaaatttcgatttttttccggaaatagaaaaaatttttggcctaagcgggacatttgagtcccgggcccataactcgtcaggggtcggttttagccaaaaatttccttagagcaaatttgtagagctttttaagctctatcgaacggtgtgctatatctcgaaagattttcaaaaaatttcgagctaggccccctagaaa

SEQ ID NO: 38780 - DNA, 899 bp, Heterodera glycines
  misc_feature (44)..(45): n is a, c, g, or t
agatgaccaaaagcacaaaaatcaggcttaacatttgggtgatnntgatattcagcctttctataccgttgttggtcgtactcccataaagaactttttgtcgcccaacaaaacggacaacgcatgcaaatcaagtgagagtgactccaaagtaatctcacgcgggtggaggagggtgccttcagcaagcaatcgttttcgcgtcttaattgatgattttgtaagcataaaaacgtgttcacggaggtttcgcgattactgataagattaggctaaacaataccgcttcagtcaaccgtcttgccaagaatcgagacaaaaaggccggcaatcggagaccgctaatttccgaatttaccattttagtcgcattttcataggataaaaaacgaatgagagaactaaatgttttagttgatgcacatacttcagcagcaggtcacttactaataaagtgacccttcgattagtctttcaattgcacgtgcttttgccctttgttcgttgtccaacccatccttggaataggaaatagaagtaacgacaataatacgtgcaattacttcaattttgaaatagtccgacaatctccacaaaataatttgcgaatccgaaattcgttcaccattcaattcaatgaatggaaagcgcttttgcggggcatttcgaaggttccaactgccaataacctactaattgtaaaacaaattatggcattagaaatggatagacttcataagtgatttcgttcgccctgaggaaagtctcaacttaaaagaaaagaaaatagagaaatattcggtacttgtacagtttacaccccataaattttttttttaatttttagtgataaaaatgtgtttccaggggtgttcggggcccctcagcacgaataatga

SEQ ID NO: 38781 - DNA, 1213 bp, Heterodera glycines
  misc_feature (46)..(46): n is a, c, g, or t
gcaaaagcatcactaatctttgttttttgcagcaggagaagtcccnggatcagagcgcctacatgtgagaagatgcaacaacgaccggcggatggatggacgaaacctgaagagcgagcgacctgtcagaagatgcaaagataaagaagatgtctcataatcgtgatctgtatttattgatgtattgtacatttgtatgcatatatcatttgctgtgtattatcactttatttccatctgtgttccgaaataaattgaattgatggtcattaagcgtgtgtcaatttattaactgaaatttggtcctctccctccctccctccctctctctgtttgacgtagacatttggatggcataaagttttttggcgttaaacattcgtcccctattagcgggtcatcacagaaaccgttggacatacggtacttatcctttttgtcatccccctgaattgttttaccttgttccccccattttcgaaaaaaatgaaaattttaaaaagtcgttaaacccagggctcggatcgacaatttttcaaaaacagaacagatttatttttaaaattattcgatcaataatgtattatttttttcgcctccgattgtcgaatttaacgatttttggggaggaaataagcaaatcgtaaatttcagtgcattcgggatcaaacaataagatttttaacaatttttgcgggtgcagtttttccataaaacttctggtgaacgggcgaggggagggggtccggcggaaaactgatttgttaacagaccaaaaaaggccaatttttccaataaaaggcaagcaatgactttttcaaaggaaagatttgattgtccggcttgttatttgtgattttttgaacgagttctgtccttatttgtgaatttcgtcatttttgtaccagtgttacctatctcaggaattgaaacagaaggaagggcacactctgaatttcagtttatctccaaatttgggcggctaacattcgaattccaaacgaaatgtgtgactggtagacttataggaaggaccacttttgtctaaaactcattttgacctgaatttacaaggagtgagcagaccgagttctacgcgagctaagcctccgaccaaacagacgccaaattttaccaccccgccccccttcctacaaaagcattgaattgaagcacatatgagcatttattaaaagcacacacaatacaatta

SEQ ID NO: 38782 - DNA, 291 bp, Heterodera glycines
ctaaaaacgtttaaatcaaattaattggcaaaaataaaaattatcatcgtacccaatgttcatttggacttgtgatccgctttcctcctcccatgttatagtgactgagttattagtgggcgatattttgaagctttttcttttaatcgtcaaaggctcttaatggggaaaaaattcaaattccaatcggaatttgacaaaaaagttaaaatgtttttagacatgaatgaaaacaaagacacgacacaaaatcaagaaaatcaactgtttgaggaaaaaaaaaaaattcat

SEQ ID NO: 38783 - DNA, 1005 bp, Heterodera glycines
ccaactgagttccagcggctcacataccgactttgccgccagtctcagtgatacgaaattttttgcttttgctttcagagcatagcggaccccaaaagagaaatgccccaactatggcctacaactttgccagcaaaaaaattttgatcagatcaaagacctgacctgtaggttaggcaacgtaagaatcactttttttggacacttcagtaccaggcgaatagcccgtaagggtttgctcggagcagggggtcgccagcggacttattgtagagctcaatgagctcaatttttccaaattttaaaatttcaaaatttttcaaaatttttcgagttaggcctaaaattcggtttttcggtttttgaattttatgattttttaacgatttttccagggaaaacgaagaccacttccaaaacatcgttttttgagctctatcgattagtgatgtttttagaaaattttcgattttttccaggaaatagaaaaattttttggcctaagcgggacatttgagtcccgggcccataactcgtcgggggttggttctagccaaaaattgccttagggcaaaattgtagagcttttaaagttctatcgaatggtgtactaaatgttcggaaattttcaaaaattttcgagctaggccccctagaaattttcggaaattttttttgggttgaaaaagagggtgaaaaatttttttctggggtattttgagatgctgattacgaatatgacctttgtttttcgtttcataatttttagaattttttaaaaattcgaaatttttttcaatttttttgaccctcgggattttggggtaaattttgaaaattcgtagctcattttgaagtgggacgattttcatgcaattaagctttaaaaatagcaaaaaatcgggagaattttatgaggtttatttgaaatttataccacaaaaacaaaaaaagttattccagaaattctggaaattttcgatttttcagaaaaaaattcagaac

SEQ ID NO: 38784 - DNA, 1270 bp, Heterodera glycines
cgacagaaggcctaatttttgttgtttttgaatggtttattcctgtttttccttttttcaattgaacaggactgtgccgccaagaaaaaaaaccgttttaccgggcgactcggtcccggttcaaaatttttgctgggcgccctccgggatcgggcttttttcaaaatggtcctaaaaaacttcatcaatccaaagttattttttgatgcgtttatgttatttcacgcttttttcagatgggtgggaggtccgtgcatgaatttttttatgaattagcgtgataaaaattaatgtctttttattttcaaatttaggacaaacaatgttaaaataatttagattttgatccaaaaatttattttcttataagtttaaatctgatgacatttaacgaaatctgttttgaaattgcaccaaattttcaaaaaccttgagttcggaaactttgaattaacattgaattaccatcaaatatggagcagtttcactggcggaatttaagcctattttatcccagtcaaaatgaccgggcccggtcttagacaattaatcgagaacgggctacccggccaaaaaaaagcgcgttttacaggacgacctgcccggtggtttgtccaaaaaacggaatcgggaacgggcgtcctagtaaaaggccgctgggcgccgggtccttccgctctttcgtgactcttagtaatttcttgcctttttaatgcatttttaaaaaatcactctttcgatccttttttcagggcaaggaatacaaaagaatgttcattcgcaatgcaagcgatgggctcattcccatgagaaaaagggccacggggagggatggcacgcttttaagccggactgtgtgttgactaagccgaccacgcgcagcgaatgccaacggaatcggcattggatggcacgcaattgtcccgaggcgtgtggctgtgaatttgtgcgcgatttgttggacaagtgcaggtgggcaaagggtcaaaaagatgccaactaatttagcatttcattatattttaattttaattttaaatttttagcaaaaatatgcccgaggattataaattggagccaattgatgaatgagaaaagaaggaaataatttcgaatggataagatataaatgaaattttataaatagggctgcaaaaaatatgtacaaaaagtggtccaaatatgtacataaatatgtaagaaaaatccccaaatatgtacaaaaaaaccccaatatgtaaataaaattttttttaatggtattttttgg

SEQ ID NO: 38785 - DNA, 929 bp, Heterodera glycines
  misc_feature (62)..(62): n is a, c, g, or t
aaaaacccccaaaatatgtaaataaaatgtttttttatggtattttttggaaagaaatttcnccgtaaagtatgaaatagccacaaaaatgacataaaaattactttctttggtatttttaggcaacattttcaaacttattctttctttataaattttcaaaatatgtaaaaaaatgaaaatatgtacaaaaatatttgccgaaattttggcttttttttgaggatttccaaaaatttccgtaaaaaatactcaaaatatgtaaaaaaaaaatgaaaatatatatgaaaaaaatccaaaatatgtacaaatatgtaagaaaatcccgaaatatgtaaaaatatgtaaataaaagtcccggtttttgttcgcaaacacaaaaaagaaagtgtttttcctgctatttagagcaaggagaagccaggaaaaaaatatgtatttacataaaatttgcagccctattaataagttaataaacaatcatcggcatgcacatcggcgatttaattcattatgagcggacgggaaaattattgggggacgcgtttatacacattacgaaaaaatttaccccccaaatcctaagaaatacccctcaaatccaccttttctctcctcaaattacccactcattaatttaaatttacattctatacctcatatttccctacccaatcagccctctcactcacaaaaatttttctactttaaattgtgtgtacttcaattgtcgatctatttaaataaaatcacgactttgaaccagggatcgcattccgggccccaaaaattttgggaaatcggaattccgaccccaaaaacgtcggaaatcggaaatttttcaaaaatataaaatataataaaaaataattagtagagctgttatttaaaaaatgaaatacttacttggccaaaaatggaaccatacg

SEQ ID NO: 38786 - DNA, 1268 bp, Heterodera glycines
atttaagaaaagttatgacgggggttttctcaaaaaaatctgtaaactcatccatccccatatgcgcggacaaagaaatgagcaacgagggaaatgaatgctctcgtaattaccagtttttacgcccacttaaaaaatggtctattttaaggaaaataacaatgactgccgggtttttagcttttaaatcaaaattacaattaacgaaagcattttggaaataaggcatttatttgtctcgcgaataaaaggaaggcatttgccatgtcagtgccgtactttccccgactcattttgaataattctttccttcgacgaatgcgtttgccaatttggccagtgtgttttttgtggccattttcgcctctgttacaatgaaagatgccaatgggaggccgtgttttttttggaattcagtgccaattgccggcatttggccattctccgaaagtgtgaccacaagccgaatcacttcgtgttccttttgcttctgaaaattttctttaaaattctcgtaaatattttcttaagcaaaaatcaaaaatttaacacttatttttttttctttatgtaattagaaatttttaatatgattcacttgcctcaatggcagcaaacaagcagtcggaaaaataacgtgccggattgcgtgcatgttgcacaatggcaatgaatgcatccaaactgtcaccactgaattctgccgttaatgcctgaatttggctatcagaaaaaagacatcattgttagcatacaaaaaataggggggtcgaaaaaaattaaaaatttttcccctttttaatgcatgcttattagtagggttcgaatttgcgggatcccgtgcggtattgcggaattttggaaaattcgaaaaaatttcaattaaattcaaaaaatttccaaaaatcaaaaaatgctgaaaaaaatctattttgacctatttggcatttttcccaaaatttgttaacaaaaacgtaagaaaacgaaaaatacacccctaagaaatgaaaaatttctcaaaaattcatgtccaaaatttttttttaaatttatttagctcattacttatttggcctaatttttttacttttttgaataaattttgtcattttacacaccttagaaatgaggtaattttagtgccattttccattttttagagcctatttttgaggtttttaggacctaaagccgacctatttttggcaatttttagagccgaaaaatcgtatccctagttattaattaacgattagttgggctgacct

SEQ ID NO: 38787 - DNA, 974 bp, Heterodera glycines
  misc_feature (865)..(865): n is a, c, g, or t
  misc_feature (885)..(885): n is a, c, g, or t
  misc_feature (887)..(887): n is a, c, g, or t
  misc_feature (914)..(914): n is a, c, g, or t
  misc_feature (921)..(921): n is a, c, g, or t
aatattcgtgactttcgcgcaaattcaaataaaaccaatgggtccaaattggctgaaatgccatggattacggcaatttcaaggaaaatatttgaagcagaaatggagaaaaaagacgaaggaaaaaaggaggacgaaatggccaaagaaaagtcaaataagctgaagaagaacatgtccaaattggaggagattttgggaaagcaaagagccgaaaagggaaaaaaagaacaaagaaaagaacgaagaaaagtgatgagagaaattgcgaagccgaggccaaagagagacgaaggtaattagggataattaggggccaaagaatttgcaaaaatgtaacgcatcagcggaagtgatggagcacgagttgaagcaatacccgcacgtgctgaagttggttcgggttgaacgtttttaccgcatgttggacaaatgcaacgaatacattcgaagaaaggacgaggagcactcaaagtggacaaaatgccaatgtcatttcaaatgtccaaattggcccaggatccttcagctgtccggattggcatttaacttgcaaacaaaagctgtcgagcgaaatccccttttgaatttgttgcaaatgcaactgagaaagaatgacgtcattggcaagttgtccattctgtcaccaaaattgctctccataatccccgaccgatccaatcagcaaaggtacacaaaccgccgtttgctcataataatcgtgccaaattgggtttaagtttgctcgcatcgcttcggcacaatttgaccagttttaactgttcgggtgtgctttcgcttttgctttcgcccactcttttcagttttcatgagcaaggcgaactctctctgccttctcttcttnaggtgtcactaataattaantnaatcatgccactctaattcccctgctnttagctncgtttgcccgaccgtgcccgaatcgtcgcttggcttgacctttgctgcgcatc

SEQ ID NO: 38788 - DNA, 863 bp, Heterodera glycines
agtgatgcttaatacttccatttacaaaaaggatttcattcggcgctgtttgcaatgtcgcaaggaagaacgggcagacgtaagcgaactcatgcgacacgagcttttcaagcccaggggacaagtaagcataggaatgctatttacatattccttcttcattcctcgttaagaaaaaccaacagccgccatcgccaagtgccaaaattgggcggattgagcaagtcgaatgcgactaaaacggccgggcaagagcgaacgatgacacatcacaccaaaacacaagcaaaaattgaaccttttccctttttcttcatatgagaatcagatgaagatgggggaggggtcttagaaaatatttgcgggcatgtgtaatgactattttccttctttcattagtagatgaacatcgtttttaatgttacgccgacaccaattccccacactcacaaagacgtgttaaatttatttcgaaagtatttatcaatcccatcgttcctaccaactctgtgttgtgttcaactgtataaataaagccgactgatgaggaacgttattttccgagttgagtatggactaacgaaatagcagtaggcaaacgttcataaaatgtagaataaaacagcaacgctaatggcataatgagcggtttataagttaattaataaaatttacgttttatcaagagagtgaatttaaaaacgttcctccgttaataaacgaactagtacagcacaagatattcgacaactgatccaacatggacatttccgacctcgtcaaaccgcccacaacgaacaccaaagtcagttggtcactggaagttactcgttaaacaacaccgaaaaagtgccaaccttttt

SEQ ID NO: 38789 - DNA, 941 bp, Heterodera glycines
cataccttttcatgtgtttgaagtgatccaattgcataaatgtgattttattgagaataaaatttcaacattctgttcacattcgggtccgggttttggaattggtcgaaagatgtcaaatccatgaccagcgagctagaaaacctctataatcatgcttttacaactttttaatttccaaaaattttcatataagggaaactgaccacaacaagcttaaatgtgaaatcagcataataccgtatccgtttaatttagtcttttgatgaatgaaatattccccttggatatgcgtggattcggaaagggcgtcgccaatttggccatttacggtaccgcgtgcgctctcgaccaaatgtttcctgtaattagtttttttttgccaatttttcatttctattttattttcgcagatttttctcaaccaaattggccaaccgcagacttttgccatttttgcgctgatcggtttttgttcactgtttttcacgtggcgatgtttgcccgaaacgcatggcaaatcattggaggaattggagaagcaattcaaattgggcgattggaatgagctgaaaaagcgccggcaaattcacaaaacttacgacgcagcgatcagaacagcccaaaatggatcaatcaataatattcaaatcaattgagaacagcagggtctcctccgtattttggtcatttattataataatgaattattttggtgtttttttttgggaaagccgtaatgagtccaaaaaatttaagcaaaattcgaatatttaatgtggcataagatttttgagttattatgattgttagcaattttctcttttttaacataatgtcccaacagaatttatcacgtacgttccggtaaaaaggcatttaaaaaattcatcgtttttgaatttacacagaaacaaattaagcagcaaaaaaaacatgaa

SEQ ID NO: 38790 - DNA, 862 bp, Heterodera glycines
  misc_feature (216)..(216): n is a, c, g, or t
cagtggcctgcaaatcaaagcagagctcgtcatcaaacgcagccaaaggaaggcaacgctcctcatacttcaaaaggaaagccggtgcatcaaatcagtgcacaaaagcgtgattattccacggatgttgcaagcttcgtcaagccaaaaaaagtcaaattacttacagctccaccagcatttattcaattacaattgcaaaaagaaaaaacactntgaattggacagtggcgccgaagttttgctggtctccgaaggcgattggattgccaatggcatgccaaaattgtaaacttgttctggactacacgcgtacggaggatagccaatcaaagtccttggtttcttcaattcaaaattaaagtttacttgtggagagaaaccactacggacttgtatgcggtcaaggacaagacaaagaatctgtgtggacgtgattagattcaaaagctacagatcgacttgaaaaatacgtggaattagaatggtgcaacaaattcgagacacaaaatccggaacgaagtgctccaaaatcacgccgaaatcttcagggaaagacttggccgctgtacacggcacatcacgttaaaatttaaaatggatgtagagccaaaaagatgcaagcaggtcccgtgccattcgcgttgcatcccgaggtgtagaaggttaaaaaccaatggtgccgaagcaaggaattcgggcttcaccggacaaggtggaagcaattcaaaaaatgccgacaccggaaaatttgaaagaacttcactcgtttctcggcatggttggctattacggtaagttcatcccttcattggcggtgttttcggaaccattgaatgaacttagccggacagaaaataaa

SEQ ID NO: 38791 - DNA, 1038 bp, Heterodera glycines
  misc_feature (935)..(935): n is a, c, g, or t
aaacaatggtttggaagaggtacaagacctgttaagagagcaaacataattcatatgtcacctgtttccatgtctttgtggaattggctttgcgtcctgcatcaacagcccccgggaagtcaccgagttcgacaagagtctttgccaactttgcgaagttgctgatgctgctgaacagaattcgtgctgcgtcgttcatcccatcttccgcacaacgatctccaacaagttgtatttgggcgtgatttggctccgtaatgaattcctccaattcagttaaacgccctgtcttggcataagcaaagcacagctcggtctcgatgaatgactcccgtgacttcttgcgggccatttgcaggtagcgcaccaaatcctcccaatggtcagtttcattgcatttctttgccacttcgatgaacgcactggggtcgtcggccttgacaaaagaatccaccgcttccttgaccaggctttcgttaagctgagctttggccaaagccgaccacactgccggttcgttgactttttccgcgaattcgtaagctctgtcaaggtttttaacattctcaatgagcacctaaaaataaaatcgaatgatgatgtgattattataaaatgttaccttaattgctgacgcattgaccccaaatttgcggaagatagcaaatgcctcttcgtacagtttgtccgtgatggcaatgtttgcgatgtcaggcgcatcgtaattgtctaatttttgaatgtattccatcacacgagatgagtctgctttcatggcggtcaaaatcagcaaattttgcaggtttcggttctcggtaaacgccgaattctcgaggacgatcttctccagaagttcgattagttcattgggcaaatcggccgaaatgaaggcacggactggttatagtgatgtcatccggggtcagaggtttccngaaagaagtgtttgcaccacctgtcaaggacgaaataatgactaaacttcagccatggcaaaacctggtcgatcagctgccgaacggtgcgggttgctttctg

SEQ ID NO: 38792 - DNA, 1034 bp, Heterodera glycines
aaaatgtttacgacgggttacagtggaaactgcgtgaaggaaattggagtaaaaaacataaaaaaaatcagtaccaagtctcagcgatggcgcaaaagccacccgatggcatgttttctcctgctccaactgaaaatggaaaggttttttttgattttgccagtgattaaaagaaaatcaaaatgaatgaaatttggccgcacttcgtttagactgacgcccgaggcgaacacaaaaaccatcggaaagttcggcaaaagtggcaataaaacgggcggcgtcctcaatgtccaactcttgctgggtggtgtcgttgatttccaattcgctctgaaacaaacattgctatcagagaaaagagacaacaattgtaattgtaaatattagttaaaaatgaatttcaactttacattcggtgccgttgcggcggccaacagtggaagcagtccaccgcatgccattgtcagactgtcgccgagttggctgagcagatggatggtgttggcgatgaacacctggttgtccgcgttgttcagatggtccgcaattggtgtgctcgaacttaaagccgattagatttaggcaattataaaatgccactgctttcgaatttgccataattaaccccccccccccctgattaattggaaatccccagtttcggactaatgaatctattatagaacacaaactcgttccattcctgcaccacactctcaatggactcgagcaggtcggacagcagacggatgtgcaccggtgaccaggtgaagtcgggcgtccggtacagtgccatcggttgctcaccagcagactctcccgcctgtcgctcaaactcagtccgttcggccaacctcttctccttttgcaggactttgcgccgatatttctcccatgagacctgaaaattgtcgaattcactttttttttttgttaaaaaaaaggaaacggagtgggtcacacatgaaaaaaaggggagggtcaccgaaatttttgcggatatatccgggccatgtaaaccaatgacttttttt

SEQ ID NO: 38793 - DNA, 887 bp, Heterodera glycines
ccttcaagaaatgaccttgctttaataaatttaaatgccctacctatattactttaagattgacgctgtcagcttttttcttgggtttttgttcgcacttaaaaaacagatcgagaaatttttaatttttttccaggattttgttcattttcacccaaaaattgaactaactgactgaaacccgtttccgatttctacccaatttcgttttttaatttaatacataaaattgcctttttatgattaaaataatcggaatacaaaaaaaaatgcatattagaaatattataatttttttttgtcctcaatcagtttcttctgtttcactttatctttcacccagctctaaaaatgtaaatttattaaaattaaatttttaaaaatttacgaaaatgccattacatacattcaattcttatgccgaacaagcaattctttttttcacatggcttctcatcaacagtttttgcttaattaattcaaatgatttatgacaaaattgttcatactgtatgtatcaatcaatcattttgttcactcgattttttgtgagagtgtcagatagtgaaaggccagaaatttgctgtcttacacttcgtacaaattcaaacatttgtacaatatgttgtaacatttagctaccgtacgggttaagatacagtacgagcctgaacataaacagccttcaaattccttacatccacggatgtccaagccgaacaagtgttgtttgacggtagttgttgtcgtggttgtcggagttgtcgtggttgtcggagttgtcgtggttgtgggagttgtcgtagtcgtggttgtcgaagtcgtcgtcgtggttgtagttgtcggagtcgtcgtcgtgggtgtggtcggcggagtgtccgaagcag

SEQ ID NO: 38794 - DNA, 961 bp, Heterodera glycines
caggtgttggaggagagagacgggctcaaggatatgtgcgactcggcagcagaaattttggaccacaaaggacgtgaaggaaatgacggagagcacaacgcgggacagagaggggaataacaaagtgttggagtacatcggagaacgcttcggggtgacttttcattacactttttaaattggcaaattcaaattgacaattccttgaaaaataaggaaaatctttttaaaaaggaagaatgtgttctggaatacatcacactgtgacacttatttcagttcacaatggagatgcttgacagtctgtacaaatacggaaaatttttgtacgaatgcggaaattatttggccgcctccacttatttggacttttatcggaatttgatcccccaacacgaccccaactatttgaatgcccaatacgggaagttggcgtccgaaatactgctccaaagttgggaccacgccaaggacgacctgaacagactgcgcgcctacgtcgactcggagccgtttggctccgaattggaactgctgcagcaccgggcctggattctgcattggtccctttacattcacttcaattacccgaagggccgggacgaagtgatcgacctttgtctgaaccagcagccctatctgaacaccattcaggcaaattcgctgcgataaatcaatcctttcttattcgaattttcacttctttaagattctctgtccccatttgttgcgctatttggccgtttctgttattaccagcaaaaacaaacagaaagcgagcctcaaagacttggtcaaaaccatcgaagtggtaagcgggggagaatattgtcacaacaattggaattgggatgtctttatttgccattttcgggttttgcaacataaaatgttctaaaaaaccaaagaaacaacttgtattgtaacatatgtgagtggttttaccctttctcatttgcag

SEQ ID NO: 38795 - DNA, 711 bp, Heterodera glycines
aaagattacaatggatgagaaagagaggagaaaggagtgagaggagaaaagagaggggggagggggcgcagagtgttcggatcagcagatattgatacagcggaagagaacacacagacgcagaagggagagcggaagagaagcagcagcaggcattatcgtgagaaggagggacaaatggacagcaggggaggggcggaagagaagggccaagacgagaacggggagggggggggggggggctggggaggcgggggtctgtccggtcatcgcgggggattgaccccggatgacctctgcccctccccccggggagtattcgtcgagaccgccctcaccaataccatcgccccacccatcgccgctcatcagccacttttgtgtgccgcaatgtgctccattcgttcgtttttcttcaatttttctgccgttgctgcacaattcgcccttttggccaaactgaaaagcttcaaattaaacacgaaatattattggtaaattcatttcatcagattggttatttttgcgatttgtctttttgaaatggacattttggccggcattgaagcggccaaagcgagcaccaatttgaagcagtacatggcgatggtcaatcagttggcgaatgccactggcctatctccccgggatttggcagcatcgaacactttgagagcagcttttcaagcattgaccaaccagtgagccttt

SEQ ID NO: 38796 - DNA, 1135 bp, Heterodera glycines
agtatgcggccgtctttgctgttgatttgcaaaccgacaatgtctttcgcttctaacagctaaaaatggaggtgaattttatgtgttaaatgtctatttttggtcgttacatcaactcccgttattggaatggcacacattgcgttgtgactgtgcgcaacaacaatgatccgaaattgggtaagaaagacgcgacctgcgaagtaaattatttagaaaaataaaaaccaaaaagcaactcacaggactccatgctgacccaattttcgctgtcaaattcttctccgggcaacggatgcaaagcattgaaagtcgagagagggttcagagaagaacgcgttgacttaaaaaccacgaataaaacaggggaaaacgcaaaatcaaaaaccaacagctgaacgatttctgctgaaattgaattgttgttcagctgaaggcgcagcgggagtttgggccgagtggggagacggcgacgaagcattgttgcaaatgctcagactcctcgtggcgtcaacaatagccaggtctgaactgcttgaaggaaacacgttgtcatcgacggcaccagcagcagatgcaccattattcacccgctcgcaattgctgttaagcaaatggttgtcgttgcaaggcataaatccggtcttatggactaggagtttgttgttcgtcgtacttttaagtatatttgctttttagttgtctgaaaataactatcataggtataaattatattaattgggtcgaatgtagaaaaatacaaacaaataacaaaggaaatttgtgattaattttgtgcgtttgagttccataataaaaacaattaggtttgctttgacacaaaatcaaagggaatgtcctgcaggctcttttgtccgtgtttatcgattatgatttatgaacatgttcatgctcacaaaaaatgcacacccgcaacatttacaaagcagcagttcttgttcagcctttgctccacagcgttcaatccaaccaaccagtcacaaagaataagccctccttgctgctgctgtccgagtagagtagcatccgtcatcacatccaacctcttagcagacactcaacgtggcgaccaagcaagagcactcactgtgaagagagagtgaagaagcagaga

SEQ ID NO: 38797 - DNA, 60 bp, Heterodera glycines
ctgcagctgattaaagacagcctgccggtctcggtgagcctcgggctgtggagcacgctg

SEQ ID NO: 38798 - DNA, 919 bp, Heterodera glycines
  misc_feature (915)..(915): n is a, c, g, or t
attaagggttttggtaaaatttgaaaatttaaagaaaattaagtttacactatttcatatatgataaaaagcaaagtaattattaaaaataaaaaataaaatatctcatcgcttataaatggtgaaaattttaaaaattgggattgatcattagtaggattatccaaatctattttttacttaatataatttgtttattatattaaataatgatgcaatatttaaaaatttggattgatcattagtaggattatccaaatctattttttacttaatataatttgtttattatattaaataaagtgacaatatttgcaaaatttggattgatcattagtaggattatccaaatctatattttactgtttattatataaataatgatgcaatatttaaaaattgggattgatcattagtagaattatccaaatctattttttacttaatataatttgtttattatattaaataaagtgacaatatttgcaaaatttggattgatcattagtaggattatccaaatctactttttacttaatataattggtttattatattaaataaagtgaaaatatttgcaaaatttggattgatcattagtagattatccaaatctattttttacttaatataatttgtttattatattaaataaagtgaaaatatttgcaaaatttggattgatcattagtaggattatccaaatctatattttactgattattatataaataaagatgacaatatttgcaaaatttggattgatcatcagtaggattatccaaatctatattttacttaatataatttgtttattatattaaataaagtgaaaatatttgcaaaatttggattgatcattagtagattatccaaatctattttttacttaatataatttgtttattatattanataa

SEQ ID NO: 38799 - DNA, 698 bp, Heterodera glycines
ttattcatctccctttttgatagaaaaagcatcagagcgtttaaactaacatgtaaataaaatttggtgcgtttcagaactcattttctgaaaaaaatatttatgaattaattatgcaaaaaacaaataaataatgaactctcttccttaataattttcctgcaccgaaggtactcactcggccgcttcgcggcctcgtggtgggccttccccccccccccgcccttcagagcacgacaaatatttcaacaaaaatttttaaaaattgactagagcaatcgaacgctaacggacgacctaatggaaaaaaatccccgaaggagagaatttaattaaatccattccttcgggggaccgtgccgggtgccgcggggtaagcagtgctggttcgtttcatcacggcaccgaaccttttggctagtcagcaatcgttgcttaacttgccagatcggacgggtgcgcatgattccactgttccaagcaccccaccaaaagcaaaacgatataaccaaaatataaggaaaaattttttaaaacattttttctccatcttcctttttgatactaaagcatcagagtgctaaaattgacttgtaaataaaatttggtgcgctttagagcattttctgaaaaaatatttatgaattaatttttcaaaaaataaataatcagttaaaaactcacaatttctaaaaaat

SEQ ID NO: 38800 - DNA, 1215 bp, Heterodera glycines
atcgggaatgatcaaaattttaacatccccaggggacttgagctctctctgaaaattttcaatacgttaaaactacacccaatcaacatgacatcatgcacagacatcctacaactatttctgatttgaaaaagacccgataaatctaacaacattccattacattgacattttagtgatcaaataccgtaaacgcaagagtaggtgtctttaaaaaattcctagggggttggaaaaattttttggtggaagaataatatcaaggtcagataaagcacaaaatttgctacaaaatggcatttggatgatggctcaatgatgcgtctccgccgaggaaagtaagcataaattcagactaccccaaaattgatcatgggatactgtatttttagtcaattttcgacctttcgtttctccatgggcaaaagtcgtagagacatgcggttttatgcattctgtagcaatctctttctgtccgtcataatcatctttaacgaaaatttttccagccccctaggaatttttttctgaaaatttcccgatttcaagccattttattttgatcgacaaaaattcaaaaaaattacctactaaaaatcagtaaacttttgatgctggtatacccatccttggtgtcagatacgaaccctggttaagccccttattatttttagaccatattcatataagtgatcgaccttcgaaactagaaaagtaccagaattattacattataaaaaagaaagatgaaaatatatttatatgtcatactgtagatatgtatacggtgggatataaaacggatagacacaactaaaccatacccaattcatccatatgcacaactcatccatggtgttccgggaataaaattcgatctgattaaaacattataaaccgagattttcggattcattacagaccaagaggcttccatttgtgagatttggctttgatacaagtattttatatagactttggtaatactgtcgatggtaccccccccccccccgcctgttttgaaaaaaatcatttttgttttcaaaagaacatgaaagcatgtttcctagggttttcgagatcactgatcacgaaatccggcatctattccgaccaatttcgaaccccggaacctgaatttccaaacatagttccaaagttcaaatttttcgagtttcagattttttgatccaaatggtttaaaaaattttttat

SEQ ID NO: 38801 - DNA, 1051 bp, Heterodera glycines
ccgtcactttcagttgcgttgacagaatttttgtccccttaatggacattccttgcggatccaaacggcccatccattacttcaaattcatttctactcacaacaaccatttgccattctgctgagtggtgtttcgtatttgtttgtggcttcttcctttttcgttatgcaatggaatgcgatttttattcaatttacattttactgccccatttgttgtttctttagcaaaacgctcttcgaataaccctaatctctgtccaacaagcaattcgatgtctgacatctacggcttcatcaacaatatctcagatcgtatatcacgacgcgtacgtcgcaagcgcccaacggagtctggggtttctggtgaggaccgagtcactttttcgaaagttcattttctttcggttttcaggtgtcagcggcgcaccgccggagactcggaaggacgacaaggcgaagggcggcggctgctccaaaaagtgcgcttgcatcatcgtgtgcagcattctcacgctcattgtgctcgtcatcggtggactcgtcctggccgctgtcctgacgcctgaaacattcaaaaatgctcctctgttgagcctcatcgcgggcaaaaagaatgggggcgcggatggtgagggggaggataccaacgactgataagcgactctgttgtcctattgtgtggctatattgttcaataatctgtatctgatcttattgtacacacattatgtttgggataaagaaagtacatttgtttgccaagttttattctttgtttcataaatgcgactttcttttttgaatccagtttcctaatgagtaaaagcgatctttatggtcgcgaaaacggtaatcgttcacatcattggtcccataaaaaggcaaaaaaaggtcgttttttcgattctaataagtactcgggggttatcgagggcgctgatcactaatctgacatcagattctcatataaatcttctaatctatgacttttcctccaaaaattttttgatggattttcaccttttttatcccttgtaactaaaaaaac

SEQ ID NO: 38802 - DNA, 425 bp, Heterodera glycines
ctaaaaaaataaaatagtgaagctttaaaaattaataaaatattttaaattcagaattactggagttagcatcatagcagtgcttttccttgtctttttgatgctctcgcaaaatctggttcgcttctgaccagtttataaaaaaaaagttaagcctaaaatttttcgcatatttaaaaagcaattaaaaatttttagattttttattcatctccctttttgatagtgaaagcatctgagtgcctaaaataacttgcaaataaaatttggtgcgtttcagagcagtttctgaaaaaaatatttatgaattaattatgcaaaaaacaaataaataatgaactctcttccttaataattttcctgcaccgaaggtactcactcggccgcttcgcggcctcgtggtgggccttcccccccccccccgc

SEQ ID NO: 38803 - DNA, 625 bp, Heterodera glycines
ttagcgagatttttgtgttacttatttcaaagacgaacatctttttgatccacaaaacggctggaaataatcaataaaaaataatgcatatataaaatatacacaattccgccgacaaacttcataaggatacagataggtgcaattattgtcgaaaccaattgggagcgaactctaacattttattgtttagtgtatatgtgtgttgagctgctagaaatttgacactttttcgatacccaaggagcagtttatgttatcttttagcgagatttttgtgttacttatttcaaagacgaacacattttgatccataaaacggctggaaataatcaataaaaataatgcatatataaaatatacactagcgggtgcgtgaaccgtcggctatttagctggaaaaaagcgcttcgcgctttgggagcttcgctacctagataagctatgggttatgaagatatttggaattttaaaagattatctgggatttttaggccgcttcgcggcctcgaacgggcgctttgcccccgtttttcatattttgttttgctttgacgggcgcttcgcgcccgtttttaaatttgattgggccttttcggccgcttcgcggcctcacactggcgct

SEQ ID NO: 38804 - DNA, 923 bp, Heterodera glycines
ttttcagtggtccgtttggggtactcaaacaattatgggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaatacaggctatagggaagctattccggaaggattcggtctccccataaatctgggcgcatcggttcggggggactgccccgaaaacaaaaaaatcgattttttcaagtgtccgtttggggtactcaaacaattatggggagcaaaactccaacgcagaattaaagtacagactatagggaagctattcccgaaggattcggtctccccataaatctgggcgcatcggttcagggggactgccccgaaaacccaaaaaaaaattttttggataaaaattatttaaatgaactgactagataatatttaaaataggttatttctcttcctttcagtatccctgcaaagtttggtgcgcttctgatcagtttctgaaaaaaaagttaagcctaaactttttggcatgtttaaaaagcaattaaaaattttattcatctccctttttgatagtaaaagcatcagagagcctattttaacttgtacataaaatttgatgcgtttcagagcactttctgaaaaaatatttatgaattaattttgcaaaaaataaataaacagttaaaaactcagaatttctaaaaaaatttaaaaccaattacaattgtcattttttcaggttaagttagtcctgtaccggggagtatgcctataaaatttggtacgattttattgcttattgaaagagctagaaccgaagaaaatctttttaatttaa

SEQ ID NO: 38805 - DNA, 892 bp, Heterodera glycines
caattaaattaagtcaaataagaaataaatatttatctatattatcgcagtacctcttctaatcactgttgtacctcttctaatcaccgttgcacttcttttagtcactgttgtacctcttctaatcacttttgtacctcttctaatcaccgttgcacctcttttaatcactgttgtacctcttctaatcacttttgtacctcttctagtcacttttgtacctcttctaatcacagttgtacctcttcttatcgctgttgtacctcttctaatcactgttgcacctctcttaatcactgttgtacctcttctaatcaccgttgcacctcttttagtcactgttgtacctcttctaatcacttttgtacctcttctaatcacagttgtacctcttcttatcactgttgtacctcttctaatcacttttgtacctcttctaatcacttttgtacctcttctaatcacttttgtacctcttttatcacttttgtacctcttctaatcacatttgtacctcttcatcacttttgacctcttttaattgctgttgtacctcttttatcacttttgtacctcttctaatcacttttgtacctcttctaatcacttttgtacctcttataatcacttttgtacctcttctaatcaccattgtacctcttctaatctagaaacgggcgcgaagcgcccgtcttaggcctcgaagcggccttaatagcccaacaaaatttagaaacgggcgcaaagcgcccgaaatattccgctagtcgcaaaatttctcactaacatcttcgatcaattcaaatcacttcacagcctaggtagcgaagctcaagaagcgcacagcgctttcccaagcgccaccctcgcatgcacacacccgctagtttaa

SEQ ID NO: 38806 - DNA, 787 bp, Heterodera glycines
acttgtagtaaaatattggaatctgtgcccttagttaaattaataaattattgaaagggttttttaaattgtttaacattaaaatataataattaaaaaaaaataattcatttaaacaatattgcataatctgattgatggaattcgaaattgagctaggatttgtcaaattgaattaagcttctttaaaatttggacccacaaaaaccttaaaattcggtagtgccaaaatggcttaattaattttaatgtgccatttgccatttcggataataattttgcaaattttgaaaaagagggcaacatcggttggacaaatgtgcacacattcaaacgtaaacaaatgatgatggattgatgaatgatgaaatggtgaataatgccttaattaattttcactccctcccaaaacgatggcacattttttcgtgccgttttcaatggattttcttcttttccttttccttgcgcaagtaagcattgacgaagaattggacgaacaaaacggcaaaagtgatgtagatggtgaatgccaagtacagattggcggtgctttgctaaaaagttaccaaatattggtcaagaaccacttttccgccataaataattgaatggccggtgccccctttttatcctcttcaaaaggttgccgtctcattagaggggggggggggggtaagccacatcttcaatcaacatcttcatgttctgctccaacttgtctttgccatcgcctgttgccatgaataataatgcatctcctccaacatgtgatctacagcttgga

SEQ ID NO: 38807 - DNA, 76 bp, Heterodera glycines
ctgggtggaggtctggtccggctggcgctcccagccacgcaccgtcggtgccaccgacaccggggcgtagatgtcg

SEQ ID NO: 38808 - DNA, 862 bp, Heterodera glycines
ctttttaaatatgccaaaaaatttaggcttaacttctttttgaaagtttgatcactcatattttttgctaattgagcagaagcataccaaactttgcagggatactccccggtaaaggactaacttacactgaaatgagcgccgagctagcttgctctaaaaaatttttcgaaaatctgagtctttcgtttttatttattttttgcaaaattaattcttaaatattttttcagaaagggttctgaaacgcaccaaattttatttacatgttagtttaggcactctgatgctttttctatcaaaaagggagatgaataaaatttttaaaaatttttaattcctttttaaacaggccaaaaagtttaggcttaacttttttttcagaaactgatcagaagcgcaccaaactttgcagggatactggaaggaagagaaataacctattttaaatattatctagtcagttcattaaaaaaattttatcccaaaaattttttttttgggttttccgggcagtccccctgaaccgatgcgcccagatttatgggggagaccgaatccttccggaatagcttcactatagcctgtactttaattctgcgttggatttttggtccccataattgtttgagtacccccaaacggacacttgaaaaaatcgaattatttttgttttcgggggagcccccccgaaccgatgcgcccagatttatggggagaccgaatccttcggaatagcttccctatagcctgaactttaattcggcgatggatttttgctccccaaaattgtttgagaaccccaaacgggacacttgaaaaaatcgattttttttggtttcgggggaggccccccccaacc

SEQ ID NO: 38809 - DNA, 742 bp, Heterodera glycines
gtagtatttgtgtgggtgtggcgtaaatgattgctgggcatggggcggtgagggggcgggcggttattatagggggcgggagggttcgccgtagtggtagcggatgttgtgtgaatgtgaatgaatgtgtgtgtgtacgtgtgcggagtaattaatgaataattaatttgacgggcaaaggtgcctgtcagaaactaattagtcaccgaagcacgcgcataatttatcccgtgtcaatggtatttattggggctgctcgggattcgcggtctcgactctcgaattgagaatttctcgtttttttgggtctcagtctcgactctcagggtgattctaggtcttggttctcgagtctcggaaaatttcgactctcaagcagccatagtatttatgttatgcaacaggtatatgcagggctgccatatctgaggctttagcctcattttgtggttttttgataggtcaatgaggctagatttacaaaatgaggctttttgtggttttttgagaaaaaccgcaaaataaagaattttttaatgaaaatatgctaaaaatatggtaaaaattcttaatttttcccccggcggcgcctatcggcaccgccggacagtaaaaatccttaatttacaagcaaaaatttgctcaaaatcgcaaaatttggtcattttcggacaaaatctgttaacaaatcgcattgaaaaacacaaaatttttcccggcggcgctatgggcaccgccggcc

SEQ ID NO: 38810 - DNA, 982 bp, Heterodera glycines
  misc_feature (965)..(965): n is a, c, g, or t
aatagcttttcttttcgaaaagagaggcgaggaaaaataaaggttgcatccaaatgtaaatttttttacattgaagcatttggatggcttgctgtttacagttggctaagtcttctttgcaagaagcagcacaacttttgtttgggccaacgaccccaaaccattcgaatagcaatcgattgggctgactagactccatatttgcaggaatagcaatggcaggtctatcttaaaggcctgacgagttatgtttcgacaaacatcttgtacaccataaatcgattagcaaatttagtcgaactatataaatttttcaaaaaatgattcatcttttttatggttagcgcaagtctctagctttatagaaacggtccccgaatctgcgaggaactactttttagagaatttctatagattattattttgcatgaatccttcgcttaaattcccatttatcttataaagtcagattaaattaattaccccgatttgttttagaattggtcccaatacgcttgctaatagcttttcttttcgaaaagagaggcgaggaaaaataaaggttgcatccaaatgtaaatttttttacattgaagcatttggatggcttgctgtttacagttggctaagtcttctttgcagaagtagcacaacttttgtttgggccaacgaccccaaaccattcgaatagcaatcgattgggctgactagactgcatatttgcaggaatagcaatggcaggtctatcttaaaggcctgacgagttatgtttcgacaaacatcctgtacaccataaatcgatttgcaaatttagtcgaactatataaatttttcaaaaaatgattcatcttttttatggttagcgcatatgtctctagctttatagaaacggtccccgaatctgcgaggaactactttttagagaatttctatagattattattctgcatgaatccttcgcttanattcccatttatcttat

SEQ ID NO: 38811 - DNA, 715 bp, Heterodera glycines
cactgttctgccattcgcccattctctgatcggcacttcccctttctacaaagctcttccgacttcttcctcttctccgccaatgccacttcccgcgttttatcaacaaaatgtgtccgcttctcaactaaatgtcccatctgtcgtcggtcagcccaattcttccgtctccgcctctttggcctctttggtccacccgccccccgttttcgctgctccttccacggcgaattctctccacacgccaaactctgccgctgtccgtttcccattttccacatgcattggcccgatgatgagtcattttgagatgatcggaacagataatcaaatgtttccgcaaaatgtgcgacttaatccgggcttggcgctctgctcttccgcccctttcggaggtgccattcattgggtgccgaattgccttttcttcctttctaagggcacatcggcacatcgcttccctccgccgtcactgtctctcccgccgcagtcgcatcggtcggtggcggtgagctccaacagtttgcaattccgcgcatatcgcaacagtcgcaagctcagcccgtgcaggggttgcaatttgcattgggacagtcggcgatatttggcggagaatcggcgagagacggtggaggacagcaaacgcaggtgcaaacgaagggcaaaacggagagcgatgcgaacggaattgagacctcagaaggggggggggggg

SEQ ID NO: 38812 - DNA, 1005 bp, Heterodera glycines
atttttcaaatttttgttgaaatatttgtcgtgctctgaagggcgtgggaggggggggggcgaaggcccaccacgaggccgcgaagaggccgagtgagtaccttcggtgcaggaaaattattaaattttaaaattttttaattgctttttaaatatgccaaaaaatgtaggcttaacttttttagtgaaaattcgatcactcatattttttgctaattgagcagaagcgtaccaaactatgcagggatactccccggtaaaggactaacttacactgaaatgagcgccgagctagctggctcaaaaaaaattttcgaaaatctgagtctttcgtttttatttattttttgcaaaattaattcataaatattttttcagaaagggttctgaaacgcaccaaattttatttacaagttaatataggcactctgatgctttttctatcaaaaagggagatgaataaaattttaaaaaatttttaattcctttttaacaggccaaaaagtttaggcttaacttttttttcagaaactgatcactcatagcgttttagtccaaactactcaccgattcagaaaggaagaaaaataacattattttaaatatgatctagtcagttcattggtaaaaaaagtctatccaaaataatacccttttgggttttcggggcagtccccctgaaccgatgcgcccagatttatggggagaccgaatccttcgggaatagcttccctatagtctgtactttaattctgcgttggatttttgctccccataaatgtttgagtaccccaaacggacacttgaaaaaatcgatttttttgttttcggggcagtccccccgaaccgatgcgccccagatttatggggagaccgaatcgatcactcatattttttgctaatcgagcaaaagccgtacgaaactatgcaggaatactccccggaaaaggactaacttacactgaaatgagcgccgagctaactggctcaaaaaaatttccgaaa

SEQ ID NO: 38813 - DNA, 1218 bp, Heterodera glycines
  misc_feature (1163)..(1163): n is a, c, g, or t
taaaaaaaaataatgaaaaaaaagaaaaagctggcggtcctcgagctgacactcattgagtcttaagccacgtgctaggccaagcacgggccctaccacgtcgtctcatcacggccacggacgtagcagcaagcacaaacacaccgctagttacggcacgtaagaccgggaacgaaaccaccatccccagtcagtgtgttatgtgcctgccacaacaaccgctcaacgacgcacagacgccaacacagccgttaggtcgccccacgagcgtgcaccccacattggcgcagcgaaccaaccaagcgaggcagcccgccaccgacacattgccacgcagcagccatacacaggctttaacatgtgcagcactgagcggtataccacagctccaacgtatggaagcaccccaaaagcatggctcgtgaggcagctgccccgtaatgttgggcagcgtccacaagtcagctcgaacgacctgtgcccgtcagcggacgggggcatttggtggtgccaacgctagcccaacaggacagcaggtaggtggtgaataggaatcacttgggtaatgatccagcagcaggttcacctacagctaccttgttacgacttttgcccggttcaagccactgcgattaaatcggttccagtctgcataccgaccgaagccggaacactaaccgtccccgaatttctcgaaatggctcagtcccgggcagcgacgggcggtgtgtacaaagggcagggacgtattcagagcgagttgatgactcgcccctacaaggaattcctcgttcacggacaataattgcaatgtccgatcccaatcacggcaaattttcaccggtttaccaacccctttcggggaaggacaagcacgctgattttgccagtgtagcgcgcgtgcagccccggacatctaagggcatcacagacctgttattgctcaatttcgtgcggctgaacaccgaaaatccctctaagaagttgtgcccacagaagcaatgagccaactatttagtaggctagagtctcgctcgttatcggaataaaccagacaaatcgctccacgaactaagaacggccatgcaccaccatccaccgaatcatgaaaaagctatcaatctgtcaatccttacggtgtccgggccgggtgagtttccccngtgttgagtcaaattaagccgcaggctccactcctggtggtgcccttccgtcaat

SEQ ID NO: 38814 - DNA, 1152 bp, Heterodera glycines
  misc_feature (1063)..(1063): n is a, c, g, or t
  misc_feature (1069)..(1069): n is a, c, g, or t
aaaaaatgataaaatgggcaactttttgtgtcgggaggagggaaatatgcactaattagttgatttgtgagctaatgtttgctgtgtggacaaaaggatgagccaataaataccatcctaataaaactgataaggagcaacaatttgcttttaaattgtgctgatagcccccccccccccggggtgtattttgttaggtgaaaaacattcattcattttatcgacgaaaaaagaccatcatttttagcataataaataaatttgtggggagattatgggattacgataataaacatacagtacgcccacgtaattaatttgtccaaaaaactgattatggaggcgaaaatttggtctcattatcgccattatcattgagtccattttttggacagtggccttcgtttttgtacaaaatcagctgatcaacaatttttgtactttttgtgtgcaattagcaaatggaaagtgtaatgaacaattattgtataatgctcattattattatcattaaattagcagtgaaaaataaaaattattcaaaaatttaaaaaatgaaattttatttttaaagagaaaatttttaagaaaataatttgttcttgaatgaaaaatccatatattttttaaaaggattaattttaaaatcattatatttttttgaatgattttcatcaaataaaattaattattttttcaaatattaataattaaatttatttagttttgaaaaaaaaattcaataaaactaattagttaaataattttgtattttttttttgttaattagtgaatctgttttaattcaaacgaatttaaatataggtttgggcgtgtcctgctttttcatctcggacattccccaccccattgaatcggcccataattctgtacagactctcatcaattagaacggtcgcaactaattgagcccattttttcttatcaaagagaagacaaacacaccaaaaaatgataatttgtcacgcttatcatcataataatctgttaattgacccttaattactattttgttatgttgccattattttttgcccatcanaattgnggcatgaaaaaaaaagtttgctgatgaggtaaaaaagtgtgcgatcaatttgggcgaggggtgactgaccgtggatggtacgg

SEQ ID NO: 38815 - DNA, 519 bp, Heterodera glycines
ttttaaattatgagtttttgttcaaatttagattaggaaatcggaattgatcaaaataattgaaggattcgtgatcggggaccccaaaaaccccagagaataaatttttatgactatcacaaaaaaaattttgcaaaacaaaagggtccccccttttgaaaaaattttcaaaccaacaacttttagactagcgccactttttgcttacttggccaatcaatgcctatattcttggtatcaaatgagagctaaaagtctcgggattttataaatgcaagaaaagagcaaatactggcattaaaaaagaaattacaataagaaatcacgagattcaattttttcaagaataattttattgtatattgcatttagcaaaaaataaaattatataaaagctattatagaccttaagctttcgtttgataccaagaatatataggcattggccaactaagcaaaaaattatggcctaataaactgaggatggtcattcatgggacgcataaaatggcatgggac

SEQ ID NO: 38816 - DNA, 1072 bp, Heterodera glycines
gacaagggatcaggtattttgatgtttttttcggaattgctttcgaccacccccgccccgtttagatgagtctgaatgggtcgtcacgagagaacgttacaaatacgatgagcaattcaatcttctacagcccatcgatgggaaaatatccggtattttggatgcgatgcttaatgtatcgaacttcatcccattaaggacgcgttgccaaggagcatatgctaaagtcaaaactcccaaattctgtgctcggaaagatttggaaattgtccgacgtcgacaaagacggacatttggactcggatgaatttgccctgtccaactatttgatcaatttaaaactcgaaggccacgaactccccacagagctgccaaaacatttggtgcctccctcaaagaaagcgatggctggcgatgcgtcgtcttccgacaaccaaatttaccctactttggatgagtgatggggcgagaattgacctacagatttctatgttttgtactttgtgactgtgaacaactccttcggcagtttcggcggcactatcccaatcggtttccctttttgtcataatatctaataaattaaccaattgattagagcccggatatcctatatttaaaatcttaaccgtttaagcatcgcaaaagctttcttaaaatccgggttctgattatgatggtgccgtcctttcttttatattagtcctttgcttgacaaaattccgacgattctttgtttctgtaatacccaaataatgacatttctaattattcgacttgtttccaatatttataaggttgtaatgctatacgtttattacacacatattcgctaatcggatataatcgaaaaacattacacacaaataaagcgagtatcagaggcacttacaaaagccaaggaaatgtgtacaacaacgaagggaggggggaataacgggagagaggaagaagagcactatacatttggaaccaaaaagagtaacttggttttggttatgcgacacacagtccagagaacacagagaaaacgttaaatcatgagaagtgaaactgctcctttggtctacaa

SEQ ID NO: 38817 - DNA, 996 bp, Heterodera glycines
aatgtaaaaaatattacgcaagaaattatttttacatcctttttagaaatgctgcataaatttttattgtaaatagtcacaaacaaacttttgttcactcccaatatctaccagttatcatacaaaaaggcaatagttaagcactgagatataaaaaaatcgtctagaataattatctaaacaatttgtcgggaaagctgtataaattctgggaaaaaacttttcaagaaaagctgaaaaattttcaatcgcatcagaagcagcctcaaattcttcaacaacataatgtaaaaaatattacgcaagaaattatttttagatcctttttagaaatgctgcataaatttttattgtaaatagtcacaaaaaaacttttttttactcccaatatctaccagttatcatacaaaaaggcaatagttaagctttgagatataaaaaaatcgtctagaataattatctcaacaatttgtcgggaaagttgaataaatttcagttgcaataggcatattggcacaatacataaatgtagagcaggctcaaaatagaggaaataccaaagattaaaaaattcgtgtttatggcccactctgctttggctggacataactcgccagagagtggagatagaccctttgttgatacatttgaaaatgtagagctcggctagcgcattcgaataacacaaaatttgttttcatttgcccccaaacaatccgcttatgacgggccgaaagaaaattcacaaaaatttggcaccggaaaaactccatttttttatgggccagcataataaagtaaacccaaaatgtaagggaatttaaattggtcatgtgagatgtttagttttttatttgacccatccgttttctgggaaaaacttttcgagaaagctgaaaattttccattgcatcagagcagactcaattcctcacaacatatgtaaaaatatacgcagaaatattttacatctttttagaatgctgctaaatttta

SEQ ID NO: 38818 - DNA, 1316 bp, Heterodera glycines
ggattggccaattttcaaggaattccttgcgcaaaacaaagtctacctttataactaatagtaaatgaaacgggcacataataataattaatttttgaatttttttaaattcgtcggtggcaaattaaaaaatatatattaaatttccgatcgtagcatatcagtaatgcttttccccactgaccgccccctgctggggtgctccctgaacatctgccgtgccgaccattgtacggtagggccaatatgttccaggacggtccatgggttgcccgggcacttggccaaggccctgattggcttggtacctgtttcttttttgtaaattaatgcaatttctcgaaattttgcaggggctaatagagaaaatttcgcaattattttttatttcaaacaaaggcaatttttcttaactttaaaatttttaacaaagcctaaggaaagaaatctcctaattctcaataaaatttccaatttcctaaaaaaatgtatttgaccgtgccaatgcttcgtattgtgggtttagtgccgaaatgaccggctccattcggcgaaattggttgtcttggccttcatacgcagtgcccttcagtgttgagccgtgttcatgcgcgaaatcgtcaaacactgaattaattcacccgacataaaattgaaattaaaaaaaaataataatttaataaattacaaaaaaaaaattatttgtttccatcataatatttgtgaaaaggatcagaaatggcgtaccaaatttgaaaccgtatatgtatgcaaaataagaagctacaagaatttttaaaaattttttggaacattaattattattttttgaattttttttcgctaactcttcaaaaagtgataaattttcccttttttaattaattaatgctcataaataattctatattttatttttatggcacactttgtccagtggcttgacgcttgaggcgattttctgtgaaatcctgtacagtagacgatggcttcgttaccgtacctaaaatgtattcattttacaactcgctaatttaatgacacattttttgcacattggaaccatatgacactacaaatttcgttgttttaggcgctacagtaaccattggtgagtttttccggttgattagtcgaattagccgattcaattttagaatgaattttttgacaaattcactgctgcgatggcgaccacaaatagaagctgctggtgatttggaaatggttcttaatgaaatttggtgtactactgtattgactagccattccctacagtagggttcaaggaaaaagtttatttaaaaaaaattatc

SEQ ID NO: 38819 - DNA, 1275 bp, Heterodera glycines
tttttagtaacatttttgtccatatgacgcatcgcaaaaacacctgttaatacacttttactgcattaccaacatgcctgaaaaaattttatttgtttaatttttaattaatcaaaccttgtatttatttatttttaaatcttttatatccgccttaatggtataatattttttttcacaaacttttaaacggcaatcaatcaattctttaattgtcaatacttcatttttatttccacttaaaaaactctgatacttaataaaattcgacggcattttctttttattagctgaaacacaaataaaaatattatgatttcaaaaaaaatatgataaactgtttttgagacagttttaaaaaaatcacaaatatttaatattttattcgtcaaattttctttccatgttacatgtttgcagcacgaaaaaaattgttaaaacattgggcaattattgcaactgccaaaactattaataaacttaaaaaaattattagcaaaatcattccaaaaatgagttcattaatgcgatcattccaaaattcataatcttggcacatcattacctaaataaaataataaacatttttttataaaattaatttttattactattattttttaataacgtaccgttatacttagttcaccataaaccaaatggaataatttcaaaattgtttccaataatgccttttttttgaatgggtttatattcttttcgtaaatttcttgataaaatataactttctcttgttggtccaaacttgtcataatcgaaaattaattttttattattttcataatttataatcatgtttttaaattcatcatgatcaatttggttcttcttattaaaagttatccctaaagaaagcacaattaaacaagaaaacataacatattttaccgcgaattttcgttttataccatatttgaccattcttgtcattcctatacttaattgaatattgcttactgccagctgatacaaattctaatacactatttccagcattttcatgtgacatttgactaaaaaattatatttaaaaaaaatgcttgaaattacccaaggaattcgccaaattctataggagttttgcccttgggatgtttgtaaatgacactatctaaaaaataacactttaagttgaacttagttttttttaaccggtatcagaatatagtagcttattttgtttatcattagtaacttgttgcaaccacccataaatatgaattcttgcttgggaagtagtccttaataaattta

SEQ ID NO: 38820 - DNA, 1395 bp, Heterodera glycines
  misc_feature (18)..(18): n is a, c, g, or t
  misc_feature (58)..(59): n is a, c, g, or t
  misc_feature (1372)..(1372): n is a, c, g, or t
aataggtcgatcctttantcgctttgcaggggactttcaaatcattatttgattgttnntattataacaaattaattattattctttttattttcgatttctatatgttaatttttcaaattattttcaaatatattcaaatttatactttatttatctatgaattactaataatcaatattcgactgtatatgattaattttttatgttaattttcatttggttattctccactagttctgtagcatttgttatatttatatgaaaaagatacaaaacggcattaaaaaagctaaccgcttgagactgtcatcgccatttccagccttttaattaaatttggaatatttagaaaatattttctatgtgtttaatttgcaaacttcttatatttatgtttttaaaatattattgtattcttcttttatttattaaactcatcgatatccgaaatcttcttgttccaagcttggtgcatcccaaagtttaacatttaattttgaattttagtttgttatttaccctaatcaatgtattatttttccattttttttaaatatccatttccttacctattgaagggctggtttggtgcaaaactattcaaataattcaaaagcaaaaaaataaaaattcaagctcattattagcggtcaggtttttcgtatggccatttcatacgctgttaacaataataactctttattattaatgaacagggctgaaaaaaaacatgcaaatgcatattttttcctggcttctccatgctataaatagtaggaaaaattttggggttttctgcatattcatgcatattttgccattttttgtacatattttctgattttttttccatattttgccatttttgtacatattttcagattttttttgcatattttgccacttttcgtcaaatattttccgatttgaatgaacatagtttttcgagctctatcgactggtatttttttcggaaaattttcgattttttcccggaaatagaaaaaaaatttggcctgagcgggacatttgagtcctgggcccataactcgttaggggttggctttatcgaaaaaacgccttagggcaaaattgtagaactttttaagctctatctaatggtatactatatgaaggtaaattttcaaaaattttcgagctaggccccttagaaatttttggaaattttttttcggacgaaaatgggggtgaaaaatatttttctggggtaaattagggtcttgagcacaaatatgatgtttattttaagtttcagattttttggaatattttaaaaattctttattttttggcaattttttggccctcgggattttggcctaatatttgaaaattcataacaaatcanagggttgatcaattttacagtta

SEQ ID NO: 38821 - DNA, 886 bp, Heterodera glycines
ttaaattcccagccctattgataatgctgcattaaatcctttttactccaaatgaatacatagaactccgattaaacgacatgtattttgaagagacgaaaaaatccagtgaagacacaaaagttccgatctctaatgaaattctctcggtttttatttttttaattcatcaacacatcattaatactaatgaacatacatacaaatgaatatacacatacgataatatacgcatacatacatatacaacaacaattatacacatatatacaacaatgtttatcctctcatttcatctcatttggcagcgactgaatttgcgcgttggtagaacacaatgtaggcatttcgcgtgtccacattgcagctttcagtggcctaaaaagaatggatgaaaagccggcattaattgattcgaaattgttttcttacgagagttttgtcgtcgttgcagaaaacccaattgtcagtgaagccgtcacgcacaaacgagcagtaatggccagagttcaagtggccgtgatgagtctaaggaaaagaaagaggggaagaatgattaatgatgtcattcaaattgccactgatcaaaatcactcaactcaccacaattgcaatgcaggaatagagaggaagttgggccaccagcgcagccggcacatcgggcgaaaagtatttgctcaggctgaagttgtccaacgggaacgaaacgggcacgtgctgtttgatgtattggcgctcaaatggttcatagatgaagcgcttgaagcaaatgatctgtgaagggcaaaaaaggggagcaatccatcgatgatcaattaatcaatgattaatgaatcaccaaaatgtcgggcaatcggcgggacttcagctgcttgacaagcgttgg

SEQ ID NO: 38822 - DNA, 297 bp, Heterodera glycines
cggtgtcatctatgttactagatcggggatcgatccccgggcggccgctcgagcaggacctgcagaagctagcttgatggggatcagattgtcgtttcccgccttcagtttaaactatcaagagagggaggagagggttggagaaggaaaggaaaaaaaaatgaaggaggagaaagggtggggggagtatgagtatgatggtcaatatggagaaaaagaaagagtaattaccaatttttttccaattcaaaaatgtagattcacgcagcgttattatagactctagaggtccccggg

SEQ ID NO: 38823 - DNA, 966 bp, Heterodera glycines
  misc_feature (17)..(17): n is a, c, g, or t
  misc_feature (67)..(67): n is a, c, g, or t
  misc_feature (122)..(122): n is a, c, g, or t
  misc_feature (135)..(135): n is a, c, g, or t
ctgtaaatgattatatntaatgttatattcgcatttcgataatatatttccacttctacaaatattnttaaaattaatacatgaataatttctaacagagaaatcaattttttactcagatntaagaaataaatntcgcaaaaaataataaatattaataaaataaagttgattgcttcaaattgtttattgaatcttaaatttaaaaaaaatgtcgtgcgcttttttcaaaattttttgattcggacatgcttcctaaaaattttttcatcacgcttcaatttcaaaaaaaaaagattagttattttgtcggtaatttttggtttttttgctttaaattttaaatattccggtctcggtttctgattcatagtaaaaataatcaacaaatcactaaacaacagcagaagagacttgtctttatacaacttatttcatttatacgaaatgtgtaaaatgaaaattttcgaaacctagaagaatttcctaatagattttatctaaaataataaaatttcgagtcttttttattcaagaaccaaacatcaatttttcaatacattcattttatggtaatttggcgcaaattcttttttccattcaaattttcctctttccttcaacttttctttaatggcatcaaatttttaattatttctctcttttgctgttcattttcagtctttttataactttgatcacttttgggaattttttgatcatcccaattggccctttgatcaattgggtcattttccatttcttcaccttttagttgaagaaaatgaataacttccaaatgttcattttgcctctttttgtttaatttcattgtttattcattttcttttttgtcccatccgtcgccaaatatttcatcaaaatttggccgaattttgacggattcaattatgaaagaaatgaaaaatatgaaaaagaataaatgccacaaattcatttatacaa

SEQ ID NO: 38824 - DNA, 1254 bp, Heterodera glycines
gtcgcaaggacaaaggaccagaaacgaagctgtttgtatggttcgattacaaatttgtgccatttccattgcccgaccgtctgttgcccagcaaaatccgttttaagcgccttcggattgagtaattaaaaatcaacgctttatgacaataaaagcattcattccattttcaggtacatcgatcactccgtcatcgcttttcttcgttcaaatcatcaaatttttgacaaaagaggcatcgatttacatttgtgtattccttattcaaacaccacggatggccagcggatttgggacatttttggtcgtgaaatttggccaattttttcgacaaacattcatcacttgcgctataccggtggtgatcatttggacaatttgcttcgtcgcatttcgccgacaattctcatcgatcttgatcagttgacttcaatccattcatttgatttgttgcccgctgcgattggtgatggttttaatgtgccaaatgaaacaatttctgctggccaagcattgtccaaatggttgcacacaccgagaaaagatggccaacccaagcgattgcataatttcaaggaggtgtggcccaacatttttgtgatttttgtttttccaatcaaattgtttagcattttctccgtgccaatgccatttcttccgtcacttacgaaattcattttcctattcatgcgccgtcaatacaaatggtgccatttgaatttcttaacgaatggacaaaggaaaagctgacaatgaccaaagcaaatgaaaatgaattgggcaaccgatggataatgaaacgatgcaaaattattggggagaccgcggcggttcagcagcagaagaaagatgacaattgtaacaaagtggccatttggctttacatttgcaatgattgcattgggtgagcaattaaaaaaggcatttaattttgtttaaataattaaaattccgcctaatttagcccattgtctcctccaccattcgcagaagaatccggacaaagcatcacaaaagggccgtcttctgctgacaaaatgagtgatggacaaaacaacaaaaacagtgatcagatgcagaagaaatgaattaatattaagaatgaccaaccgatcataattcaaatcagtgatcaaatgtattttatgaagaaaatcctctcaaatatatgtaaataaattggatgtgtaaaaatggccgtatgtacttgtcacaataagccagcaacttaatacgtccgattttggcttagta

SEQ ID NO: 38825 - DNA, 1001 bp, Heterodera glycines
  misc_feature (978)..(978): n is a, c, g, or t
ataaaatttctcaaaaaaagagatagccatttttctgggatatacctctaaatataaaaatcctctgtgaaataaaatggcgattgtgcacagccctccgtctcatgctcgagagcatttgtatgtgtataaaatttatcaaaaaaagagatagccatttttctgggatagagtataaatttaaaaattccctcaaaaataaaaggtctattgcgcaccgccctccctatcatgctcaagagcatttgtatgtgtataaaatttatcaaaaaaagagatagccatttttctgggataacctctaaatataaaaatcctctgtgaaataaaatggcgattgtgcacagccctccgtctcatacgcaagcgcttttgtgaggtataaaatttatcaaaaaaagagatagccatttttctgggatagagtataaatttaaaaattccctcaaaaataaaaggtctattgcgcaccgccctccctatcatgctcgagagcatttgtatgtgtataaaatttatcaaaaaaagagatagccatttttctgggataacctctaaatataaaaatcctctgtgaaataaaatggcgattgtgcacagccctccgtctcatacgcaagcgcttttgtgaggtataaaatttatcaaaaaaagagatagccatttttctgggatagagtataaatttaaaaattccctcaaaaataaaaggtctattgcgcaccgccctccctatcatgctcgagagcatttgtatgtgtataaaatttatcaaaaaaagagatagccatttttctgggataacctctaaatataaaaatcctctgtgaaataaaatggcgatgtgcacagccctccgtctcatacgcaagcgcttttgtgaggtataaaatttctcaaaaaaagagatagccatttttctgggataacctctaaatataaaaatcctctgtgaaataaatggcgattgtgcacagncctccgtctcatgctcgagagca

SEQ ID NO: 38826 - DNA, 1071 bp, Heterodera glycines
attagggattatttttttatgtaagaaaaatagcgaaatatgtaaataacatatgtatgaaaaatgctaaaatatgtattaaatatgtactaaaactcccaaatatatacgaaaatatgtaaataacaatttttaaatggtcatttttttggaaaaaattcttcgtaagaagtgaactaatcacaaaatgccataaaaaggaccaaaatagggtagtgaatcacattttagtattatgaaaaaaaagaaaactaatttttgatatctgatttttggaacaaaatcgactttttaagggtacttttcagaagatttttagacgttctgagagatttttataatgtatcccaaaatatgtatgtcagagaaataaatatgttcgaaaaaattgcgaaatatgtactgaagagtccagaatatgtgatcgaatatgtacatatgtaatatgtagaataatacgacaatatgtagataatgaatatctatgttgagctactagactaatggaatatcccaattaggaaataaaaaagcgaaattttcagtttggcgccgcctttgctcagtcaaatttatattcttcaggcaaagtaaaaccctaattttttcacgttttttccatataatacttcaatgggcttatgcttgttcatattcaactgtcttccgcttcatcaacacaattcgacgtgagaaatgatgcggacattgcgtgatgcgtcgctggttaagcccctcaaaaaacgttcaaatcagggttgccgcgggtcgagaaaaatatcgggtcgggtttcgggtaacccgtggcaaccctggtgcaaatgtcgtgtcgtcgtcgcgagaattctcgactcttacagggttacaatgccaccaacaataacccggctaacaaaaatgaccacaattatcttgccaatatcaatgttaatccctataacatactaatcaatttcttctttgatatttcacgaaattatgaaatgcgcccataaccatttttcaatgttttgttcttttttcgttgttaacacattgataaatatgttatgatattaatttaaacgtttt

SEQ ID NO: 38827 - DNA, 773 bp, Heterodera glycines
cttactataatgcgtgaattacatctttttacagactatactatatattgttatacaagagttcccgttaaatattgtttggtgatcattgtgggtcgatacggcccaggaaacctaataccatattcaaaatagataaaataaagttaacacctagaatggacactcttagaatacgtcaagattaaaatgaaataacagtaataataatttattaaagatatagctaataataaataaaagcatcatatattaaaaaaataaacgaaaaacgcaataacgatattgatataaaaattaaataaaaacttaaaaacactaaatcattaatgcataaaacaataaaattataacaatactatatccagttataacaaaaaaactgaaaaataacataatatgctgtgatgtaaaaccctgaactataagcttactagaataaattctatattatttaaagtaaaagttaaaaaatagctatcaattaaccaaacattaattaattaaaaaatggatctgacttattaagtaaaaatcgttaatcttattaatagtagagatcggaccggtcggtttttttcggtttcggttttttaaccgaaaccgaccgaccgaaaattttttgagtttttcggtttttttcggtttcggttttcggtttttataccgaaaccgaccgaccgaaataatcaaaaaaccgaataaaccgaccgacttttttcaaaaaccgaaaaaaaaccgaatgaaattgcagcgatataacctgtttttgt

SEQ ID NO: 38828 - DNA, 1002 bp, Heterodera glycines
ttttgagcgtaattacgattttacttagaccatttttttgctaggcttagatcacatgcgattttcggcactctgatattttagcgctcataatgggatgtataaaggcgattgtagaaggaattggaagcgctaaaattctttgagaagctttttgagcgtaattacgatttttacttagaccatttttttctaggcttagatcacatgcgattttcggcactctgataattttagcgctcataatgggatgtataaaggcgattgtagaaggaattggaagcgctaaaattgtttgagaagctttttgagcgtaattacgatttttacttagaccattttttctaggcttagatcacatgcgattttcggcactctgataattttagcgctcataatgggatgtataaaggcgattgtagaaggaattggaagcgctaaaattgtttgagaagctttttgagcgtaattacgatttttacttagaccatttttttctaggcttagatcacatgcgattttcggcactctgataattttagcgctcataatgggatgtataaaggcgattgtagaaggaattggaagcgctaaaattgtttgagaagctttttgagcgtaattacgatttttacttagaccatttttttgctaggcttagatcacatgcgattttcggcactctgataattttagcgctcataatgggatgtataaaggcgattgtagaaggaattggaagcgctaaaattgtttgagaagctttttgagcgtaattacgatttttacttagaccatttttttgctaggcttagatcacatgcgattttcggcactctgataattttagcgctcataatgggatgtataaaggcgattgtagaaggaattggaagcgctaaaattgtttgagaagctttttgagcgtaattacgatttttacttagaccattttttctaggcttagatcacatgcgattttcggcactctgataattttag

SEQ ID NO: 38829 - DNA, 1205 bp, Heterodera glycines
ctgcacctctccgccagttgccggttcataactgctatattttttggtgcaaatgacatcactgtgctttctgggaggtccttcgggaatgctgaaatcgatttttttttcttgaaaaaattttatttttttgtttacttcggaaacgaggctgagcaatcataagcgaaataacggtaaatagtcctaaaatggcaaatacataaaagttacaattgttatatttttggtgatgtgtttcttaatttcaccaagtgaacgctaacttttgtttttaccaagttttgccaaaatctttggaccgctcaatgaacattgctgctggacgaaaggagcgaaaaatcatgatcagatgggtgaagtgaaattctgcctccaggtcaagttgaattgaaacattctgcagaattagaaaaataataattaattaattgatgtaaaatatctcaatatatgtatgatgtatcggcttgctgattaccgatattatagcgaaattgcaattttaaatttttttcatccgatttccgaaattttttgagggcgtcggaacaatcactgaaactcgaaaattgccaaatatgcactaaatgtattttttttatttccaaaaagtcggtccttaggggtgtatttttcgttttttcatcttgtaaaaatttccaaaaaaacgagacatatgctttaaaaacgcgaaaatggtaaatatgcatttattcttgaaaacgccaatatacatttagacatttcaattattttaaattaaaaaagagtggaatttgcattgaactgacctgtactccattctcggattgccaccagctgcttgtgcgattttcaaaactctgcaaatttacagaataaaaatttttaatgataaaatttactaaaatttaaaaaaacaaattttctttttaataattatttatttattttaactttagccccacattttccaacacaatattctcaatgcgatgactgtgcatgccgccgtcaatacctaaattttaaacgaacaattaaattctttccccagaatttgttcttaccagacgaccatggctggcgcgaatcacagagagagcatttctaaaattaattagttataattattaaaaaacaaatgttttacatcgatttccagatgcgaaacaatgcaaaaaggctgaggctcactaatccctgaaaaaattaaaaagatt

SEQ ID NO: 38830 - DNA, 990 bp, Heterodera glycines
  misc_feature (5)..(5): n is a, c, g, or t
  misc_feature (920)..(920): n is a, c, g, or t
aaacnttgacaagaaattttttttacaatggcaaaaagtcaaatcgcgtctctagttggtaattaattattgaattatttgattttttttttttttttttggttttttcctgagggatctcaaaaagtagatcaaattttttcaaaattctattttaattttatttaaccctatttttaaaattttttacacaatttaaaatttaatgtaaaaatataatttcatataaaaacaaattaattagttaatgctttttcagcacctagagaaatttaaaatttggcccaaatgttatggcatcccactaattatagatttttcataaaaatcctttaattaagtgtaaatatcttcctaaagtctatatttttttaaccgagcagtttcctaatctgcaaattttagaggcagaattttcgggaatttttacggcacccagttacccctccgctgtattaaaaaagcaaaataatatttcaatcaatttaccggttcttcgagcagttcaacaacatttttgcaccgctgttccaaccgggacagtcgctgctccaactgttccgtgtgcatgtgttgttggagcagtaacagggcgaacagcaacaggaacagaaatggacaaatgcgatgcacacaatcggtggagggccaaaggttggccaattttgaatttggcgccatttcgttggcatttgtgtggcattttggtttcatttttgtggcattgtgtttggccgacttggacgtgttgaaaaatgtggtcgaatttgttgtggatgatgaagaagcaaatgaagagctgggaaaatcctgaaatttttaaacaaattcagattgaattttgggtgaaaaaaaaattacaattttaatttttggataaattttctaagtcatttttaaggatcttctttttaaaaatnaaaaactacatggcctgtgtgtggggaaaaaattgctacaaataataaagtaccacgatggtactctaga

SEQ ID NO: 38831 - DNA, 1152 bp, Heterodera glycines
tttcgcgccagagaaattcgccccaatacgagtcaagcattgggcgatgtgtgccgtgttgttttttcacgccacagtcacatgcgcgctctctatggataatccccttttctgctaggaaatgtgctgcggtaaattcatttgttgttttttgaagagtgttataaaattaaagctcattttattatcaatattgggggaaggatcgggttgggaagaatgaggggaagcacccttaggtaacgcgtattgcgctaatttattcataaaaatggtgggaaagcaaatgccctttcgttattttatgcaatgggaataaagattattacaattctacgcgcccgctgttgattttttaaaaattcaaattttcggcctcaaaacggaaaagtaccaaaaacagatagttagtccaaatgaatatgtgtattaggtcgtttctaattatttgcacccccctagaaatggcataacttttgaattctcacattttcttgctgtaattagcaatcattcaaaagccaagtgggtcagaattaccttgatcagagtttcaaatacataactttgtttgttttattttaaaaaatgtggtttactactatgcaaacaaaacaaaaattgtctttttaagatgcccgtccgtggcaacaaattttcccggatatttccttcccacccgacttcgtcaaagagcgcgttaaactcgacggtattttagatcccccattcatttcctagtgcctttctttagctctgttggcccgagacctcctctcccaaatgctcgtcatcgacccaaataatcggttatacaaaaattcaaagctatgaagatcattttatatatactacttttgcaacttattaccctactttttatatctgaatcgaattccgctcgtttttccgtttcaaaaaatctgactcaataattgcctcgactcgctacaacatcgtgtaaaaattaatctttggattacaacttcattttaggatcaacgtgcaagaagcactcaaacatccctatgttaatttggtatgaattctttcttatttcgattaattttttctttttctccagtggtacgatgcgggagaaggttgcaaaaacaaacaaaaatgatcatttaaacgtgaattaagtggatg

SEQ ID NO: 38832 - DNA, 1460 bp, Heterodera glycines
  misc_feature (45)..(45): n is a, c, g, or t
tcacaacattgtcggtctgtttcgctcacactctgctctcgtcgnctgtacggaggccggttttacaaaccgcacggcgagcagtgacaccaggacgcgacgactccgagcgggcgctcatgaccgaccaaacggcattcaaattgccgaaaaagggagtccccctcattttagtccatcagaacacgcccgcgcaacgcgacgaagtctccacctcttcggccaatccgggccaaaccgacacagcgatgagagccctctggcgtttggcgcgggccttcccgggcacactcatccgctgcatttgcttctacgccgcccaagccctggagatcgaacggttggtggcccaacaagaaatcccggacattttagtgacgacagcggacgcgacacagggccacgagtcgtcacttgccgtcgtcgtcacaacatgctccgtcttcgacagtggggccgactcgcagcccttctgggcggacgctgctcgcgtggacgtcgccatctctcgtgccagccatggaatgatcatcattggcgatttgctgctgctcaaccggacggagacgtggcggcgctacctggaccaagcgacgactgagacaacagtggtcggtccggagtacttcgacttcgagcagttcaacaaccccgacaactactacgacaaggacggacagctgatctcagccaacggcggtgcggtacggtcagagcatttctacagcaagtacggtaagaatgtgtggtacaataactccggtgagtcaaggggggcggagaacagatatcaaccttatcttcctcaaggtggcactcgggaacgcactcgtggcaaagctcaaacttctggtgtgcgcagatgaaagaaggccaagctgtacgccttcagccatggacggcagccgcgcttggacctccttctttcttcattcccctccctcacgctctgcaaatttcttttttgttttgattctctctatctcactctctctcttttgtccatttctatttaaaagtatcattcattttgtcttcatttccgagctgttaatggcctttctttcccccaattcaaaattcttaaaatgcgtcggttttcctcacactttctctggcccactcttgctctcttctctcatcatgcttttacatcccatccccaaaccggaatgacccctggttgcttttctccgatttcccatgccatccatctgagatgaaggtggaccgctgttcattattgcaatgcgcagcttggccgtggaagttcggattggagagacgaagggcgaagccgagagtttagacccattcattcattcacttcatttttcttttaaggatcggggacgatcctaaggaaagggggggagttgtaaggattattcgacgcatttccctcatttaattatttcccatttgcccattatcaatttcatcacatttaatcctttctc

SEQ ID NO: 38833 - DNA, 694 bp, Heterodera glycines
ccccttttccaataccatattagtggggttttttgtaaaagtcggtgtattgttgaaagagcgcatacctatgtactgtgatatgtgtacatatagagatagagaaatacatacatagaagaggaacgggacaaaacagtcctccagcaatatttgcaccacccagtaaaatatgagtgtgtttgatgagctgggtcaaggcatatatatgtaaagcaaacggtataatctccggtttcgccaatcttagcgaactttgatgggaaaaacttttcaaaatgaatcgagagaggtaagaagtgcttgtgtgatcagtgatcacatcggaaaacgttgacctatgaactaattattcgaaaatttaatcgggaacagttctagtgtgtaaggaaattatccaatgggaattgatcagagaaccgagaatcacggtgagaaatagagaccgagggaaatgacaaaaacccgagaaatttatcgagccgaaaaccggacttttgactcccattaccataaccaccccatttatctccttcccagtcgatgcaaccaattcaattagcaaattttataaagaagtttcaatggaaatccccgtaaacctaatatataaaagtgtgtgtatatcttttttgcttcattatgttaaattatggaaacttttgtagatatagcacaatttaccgataaatga

SEQ ID NO: 38834 - DNA, 1382 bp, Heterodera glycines
  misc_feature (89)..(89): n is a, c, g, or t
cctttctccccatcttcaccaatttcgtgtattcatttcctattctttgcgcctttaaccacacaacttttgtgccaagaacaatcatntaattttgtcaaatattctgcgagaagccaattaaaatataattttgcattttttaaataattaacatgaaaaaatcaaggtccagattaggcacaaaaacctgctggacttcttggatattaatcaaaaatttaaattgatgaataacaaaaatttttaatttaaggcccaaaatgttcatagtttgcgccactataaaaacaaggattgttttttctttattactgctattattaattaattaccctcaatgttttgtgatgggccgacatcgaatcattgcggcagaggacatggaaacagtgctaaatcgcctgcgcccttctgtggaccgatttgatgccaattttcagcgcacatttaacgaatacggacgtgtggactccgtgcgtgaagtcagttcaaaaatttgttttatttttttacattgtaaattattttaaattatttaatttttaatttaattaataattttcttttctttctcccttatccatcagaagggatttctgaagatttttgactccattttccaattgatttttttgggcaactgaatttcattttaataattttttgatacttggaattcttttttgaaaaaaaaaagtttggacatggaatttcgattccgatttttaattgaaacaacccctcatggccataggaactcaagaacacaaaaaagcagggttttcaacatttttgttacaactttttgcaaacttcacaaaattttggaatgttggcagaataatagaaagaacatttaggattgattatcccatgattcaagaattaaaaaacccaaatccccaagtgataagccaaatttatttggttttctgctgtttctttcagtttcttgaggacagtgtggtgccacggtttactgtggaggagcacggtcgtgttgattttgtggacgcttttcaacaattgcagttacgcattcaacaattttttgacaccaaaattcgcgcactccaccgtttggtgggcgccgctgaaaaggaggcacaaaaagtggacatggacaaagtgatgggtccaacgttgggcagtgagggacgctgccgggaccaaatgagggcattgaacgccagctcagtgcacaacccaagcatttggaagaaaagcaatggaaagacgaattcgggaatccatgttggcattttggggatgaaagtgcttggggacgataagcaattagggcatggaatattcaagactttttgagagattatttaagcattgattatgattttttgaactatcaatttttgggcaag

SEQ ID NO: 38835 - DNA, 1274 bp, Heterodera glycines
cccataatgaggcaattaatacacctgtctggtccgcgaggcgctttcttcgcgccccccgagtgatgtatttcgtgcaccaactcggtgtatgcccctttgtttcacaaaggaagcatatgcgatttgagcccctattggaataggggttcgttgttggattatggccgaaaaggaatgattcgtctgaggagacatcctcattgccgtttcatttccttccactggcctccaccgttcctctctgaacgggcgggagaagcggaacggtgttcctctcccttggttggctctcccctcatttgaatgagggggaaaattcctgggtttttcctctccccggaaaatttgagtacatctctatacttcttctttgacttcaacgattgaagagatagctcttcggagctctgtgcagttaaaggctcctcctgccctcatttccttctccaccacttgggtgagaaggtgatagggcagtttggacttaattgtggaggccatgaacttgttttgttcattttctccatagtccaataactgatggcaaatccgttcaatggactctgaaaattgtctcagagactgaacggattcagctggtttggcaaggtggagcaactccgcttggagggactccaccattgtcttttcatccccaaaccgctttttcagaatctcaactacccttaggtagttttaatctgacggtgggtataagtcaattgctctcctagcaactgacttctctgggaggcatcccagcaaataaatgtgcttcttgaagtcttcaatttgaagactttaaacggaagtctcaaatagcttccaaaacaaaggccattctcggggttcccccgagaatttgggcaatgttatcggcggaagcgtcacatcatgacgctgatgcaccactggtgcctgctgcacaacttgtgctggctgatttggctggggaattgcatcccccagctccgagaggcctaaagcccctccaatggtgtcgacaagccctcgggcttggtcgacccaatgcatgaaggccttgccttctggtttgaagtctctgtaattttgctcttcatcttgaagagcttgtcccttcactctcaggaaaatggcttcccattttccattgtatttctcaagaagagaaattgttttgcagagagtttgtctctctgcaatcagatctgcgcggacactttggtccgtcagctctttgcccaagttatgttgggctgtctcaatgtacatcttgagacgcaccacca

SEQ ID NO: 38836 - DNA, 1423 bp, Heterodera glycines
  misc_feature (1361)..(1361): n is a, c, g, or t
  misc_feature (1387)..(1387): n is a, c, g, or t
gaggaagaggaaaaagagagggaaaaggaagacagggaaaaagaaaaagaggaggagaaagaggaagaggaaaaagagagggaaaaggaagacagggaaaaagaaaaagaggaggagaaagaggaagaggaaaaagggagggaaaaggaagacagggaaaaagaaaaagaggaggagaaagaggaagaggaaaaagagagggaaaaggaagacagggaaaaagaaaaagaggaggagaaagaggaagaggaaaaagagagggaaaaggaagacagggaaaaagaaaaagaggaggagaaagaggaagaggaaaaagagagggaaaaggaagacacgcaaaacgagcacgaggaacagagagagcaacaccagcagcaagttgggcatggtcatggacaggccgcagaatcagttgagacacggcatggccaattcgaaatgagtgccgaggaaagggaatgtctcagctttttcggtatgacttttgactttttgactctttaacgaataacggttcatctttttttttttgatcaaattgtcttcaatgcttctgctgatgaggaaggggaaagtgatgatgatcattatcattatcagctgcgcaatgcgccttcgacttctcatagcgtaactttttcattttaattcaaattaaaatgaaagttttgttttttaaagcaaccaaatttcaccgacattgatcaatatttgcacttcaaactccattctgatcagcgttctttggcaaatgcccttttcaattgggagaaaatgtgcaaaaaagcgacggacgaagtgatcagttcgccaaaggtgaaaaacaaatgtggccattaattgttttcaatttttcagattttgcaaatcatccgcgaatttcggaccgaatatttgctgcaatttgtttccgctaattttgcaattgaatgaacaaattaggcaggaaactgacattactggcacttagcattaaccgtttagttatcgattgattgatttgattagattagcatagcacgttgcccgaacaaatttgtaaattttttattagaaaaaatttaaaaaatcaaatgaaatttaaacttcttcaattttgtttttgatactcttgttatttaaatacatatgtaaaaaaaattgtttttatttatgttagaaaattatcgcgaattttaatttagaatattcgaaattatcataaaaaataaaccgagacctgcacagaaccaaaaaaattgttaccttttggccaaaaagccaaggaataataaatgaatattaaaatatttataattaacatttatattttctttacttcctctcaatcactcagaaatatgaatttttcgtgagactanaattttaaaaattcgaattaaaattntttttcatcaatttctttacattctttttcattact

SEQ ID NO: 38837 - DNA, 963 bp, Heterodera glycines
attgtggccaataataaaatggcataaatggtgaactcttataaaatcatttatcctcgaaaaatcgtgtaaaagcgctctaagttagcccgcattgatttgctttttcattgctttccgcctaacattcaaggatttagcttcattcaaataggacaaaatgaattaattgacaaaaatttgcaaatttatttatgaaattgcaatttaattaaaataaatcaactaagtagagactgggggataaatagagactggtggattataaattttcttggaaaaaataaaaattctatttacccccccccccccatgggggataattggagactgcgggattaatagagactgggctataattagagcatatacggtaattttaaatccaacctttggaccaattgattttttgaattgagtgattcatattaaaaacgcaataaataagatatgaattttgtattaaatcctttttcccaatttgtccagtgactactgtcaagcatcgtactcacatctgaccgcgctgtacgtgacgctgaagttcgacatcacggccggcctgcgctattactacgggcacgaggagcaagtgatgctgtctgtggagcaacaggtgggtagtgaagaaagaatgatttaattagatgccattttgatcacccacccgccctaatcacttcccaattcattcaaggcgtgctgggatgtttttcctaaaaactgccacccatttgcgttaaaaatactaatttaaaatttaataagtcgaatacaaattaaattttttttactgttctttcgagtgttcatcaaaaatacgaactgaccgcataacaaattctaaatataattaactctttaaaatacgggtaaatttctttggcagtttttgaaaacgccctagcaaagtttaggaaacacccaatttgacagtttttgggaaactacctaccaccaatt

SEQ ID NO: 38838 - DNA, 882 bp, Heterodera glycines
  misc_feature (867)..(867): n is a, c, g, or t
ttcacatgacactgatgcccctcaatttgggatgtttttgtatgtcaaatttggcccatttttgcgccaaacattcgccgcttgcaattttacgatggcgatcatttggacaatttgcgtcgtctcatttcaccaacaattcttactgatcttaacattatttcaatcttttcttgtgttctgttccccgatccaatttgtgatgatggaccaaatgcaactgctggccaagcgttgtccaaatggttgcacactccgcgaaaagatggccactcgaagcgattgaatttcttatttactgatgatgatataccaaaagcaaaagaatttgtcaacagtttcaaagaggtgtggtaacagtttcgttaagcaactgattgccatttatttaaatcttttcccattgtttaggcatttctccgtgccaccgacacttcttctgccagctacaaaattcagcttattatttttggtcactcaacgtcaatggtgccatttgaattggtgaatgatcgaactcaacaaaagctgacactgatgagaaaagcaagcaaaaatgcctgggacaaccgatgggaggtgaagcgatgccaaattggggggacgacggcggcggttcagtgggaggacgaaaatgttcaccatttgaacactgtctacttttcgctttgcaaacaatgcattgggtgagcaacaaaaagcacttttattttgttaaaaactcaaatttcacttaatttagggcattgtctccgccaccagcagaacaagaaaaagcgggacaaagcgtcgaaaaagagggacaaagcgtcgaaaaagagggacaaagcagcgaaaaagagggacaaagcagcaaagaagagggancaagcatcgaaaaag

SEQ ID NO: 38839 - DNA, 1240 bp, Heterodera glycines
ttccctgctcccatttccagaaaataatttcagccacttactgagccttcgaatcagtcggattgcccatgtcagtgacttccagataatattctttaaataagttaaagaaaccatttttttggcaaatcgaaactttcctaaattaacatggaatataatcaaatgaacactcattaaacgtgtaaaattacagtgaagcgaattgagacgaatcatagaaaaaatactcaggcaactttggtaaaacatcctttttgatccctttgcatgtgacattattgatagctttttcatcaacaataaaataattgtagtaatttgctccatcacagcgaaaagccattttgtttgtgatgcttttaaattaaatttaaaaatgctaaatatgtagaaattagaattaacaaaagtattgaactgatgggtaaagtaataaaaaataaactgccagatataaaaaggtaaacaacatttgtttatttctttacatatttaaagttgtttgtgtgaatgaataaataggatattccaagaaaatttttagcaaaaactaaatatttaggaaaatttaattttccattttcatatattcttcgtttacagttggtagaaagaaagccgcaaaaatagtcactaaaattgttaaccctaattattgcttaaataatatatcgcatcgaaatttgcaaattacatttaaaacttgattcaatggtataaaactgcattttactgacaaaggaaggtccccataagcacaagtgccgagttatgacgtgccaaacctttttagtgaataaataaattaaatatttatcttcgctttattcgaatgtccaatggtgtaccggtagtgcgccagtcagcccgacatgatattttgtgcatctattacatctttatgtttaatgatgactaatatttaatcatttactctttttctcactgtctctattctttttctgctctccctcttctttgcttatagccatatgacaatttgcctggggcggtccttccctttgtctcctccccaatatgcttgtatatgcttttcctttgtccaccctctcttccttacctggccgttggatccggatcccgaccccctcccttccccgctccgaatcggggaagctcacctttgttaaacatgtacgttcggaataaaggatattattccacttatcgtattttctgtggtgggcttatcaaaggtacggtaacaccataatca

SEQ ID NO: 38840 - DNA, 1832 bp, Heterodera glycines
aaaaaatatttttacgtattttggcgttttcccaaaacatataacaaaaatgcaataaaaacgaaaaaatatacccctaaaaccgatcgcttcagaaaaatacatctctaaaaatcgacataatttttttccaaaaatacaaccctaagaatggaccaaaaaatttctgaaatacacatccataatatgaaactttttgttacctattttccattttagcaactattttaggagttttttagaaactaaaaactaactattttggcactcatccctaattaacatatttttcagtccgatgaatggggtcacgaggacgttgaaatgggcaaatgtttggagaaaattggcgtcaaggctggcgattcgcgtgatgccgaagaccaccatcgctttttcccatttgtgccggaaactcatttgtccccagaccatatggacaaatcattttggttctggaaatacatttactatccgatggaagaagtaggacgaaaaaaattataatttaatttaatattagattttgggatagctattttaaattagaacaaatcgtttttttattactttgtaaattgtacatttaggggcccaactgttgcagtgattatgccatttcttttcactatgttcagccgaattcgatgtatagcgatttgaattatttaaataattaattaattacaggtactcacttgaatatttggtttaccatttacatctattcggcaatgaaattgaattaaaggacaatttcgaaaaaaacaggctaatttattgaaaataaaattatttattatttttttgttgtaaaataaattttcaaaaattagtttaataaatcgaaaatttttattatttgaaacttaatgaaaaagcttaaactttttaaatgttagaaaattaattaatatttatttatcacaattagacttaagtattatttttgtgtataattaatttagtgtcggcataattctacgaaatgcttacaaattggcaatacaaaacattggtgctgatgatgtgttcaagaacaacgaaaaaactatcgatgaacaagtggacaaattgatgggaattaacggccaacaaccaaattgtgggatcccgtttggacaaagtcattatttaatttatttaactattatttttatctttcattatcttgtataacttttctctctttacaaatttattttcccatcccaaccaatgtgttacactttgctacaaacccaagccaatttgtgtccttcccaagtcactccctcattcatctgctttttaaactgaactgttccctcatcgcttttttcctactactcgaaaaaggctgaatttcgtgttatctcaatttatttttcttgaagtcattgttagctcttttctttatttataagtttaagcgttcttttgttgtaaagaagatagctatttaccaagtaaaaaataaaaaaaatgttggcctaagaaacttagggtcggcattgaatgaacgcgtaaagagtagaaacaaaatggggtcggggtctacgggaatacgaaatatatggaatgttgtgggggattggggatgggccaaccgaagatgtgttgtccgaatgttgtcaatagttgggataaatatttattttaaagtaaattgggaaacggcggaagaaatataataaaaatggagggacgatgaatttagaggagaactgcagcagaagattaaaacataaaaactgaacaacacgaatgagaaagaataatgaaaagagggatcaattttgggacgaattgggaaattgtcaaaataaatgatcgcggtaatacaaatatat

SEQ ID NO: 38841 - DNA, 1787 bp, Heterodera glycines
tcaataaattttaaatgctttcctatagatttcaaaaccctctaagcacattggcaacaaattacagtattcttctgtgctattaccgtacttaaaacaaattacagtattcatttcctattgctaccgtaccctttctgccaattgcattttgcactgtcatcttcccttcagcgctgctgctgctcgtttccgtgtcattccgtcgatggttgtcatgcaaatacagttccccaccatcgttgaattggcgcagcgacttgcccaaaataccgtagcgatagtcgtcgtccgaactgtccacaacgcttacacgacgcttactgtattcattagaatcaattggagacaaatttcaaattcaaaagtttcaaattatatatcgcgatgcccaatttaacagcaggaaaaatattttgtgcccgattttagttggggtttatttgtgctaaaaaccctcaaaaatgccaaaaaaaaaagtgaaaaataaatgaaaaccctaaaaaatcttcaaactgatttttttctttaaaaatacttaaattcagcagattcaaaattatctccactcattctacaaaaaaatataaaaaaagataaattttctcaaatttttgtcaaaatcaacaaacaacttttcgccaaaaatttgtaacgaaattatcaaatttgaattttgactttgcattcagttcataaaacattggcaaaacccatatgatcattcactagcagagttcccaagtttttttttttcaaaataagacaaaatggcctaaaaactaagattctgaccccaaaaataagattttttctaaaactaatatttgcgtgaaggaaacgcaataaaaacatgaaaaattgacttaaaacataaacatgtttacgttttggtggcattttgtgaatttcactcaaaaaatgaaataaaatgtaatttttttttaaatcaaattaattcaaatattcgcttcagaaaaaaatgaaaaatcaaaatagtcattcaaatttttcattttttattttcaaatccaaaaataagcacaaaataagcacgtaacgctgaaataagcacaaatcttagaaataagcacatttttactttctaagatccgacccctcaaaataagcacaaatcttagaaataagcacacttgggaactctgttcactagtcataaaggaaactcctttattgactcaagaaatcggcaaggaaaaactttgccattaaagaaaatccgattcgaatcgccacaaatatattaaaaaattaaattttcaatttttaaaagtctcctcctcactttggcacatcgtcgccttttaagtgtccgtcggcggcgtagcggcgcaacgctttgctgagaatgccgccgcgcatgcgcacctcccattcctcggggcttagcatctgagtttttttaatcagtttgagagtttaaggtggcatgggaccaaatgccacaaaatttaatttttttttaaattattattaactcgtcgcgttgtggtggtggtggtggcattttgcgatgaagtcgtcgacgtcacaattgcggacggcacagtgacgcgcagtgccgtgtcactggcactcacaattttgtcaatggacgatgttgtggcagtgtcatctcgtttgtcggcaatttggttggtggtgttgctcggcacagtttctgacgatgatggcaccacaacaacggcggccggttccatcgctacggtggtcgccgccggcacagtgtcgccggtgccacggtcacccgtgccgccgccactcgg

SEQ ID NO: 38842 - DNA, 644 bp, Heterodera glycines
ttgtactttataaagataccaaaaagataggttttgttcgaacatgaacaaagttattgtataaaaatccgggattttcaattgattggactcataaaatactgtaagagaataaaaataaaataaataattatttttttttagtaaatttctcaaaaattcgttacttttccgttttgtctccccattccacacccttttatcaggggaaatgaaggggagaaaggtgtaaagtaccccaaattttccaattggacggaacgaccttgaaaatttgcaaaataattttgtaaaattttttaatggcggtgcaattataaaatttgctaattagctaattaattaccttcgaatgacatgataagaaaagaaagaaaaaaatggaatgaaaaggagctcatcaaattgtttgtttattatgtatttgtacccgaaataaaaaaaaaattgatagagagagagagtgcagcagattgttagaaaaaaaatagaagaagagagaaaagtgaaatggagagaaaaaaaggaaagagagagacaaaggagagaaagaaagagagagagagaggagagagagagagagagagaagagagagagagagagagagagaaagaataagagtgaaaagagagagagagagaga

SEQ ID NO: 38843 - DNA, 867 bp, Heterodera glycines
ttatatcgattttaatgcgctaggttcgatgaaactttttaaaatataagcctaaactttttggcctgtttaaaaaggaattaaaaatttttaaaaattttattcatctcccttttgatagaaaaagcatcagagtgccttgattaacctgtaaataaagttttgtgtgtttcagagcactttctgaaaaaatacttatgaattaattttgcaaaaaataaataattaatgaaaaagtcagaatttcgaaaaattttaaaaacaacaatcgttggcattttttcaggttaagttagtcctttacaatggagaaggcctgcaaaatttggagagattatatcgattttaatgcgctaggttcgatgaaactttttaaaatataagcctaaactttttggcctgtttaaaaaggaattaaaaatttttaaaaattttattcatctcccttttgatagaaaaagcatcagagtgccttgattaacctgtaaataaagttttgtgtgtttcagagcactttctgaaaaaatacttatgaattaattttgcaaaaaataaataattaatgaaaaagtcagaatttcgaaaaattttaaaaacaacaagcgttggcattttttcaggttaagttagtcctttacaatggagaaggcctgcaaaatttggagagattatatcgattttagtgcgctaggttcgatgaaactttttaaaatataagcctaaactttttggcctgtttaaaaagggattaaaaatttttaaaaattttattcatcttcctttggataaaaaaagcatcagagagccttatttaacttttaattaacatttggtgcgtctcagagcacgttctaaaaaatatttatg

SEQ ID NO: 38844 - DNA, 908 bp, Heterodera glycines
ataaatcattcaaaactcctcaaatctgtcctcgcaaacttatatgccgatttgtaagcactgtattctcagctcatcgccgactccaatcggttccgcttggaaatggctcgtgtcgtcgggtcccttcactttcggataaagcgcttcaaacatgcggcacggatcgccggctgagggagcggcggaggcggcggcgctggtgccgcacattgtggcgggagggacaaagctcggcggacagacctaagccaaggaaattgacggggaaatggcacggcactgatcggtaaggtcgagaattgagagtttggggggttgagaatggatccgagtgctttttgattacccttttttgaagcacggcgacccaatcgaccagtgaaaaccatttgtgatttttaatgtccgttggccctccccgcaaattgccataacgttttgtaaggtcaacttggagaagattcttcagcaaatccctcagatcggaggagaaatgtggcgggtatttgacctaaacaacacaaaaaaattgaaataattaatttaaaacaattaaaattaaattattttattggtttatacttttccagaaacaattttctcgtaaatttgaattggctgttcggcaaaaaacggtggataaccggcgaccatttcataaatgagcacacccaaagcccaccaatcgacggcctttccatagccctaattaaatggttattagaataaacacaattgccgatttaaaaaaacaatcaagaaaacagactttgctcagaatgatttcgggtgccaaatattcgggcgttccgcacatgtccacgtccgtcctttgacgcgctttgcgaagccaaagcccgtaatctgtgccaaaatgtaaaatcaattaagtaattgacaaggaa

SEQ ID NO: 38845 - DNA, 789 bp, Heterodera glycines
  misc_feature (19)..(19): n is a, c, g, or t
tatctgtcatgggtatttntggagcaattaaaaacgatcaacagtaacgtctcaatttctccccccgacttaccccaatttgcattttccccgtctccacctcccccacccccggatgcttccccgtaaatctgtcgtcttttcccgtcgtctccattaattttgccctccaccccccccccggcgctgttttttccgtttttttccatcacaatttttttaattttgtttttgctccctcaattcaccacaaattatgcattcattcattctccatctccacacatattaatatgttgatcatttttgcactctcactcattcattttgcacaaaaaatggtctcaaaaatctctgctgcggcggcggcggtttgttggacggacggacggacgacgccattaggggagagcggcgaggtggacgatggacgatgatcacagccaccgacggacggctgtaaaaatattacccccaaatccctcagagccccgcctccctatttttttccctcaattttgaggatggtttgtgaagatgatggaccacacaaaacacatacatatacatattatgtagcataatttggtgcgcggagattgacgcggattttattgctgccggtgccctttgatcttttcgcccattaatcgccgcgcggcggcgttcattcgctgcgctgtgcagctgcgaagctctccccccagccccctcatggcccccgggtcctctcctcactccaccaaccccctctcacattttctcaaacattacttgccccccacccct

SEQ ID NO: 38846 - DNA, 943 bp, Heterodera glycines
gatttttgggaatggttttcaaatggttagcacatttttaactgtatttggtcaattttaaaattataaatttcgaaatactttcaaaaatccgagttttctaaatatgcggaaaagaattgtcattttttaaaataatcataaatttgtacatttttaaaacctgtactcctggcggtttttggcctttaaagatggaaggaatcatgtttgtttggatttggttttttgttcggaaaaagcgggtaaaattcagggaatgcgaccggatgggatgtgatgagcggaaaccacgttgactttattttaaaatatttgtatcaatgacgcattttccggtcacgatcacatttgcacctgcaaatgtgatttttttcttttaaatataaaaatttattttttctattcccaaaattttttaaattttgtttttaattatgtcaaaatggcagtcaaaagttttcaaaatcataaaaatacattaaaaatgaaaatctaacaattgccttatttggcattatgtcttcgtcatgtctaaatttgtgtaactataaagttaaatttcatttttccattttctcgatcccttcattaattttaaattatgtatgttttcgtttccccccacggaaaaataaaaaaaacattctcacacctataaatttgtaaaaaaaaccttaggaaattttttatcagaaaattcaagaaaaaaatttttagaaaattttttcagcgattttttcaaagttttatgatgaattaataatttttcttaaaaaaaatttctaaaattcgctgaagaaattttttaaaatttttcccttgaaattttatcaaaaatttctcaagattttttttcttgaaaattttctagatttgagaattttttaatttttttcccgggcagaaacgatgcgggggaaactgatttggagaaacggtg

SEQ ID NO: 38847 - DNA, 1090 bp, Heterodera glycines
aaaaaaatattttttttttttttttgggggcaatcccccccgaacccgatgcccccaatttttatggggagaccgatatctttcgggaataacttccctataaccctgtacttaatttatgcgttggattttttgctccccattattgtttgagtcccccaacgggaccctgaaaaaattgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttccggagtagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataaatgtttgagtaccccaaacggacacttgaaaaaatcgatttttttgtttcataaatatttttttcagaaccgatgtgctctaaagcgcaccaaattttatttacaacttaattttagcactctgat

SEQ ID NO: 38848 - DNA, 928 bp, Heterodera glycines
  misc_feature (783)..(783): n is a, c, g, or t
aaatgcagtggggcaagcacagcgagtcgcttaatgcacaccctttgacacgtaaaatattccaaaaaaagagatagtgattttttctggattaggccggagaaataaaaattaccagctatttgaaatgcagtgggaaagcacagcgagtcgcttaaatgcacaccctttgacacgtaaaatattccaaaaaaagagatagtgattttttctggattaggccggagaaataaaaattaccagctatttgaaatgcagtgggcaagcacagcgagtcgcttaaatgcacaccctttgacacgtaaaatattccaaaaaaagagatagtgattttttctggattaggccggagaaataaaaattaccagctatttgaaatgcagtgggcaagcacagcgagtcgcttaaatgcacaccctttgacacgtaaaatattccaaaaaaagagatagtgattttttctggattaggccggagaaataaaaattaccagctatttgaaatgcagtgggcaagcacagcgagtcgcttaaatgcacaccctttgacacgtaaaatattccaaaaaaagagatagtgattttttctggattaggccggagaaataaaaattaccagctatttgaaatgcagtgggcaagcacagcgagtcgcttaaatgcacaccctttgacacgtaaaatattccaaaaaaagagatagtgattttttctggattaggccggagaaataaaaattaccagctatttgaaatgcagtgggcaagcacagcgagtcgcttanatgcacaccctttgacacgtaaaatattccaaaaaaagagatagtgattttttctggattaggccggagaaataaatattaccagctatttgaaatgcagtgggcaagcacagcgagtcgcttaaatgcacaccccttgacacgt

SEQ ID NO: 38849 - DNA, 551 bp, Heterodera glycines
aaacaaatttttcctttattttctcttttttattctcttctccgattgtatcaccctttagttctgataacccttctatcgcttacccccttgaggttttccttctgtatgcggtattcccatccaactcactaaaaaaagaaactggccccgaccatgtcaatgggcgctgcgtgttcctatagaattaaaatgacagatatgtgccagatacttcaccttgcatgacaaccattatctttattagattttatagattatacgaaaactatcttgaaaattttatagtagagttttctcaatcagagttttcattcataaaaccataaaatcccggatggcttagcttttcttctcaatccaatctcttctgttccattttggcatttctgtttgtacacacacacattatatttattattttttttaatgacaatgccttagagccgcttaactaattggcaaaagactttatcaaaaaaaaaaggaaaatttccaagcaaatttgatcttgacaagattatatctcgtagttggagaggggggggggg

SEQ ID NO: 38850 - DNA, 633 bp, Heterodera glycines
ttttactgtttttggtaaaagtccatcaaaaatcttgccttagctccatgggcatttaaaaacagcagccgtaagaacattatatacttacgccggccttttcttcaattggtttcagcagcctgcgcaacagggcaattgtttttcccgagcccgacgaatgggtgatcagaaaaacgatgttctgcaaaattgagaaaaggtacatgaaaaaagagggaaggggtgggattgttgccgccggcaaaagagaaataaatcataaaaattgatcattttaaacaaaatcgactaagaagcaggcatttttcaaatttttgctctaaaatgaaattttttattgaaacattgatgactttcaatggtttccttgtactagtatttaagccggttttgaaccaaaaatgcgtaactcaaaaatttaaagtttcggtctttgtgccaaaagcacacctgtgccacatttttgtgcagattgctcagaagaccgttgatgcagtaattgaaggaagcgtcggcacggttgtcgttctctttcagcacaatgccgacgccgtgcaacgcatcatagccacggaggtagccgaacgtgttggccatgttttggttgtccatttcgatgccacgcgtgtc

SEQ ID NO: 38851 - DNA, 907 bp, Heterodera glycines
cagccaagcgcaatggtggcacacatttttccgcccactgatttcagtcggatgctcctgtcgcgaaatgcgccgaaccttttgaggacggtggagagtctcaacgcgggatacctctttgtgatactaaccaacaaatagagcactgattttgccgctcattcataccttcacacttttaattgttttagggaatagttcatagtttattttatttgttttccctgctaattctgacatttcctattccgtgattcggtgtatataactgtacgtttaatacatttattgtatgacagtaatttaaacaattcaaatgataaacctaagaatgtataattcggaggatgcttcaagtggactcactttgagagtctgtaaaatacgctaaattggcgaatattgttgtcgttggtaatccgtccattataaattcatttatgtgtgtgctgtgtgcctccgtggataaatgaattatataagaaagggtcacaaaaggttggggcgagtgagtattatttcgaaggagtgcctctatcaggggaattgggaagcaaaaattacgccgcggggcactatggacggagcctaataattggaattaggaagagcttggagggggggaattactgcccctgggatttgggccatcttttggcattgttttggcaaaacgcttttatatgtccatctgacggagaaacggcatttctcgagaagcgcaaatgaccattggcaaaaaaagacgatttggcacagtccaaaaaaatggccaaattttccgctgtcgccccccccccactgacatcggctaacataaaaaagccaaaaaaaaggtaaagacatgcagtgcaaaagggggggggagtgaatggtccgtccgtccatcgtcccatgacagttattt

SEQ ID NO: 38852 - DNA, 994 bp, Heterodera glycines
aatttctgttaataaattgcaatacaatttttaagaatttgccggcgccacctatcggcaccgtcggaccctaaaactccttaattttcttgaaaaatttgctcaaaacgcaatttggacaattttttgacaaaaactgttaaatatcgcattaaaaatcccaactctcggaggtcaattctcgatatcaacagaatcaattcgacccaattttggttgaccgaccaatatttttcgtcaatgtccggccgagagtctaacaggtcgtcgccaagtgtgtgcaatttggtgaaattgatgcgcaaattggttatttttaacagttccgcaatctccggtgcgtatgggtcctccgtgggaatgtgaggcgaaatcactttgtaaaccaactgaataattattgttagtttgtataccgtatttattctattattagacccggctctttattgttcgaccccctcaaaggggggtcttaaatccgtgggaggggggggggggagagtcgaaatatcgaagaaataccgtatattgttttatggcaatgaatggcaattttttaaaaattaaaaaaattctgcacctctccgccagttgccggttcaaaactgctatattttttggtacaaatgacatcattgtgctttctgggaggcccctcgggaatgctgaaactcgattttttttataatatttatttatttaattttttttttgcctacttcgggaacgaggccgagcaatcataggcgaaatagcggtaaatggtcctgaaaaggcaacaattatatttttggccattgtctctaaattttgatgaatatgtaaatctggcggaatattgcctgttaagttttttataccaagttttgccaaaatccttggatcgctcaatgaacattgctgctggacgaaatgaacgaaaaatcatgatcagatgggtgaagtgaaattctgcctccaaggcaagttgaattgaaacattctgcagaat

SEQ ID NO: 38853 - DNA, 510 bp, Heterodera glycines
tgaacgggagcgctgatctgagcccgccttcgagatcagcgacccaaaaaaccccttaaaacttattttaattaatttcaaaaacatatttatagacatttgaaaatgtatgtgaaatctgtcaggtaaactgaacaagtaccgaaaattcaatcctaaaatagccaaaaaccggtcatttttggccaaaaacgactatttaatgcccagcaacgaaaattctagaataacactggagaaaaattttaaaagaattttggaaaaaaattcgagtttcgcgtttttttgaaatttcatcgtcgtagggggtgccgagaagtccgcgcaattaattgaaccaattctgataactccagggaaacgcaaggtgcgaaatgatgcccaaaaagtgtggcgaaaattaagggaccaaaaaaacgacattctgccgaacattgacaaacccaaaaacgaagcccttctcatagctgtaggcagccacagcagcagcggaaatctgaaaaaggacag

SEQ ID NO: 38854 - DNA, 1060 bp, Heterodera glycines
  misc_feature (959)..(959): n is a, c, g, or t
atccgttccggagagcctctgcaaaatttttccttaccctaagagctgcggaaattgtgaattaattctcagaaaaatggctatctctttataggacaattttctatctcgtaaccccgatgctaatccgttccggagagcctcttcaaaattttttccattaccgtaagagctgcggaaattgtgaattaattctcagaaaaatggctatctctttttaggacaattttctatctcgtaaccccgatgctaatccgttccggagagcctcttcaaaattttttccattaccctaagagctgcggaaattgtgaattaattctcagaaaaatggctatctctttttaggacaattttctatctcgtaccccgatgctaatccgttccggagagcctcttcaaaatttttccttaccctaagagctgcggaaattgtgaattaattctcagaaaaatggctatctctttttaggacaattttctatctcgtaaccccgatgctaatccgttccggagagcctcttcaaaattttttccattaccctaagagctgcggaaattgtgaattaattctcagaaaaatggctatctctttttaggacaattttctatctcgtaaccccgatgctaatccgttccggagagcctcttcaaaattttttccttaccctaagagctgcggaaattgtgaattaattctcagaaaaatggctatctctttttaggacaattttctatctcgtaaccccgatgctaatccgttccggagagcctcttcaaaattttttccattaccctaagagctgcggaaattgtgaattaattctcagaaaaatggctatctctttttaggacaattttctatctcgtaaccccgatgctaatccgttccggagagcctcttcaaaattttttccttaccctaagagctgcggaaattgtgaattaattctcagacnaatggctatctctttttaggacaattttctatctcgtaccccgatgctaatccgttccagagagcctcttcaaattttttccataccgtagagctgcggaa

SEQ ID NO: 38855 - DNA, 1146 bp, Heterodera glycines
ctgttgcctacgttccttaaaaaaataataattttgctcttctaagctaaaatttacttttattattaaattgttttttcattaaatacaaattattgcagaatttattattgtaattcggcaataacgccctacctatttaatattcttttgatggaaattagctaaaggacgtgcaatttgctcttttggtaagacataataaaaaatattataaaatatttttatttaatttaaaaaaataaaataattatttacaaatattttttttactaattttataaaattaatcaattaactaataaacaaataaatatatcaatatttttattatataaatattaatgattttaatgcacttaaataaaagtttccaaccaatttaaaagtagttttaagatttaaaaacatggcatccgattacgatgaggcggactacggtatgtgttgtacacaaatgccacaaaatccgggccacgaacactttgttcgcccactaactgaacttgaacacggacaacacaggcaacattggacgacaactcacaccgaggcaatgtacggtatacattaatagggaatggatgatacggtatatggctgtttagtatggtattaggactgctggagaataaaatttctaaagaaatgaactaagaattgaacccaatacgcgagaaacacgaaaattttctagcgttttagagtgccacgggaccgggacctggtagcggacaactgagtacaactgagtaccaaggtcccggttttgaccgggaccgggactagtcccggttttttcccggtttcccagccaaaaattcccggtttttcaacccgaaaaggtcccggtccagggcttgcccaaaattcccggtcccgtggcactctagttgaaagtacacaggtatggacgcacaaaaagaagccgacaaatgatgtcagtgttgaacagcaatagcattgtcataaacagaacgccaacaacagtcaaattggttggggacgagccaaaacaacgacagtatgccaacaacagctgtaacaatgaataccatctggtacggtattatttgtagtaaatttttcaattattttaggatactgagtttttcaatttttcaaaagtacatccctatgaatgac

SEQ ID NO: 38856 - DNA, 194 bp, Heterodera glycines
catttttcataacaaatattggcaaaacgcaaaaatagttgataatagtttttttttaattttatagttttttagttgttaaaaataaaaaactagaaaatagttgctaataactcgaaaactatcttaacacaacccccctaaaaaacatgttttcgtgtgtttcagtctataggcagctcagaaaaaaatag

SEQ ID NO: 38857 - DNA, 866 bp, Heterodera glycines
ggtccgaagcttattccttgctcatttgactgaattgtaatctgttcaataattcaaattaatgaatttaattttaaccaaattttgtgttttaattaattaattttatttgttaatttaattacctaattactttgaatcaaattttattaaagaaataatttagtttgtacctaattttgagaatttttattatttaattttaaagaaaatgtaaattaaataatttaatttgaataaaatttttgaattcaatttttctatctatattcagcatttataaatctgggccttgatcattagtgatctgtcgagagtctttgtttcgggtctcgactcgggtctcttgatcgctcggtcctgattcttcgactcgttaaaagtttttggaatccaatatcactgatgaatagggccgcaacttttagtgaaaaaattaatttaatttttaaattcgcgaaattgtttaaaaagtttacaaaattttttgtccaaaattttgtcttttattgcccttatttgctcatttagatcctcaaaaattatacagtttctcaaaaggttaaatagatttacttgtaaaagattagtagctaagcacaaaagcagtaaaactgaaaactcatttattaatagaacaataaaacaatggaacaatcttgactctgaaattacggcatcatcttccatacgtagttttaaaaacaaagttcttaatgggttaaagcccgtaaataccataaaatatttacattgcatgagaaaaatatttttgattatttataactgtgtttcgttcgatgcttgtgatctgactttattttttcatgtgtgatctccatttattattcttgtattcaccgatc

SEQ ID NO: 38858 - DNA, 928 bp, Heterodera glycines
aaactgaatatcataagaaaaatctgcttcattgaaacctttgtcagagtgacttgaaagtgccgtaattttccggcacgattctgttcccgctcaaactgagaaattataacaaatacagtaaaaactttcattgtattttttgtacagtaatcgtttttttttcttactatattaataaattgtctttcttcaccaatgtccacacatagtcagtgctgcagttaaaacagttgtcatcattgctgctggcacagtttcgactattgccaataaaaccttcagaaaaattttcaaataaaaaattggctaaaatttccattgggtttggctaaaaaagcaataaaaatattatttcaaaatcagaaaattttatgtatcgaaataggaaattcaaaaattagaaaaaaagcaactaatttcgataatttgatttataatctctttttgacttattctttactttgataaatttttgtcattaatttttttttaaattttccttataaattcgatatgaaaaattcgtttccaaaataaaaaataaagataaagataaatgtgaatattattattattattattgttaaatatttaccgataatttgatagccattactgaccaacatggacagttgcacttctgcattttgcaaatcggcaatggtagcgcttacaattcggacagctggcaaagaagggaatgggcgaggtgccattgcaatattcgtgaagaaaaaagtcgagaagatgaataaaaaatgccaaaacatttccataagcaatttttcttttatttttaaaatattttttaatttgtgaattatttttaaaaaaccctgtcaaataattcctttatattttaatcaattttagatataaaaaatttgggtttttgccacgatcaaaaacaggaaaatcaaggaaa

SEQ ID NO: 38859 - DNA, 942 bp, Heterodera glycines
ttttgcaggaaactgctgagaacactacaaatgcatataaatttcataaatttttgcctggaggtacacagttcttcacacttaccacacaagtattatttttcgaaaattatttttttcattttatcacccaacgttctagactgatcggaagctcacccaattttgcagggaaactgctgaaaaccctacaaatgcatataaattttcataaattttttgcctggaggaacacagttcttcacacttaccacaccagcattattttttttaaattatttttttcattttatcacccaacgttctagactgatcgaaagctaacccaattttgcaggggaactgctgagaacactacaaatgcttataaattttctcagaattttttgcctggaggaacacagttcttcacacttaccacacaagtattattttttttaaattatttttttcattttatcacccaacgttctagactgatcgaaagctaacccaattttgcagggaaactgctgagaacactacaaatgcatataaattttcatagaattttttgcctggaggtacacagttcttcacacttaccacaccagcattatttttttttaattatttttttcattttatcacccaacgttctagactgatcgaaagctaacccaattttgcagggaaactgctgagaacactacaaatgcatataaattttcataaattttttgcctggaggaacacagttcttcacacttaccacacaagtattatttttcgaaaattatttttttcattttatcacccaacgttctagactgatcggaagctcaccaaattttgcagggaaactgctgaaaaccctataaatgcttataaatttattagaattttttgcctggatgaacacagttcttcacacttaccagtccagcattattttttaaatta

SEQ ID NO: 38860 - DNA, 1023 bp, Heterodera glycines
aaaaaagtcataaaaaacgccaaaaagtcacggaaaataaaaaaaaatcatgaaaaaatagtcaaaaagtcaactaaaaaatagtcacaaaaaaggtaaaaacttgttttttttttgttttcgtgcgtatatataataaaacgattaatttgattacaattagggccgcgaattttagtgacgaaaaatctcgaaatagttaacttaaaagtgaggaaaaaagtcaaaaaaattttaatcagtagcaaaggaatgtttaaaatttttttttattcaatttgttaaaaatatttataaaaaaagtaaaaagcaaattaatttaggtctctgacaatataaacaccgcgaaacaactttctgcaacatttttatgcttttttctgtcaaatttgttgttcacaattttgtacattgtcatcacattgaatttggtcactgaagcctatcaaatcagtttggtttatgcctgtggaaattggagcatcgcaattctttgtgtggccactgaattcaccataatgacgtaatgaatttattaaaataaaattaaaaattattaattaatcttttataatttaggcatcatccgttgctgcaacgacggttgaccaatcttttgaattcaattttttgttttagactccatcgggtcgctccaaattcagaaggtctgcccaatgttgttcacaaaaattgtgatgtagaactaaaaggtaactcgcccggtgggactcgaacccacgaccccagcaatccgtgccgtgctctaaccaactgagctacgggcgcctcttttagaggttctctcaggtcctttatcccactttctcccacactccgttccttctggcatcacagtgaaaatgaaatgaatgaccacttcagaatgctgcaacaatgttggaataaataaaattcattaaaaaaatgaatttttttgtattgtttttaccttttttgtataaattctttttatttaaatataattaaaagctagtggtaataaaacttgaaaataaatat

SEQ ID NO: 38861 - DNA, 616 bp, Heterodera glycines
  misc_feature (53)..(53): n is a, c, g, or t
  misc_feature (60)..(60): n is a, c, g, or t
  misc_feature (65)..(66): n is a, c, g, or t
taggtgctaataactcgaaaagtagtcttaacaacatcatttaaaaaacatgnttttcgngcggnncaggccacggggactttcaggaaaaaaatatgtaaaaacctaaaaatcgaagccctattaatgacacttttaatgagtcccaataaaaatttaatcaatggaccattttttgaagaaaacgcttaaaacccataaaaattcaattcaattcaacgttatgtcattttgcctttttaaggccttttgttttctcttcacgttttactcatcgctcttttgaagcggcgtccctctgcatttttcttcccaagggaaattaaatgaccaaaaaagaaatgccgcatttaatttgcttaattgattctaaattaatgtttttcaatttttctccaccatttttctctccccttttatctctccctctactctctctctccctctcatctccctctactctctctctccctatcatctccctctactctctctctccctatcatctctccctctactctctctctctccctatcatctctccctctactctctctctccctatcatctctccctctactctctctctccctctcatctccctctactctctctc

SEQ ID NO: 38862 - DNA, 666 bp, Heterodera glycines
tcctttttaacaaacaattcaaaaaaaaaaaaaaaattcctaacaattttcaaaatttgatgcttttagggcgaaaattttaaaaattcggatgcaaaacttttaaataaaataaaattctttaccaatgccattagaaaagtgagcaaaaggatggccacagagtgttgggcaccaaaaattggcattgtccattcccaaaacagtgccaacaaaagcatggaaacggtggacatggccaaaaggacgaggatcagcggtggcttttcaatgcgaagaccgacgcctttgtgcaacacactgtagaggagagggccgacacatgcgagctgaacagtggggtggcttagaatttttaaaatttaatttagcaaatttttggcgggcgaaattatttttttaatttagcgaaaaaagtagcgttttttatattttttaaaaaccaaaggtgggacaattaagttaatgagtgaaaaattgttcacatggggttttttccgtgttcttgatcacgaatctgacatgaattttcgattttttttcaaattctgattagaaattcgtcaaaatcaggcccgtagccgggcggggaaaatgggacccacgcgtttcggcgccgaccgtttcggcgccagaccagtttttggactataacttttttctttg

SEQ ID NO: 38863 - DNA, 779 bp, Heterodera glycines
  misc_feature (63)..(63): n is a, c, g, or t
aggcggatggtcagcgaccaaaaacgggatcattttcaacttgcgttcccagatcatagacanaagagcggtcatattgcagaatttatcacgaattgagagattggaatgtttcgcttcaaacgtaatttaaattttaatttattggattttttaatttattttaatataataaataattcaacatttttaaaattaaaactatttttttcagaaccgcagtggtcgtggtaactttcgtctgcggtataacccaatggcggctgttgaactgaccctgctcgggaatcgtcttgaggacagggctcgtaaacaccgggtggccataggcgcatcgacgtcagcatcaactgtgaacgaagccaacgcgggcgagaatggtgagggaggtagcggacaaaaccagaacggtgagttttaaaaatgtgcataaaataaaataatatatagaacaatcaacaccgcgcacttcacgcgtgcctttgtcggccatgggtattaaaataatcacatttcaatttttatccccctaaaaaatagataatgttgtcgctggtcaggctgtgcatcaacctcagatgttggaaggcaaaatggtgaatttatttaataaataaattaataaattattttaattattttaataatattaaattttagtcgccttcttttgggcaaacaattgagcgtcatatggagaaatcgcgtcaccgattgctccatgacgagatggtccagagatcggtacagcagcattttcaacaccaacaacaacagct

SEQ ID NO: 38864 - DNA, 1167 bp, Heterodera glycines
gctcatgtcagcccaatgtttaggcggagcaagaacagcgggcccaggggcagaaaagtccgttggatgtgaccaccagcgaacgcttcagccccaaggcattgcacgaatgttgcgcggacgcattcaaacggctgaaacagcactggccagaagtgcgttttgctttttaatgccacaaaagcgttttttcattaattttgtttccttagttttatttaaatgaaatataatattttagctgaacccttttaatctgttttggctttttgttaaggttcgcgctgccttcaccctttacattggagtccgcgaaactgaggaaatccttctccagccaatacgaaaggcggtggccaacgcattcggcgcattgaatgcatttgctgaacgacattatgacacagagcaacgccaaatcatttctgcaccaaaccaagaacaaatttggcttattttgaatgcctctgcctcgatttctttgcattaaattgatccttaataattccattaatatatttcccataataggcaatggtaaagttttgtggtttcttcgaaaaataaatttaaaaatttaagaagcacattttctaggctgaaaaaatgcgctgatcacgaatctgagctcggattttgcaaaatcattgattatctatgattttttatcaagtacttgacttttacaaaaaaatgtgtatgtcggactattatttgcgccacattgtagaattaatgctgatatcctgacatgtcccagatataactattgtttctttccataccttcttgtacagctcgagctgctctttccaatggacttatcccggtctcgatccgtgccgaactcacaaagttatggagtgaaatgtgaaatattgttttcaccacaaggcattttttctgaaaaccggattcaaaaatctggggtttggtacaaccgttttagaaatagcgtagaaaacagcttcgatatcaagaaaaccagtcaagtccagaaaggagtattttaaaacgatttcgttttgttttggcattatgataccgaataactttcggaaattatggaaacaaaaattggaaaatttcaaataatttttttgactgcaaattttttttcctttttttgaatttgggtttcaaaaaaatttttaaaaaaaatttttt

SEQ ID NO: 38865 - DNA, 1577 bp, Heterodera glycines
  misc_feature (124)..(124): n is a, c, g, or t
agtcatgggttcagtttcgcttcgcgtcgagcaatgattaatgtaatattctgacacctcttatgttagggttcctgttgagggagctcaatgattcgaaaatggaattatgagctcgattgtntacacagaattttttcaataaaattatttaactttttcccattttcaaaattttaatgatttctttttttaatagcaaaaattaatgtttatgttttatgggtaaattgctggacgttgattagttagaaaattcttaaacgaaaggggttcccttttgctttgcctttttttgtttagtcgacgaagatttttcctggttttttctgtatcgatataatgcttttggcatctatttcgcgaaaagtttgcactgctaaacccggcggcaaccctttttttgtcatcggtcggcaaaaaaattttttgatttttatttaattaggcaggattggcctgcgggtggttcttacagattacgcaagaaaaattcttacaaatttcgtcaagaatatcattttcaagaataaccattttattaattccgctgggcaggtgttgttccgattccgagacacctttcaaggcggtagactttgcctctctcatcaattcgaccgcggtcggaatgatttcagaaatcggcaataaaaaaataggaaaggcactctcggcaaaaatcgcccaccgcggcacagttggccaaaccttgacttccggattttcttgtttccaattccaaaaaaccgctccccttgtttagtgaacatcccgcgcaatacgacttgtttttggcggaggaggacagcatggagttggacacggagttgccaccgcaggaccgccgacggttggtggcagactgcggctttcccgcgctggcaatggtcgcccggggggacggacgcggacggcggaggcgcagcagcaaatgcagcagcggcagaaaggcgtcgttggcggacggaggcggcgacaacggcaggcggctccaagcgaacatgtcggtctgacccacttctgttgtagatcaagcaaaaatgcatttgatcagcagattttttaatccattctatgatgcacatattttaaatgggtggagagccaaatgagggggactcattaacagtaatgggcaacccgagggccgagggggatattctcaaaaatttgacaattttttgtggagaggcaaatgagggggactcattaacagtaatgggcaacccgagggccgagggggatattctcaaaaatttgacaattttttacgaatattatgtaaataaaaatcccattttcaaagcgaagaaaaaccccaaaattgacaaaggccttgaaattttgtattttggtggtttcacaaattttagctgatccgaacgccttcacaaattcgagttgctccgatttaaaaaagcattaattaagctatattttccaatatcattaaatggttcagttttcatagtacaatatcgcccaccattcattgtttttacttttcactgtctaaaaaggccctttaattatttcgacatttctttttttctgacattattccaactgtaaaa

SEQ ID NO: 38866 - DNA, 743 bp, Heterodera glycines
cagcgaaaagctctgttcactccatcttctaatttccccatatcattttgagctttttctaaatcagagatttttatcgtggtctttccttgccaaaatttcctatcaatagccgaaatcgaggactcatcatcctttccactcaaaaacatctttgtttcctgcccgaaggcttgggatgtaccaaagggaaactcatttgacgagccccctgatgtagacattcgaagtcgttcagttcgtaataagattttgttttattttgctaaaaaaaaatttatttggtaatcccattatgcattaattgagagagaaaaaaaattaatgaatgatagcgggtaatcgaatggatgcgaacaccttccaggaatgggcttatctgctccatctccgtttaaacttcgcctaacaagagcaattaacaattctcaggcgccgcaaaaatgtttaaagtgaatgatctcgcccaatgaaaaatgcggcggcacgtgattacgtgaatattcttatggcgtgaaaactgagagaaaacaaagagataaaatgaactttggaacttgtaaaaactgtagttcatactgtaagcaaaatgatagggcctaattttcattttttttttaattggtccctctttttagctaaaatagcgcccctttgattggttaacagcccgggcctttttgcttcctcaaaaaaaaatagttctatatttttttgtttcaattcttctctctctctctctc

SEQ ID NO: 38867 - DNA, 304 bp, Heterodera glycines
gaagacaaaacacacaaccaaaacaaactcaaatgtccattaaaattttaaattgggcactgataaatgaaatttatttgttttgttatttgtaaataatatattttaataaattatttattttaattgaatttaattatcctgcaaaaatcccactgaattaaccattgggtgcgctttctaaatcaacttcggtatatccaattgcttcatcttcagcctttttgcattatgccagctttatcctctcttttggcacccccggggaggggggaggcgggggaaggggaaagggtcttcacct

SEQ ID NO: 38868 - DNA, 1015 bp, Heterodera glycines
ctgcccgaaaacaaaaaaatcgatttttcaagtgtcggtgggggtactcaaacaattatggggagcaaaatccaacgcagaataaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaataaatcgattttttcaagtgtccgtttggggtactcaaacaattatggggagcaaaaatccaacgcagaattaaagtacaggctatagtgaagctattccggaaggattcggtctccccataaatctgggcgcatcggttcagggggactgccccgaaaacccaaaaaaaaattttttggataaaaattatttaaatgaactgactagataatatttaaaataggttatttctcttcctttcagtatccctgcaaagtttggtgcgcttctgatcagtttctgaaaaaaaagttaagcctaaactttttggcctgtttaaaaaggaattaaaaatttttaaaaattttattcatctccctttttgatagaaaaagcatcagagtgcctaaactaacatgtaaataaaatttggtgcgtttcagaaccctttctgaaaaaatatttaagaattaattttgcaaaaaataaataaaaacgaaagactcagattttcgaaaatttttttgagccagctagctcggcgctcatttcagtgtaagttagtcctttaccggggagtatccctgcaaagtttggtacgcttctgctcaattagcaaaaaatatgagtgatcgaattttcactaaaaaagttaagcctacattttttggcatatttaaaaagcaattaaaaa

SEQ ID NO: 38869 - DNA, 1028 bp, Heterodera glycines
  misc_feature (95)..(95): n is a, c, g, or t
ttatggggagcaaaatccaacgtcggggggactgccccgaaaacaaaaaaatcgatttttcaaagtgtccgtttggggtactcaaacaattatgnggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaataatggggagcaaaaatccaacgcagaattaaagtacaggctatagggaagctactccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctactcccgaaggattcggtctccccataaatctgggcgcatcggttcggggggactgccccgaaaacaaaaaaatcgattttttcaagtgtccgtttggggtactcaaacaataatggggagcaaaaatccaacgcagaattaaagtacaggctatagggaagctactcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggtagctattcccgaaggattcggtctccccataatctgggcgcatcggatcggggggactgctccgaaaaca

SEQ ID NO: 38870 - DNA, 1260 bp, Heterodera glycines
  misc_feature (1172)..(1172): n is a, c, g, or t
  misc_feature (1200)..(1200): n is a, c, g, or t
  misc_feature (1208)..(1209): n is a, c, g, or t
  misc_feature (1247)..(1247): n is a, c, g, or t
acacggcgattcaattttaggctccttgtacaattaagttgggtttttcgtcttagtggtctgtacgttagtcaccaaaagggggtctcaggttcgagtcctccttatgttatgtgttatttcaatttcttcttttacagaagaaggcagaattattttttcattaataaaagttttcgtgtcaataaaaatcatattcaaaaagcgttggttacgtgcaacatcgacaattttatgaaattttctttgcactgggagcccaaaattgaatcgccgtgtgaatgaataataaaaggtagttttggtttcattgcactttaaacattgtttaaaaatcaattctgactaatattaacggaggattaaatatggtattaattttccaataactcaatgctcaactgtaagagtacagtattaaataaattaccgtatgccttacagttttgtgtcttcgtcccttttttgctgtcgttttctcccgccactgttgttttgaccaacagcagctgctccaattcgctgtcctccttgtccaaactcttcaaccattggtcaatctttttgcttagtttttgcattttctgcgcgatgcttttccgcccgtcttcgccttctcccggcgctgaaattagtgaaattcaaactcgagactcttgaaaaggacacaaatttaatttttaagaagccaattatttccattttaaaatgagtcttttaaaattagaattttttaaataatgcgctaaaaatttcaaaattttctcccattagtgtgcatcagcaggcattaacggaccattttggtcttaaagtggcatcccaaaaaggccaaacggctcctgaaaatttccgaacccattagcggaatttaagaaacgcgtcagcacgccaactgccaaaaaaaagcgacggcaaattttaataagtccggcacgaacccaaaaagcggcacatttcgaaaaaatcggcaaaatccgtcctgttgtgacttattaatctttgagcatttctgataacgtttcaattatgctttcgaatttactgcaccgttattagcatccttttcgcccgccgctgctccgtccggctcttcagtgactgcgcttgaatagcctttgtccgcttcggaataactcagctctgaggaagcgtaggagcaataggagtanggcccaacggacacttcaacatctgtancgaataannggtcattagcaaccaattagtaacccatattcctaaantattgctccttcc

SEQ ID NO: 38871 - DNA, 940 bp, Heterodera glycines
tcagtatcagcttctcattcgtccgttcgttcaccaattcattaggttcaattggcattgttgtcacaaataaattaaatcgaatattgtaactgacagaagtggtggcacggagaaatgccgaaacaaaatgggaaaaaaataatgaaaatatggtgggccacctctttgaaattgttgacccattcgagatttgttgggcccaaataatcacgacaacacaatcgcttcgactgtccatcttttgtcggagtttgcaaccatttgaacagcatttgctcagcagctgcatttggcccacatcagcaattccatcggggtacagataaaagcaatcgattgaagtcaattgatcaagattaaatgagttgacgcaaattgtccaaattaacgccaccagaaaggcgcaaatgtcaaatgcttgtcgcaaaaattggccaaatttcatgggccaaaacatccaaaatcggctggacattgctttcggatgaaggcacattcaaatccaatttggtgccacttctgtcccaaatttgcttgttggaacggagaaatgtaatgacggaatgatcaatgtaactgaagaatttagaatgcttgaatttaaataaaaatttaaaattaccaaatatgaagaagttgaaaacgaattttgttgggtagcggacgctcgggaaacggaaattccacaaaattaacaccgatccgtacagacagtttcagtgttggtccaatgtccttgcaaattagtatcaatttagaaatggtatctgtggaaaaattttgaagtttctccaaaattttcttatatgcaggtcataaaaagttaaaattggagaaaacttttccgaaagctttagaacttattcgggggttccacggacagtgttcttgggcctcttcttttcttggtttttataaatgaccttactaattatat

SEQ ID NO: 38872 - DNA, 1290 bp, Heterodera glycines
ttaattttgggaaaactttcccccactgatttcatccggtatgagcagcaagttttgcctaaaaaggcagcggagcttggttttcaggaaaccatttcaaatttgaagtccctattttcagacacgaagtcaattttcatccgcaggttcgagtgttttcaaatgtcatgcgcaccggaccaggacgttcttgaatttggcgcttccgtcaacgcaaaatgcgaacgggcggacatgacactcagcaaagatgagataaaatgtctcattttcattacaggcctaagtgacgcgcatcgcgatttgcgccaagagtgtttgcgtcaattggagagggcaaaaagcgcaacaccgccacgaacggtcaaactcgaaaatttgcttgaggaatgccgttcgattttgtcgctgcaacactccgctgccgctctcacaagttctggtcaagcacatgccatccaatgcaaaccacaggttttgaaggaggataagccgaaaaacaagggttttaagccgaaaacccaattaaattcgggcaaaaatttccgtaatgagggaaataattcgggcaatgtcaattcaaatcccaagcgacaggaatttcgtgcccaaacgtgtggacgttgcggcaaagggcattcatatagggtttgccgataccctgccgatgtccaatgttttggctgtggaaaacggggccacgtaaagcaaatgtgcccaaaccgagcccagtcaaattccgtcgccgtcgcatcaactttcagcgtggcacaaacaaaccgagattggatttggatcgaattgcaaatcaatgacaaaccaatcaagttggctgccgactcatgctccaacttgaccatcattcagctgccaatttgggaaagtttgggaaaaccaaaactcaaaaatgctggtaagatggttggttcttattctggtgaaaaatttaagcttttgggaaatttctggtgtaaggggtcaatttcagaaatgtgattttaagtctttgttgttcagttgcaaacacaacagctccaagtatcatggggttggactggattaccctgtttgaacaaaagacgcagctgccaattgcgaccacactgccagtgttgttcgactccactcttcaccagtcggtcaacgcaattcagtctcccaaagacccaaccgatttggccaatcaaattaaagcgcaattcccacaggtttttcaacagggattaggccgttgtacaaagatgaaggccacgcttcatctcaaaccgagcgcaaggccaactttctgcc

SEQ ID NO: 38873 - DNA, 765 bp, Heterodera glycines
tatatttagggctgggatgtatattgaaaatcccaactattaaaacgaatatttactaataatgtcgaatattaaccaaaatattgaaagtgaaaacaaaatccgaaatattgggcagcaaacatttaagaaagtgagaaaaaattgcaggatataaattaatttaaaaaaatttgctcaaaaataaccaaaatttttttttttttttttaatatttaatcattttttaaatctaatttttgctattctgaactttgtataattataaaaaaaatcggagaatgctaaaatactcaaaaacattgacaaaattctaaaattgtaagtacaaaaattatttatttttaagaaaatgactttcaaatgaaaacaaaattgttttgatttattcctatcttcggtgtataaaaagtaaaaagaaaattattaaataagtcacagcactaataataacttgatattgcctaggccattttatttttatttaatttcatacactcaaagcaacagcaaaactttgcgccttataagtgttgtacgtttctgaattttgaattttcgtacaagttcaccacatgattgtcgaaagaagaaaaaaataggtgcggttagcacagggttcggatcgaaaatttttccaaatcagaacatcaggcccaaaaaaatcagattttagagtggaaaatcagaacatttcgcaaaattgcttcaaatcagatatttttacaatttattcgatcaaaaatgtatcaaatattatatttt

SEQ ID NO: 38874 - DNA, 779 bp, Heterodera glycines
tcactgttgtacctcttttaattacttttgtacctcctttaatcaaagatatacctcgttgaatcacttttgtacctcttttaatcatttttgtacctcttttaatcacttttgtacctcctttaatcacttttgtacgttttttaatcactgatgtacctctttgaatcacttttgtacctctttgaatcacttttgtacctcttttaatcacttttgcacctcctttaatcacttttgtacgttttttaatcactgatatacctctttgaatcacttttgtaccacttttaatcacagttatacctcttctaatcaaatttgtacctcttctaatcaaatttgtacctcgtctaatcatttttgtacctcttttaatcacttttgtacctcctttaatcacatttgtacctcctctaatcagttttgtacctcttttaatcactgtttgtacctcttttaatcacttttgtacctcttctaatcactgttgcacctcttctaatcactgttgcacctcttataatcactgttgtacctcctttaatcacagttgtacctcttctaatcacttttgcacctcttctaatcacttttgtacgcacttccggtttccattgcattatgcgatgtgtcaactccaattattggaggaaaccaagtgcatgtcggctgacgcaaagaccctaacagactaaaacgcgcctaggtagcgaagctcacaaagcgcgaagcgctttttcccagcccagatccgacggttcacgcacccgctagtt

SEQ ID NO: 38875 - DNA, 981 bp, Heterodera glycines
gtccacgttttggcgccaaggtcgttttggcgccgacgttttggcgccagggtcaggtttttaaattttgtctatgtttgaataaatgaaaatatgtattcgtcagttttctgagtcgctaatcacgaatattgtattcattttgacaattgcgaagcccgtacttgatttaaatgaaatacaatttttgaacatattagatcaggccttctatctgttttgttttatcaaatgttttaatatggtgggtccaaatctaatgatttaccagattctgatttagggatagtgactattatttattaaatataccgttaaggttatgtttataatcattaactcttttgaaatttcaaccgaaaaaatttaagagtttaaaaatattcaaaatgttttgacattttttgaagcatagcgaagagaaaaatttgaaaaaattcttgctaagtcaatttttcatgttgaccaacaaaatgttcacagcaagttgatcatatcactccttcatgttgatctacactagagatcaacattttgaaaaaaccgtagttgtacctgtttaaaaaatggcctgtacctatttttttctgtacataagtacaggaaaataaatgtacaggaaaaatccaggttgccgaaaaatggcctgtgcctgtacctggatccaggaaaaatacagggctggatccaggtacatgttgatatctctaatctacacccataaaacacagtcaaaatcggaaatttgaaaaaaaattctagggggttgtgaattttttgaaaatttgaaaaacctattggaaggtaaaagtttttcacttttttttgtaaaatttttgatcaaatttttaccttttttaatttttggcttcgcgccaaaacgtgggcgccaaaacgatcctggcgccaaaacgtgggcgccaaaacgtgggcgccaaatcgtcggcgacaaaacgtcggcgccaaaacgacacagtcccg

SEQ ID NO: 38876 - DNA, 896 bp, Heterodera glycines
tctcgaaatcgagcccgagaccaccaaaaatccgagatttttctcgagatcaaggctcgagagtgagtctcgacctgcactattagtcattatttgcttggttggctttgtgctcaaacactttttcgatcagtcgctcgttttcccccatttcctccaccaattgatcaaactcattctcagcaatgccttcctctctgatcagttccgtcatgtcggacttttggccgccgtctcccacgcaattgaccaaaacgtaatactaaaaggacagaaaaagcagagaaaaaaagtgacttccgaccctttaaagtcagcattggaccaaaaaaatttgaaaattttaattttataaaattagagaaaggaatgggggggcatgggcttttctctttaaattttcaatggaaaattttaaaatggcgttgagggtgggccttgggcttttctctttaactttcaacggaaaatttaaaaatggctttgagggtggaccttgggtttttgaatttaaattttcaacaaatatttttaaggctttgagggtgggccttgggtttttcaatttaagttttcaatgaatttttgaaaaaattcctaaaatagctttcataaattagcattttctaattttttgccaaatattttcataaaaggaattatatgaatggaaaagcgaatatgaataaatttaaaataaaatatgatgaagaaaatagaaaagctctcgagacctggacccaggcctgtacctgtatctttttttttataaaaaacttttattaaaaaaattaccgtacaaacacctaaaataaatctataaaacaataaatatcgcttgtatttaaggctataaattatatgctattgcatattttttatgcgcatatgctgtg

SEQ ID NO: 38877 - DNA, 938 bp, Heterodera glycines
aaaggacgacgagggaatgaaatgaaattggcaaagcgtatcatattttatttgctcaaaatcataatgccaggggcttatgacacaggccaaggccaagcagagagaagcaaaagaaatgccaaaaacatttgtacagaagagacggcacggcacggaatttgctggggggggggatttggccacagcagggagatggaccacctaacttatgaatgaaaggagaaagaacaagcagcagcagcagcagcagcagcagcagcagcagcagcagcaggcagaacaaataaagtcagtcgagaagaacggacacacaacaaaaagagagagagagagaaaagagagagagggagagaaggaggagaaaagagagagggagagagagaaaaaggagaaaagagagagagagtgagtgaaacgagagagagagagagagagagaggggggacatgagtataaaatgagtggaaaaaagagaaagagaactgctggagtaaagagtaaaagcgaaggaggagagaaaggaaaaggaaagtgagagagaattaaaacggaagggatcagaagagaggtggaaaaagagcgggaagaaattaagaacaactttgaaatgagttaggatttgcctataccatagcttattctgtgcatttttgtgcccttattgattgtttacacattttcacagccttcggcggggttttttggacggattcagaaaagatggccgcagggagcggagaaaatgaaaaacgccgcagggaaaggaaagcggggagagagtgcataaaagaaagggaaaggcgaggcggccaaacaaaggcggacggaagagaagcgaattatgacgaaacgaagcgaaagtggcaattaattaatgagctgctgaatcaccacgacaaaagcagggacaagtacatatgtcggacatacgcatg

SEQ ID NO: 38878 - DNA, 981 bp, Heterodera glycines
aacctctcccccccccccacccgcacactctccacaaacgagggaaagtgaaatagtgagtttaatgatggaaattgggggatgagaagaaattgcaggcaaaaggccaagggatattcttgtcattaaaacaaaaagggacagaagggaagagtcactcactttcttctctttcctcctctctctccttttctctctctctctctctctctcttctctctaaccaattatcccttacaaattaattattaaataatatgtgtatataaataaattaagctaagaaatagccgaaaatgcacaaatttcaattcaaatggccaatggaatttggaagggcaaatggggggaaatgggaaatgaatggtacgacggacagaaagcagcagctgatgagcggactctgatcagatgggatggcgttgtccttcttctgatttgtttttgagtggtcactccgtccgttcattaatttcgtttgtcagttattttcggaaacattctctccctgtcccaatcgttctcccattgtccccattttgccgttcatttccggttctcacctaactttcctttatttgtttttgtccgcttcgactcaaattcatattttaaaatttttcgaagagctttcgcttttggctcgtctaattattgggtatgaagccaatcagtttttttgatcagtttattggtcatgagaaaataccgtaagtttacaatagcaaagtgggatatctatacgatggatatggttagaattttattttacaggtagaagattgcgatcctcgagactgagatggttaccccgagactcgtggttacaaaatgcatgcttttctcgagtcggactttagtggcttccctttttcttcacctatgatatttttacgtaaaaaaagacttggcgagcaaaggtctgacggtgccgattttgagtcgaataattacaacccaacctacaaaaattgcaaattt

SEQ ID NO: 38879 - DNA, 1404 bp, Heterodera glycines
acgctattacagtaagaaacactttggccaatttattcggctatcccaaggctaggctaatttcatttggtgacagagcctatggagaaggacgagacgacgaagttgagaaattggagaatggggccattggagaagaagcagaggaggaagaggaagaacggaggaagagaaaggggaagaaagtggcacggccgggggaagggaggagacaacgcctgggggaaaagggaggagggagcaactgtgacagacagactaaagagtgccaatcagctatggtggcactgatcggcactcacatttcggaatcattcttccaatcaaagtgattgattaaagtgccaatcagctgccgttgcactgatcggcactttcttacttcgctgcccccttccgtccgtctctccgctttccctttggctcttttccgcttcctttggcacttcgtttctttttccgcttttgctccgtttcgcctttctcggacccctctccttctgcacgcctttaacaaatcttttattgctttatcaattccattcgtacgttctttggccatattcgcctcggcaatgcatttgttaaaacggcacgcctggcaccaattgcgacggcatttgtccaccaaacatttgccagtgcccgctgagctttcaaaacggcattaatcagaaagacaaaaccagcaaaactctcaccaacgcatttatattcagcacttcgacgaatgctaaacataaaaatgggaggagaagtgatcagttcgtcggatgactctgataagtgatcagtcagtcatccttttcaccttctcttgaaaaaacagctgcacccatcgcacacccatgcaccgtaatggcgcccgaaagttttatccccgcaaactttgcaaagattttgggtcggaatgagtcggcctaaaattgggaggaaatgaattgatgatgtgaatcatgccgttgaagtggtgaactaatgtttgtcaaaactgacccatttggaagaataaaatggagcgaattttcgagggaatggccaaagaaagtgccaaaaggagtgccgaggcattgccgaactgccctataaaagcatgacccaattacctgacaaatcacaaagtctgtcgataagaaggcattggcactcgtctcaatttcaccccccccccccccccccccctcattcatttgccattccattatttttttgcttgtcaatcaaaaggcaaaacgatcgcaccaattaaaagtgttttgtagacgattcgctgctgtttttatttttgttttacttggtcttatttcacactttgcgttgttaaaaaatgcgagcaaataattttaaaattagaacttaaaaatcccccgagggtaagcgaatgatagcaaatgttaataaaaa

SEQ ID NO: 38880 - DNA, 964 bp, Heterodera glycines
tgctgttgttggccaaagttgcggcgggcgccgattcggcccggatggagatgattggtgcgtgcggtgattgggggagcggacgacgaccgacctgaccccggggggggccacgacccgccgccgtccaggaaaaagacggggggcagggaagaaggagaagagatgtgattgtgatcataaaaaatgatttatgtggaattttgcgcggcgcggactccctccctcccccctttcccccgcactccgatcggtcggaaggaatcgagttgtccccctcagagcacgcgcattccgtgcggattgtgtgaagttgggggacaacaacactaatcagtttaaagttgtggaaaaacgactgctactgctgctgttggttggacaaagcagcaaaaggaggagagagagtatcagtttaatcggaaaattaagagggtcttaattataaagtccgtcgtggacatgacactaattggccacgcgccaaaaaaaatattcggtttcacagaatgctttttttacgctgaagccttcggaaaaatgcagaaacggagttgcccgctgttggccttggctgccacattttgtagacaataattattactgcagcgcagcaacagaaaaaataaatcgggctttttttttgcatcacttaatagtgggggaggggggacaactgcttggccccatcagcagccaccaaatcggcggaaggaaaagcagcagcagcagtttaaagctacacatgcgcgcgcacatcgcttcccaattgggggaaagcggacgggcgggcgggggatgggagaaagttttgcagcggcagccgcagcggcgaagcgcagcggtcgcgtcggcggcggacagtcagtcggctttcccatccctgggccccgcgcgagaagtccatgttgtggaggaggaacctgttttgccccccccccccccggttaccacaccgcccatt

SEQ ID NO: 38881 - DNA, 1512 bp, Heterodera glycines
  misc_feature (17)..(17): n is a, c, g, or t
tttttagaggtgtgccntgattcacggtcacggtcacggttactgtgatttcacgggttggatcacgatcacgattcacgggttttttcagtcacggcacacctctagttttttttccagagggaggaaattatttttttcttaatggggtatgctcttaataggaaaaacttatagttctaaaactagaaagtttatatattaaaagtttaagatcctttaaccctttttaataaaataaataaataataatttataggtttttttataaaaattaaaatttttcatttattttcaatcgtttgtctatttttttaagaaaattttatttttctgggaaatgaaagagagggtggcggggaatgaaatgaattctacccatttcaattgatttattatcactggcatttttatttaattcactttatttcatttttaaattcaataaattataaatgttaattttttggataatcttttttatgataaataattgtaacaggaaggcatttcgattgcgtagataaaatgattgttaaataccaaaaagagtttaacgaaataacaaatgagatggggaacggattttgcaaaatttcgcatttgttttatttcatattgcacaattttatcatgttttgtattttgttcttcggtttaaaaacctaaaaatgtgtgttcaagtatttagcttaattaatgataattaattgggctaatatttatagttttttcacaatttttttcctgagcccccgtagcctgaaatgcacgaaaaacatgtttttttcggctgttgttaagctagttttcgagttattagcaactatttttatagttttttatttttagcaactaaaaaactataaattttttgaaaaaaactattttcaactattttggcgttttgccaaaatttgttaacaaaatttgcaataaaaacgaaaaatacacccctaaggatcaactttttgaaaattttcaaaaatacacccctaagaatcgaaccgaaaattttttcaaaaacacacccctattctcgaatcaggtagtttgggatttcaaggttctgagacaatattgaatctgaaaattttcaaaaatgtggttttatccccgatgggttaaacaactttaaattgtatgcgaatttgatcgttagaaaatttttgaaaaaaatattaaatttttcaaataatgtaattattgttcctaataaaccaaacgaccgtgttttcttcaatttaactctgtttgcgacctccaagattgaaaaagcaaatttaaaaatccgatttttggcataggcacaaatcagggatgttgcaaagagaaaaataaaaagcgaaaagtgaaaaaagcaaaaccaaaataaaaagcgaaagcgaaatgcccaaaaaagcgaaaaggcgaaaatgcgaaattttttttccaaaaattagatgaatttgaaagtctcaaaaaattcaccttttttaatacttaactgttatgatgattgagtgatttttt

SEQ ID NO: 38882 - DNA, 1350 bp, Heterodera glycines
tgcaggtcaaatggcctggcccaaaaatcgcaattttacattcattttttgtaatgtatcctctaaaaatcactttaaaaaaaggaatattgaaaattacttttaaaatagctaaaaaagttatacagaatagttaggtcatttttcggcatttgtgccctatttcacgctttctaagaattttttgtcaaaaaaatcataataattttttttattttggtacatatttgagagtttttgtacatatttcttaaatttttcgtgccttttttcatattttatgtatatattttgcgattttgttaagaaattttgcgtcaaaaaaaatttttttatgaaatatttcgtatttttcccaaaagtgtccgctaatttccgtccgcatctgtccgtaaggcaccaatgatgacaatatttactgtgagctatatgacacggaaaattgaaagataaaaataaacaaaaaactaggcttcttacagattgaatgtgctacttcttaacaaaaaaattttacttaatgataagtattttaaaaatatggaacacagaaatagtgaagaagcaaagaaacgagagtaaataagagagcgtaaggaaacaagtacttttcctttttttctcttctcactgctacaccccatccttttttgatttacattatcaccagcagggaaagtgtttttcttatctaaatcccttgcaataggttttggatatagaatttttggaacggggccatcgggggatggccctacaaaaagcatttgaaacgaataaattttattttttaattttggtttaaaattaacaaaaaaatgaatgatttttaaaatttcagagggacatttgtcggagtgctggtgaataatgccaggggcctatttcaatcaacatcaagtcaacgacttgatgacttgatcatcaagtgaagcgtttcaattagatcaagtgcaatagcacttgataatttggcgcagaataggcttgtgatgtctgcccatgatgttaaacatcatgggcagacaattctgtttcaattctacagacgatgacttgacgtgattttttacgcttgatgatgcatatttgggggcagggaaaagttttttttgaaatttctaatttctgttgtaaaaataattatgttatattatacataatgatttttgctgctagaaaattatattaaggatagcgcgcatatattccgattaccgaaattttttttagaaatttcgagttccaaaatttttggtaaagtcggatttctgccatcaaaaaatttcttataaagtgaaaaataattagtttttgtattgtaaaagattttcaagaaaaaaaccgaaa

SEQ ID NO: 38883 - DNA, 958 bp, Heterodera glycines
  misc_feature (19)..(20): n is a, c, g, or t
  misc_feature (896)..(896): n is a, c, g, or t
gtcctaaaaagagatagcnncatttttctgagaattaattcacaatttccgcagctcttagagtaatggaaaaaattttgaagaggctctccggaacggattagcatcggggttacgagatagaaaattgtcctaaaaagagatagccatttttctgagaattaattcacaatttcctcagctcttacggtaatggaaaaaattttgaagaggctctccggaacggattagcatcggggttacgagatagaaattgtcctaaaaagagatagccatttttctgagaattaattcacaatttccgcagctcttagggtaatggaaaaaattttgaagaggctctccggaacggattagcatcggggttacgagatagaaaattgtcctaaaaagagatagccatttttctgagaattaattcacaatttccgcagctcttacggtaatggaaaaaattttgaagaggctctccggaacggattagcatcggggttacgagatagaaaattgtcctaaaaagagatagccatttttctgagaattaattcacaatttccgcagctcttagagtaatggaaaaaattttgaagaggctctccggaacggattagcatcggggttacgagatagaaaattgtcctaaaaagagatagccatttttctgagaattaattcacaatttcctcagctcttacggtaatggaaaaaattttgaagaggctctccggaacggattagcatcggggttacgagatagaaattgtcctaaaaagagatagccatttttctgagaattaattcacaatttccgcagctcttagggtaatggaaaaaattttgaagaggctctccggaacggattagcatcggggttacgagatagaaaattgtcctanaaagagatagccatttttctgagaattattcacattttctcagctcttacggtaatggaaaa

SEQ ID NO: 38884 - DNA, 848 bp, Heterodera glycines
tttcccccccccccctttctccgtccttttccgatactttcgccacccatccacattaatcatcactgtacacacacagaataaatttattacgaataagcaaatgtggtgaaatgtgtgtggtataaagaacgaattgagggggggggggggggctaacttttctggattcattcacagcaagcataaagtgtggtgcccttcccccgctgtctctcatcgctcccctgggggtgtgtttccaaaaatggcttttcgtgccctctccttctcatgcctgagttcttcatctcactcttggccttggtcttcctttcccttcccattccgttgggcactcccttttctcgcaccctctctttcttctgctttcgtccattgttcaaaaagtggcttttcccttcatctcttttccctaaatcagtcgctaattagcccccccccccttcctcatcgttgtctctccctcgccgcccgctttgtcattgtcggccaattggcctccctgccatctgaggcccattcccatcttttctgctaggtagtgtccatttggctctttttctttccctttctgtctttttttctctgactgcttctagaaggttcttctctctgttgaatatcccttttttccatcattcatcctttcgagaaccttctctcccctctctctgacctccctcgccacccctcctcccgcgccgtcgtccatcagtcactcttttggcagagaagggggcgggggagatagaacaggggctaagataaagagggggagaaagagaggggagagagagatggagaggcgggaaagatggatgatgaatgcttcttcgccacccccc

SEQ ID NO: 38885 - DNA, 949 bp, Heterodera glycines
  misc_feature (139)..(139): n is a, c, g, or t
ttgggtcgcaaattgcacactcacatttcactcatgcgctctgatcaatgtcaaacacgcacagaggaaacaatgtcaacgcgcagaaaatgaaaacacagtttgacagaaaacatggagcaaaaaggattgagtttanaataggcgatcaagtatagtttgttattaccaaaacggtaaaacagtttggctttttggtaaaattgtggcaaataatggattaattctcaaaattcaatccccacaattagcacataagatcatcacacgtcacgcaaacgcagtgaggttatcggcagcgactggcactgaccatgagtggtcaaacgacgaagtgatcagaccgcttcaacaatatgttccggcaccagttcattcaccagtccgatcgccacaaggacacaagcaaaacacaccatcacccgatcgtcgaatgcaaccacaagaacggactgatcagaaggaccaacaacaagaaactgaagaacaaacaccggaactgcgacgatcaaaaagaacaaccaagaaagttcgatttttgagtccaaggcccactggacagcgacatgagatcagggaacgtgattaatttaagagggggaggtgttgtattattgccatttcatattttcttggcattatgtttattgacacgtcaccacatcaccgcccataaataccgctgtcttccctccttcttcgcttcggacttccttcattctcatttctcatttgcattcacccaccccacacatatttatctctctcgtcacctctgacttaatttatttatttattattgattgtatttgttgttgttgataaacgacacaacatctttcaccgagcgtagacactcatacctgtcaatccagacggattgaggtcggctgaacaataccttcagcttctccgcagtttccacaaagtcgaagtcggccacttctct

SEQ ID NO: 38886 - DNA, 1205 bp, Heterodera glycines
cttggaaaagtagagaaaaatagacatagtcgaaatagtggagtagtttgtgcgaccagtgcagaaggcggagatgctagggcagcgaaaaaagacgatctctgagggaggggggggggggagtgatcagagaaaggaaggacaaaatcagcctctgatcacattgagaagagtgaatcactcactaatgagccaaagatattttggtggataagcgaatattaattagtcaattaattattaattttgctttggataattgacccatagattggtgattttgtgacctgagctgaggccaaatgattatggctaaggtccaattcttcaattgccggactgaagcgcagaatgtgttcactgatagtctaaaaaaggcaaaaaacggcgaaaagattagggaaaagggaaaagccaaccaaaaggcaattagcgctgagggaaaggcgccgcaggcgaaacagtcgaaaggcctcccattcgacgctaacgatgcgattggtgttcaggcgaatttcttcggcattcggaaaggcaatgaaactgtgccgggaaatactctgagagagaagagtgatcggagtttaaacatccaaagttaccgtaattaaattttggctgaggtcgagaaaaaccaatgcgggaaaagcgggcataaaatgagaagtcattcgacgatcggtgaatgagaaaaagctaaaatgaaggtggaagcaaaagatcgttaacgaaaaagaaaatacataaaatttcccaattttggcataatttgccttaattgccatcgtttgactggagtttaaggtgaatcccctccccatttcgtaaaatgtcaaaatgatctcctctgctcaccttttctctacccgcaatgtctccactttctctaatttattttcgcgcaaatccaaccacattaagcgttccattggcggcaaaatgtccaaagagtccaattggctgcggacaatgctcagattgagcaaagtcgaggcgaattgttggccggagggagtgccaccgaaaagagaaagaaacaaatgaaaaaaattgagaacggtggataaaagatagagaagtgcctgaaccgaagaggtggcgcaaatcggcacgggcttaatcgctgcaggcgatggaagagccatctgatcagtgaccggaagtcagaggggaagtgatcgggtcaaacaaataccctgcgaaca

SEQ ID NO: 38887 - DNA, 1071 bp, Heterodera glycines
  misc_feature (11)..(11): n is a, c, g, or t
ccccccccccncctcttttcaggatgggatttatactgtaagcagtggcccacccctccctatcgccaaaatgccaaaagagagaaaatagtgtgtgccaacggtcatcaatggtggtgccaaaattagtcaggctaaattgggagagggagaaagtgcgtaaattctagcctggaaaaggttttttccaaaaattgaccaatgaattttttgcacgaggtgtaaaactaagtatgtttatttaataatcaattttaaaaaagtacttttattttcaaaaaatttacaaattttttctgtttttgaatcatcggataagggggctaattgtaagccaacgcggaccacatcctttccaaaccaattgaaagagattgaaaatttcataacaacaaataaatttcttgagcgcaaaaaaccaatagaaggacgcataacggtagaaggaaaaatgaatttttttttaaaccatttccgacatttatgtaaaagccgaaaaagaaactttccatatttggtagttggagcacaatgagaagattgcttgatgagaaagaaaaaatttggcgacattttgccctcatcattagaaaaaagcctcaattttcaaaacaaaaactgctcgcgggcaaaaaggacataagcgcacggaaaaatgttggacaaatttggtgccaaatattttcgcgacttaataattgtaaaaaaatagttcattatttgtggcggcagcagtttttggccaaggttttaagtatcaaacggtttagccaatgccgtcggctggttttgggtggaaaaatttaaggcgccctcgccggtcacgcataccgtatcacgtctaattatcccccgtctccaattatcccccccccctttctgagaaggttgaacaataattccccgggggataattagagataatagggtatctgtataattttttggcctcaattatgggccaccagccaaaatattttgaatgcaattaggctgcttctgcctattcgacctttgccagtattatattattgttcattttcttgcaatttaaagttttttggaacgaaa

SEQ ID NO: 38888 - DNA, 950 bp, Heterodera glycines
tcccagaaaaatggctatctctttttttgataaattttatacacatacaaatgctctcgagcatgatagggagggcggtgcgcaatagaccttttatttttgagggaatttttaaatttatactctatcccagaaaaatggctatctctttttttgagaaattttatacctcacaaaagcgcttgcgtatgagacggagggctgtgcacaatcgccattttatttcacagaggatttttatatttagaggttatcccagaaaaatggctatctctttttttgataaattttatacacatacaaatgctctcgagcatgatagggagggcggtgcgcaatagaccttttatttttgagggaatttttaaatttatactctatcccagaaaaatggctatctctttttttgagaaattttatacctcacaaaagcgcttgcgtatgagacggagggctgtgcacaatcgccattttatttcacagaggatttttatatttagaggttatcccagaaaaatggctatctctttttttgagaaattttatacacatacaaatgctctcgagcatgatagggagggcggtgcgcaatagaccttttatttttgagggaatttttaaatttatactctatcccagaaaaatggctatctctttttttgagaaattttatacctcacaaaagcgcttgcgtatgagacggagggctgtgcacaatcgccattttatttcacagaggatttttatatttagaggttatcccacaaaaatggctatctctttttttgataaattttatacacatacaaatgctctcgagcatgatagggagggcggtgcgcaatagaccttttatttctgagggaatttttacatttatactctatcccagaaaaatggctatctctctttttgagaaattttatacctcacaaaagcgcttgcgtatg

SEQ ID NO: 38889 - DNA, 61 bp, Heterodera glycines
cgccagctgctggtcgaagatcggcgagttggtcatcacctggtagcgccggtcatggtgg

SEQ ID NO: 38890 - DNA, 502 bp, Heterodera glycines
ctaaaaattggctagaaaatcgcaaaatttggacaatttttggacaaaattctcttaacaaattgcacttaaattttcaaaaattttcccggcgtacctatcggcaccgcctgaccatattccctcgccccaagtttccaaaaaattttttttaaatcgcgccgctaaaattgtaaaatttttgagcctcggttttcgatttccgaattctgaaatttttgggcccttggaatggcatgttataaaatgccaaagtggacgcacttttactggcgccaacgaatgaatttgattagattattaaagtgaaaaaatgaagatttacgagtctttaaaaataaaaattgattattttcgttaatataaaattttggtcatcccccgaccggggtcccaaacccccgacaatttagctccccccgacccgacccccgacatgtcgccccccgaggtccccggcccccgacatttcgccccccgagggctcggggcttaaccctag

SEQ ID NO: 38891 - DNA, 958 bp, Heterodera glycines
acatttattgatattaaattttatcattgtttgattattattattattattattgttgttgttgttgttgtccaattaaaagcatttcttccaacaaacacttcacccaattcggcacatttctccccccccccccccaaattgccattaaaagtgttcgcgtgagtgccggaaatttgcatttaatgtgaggaggaaaatgcgattgaaagtgttcatttgttgccaaaagaatggatttatttttgatacgaaaatgaatttggacatgttcaaaatgtttttttttcaatttcgaaactcaccggtccatccgttcggacacgaacagctaaagccgccctcgagggcatggcacgtgcccccgtgaaggcatggcgcgttgaagcattggttcagccgttggttgcattcaccgggcacactcgaatttgctaaattttaaaatttttgattaatttaatcctttcaattggccgactgactgataaatccgcgcggacattcgcaactgaaagagcgaagtgttgaaatggggcggaaaatgaagtcatccgtggaaattgtctgaaatattgaatcgatttattttaatttatcgtaaccaatttaaatggtacggtactcaaacgcacttcggaaagccttaaaaaacgaagggcacttcgacaccttaacaaaaatcaacgatttaaacaactttttgtgtgattgaaatcagtcggattgcctttgaaagtacggacacggctcggacacacaaagactttcgcgcttcaaaagtatcggagcgccgaacaaaatgctcaggtttgctcgaaattcctcgatggcatcttcgacgagccatgagctgaaaattatttgaaatttttcatttttttcatttggtcccttttcccgttcccgttggcattgccttttgcataaaatcccctttttgccccccccccccccc

SEQ ID NO: 38892 - DNA, 1139 bp, Heterodera glycines
  misc_feature (64)..(64): n is a, c, g, or t
gctgtccagcatggatagggatcggagttctaaatttatggctctttcggcgggtggtaaagtnttctgagtgctacaattttgctttctgggtgatgataccgaccggaaaattgctgttttggattgtcttgatatattctctgcattggttatgacacataattccgagaaatgtgtccaactgaccacaattgtagaaaatgacgttccttcgttgattttggaagctttcatctgagaagaaccgttattttggctgtttcgccaagaaattcgtgcagcattttgaactgccttacccttcgtaaaaggttgctcgcggtttaacggctatcctatggtcatggccaattcgggttaagcgagagccctgatgaaatgcatgttcaagtattcgttgtaaaactgttcaatgaggactgagtattattacggaccaatctcgaaacaccttcgcctaactgtaatggtttcattcggcctaggccaagcccctttcatcaattgatcaacctttaattccacatcaatttacttgaaaaaggcgttcaacgaatctgctcctttgttgccgtccaaattttggattgtattcaatgtcattgtgtgagccgtttaggcttcgattcgcccatgccatcatgccatcaattactagtacaggatgaaggccgctcattctctccgaatccatttaacatatcattaattgtggcattgtttgtcatgatgggtcgccttacacaatttcaagaagccgatgtctaaactcgtttttgtccgcttcaatcccgttgttttagctggaaaatgaatatttgcgagctaccacaaagatactactcgaagaaactcatataattcggccaagttcagaactttcttaacaattcgctaaagaagtcagttgccattgtttatagcagcaatgtgatatcagtgtaaaagaacggatcaattcgaaacacctaatcgcagcaatacatttgttttgtaatcaacaaaggataaaatgcaaagccgcagcaaagcgtttgtgttgcgccagactttacccatgattttcttttcttttctcattgatctatgaatatcccttatcgacttagtatggtagcattcagaatcgttcatac

SEQ ID NO: 38893 - DNA, 817 bp, Heterodera glycines
  misc_feature (747)..(747): n is a, c, g, or t
ttttcaagagactgatttttgggaaaattgttggacaaaccgtgcatgtccaaacatttgcgcctattccaaaaatcggtttcaaatttatgttttatagccggaatttacagatggcattaggctcacaattaggcgcaaatatcgggtaatcctgataagcccccgggaaaattgttggttttattttcaaaaaaataaaagaattctttgttatgctttgaaatgacgtcagatttgggatcacaattgtacttgaatgcaacaaatgtttgtttttttataaggttgacggatgggcgacaacggcggccaagccggagcagcaccagcagcagtacagcaacaactgcggcagcaacagcaacaaccatcaccaccaatatcaacagaatgggaccaacagtggcaacagcaacaaaaaggggtactgtaaggggaagtgtgacggcgtaggcacatttaatttgcaaaattgggtactgtaggggggcgggagaggccggtgccccggaattactgttttttaaacaaaaattgctaaaaaattttcaagaatttttttgtaaattttttaagttctcggggggcggggcggctgaaacacgtagttcaccaagcttatacggttataccgtataaattttaaaattttatttgcctcccccccccccgctcaaaacagccaccatcgttcccactcgacgactccgttcgctgctgctgaactgttgcaggaaaccacgntggtggtgaccgtgctgctgcacaactacgcccaccagtacattgactccatgctcacgctgtacatcgc

SEQ ID NO: 38894 - DNA, 1260 bp, Heterodera glycines
  misc_feature (33)..(33): n is a, c, g, or t
tgctagtcatgattattaaattaagttttcacnatatgtaacattaattaagtgtatatttttttttcaaatatagatttttgtttatttatggatttagttttttaaatatcaaatgagtgggacgatcacaaggtgtgatcgggttttccgacgggggagtcggaggccaagattttgattgaatagccatttcattgatttgatcaaatttggtaaaaaatgtgatgatttatttaaaaaatttaatttgaaattttttcaaaaatgttttttgttttttctcagatggccacgtgctccatgttgcaaatattattggcttcgtctgatgactttttgtggcattttttaaggtcatcattcaacaattagatttttatgaaaattgaaattttggcataattttgccattcatttgtgtaatgcattcatttatattttatttacaattcttttttttacaaatattaaattcaaattgaagccttggctaaaaaccattgaaataataattaaaaataaaaatttaaataaataattaattaatttcttaatgaccaggcatgagctgccaccgaagcgttttttcagtgtgtttgacccatttgatgacgaatacaaacattggaacaaatacggctcaaaacggatggacgagcgattgaacagacaatgctattaccacaacaagcggcattattttgttggataaaatgccgaaaaaagaaaaacataacggcattattttcttcgacagaatgccaaaaacgattgattgatgtcaatttttttgttatgataaaaaggggatctacaaaaccacatcctgggctaaatctctttgcaaaaaaaaatagggctggtgatttaagccacgaaaaatcgccaaaaagtcgactaaaaaaagttttaaaacagcaaaaaaggcattaaaaagccataaaaagacgaaaaaaagtaaaattaaaaagaaatatccaaattaacaaaacaaattaaaaaaaagaataacggagaacgaaaaaatgtggaaattaaaaaaaaattgcaaaagaaataaaagagattgtagacggatttttacaagaaaatttgagaaatttttttatcccatatcctgaaaatatatcaacgcttattgttttaaaaaatgttcgaaattcagaaggaaaattgaacacaaaaactgatggggtgaaaataaaattaaataaggaagacaacaaaatgccgcaattttttaatttaattatccct

SEQ ID NO: 38895 - DNA, 886 bp, Heterodera glycines
aatttggagagattatatcgtttttagtgcgctaggttcgatggaaactttttaaaatataagcctaaaatttttcgcaaatttaaaaagcaattaaaaatttttagattttttattcatctccctttttgatagagaaagcatcagagagccttatttaacttttaattaacatttggtgtgtttcagagcacgttctgaaaaaatacttatgaattaattttgcaaaaaataaataagtaatgaaaaagtcagaatttcgaaaaattttaaaaacaacaagcgttggcattttttcaggttaagttagtcctttacaatggagaaggcctgcaaaatttggagagattatatcgattttagtgcgctaggttcgatgaaactttttaaaatataagcctaaactttttggcctgtttaaaaaggaattaaaaatttttaaaaattttattcatctcccttttgatagaaaaagcatcagagagccttatttaacttttaattaacatttggtgcgtttcagagcagtttctgaaaaaatatttatgaattgattttgctaaaaaaataaaatagtgaagctttaaaaattaataaaaaattttaaattcagaattactggagttagcatcatagcagtgcttttccttgtctttttgatgctctcgcaaaatctggttcgcttctgaccagtttataaaaaaaaagttaagcctaaaatttttcgcatatttaaaaagcaattaaaaatttttagattttttattcatctccctttttgatagtgaaagcatctgagtgcagaaaataacttgcaaataaaatttggtgcgtttcagctgtgaagctgaaaaaaatatttatgaattaattatgcaaaaaacaa

SEQ ID NO: 38896 - DNA, 932 bp, Heterodera glycines
  misc_feature (822)..(822): n is a, c, g, or t
  misc_feature (831)..(831): n is a, c, g, or t
  misc_feature (866)..(866): n is a, c, g, or t
  misc_feature (885)..(885): n is a, c, g, or t
aaataaaatggcgattgtgcacagccctccgtctcatgctcgagagcatttgtatgtgtataaaatttatcaaaaaaagagatagccatttttctgggatagagtataaatttaaaaattccctcaaaaataaaaggtctattgcgcaccgccctccctatcatgctcgagagcatttgtatgtgtataaaatttatcaaaaaaagagatagccatttttctgggataacctctaaatataaaaatcctctgtgaaataaaatggcgattgtgcacagccctccgtctcatacgcaagcgcttttgtgaggtataaaatttctcaaaaaagagatagccatttttctgggataacctctaaatataaaaatcctctgtgaaataaaatggcgattgtgcacagccctccgtctcatgctcgagagcatttgtatgtgtataaaatttatcaaaaaaagagatagccatttttctgggatagagtataaatttaaaaattccctcaaaaataaaaggtctattgcgcaccgccctccctatcatgctcaagagcatttgtatgtgtataaaatttatcaaaaaaagagatagccatttttctgggataaactataaatataaaaattccctcaaaaataaaaggtctattgcgcacagccctccctatcatgcgcaagagcatttgtatggtataaaatttatcaaaaaaagagatagccatttttctgggataacctctaaatataaaaatcctctgtgaaataaaatggcgattgtgcacagccctccgtctcatacgcaagcgcttttgtgaggtataanatttctcanaaaaagagatagccatttttctgggataacctctnaatataaaaatcctctgtngaataaaatggcgattgtgcacagccctccgtctcatacgcaagcgc

SEQ ID NO: 38897 - DNA, 926 bp, Heterodera glycines
agaaaaggaacctgtgctacgcactgtatgaaatacctaatgcgcaatttggatacaaaaaagagatagctatttttgggcacgttacgatttttctgtcggtgtccaacaccctactaatgcttcgtttggccggataagaaaaggcaacctgtgctacgcactgtatgaaatacctaatgcgcaatttggatacaaaaaagagatagctatttttgggcacgttacgatttttctgtcggtgtccaacaccctactaatgcttcgtttggccggataagaaaaggcaacctgtgctacgcactgtatgaaatacctaatgcgcaatttggatacaaaaaagagatagctatttttgggcacgttacgatttttctgtcggtgtccaacaccctactaatgcttcgtttggccggataagaaaaggcaacctgtgctacgcactgtatgaaatacctaatgcgcaatttggatacaaaaaagagatagctatttttgggcacgttacgatttttctgtcggtgtccaacaccctactaatgcttcgtttggccggataagaaaaggcaacctgtgctacgcactgtatgaaatacctaatgcgcaatttggatacaaaaaagagatagctatttttgggcacgttacgatttttctgtcggtgtccaacaccctactaatgcttcgtttggccggataagaaaaggcaacctgtgctacgcactgtatgaaatacctaatgcgcaatttggatacaaaaaagagatagctatttttgggcacgttacgatttttctgtcgtgtccaacaccctactaatgcttcgtttggccggataagaaaaggcaacctgtgctacgcactgtatgaaatacctaatgcgcaatttggatacaaaaaagagatagctatttttgggcacgtta

SEQ ID NO: 38898 - DNA, 987 bp, Heterodera glycines
atcatcaaactcgtctttgtcaatacgcatagtaattaaggattaccccttcgggatcgaacaaagcggctgaactcacccatacgcttttctaaaaatcttgccaaattcaaaatattacaatataaaaaaattactgtatcaaaagttgagtggttgaagctgacatatacaccgtttcctcccaatttttttctgctcaacttcactacttgtttcccgccttctgatttcgttttcccgatgaaaatatcacgagattgcacattaacagttgtgacttgtacggtgtgttcaaaatcgctgggctcaaagtgaataagcagaaggacaaaaggaaccgccacaaataaaagttgcatttctgtgggcaattaggtttcaatttaattatttaatttttgtaaagtgattaaaaattaaaggatgctagcttggaatttgatgttcagaaaaatttttatgtaacagtttctataaattgcattgcactcatttcctaaatttttttcggcggcgtctgtcgcaccgtcggtcatcagagttcataatcggcaccgctggcgccatgttcgtgataagcgacccagaaagtccttgcaaacatgctttcatgatttttgaaagcaaaaaacattttttgttcagggataccaacggcaatattaccgaaaaatatgttttttaacaattaatattgagctcgctcagaccatgtaagtcatttttagcatatttcaaaaaaaaaaccagctccaggcctggatctaggcctcgaggatccttgatttttcctggacctggaatttcctggattttaatccagaaaaaccagtgaatgtccaacatggaacccaggtacagcttttttcaaaatgtctaactctatgtaattttgtaatttttggactcagattaataatttaaaagaagtgaaagtgaatgaattatgcgctgctggtccatcgcggctcctaaatagcaaaa

SEQ ID NO: 38899 - DNA, 948 bp, Heterodera glycines
tttttcattaccctaagagctgcggaaattgtgaattaattctcagaaaaatggctatctctttttaggacaattttctatctcgtaaccccgatgctaatccgttccggagagcctcttcaaaattttttccttaccctaagagctgcggaaattgtgaattaattctcagaaaaatggctatctctttttaggacaattttctatctcgtaaccccgatgctaatccgttccggagagcctcttcaaaattttttccattaccctaagagctgcggaaattgtgaattaattctcagaaaaatggctatctctttttaggacaattttctatctcgtaaccccgatgctaatccgttccggagagcctcttcaaaattttttccttaccctaagagctgcggaaattgtgaattaattctcagaaaaatggctatctctttttaggacaattttctatctcgtaaccccgatgctaatccgttccggagagcctcttcaaaattttttccattaccgtaagagctgcggaaattgtgaattaattctcagaaaaatggctatctctttttaggacaattttctatctcgtaaccccgatgctaatccgttccggagagcctcttcaaaattttttccattaccctaagagctgcggaaattgtgaattaattctcagaaaaatggctatctctttttaggacaattttctatctcgtaaccccgatgctaatccgttccggagagcctcttcaaaattttttccattaccctaagagctgcggaaattgtgaattaattctcagaaaaatggctatctctttttaggacaattttctatctcgtaaccccgatgctaatccgttccggagagctcttcaaaattttttccataccctagagctgcggaaattgtgaattaatctcagaaaaatggctatctctttt

SEQ ID NO: 38900 - DNA, 915 bp, Heterodera glycines
  misc_feature (709)..(709): n is a, c, g, or t
tcaaatattctttggactgatcagcaactgccaaaagtgagtttaatcggctgattagcataagcaagttgggcaccaataaaggaggagtaatagcggataatgttctcgtggttcagcttcttcagcaggtcaatttccttgcggcagtcctcccgtgcctttttgttcttcattaggtccatctgaaagtccaattgtgccgtcatcctttcccccccccccgccccctcccaatcgcccaaatgacctcaatctttttcagtgccaccatattcccgttcagtttgttccttgccgaaaggacctccgagaattggccctttccgattcgcttttccatttcgaaatgctccattgtgccgtaattattggcaaagttctggtcaatggtcattttcaaagtgccattgggagcagcagcagaagagggcgagggtgacgctgaagaagtgctgctggtgctggtcaattggcccagcggcgaaagtccgttggagggcaaaaattgggccaccctttgggaaggcatcgccgaagggggagaaagcggaaaagggccgcacgcggtgaacggaggcaaactcattattgtggggaattgatcagaaatgagggtgagaggtgatcagcagcagaattggtttaatggattatgacagacggaggggagcgggggaggcgacgatttttggatcaatggggcggngattggatttgcttgcggaatgtaaggggcgagtgagtgggtaaataattaattaatgataatgataatgcagacagctaaacggaattcattggaggtgacaaaatgcgacaaatttgaggggaaatcgattgggttgtgagaaactccaaaagtaagagcagcaaaaagacaatttgggggagttgtgaaacgggaaaagacaa

SEQ ID NO: 38901 - DNA, 1143 bp, Heterodera glycines
  misc_feature (94)..(94): n is a, c, g, or t
  misc_feature (111)..(111): n is a, c, g, or t
  misc_feature (1016)..(1016): n is a, c, g, or t
ataagttcaatttgtaattatatttctttttcatttctgacttttgtgccgcgctcgctaactgaaaatttgtttaaatgaaattaaatatatntagaaacaaaccccatntaaaaggggtaaaaagaagtaaatgcatcattttagaagagattttttatattattaaattcttattaactatggactttaataatctgtcttcaaattcgacaattcttggggatttggtaatttataacattaaaaataaaaaattaatattatcaattttttagttttacaccacttacaaaaatgccggactgagtgccggcctcgtcacaatggctgtgctaattgctttgtgtgctgtgccgggaaattgcatgaatctgttccttgtttatttgacaatcaaacgaaagtaagttttttaattaaaggaataaaattaaaattgattattttattaaatttttgattttaatttatttttcttcgtcatttttgttcactttcttttgcctattccttcactcaaatttttatcaaaattatagggatttgtcgaactcaattttaataccatattccctaaaatatagcctcccccaaaattctgcccgaccattgagaaaacgcccttccgaggggccaaatttgagttcgggaccctgtgactgaccatttttccgtttttttcaattattattttttattttcgcttttaaatttatgaattttaatgataaatcaaatttcaacaggtcgcttcgcgggagcagcaattatttgctggcattgaactcgttctacgagtttctgcaccaaacgggccattacatttttctgttcaccattctgagcggacgcaattttattccgttttttggcagtgccatcttccaactccaatccatttttggctataatgcggcaattttcacaatgattgagacggcggtggaccgatttttggcggtggtgacgccgaaattgtatgcttcagaaaatgaaagaatttatataatttntattggtacttttccattatgcggacacaccccaaaattatacaaaaagaaggggaaagggccccgattttatgcctcctaaatatttttagcggagatgtacgggactatgaagatacattcgatg

SEQ ID NO: 38902 - DNA, 974 bp, Heterodera glycines
taatgtactgtttgcatatggtaacaaagcgaatattaagtacgcactcaagtacccgtttaaagggccaggacattgttatgtcgagtgcaaagaagagtccggcaataaaatcggaattgatgagccggctcaatatgccaagatgaacttccgtggtgcaacggaagcatatgccattgttcattcaatgccatttgcccgtctttcacatcatgttgtcaaattggcaattcatttgccaaaccaacagcccattgtatatagggcattccagctggtgagcaaagctcaacaaatccagcaaggcgaactgccagaaacgcattgttcagcatattggaaacaatggcaaaatgagtggaagaatgacccaaagtttaaggacattctttttgaaaaagtcccagagcagttccgatgggcaaaggacaaatgggtcctgtacaaaaggcagcaaataaaaaggccacctatcggccgaattgttcctgtacccccatcggacccggaaaggttcgcgctctattcacttatgcgtcactttcctggagatccagatcatcttaagatggttaatgggttgctttgtacctcattcactgaggctgcaataatgcatggtcttcttgaagacggcaaaatttgggacaaaactctggcggaggcagctctgtcgcgctggccagatcagatgagatggctttttgtgagcatcatggtctatggccagccgagtaatgccatagaattgtggaacaagtacaaagaccaaatgtacaatccgcaaggcattattactccggcacagcataaagcagcagagcttgaagccctagccgaccttgattggcggctgcacagctgctttaacttaagctgtgtgcattttggcctgccagacccgccaaactcaattgccaaaaatactgacgcggcaattgaagagtttttctttggcgatgatgatttga

SEQ ID NO: 38903 - DNA, 618 bp, Heterodera glycines
ctttggcaccctttcctcattgctccccttccccccctgccttcctcaatacgctttttctccccctccccccaacggcttcatcccccccccttttggccccctccgttctccccgcatttcgctgccatttgttttgattggaatcccttcaaatgtttacactttatctccccccccccccccaccatacgctctctctttctctctttgttaagtgtttgttattgctttggcttttggtccctttgcccttttgttttcccctataaaatattttcgaattccccccccccccattttctgtttatattttatctccactcatttgtaccattcactgccgccacaataataagataataactccgctccaccacatcaaatttcatttatcagcgatttttaaaattttccctgcccaaaaatagaaaaaaggggaaatttaaacccggagggggggggcatgtcgcggacagagggacgaaaggggacaaaaggggtaccatttggggagagaattaccaattcacaacaattgtttttacattttaatatgaaaagataacaacgaagttcacttaattgctctcacgaaacgcggcggaactataaaag

SEQ ID NO: 38904 - DNA, 1177 bp, Heterodera glycines
gctttaaaaatagcaaaaaatcgggagaattttatgagatttatttggttttataatgttcaaaagaaaaaaagttattccagaaattctggaaatttaagatttttcagaaaaaaattcagaactcgtttctgaaaagtcattctgtaaaagtaaaatactacaaaaatccgcaattttttgctctattatataaattttattttaaatttttatcccttttaaaaaaaaagttataaaaataaaagtgattttgggattcgggaccaaaggggggtgaccaggatttttgagtgaaaaaaaattttcaccaaaaatcttcaaaaaacatgtctttaggcgttatttgggccgctgatcacgaatacgtgatcagattttacttttgacatcgtcaagacctcagaatccctgtgtgattggggattctgggacatgttctgaggggggggggcagcaggttcgaatccggacggtgtaacattatttttctttgtatttttggcttattttacaatgtttttaattaatttgaagatttcttttaaattatttaaatttattttttttaaattaaagaatttcattatttatttttgaatttgtaaaaaaaattcatttaatttcaaattaaataaatattcaattaataatttccaaggttgtttttaattaataaaagagtattttattattaaaaaatttttaaattaaaatgcactcgatttttaacctttaataaaaacgtttccttatttatttaattttaaacaatattgtacctctcctaacaatgatgaaccacttctaatcacagttgtcctcttctaatcacttttcttcctcttttaatcactattgtacctcttttaatcactgttggacctcttctaatcactgttcttcctcttttaatcactgctgtacctcttgtaatcactgctggacctcttttaatcactgctgcacatccttttaatcactgctgaacctcttttaatcactattgcacctcttttaatcactgtcgtacctcttttaatcactgctgtacctctttataatcactgctgtacatcttttaatcactgctgaacctcttctaatcacagttgtacctcttcgaatcactcttgtactgttgtgaatcactttggtaactcttctaatcactttt

SEQ ID NO: 38905 - DNA, 1115 bp, Heterodera glycines
  misc_feature (1057)..(1057): n is a, c, g, or t
tttctccgtcttcttcctgattggtcggcaattgggcatgttcctctgaatgcccatcctccatccacattgttcgaccaatttcctcgtcctgttcatattccaaaatttgaactcttgcctggagagtgtcaaggctctccaaaactttgcccacttcagccttcattttttcaattattttcccgaaacgcactttagtcaatctttcctggtaatcaattctcatattcactttaccaacttcttgttcaatatcaatcattttttcttgagcctgaaatgtgtccatttccattgtattttcgagttcctttaaggaagactctaattccctgacacgatcagcagtgtttgaaatttgaatttggttcgaaatttgagcaaattgggtttcaatttgacgaaattgtcggcagacagcctgctcgaatgctctcattctgaccagtaagtttgcccatctttggttctcctcaggcgaaaagtataccggatcaaaatctgacccactattttgagcttcgttgccttgaggcaaatttgtcgtcattttctcttttcctttttatgcgcacacagcgtaattcactttcttttcaaaagtacggcacacagcccggctggaaagacacacttttaccagctcttttcctgttgtttctattggcactcagcccggctggaagcacacagcttgaccagctcaaattcactcgtttgttggcacttagcccggctggaagcacacagctcttaccagctcaaaatttccggcacttagccttttttcggctcttggcctttgcttcccctacattcctttttaggggtcccgggtcgtggcaccaaaaagttgttgtgtccaaaccacttggacttcccggttcttaaccctttttcctttgaccaaggttttttggaaaagagtttatttaagtcagaaagcaaaagtaaaacgaaaggttaaatgtgattaaatgcaaagaaattaattaacagttgaaaaagatcgcttttaggatttgtctgaagttgggaatgtgtgggaaaaaanggtgctgaatgagagaaaaagaggcttaaatagtgccacaaattgggaggggcgaaca

SEQ ID NO: 38906 - DNA, 1271 bp, Heterodera glycines
gatttcttaacaataaaattaaataaagatttatttttatagatatacagcaaattgttaatgaattaataggcgaattagaaaaatgataaaagagggagaattgaaacacaccaagttaaaatacgaaaagtatgaatgggatttgctcaaaaatgaacttgctaacatcggacaagaagaaaaatgggaaggaattgaaaaagcgatgaataattgaggggaaagttatgacaaattatggaatggaactgaaattaataccgaaacttataaaagtaaaaatgaaagagactaaaagaaaagttggaaattttggaaaatggaataaaaacggagcaaaacaaagaaaaggaaacggaaaagcaaaatgagaaaaaggaaaagtgaaaaataatatagggaaaggaaaagaaagatttgctttaatgataatcccaatttaaatttaaaaaattataatacataatgtttgtgatagccaatattaaaaaaattgatgatttttcagaagaatttcatgtcgtgcaatgcaagatatattaaataaaagggcttttgactgatttataacgagtgctgtgcacaatggtttaagattttgattgattaaaaccgaacgacgctatcagtagttaacctccccggtgcgtagtttgggcgggaaaatttcgcgcacaaacgtcagcctattggctggttttaggctttgaagttgccgccacctgtcaatcaaaaggtggccggggaggggaggagtcgagagtgagtgatcggtagggaggggtgcgcgggaggggtgaacctaaacctattgcgtagtttggggaggggtcccgtgggtgttgaggggttgggttgggatttttttgaaatgtgagtgggggtgtgtgcccaattgagtgagcaggtgcaacaatacaccaattaattaattaaacgttttttgtccaacaggactttgtcaatgcgcaccgtcttttggccaaactttactatcagtacgggtcacgaacacagcccattttgttgcgggacgcacccaacccaaggaaattaatcataatatgcttatttaattatttgaaaattaagcctaagcgcgttactcgccggtgcctttggcatcgttgcgcttcatcaggattatctgagagcacagaaattgttgtcggtgaaaaccgagcgcaatgccgaggcagaagtgaatcgattgtacagagaagagctggaagacattgtgaagctgccatttgccattgtagcaggtg

SEQ ID NO: 38907 - DNA, 847 bp, Heterodera glycines
tattttatatatgcattattttttattgattatttctagtcgttttatgtatcaaaatgtgttcgtctttgaaataagtaacacaaaaatctcggtaaatgataacataaactgctccttcggtatcgaaaaagtgtcaaatttctagcagctcaacacacatatacactaaacaataaaatgttagagctcgctcccaattggtttcgacaataattgcacctatctgtatccttatgaagtttgtcggcggaattatgtatatattatatatgcattattttttattgattatttcaagtcgttttatgtatcaaaatgtgttcgtctttgaaataagtaacacaaaaatctcggtaaataataacataaactgctcattcggtatcgaaaaagtgtcaaatttctagcagctgaacacacatatacactaaacaataaaatattagagctcgctcccaattggtttcgacaataattgcacctatctgtattcttatgaagtttgtcggcggaattatgtatattttatatatgcattattttttattgattatttcaagtcgttttatgtatcaaaatgtgttcgtctttgaaataagtaacacaaaaatctcggtaaatgataacataaactgctcattcggtatcgaaaaagtgtcaaatttctagcagctgaacacacatatacactaaacaataaaatattagagctcgctcccaattggtttcgacaataattgcacctatctgtatccttatgaagtttgtcggcggaattgtgtatattttatatatgcattattttttattgattatttccagccgttttatggatcaaaatgtg

SEQ ID NO: 38908 - DNA, 1103 bp, Heterodera glycines
  misc_feature (1016)..(1016): n is a, c, g, or t
aattcaattttaaagcggaatcagaggaggagaaaacatattgagatgcgcacagaacagagagcgagagagagggaaaatggaaaaaattgatcgttttctcctgatcaatcgatatcgagttttggtttaaaaatttcctacatatttgaaaaaacattaaacatgtatttaataatttaaataatcaaaattaagttgtttttttttgattatccccctggaatatgtaggtcgaagaaaaatcatacattttccaaaaacccatacaaggtttccaaaggaaatcttgattcaaaacgaggcagatatgattatacatatattgtcttgaaaaaaaatatatagcgcgaacattacattatactcgtcattttcattatttcccatcatcatcgtcctcctccccctcctcatgttcatcctcagcaacatcatcatcatcctcatcatctttggcattcttttgcgtttggctttgtgtcgtttttgattgaccatcaccatcagcagcagcagcaccattattcgtattggcatttttgttgccgccgccgccaccgctgctcatcaacatctgcaggagacgtgccaccgcattggtcactgtctgtgccggacttgacgagctcgacgtctccgtgtgctggtcccgatgggtacgcgtgccatacggttggaacagacggcgccggtgctccgcatggccaagcacaaccgttccacatagtcctggtgcttgtacatgtactccttgaaaaacacgaggggaattggtaacagataattagtgaattgaagaagaagagcacagaattcatcccaggatgggagttttttattagaaaaaacctctttgaaataaaaaaaaattggtgggggaggaagggcgtcggcggtagagaacatattggagcccccacacaaaattccatgtcaattttctgtttattttttcaaactttttccaaaaaattgttcaacttttttccattttgcttggaatttttctttanaaatgcaataatatacagcgtccccctcttttgttgtttttaatttcaatttttgcgtgccattcaaaaaccgaaaaaatgccaatg

SEQ ID NO: 38909 - DNA, 1044 bp, Heterodera glycines
caaaaaaagagattggcatttttctgggatagagtataaattataaaattcctcaagaataaaaggtctattgcgcaccgccctccctatcatgctcgagagcatttgtatgtgtataaaatttatcaaaaaaagagatagccatttttctgggatagagtataaatttaaaaattccctcaaaaataaaaggtctattgcgcaccgccctccctatcatgctcgagagcatttgtatgtgtataaaatttctcaaaaaaagagatagccatttttctgggatagagtataaatttaaaaattccctcaaaaataaaaggtctattgcgcaccgccctccctatcatgctcgagagcatttgtatgtgtataaaatttatcaaaaaaagagatagccatttttctgggatagagtataaatttaaaaattccctcaaaaataaaaggtctattgcgcaccgccctccctatcatgctcgagagcatttgtatgtgtataaaatttatcaaaaaaagagatagccatttttctgggataacctctaaatataaaaatcctctgtgaaataaaatggcgattgtgcacagccctccctatcatgctcaagagcatttgtaagtgtataaaatttatcaaaaaaagagatagccatttttctgggatagagtataaatttaaaaattccctcaaaaataaaaggtctattgcgcaccgccctccctatcatgctcgagagcatttgtatgtgtataaaatttatcaaaaaaagagatagccatttttctgggataacctctaaatataaaaatcctctgtgaaataaaatggcgattgtgcacagccctccgtctcatacgcaagcgcttttgtgaggtataaaatttctcaaaaaaagagatagccatttttctgggatagagtataaatttaaaaattccctcaaaaataaaggtctattgcgcaccgccctccctatcatgctcgagagcatttgtatgtgtataaaatttatcaaaaaaagagatagccatttttctgggata

SEQ ID NO: 38910 - DNA, 984 bp, Heterodera glycines
aaaacaaagttaggaactcactccacgcaaagccatgattcgcgttcgatcttattgaggctgccgtagttgcagcagcccctcgctttgaccttgtggaaccagcccgaacaaccccaacactggacgcccaaatggtggcattttcggcacgacttttcctgcttgtcgtaggaggcttcagcggcagcctgcggagaacgacgaggcgtggcagaggccagcggaggtggaagaggcgtggcagaggcccgcggagatcgacgaggcggcgtggcagaggcccggacccgcggggtggaagaggcgtggcagaggcccgcggagatcgacgaggcggcgtggcagcggcccggacccgcggaggtgaaagaagcggcgcctgctgctgctgttcctaaaaattttttataaaaggatgtacaaaacgtacatttacatgggcacccttgtaaatgtatatttagtacatatttatttatagataattacaagggtctaagaacattccaaaaaaaaaacccgcagttcccgagcgtagactggtgtctcaaagtcgagaacttcacggcggcgagcagcatcggccctttcgtccatggtcaggtcgtctgggacgtcgttggcatcgtcctgctgctgctgctcggtgttgtgagccgcatcctcttcctcctcgtccccttcgctttcgctgctgagctccgggccaatgtccgcgagaccgagcttcttcagcttagccttaggagcgatctctttgagctgttgcacttgctgaaaaaggtcgtcttcggcagcgcggatggtgccaatggcagtgttgacctcacgtttcagctcccttttgcgctttcgaaacttggctttggtgcggtcgagtgcatgcctggtcaacaccaccctgtgggagacaatgagaaaataaagtcagatcaaagctaaatttcagtccgattacctttcgctgcagcagcccaatga

SEQ ID NO: 38911 - DNA, 1047 bp, Heterodera glycines
ccgttaattctgtacacagcgcattaaaaattcttcaacattattgcgcagaatctcaaggcattattaactagagtttaatcaaatttttaccatatccggtcgccagcgaccctatagaattggactagttgtcgcctcaattgatccattaaaaattctctctaagagaagctttttctaatttttgacccaaatttaatgcaagctttaagcaatatattacgacggcctattttcggctggcaagagtgggcagagtagatcggcagctggcagcacccgcgatggtgccagcagtgccattgatggcacaccctcgttggatgttggtgacattgttggctgtggtgttaaccgaattggcggcagaatcacttacacactgaatggaaaacacttgggtatgtgaatggaatgggggaagggcaattgataaatttaaaaccgaaattattagatcctaataatgtaaataaatagtatttttttgcactaaaatttagttacaaaaaatttttcctactacaaaaaaatttctccgacccctcctttccaccaaaaaaaaatttaatagaataattttttaattggcaaattttgagatggttttgttctgttttttaaattaaagacaagcaaatattttattatttcaactgaaaaatcattttttggtttttttctcttggacaaaatcctgttcgtttaaatgcaacttttggttcgatcttttcttgcacaaaaataactccaaaaaaatgctgaataatttttcaataaaaaaaatgttcatatctaatattctcgtgtttatagagcgactcgtttttttaattttatttttcgcaacatccccatggctcttaccgtctgaaattttttggggatgttaatgtttgtttgtaaattaatgtttgaagaagaaaatttttattcttttagaatttttttttattttggtttagattaaaacctggagatattttatttcaaattgaaaatatgtaaaaaaaataatgcataaataaaacagaaatacaaaaa

SEQ ID NO: 38912 - DNA, 1018 bp, Heterodera glycines
cttactatgatggttgtgtcggtcaatggccagcgaacttccaaaatttgagataaagacgggccaatttcgcggaacaatgaagtgccaagacttacagcacacgaacaaacatttggccagtaaggagcaattttcaaaagcaccgacaagaatttaattcaaacgatgacctcaagttgaattctataaaaatatgcaaataaaacttaataattttgaaaattgggaaaaaactttcaaatacaaaacatgaaaaaattatcataggctttttattgactgctgtttacaaaattctgcttctgcattcactactacgcggataaaatttaaaaaaagcgaatttcggagtagtgccattgtaatatttttacgaagtgataaaatgaacttacaatcagctattgatcgcatggcgatttgtctctgattttggaggtcatttattatttatttactaattattctttcgtccattctctcgaaggtccttcattttcttacaagtaaaagtgtgtgcatttgcttattcctttatcaattcaatcgtccgatgattgacctgttataaaaaaaagatttcactataattaaaatagaaataattatctcttggtttattcattgaaaggaattacctcccatttttccaataattattcattttaataattttattcaataagtgacatccaaatcaaagttaatattaactaataggtaatctaaagattggaatgtttaattttgagactaaatttttgagtcctcaaaatttaggacaaatagtgtgcgcctacgggaaaatttaaaatttagttgaaatttgttaacataaagaaaatatggacaaaaagattgcgttgaatacataaccttaaaaaatactgattatcagacagaaaattcattttcccaaacaaatttaaaagaattttcttaaatttatttgatcttcacatttaaagaaattacattttgtttattgcattttcttgatattttattgctattt

SEQ ID NO: 38913 - DNA, 1026 bp, Heterodera glycines
aactctttaatttcggtcattcatcatcaattcggttcctttccggtttcaatttccggttcgtagtgttttttcgattcccattagtgcggggggagggtaatcgaatcggaacggacgaagaaatcggtggtagggagcaactaatcgttcatttcgttaatcgattttcgtgccgatcgtcgtcatcaaagaaagagaattaattcggtattaacgttcaaccaatcgttctctctctctccctccaaccctctctctctctccctcgctgtctctctctctactctctctctctcacacacactctctctctctatctctctctctctcctctctctctctctccctccctcgctctctctttctctctctgtgttccttccctctctctcttccattctcttttttgagaaatttagacattttttgggattttgccggggcagagaagggggagataatttttcatcatcatagtaaatatcaatcgtttaattcttcggccccaacatttcccccccccccccttctcccctctcctccgacttcgtttgtggcagctgtttccacaaatgtttctcttggcttttctgtctgtgtcctttttttctttggcgccctctttctgccaacttatgtgagcagcagacgaccacgaggtcttttacaacacattaattttgaatgacgatgaatgatgaaaataatggtggagggagagaagaaaagcattggagagaagggaggagagaaagttaggggaagagaaagaagggagcgataggagggggaggggaaaagaaaaaggaggagggagagaaggggaggagagaatgggggagaaaaaggagaacagcagggagaggaaggggaaggaaggccgtgtcggactgactttgactgccaaatggtgttaatttgcggaatgactctttgtgggtttgttgcattaaataccaaagacgacacacggaattagtcgatatttagagaattagtgccaaaagtgaaagaaaatgaaaa

SEQ ID NO: 38914 - DNA, 862 bp, Heterodera glycines
  misc_feature (856)..(856): n is a, c, g, or t
aaatttcgatttttgaggcctcataacttttttttatttttgatctcacaccgctaatattaaaaattcacaacagaagtcgaccctgctcgatccaataataccaaatttatacccactttttgactaacagttcgcgaggttcccttgttagtccatttaatattttcgacttgattggcccatggtaagtatgtgaaatggacttgtttattaattttgaaaataagcattatattggcaaaatgatcttaagtatatttgaaaaaaaaaaattttttttttggctacgtttttatccaaaaatctcaaacaaacaaaaaaactcaaaaaatcctcattttctattaaaaaaaccataaaatcgggatataaatcctcacatatctgaactctctattattttatttaattgaaatggtatagattaccaaataatttaattaaatggcctcttcacgtcccgaatattcgggtccacctgaacaatattatgacaacacagaagcacgcaaatacacggcaaattcacgcatgcaaaaagtatggcagcaaatgaatttagaaattacatttcatggttttcaccactatttaaatttataaatttgtgaaatgtacggcaattttttgaaattttcgatttaacgcaaaatgaaaaattttctcattactaggaaaagtggtcagagttggctaccccaagatttcttgcaaatataggtctatgctagagtctggtgtgaccaggattcccgcaggatttgggggattttacgtaaatcccgatcccgtacttttagaccaaatttttatcctttcatccaacagatccagcgtgagcttgcccagcgtncatgaa

SEQ ID NO: 38915 - DNA, 1008 bp, Heterodera glycines
gggcagtcccccccgaacgaatgcgcccatatttatgggagaccaaatccttcgggagtagcttccctatagcctgtactttaattctgcgttggatttttgctccccataattgtttgagtaccccaaccggacacttgaaaaaatcgatttttttgttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgattttttttgttttcggggcagtccccccgaaccgatgcgcccagatttatggggagaccgaatccttcgggaatagcttccctatagcaggaggaggaggaggaggaggaggaggcaaaagtgaactgagggacggagaagggataagtgaaggtggaggagagggagaaagggcaaaggcaattaagcgacaattaagggcaattagcaaaatgagtgagtgactgctgctcggatttgggcgttgttattgggaagaatcggttgttaagttgtacatttgtgttgctgcagacgacgagtggttggagaagacggaggggacggacgaaccaatcgacgggttccaagggcagtcagaaacgactgccgctttcaggaggacgacggatgagtgacccagaaaagggaagcggcggcgggggacaaatggacgagcagcgagcgtttcttcttcattcccatcttggtcgctgatctctccaattgaattggatgtaatattcgctgcttcatggaaagccgtatttgaaaaaggaagaaaagaggggggggggggaggaggaagatgagtaatgggaaagtgggaaaagggaaaaggggagggggaaggagagaaagaggaagaggaaaaagaaaaacggaggggacggatgaatgggaaaagcaaatgcaaagcgaacgcacggaagaa

SEQ ID NO: 38916 - DNA, 845 bp, Heterodera glycines
actttaatggtcggggttacgaagaactgcgatttttacaaatgttcgagtctaacttttatcccaagtttcattttattgcagaactttaaagccgttttttatttattttaaattttggcagggggagccccaactgtggtgaccaattcacgcgatgtaacatttgaaaaatgaaagccatttgttctccccaaaaagccacgccatttcattgtccgccgctggggtttcccaaaaaataaaaggcgacaaaaaagagtttagtcataatttgagacggtaaatgctagggaaaatgagaaatgaaagagagtttggaatggcaaaagtctcaactctcgggccaaaaattccttacattcaaatatatttaaacttcgaaaatatttttgatcaaattcagaaaatgtccaactttattattatgtcgcaaattccatgggaaaaaatcaaatatttttttgtttttttgttgtccttaatattcctttttattacctacaaaaactacggctttttatatgacaattcggcattattcaggtgacttaattgaaaataatattcacaaaaaacacatattttaaagaaaacaattatcaaattaataattaatttaggtttgcctatacggaaaacaatagcgttacaatatcaccagaagaatgctgcggtgaaaatgtatttttaattaattatttactaaaatgaaataatttaaatattaagatggtttacactttgaaaatgaacgactcgcgaataattcgtggcaaaaagtttaattgctcattaaaatggcttttggaacgctacaaactttcagacaaatatgcaattaa

SEQ ID NO: 38917 - DNA, 1549 bp, Heterodera glycines
ccccccccccctccacgcccttcagagcacgacaaatatttcaacaaaaattttgaaaaattgactagagcaatcgaacgctaacggacgacctaatggaaaaaaatccccgaaggagagaatttaattaaatccattccttcgggggaccgtgccgggtgccgcggggtaagcagtgctggttcgtttcatcacggcaccgaaccttttggctagtcagcaatcgttgcttaacttgccagatcggacgggtgcgcatgattccactgttccaagcaccccaccaaaagcaaaacgatataaccaaaatataaggaaaaattttttaaaaaattttttctccatcttcctttttgatactaaagcatcagagtgctaaaattaagttgtaaataaaatttggtgcgctttagagcactttctgaaaaaaatatttatgaaacaaaaaaatcgattttttcaagtgtccgtttggggtactcaaacatttatggggagcaaaaatccaacgcagaattaaagtacaggctatagggaagctattcccgaaggattcggtctccccataaaatctgggcgcatcggttcggggggactgcccgaaaacccaaaaataaattttttggataaaaattatttaaataaactgactagataatatttaaaataggttatttctcttcctttcagtatccctgcaaagtttgctgcgcttctgatcagtttctgaaaaaaagttaagcctaacatcggttcagggggactgccccgaaaacccaaaaaaaaatttttttgaataaaaattatttaaatgaactgactagataatatttaaaataggttatttctcttcctttcagtatccctgcaaagtttgctgcgcttctgatcagtttctgaaaaaaagttaagcctaaactttttggcctgtttaaaaaggaattaaaaatttttaaaaattttattcatctccctttttgatagaaaaagcatcagagtgcctaaactagcatgtaaataaaatttggtgcgtttcagagcagtttctgtaaaaatacttatgaattaattttgtaaaaaaataaataaacagttaaaaactcagaatttctaaaaaaatttaaaatcaattacaattgtcattttttcaggttaagttagtcctgtaccggggagtatgcttataaaatttggtacgattttattgcttattgaaagagctagaaccgaagaaaattttttttatttaagcctaaactttttggcatgtttaaaaagcaaattaaaaattttattcatctcccctttttgatagtaaaagcatcagagtgcctaaactagcatgtaaaataaaatttggatgcgtttcaaagcattttctgaaaaatatttatgaattaaattttgcacaaataataaacagttaaaaactcaaaatttctaaaaaaattaaaaccaattacaatttgtctttttttcgggttaattagtcctgtacccggggagtatgccctataaaattttggacgattttatttgcttattgaaa

SEQ ID NO: 38918 - DNA, 1316 bp, Heterodera glycines
tgccctcaggcgagaatacaaaatatttttagtcaattatttaattaattaattgaatttttgcaagtgacgcgatggcatttcaattgtatgtatggcatttggtcacgacataaatcgctacattttttttgcgcagaaaatgccgaaaaattttgtattttcacgacatatggcaatttataatacgtttagatctcaacgattaatttcttttatttatttttcggctttctacaataaaatggacgcgatcaagaaatacgcgatcaaaaaattccatgatttgggtaagatttttaagaaaaaaataaattttcaaaaaaaaatttaagttaaaactgcaaagagcccacaattgccgaccacactgcccatggaaaagttggtttggccaattggaaaaaattttcttaaaaaattgggccagcccatcatggcaaattcagacagattggcgctatatacgattttaggcgcccaaacaatgactaactcagtttcttgggcaataacatttttcttactttattaaatacctacattcttggtataaaacgaaagctgaaagtctcgggaatttattaatacaagaaaagagcaaaaattggcattatgcaaaaaatacactgagaaagaaacaagaaaatcagcttttttcaagtataattattaattaaaaattaattttttgttttttttttgctttttacttttagcccagaatttattttttgcaaaaacttccatagaatttaagctttcgtttggtaccaagaatgtgtgggccttgatcaagtaagaaaataattatgcgatttactggtgctcagattttctcaggttccaatatttttggctggcacccaaattttctgcccgcttccccaaaaaattggcccaaaatttttagccctgcatcactgcaatctaagttggccagattcttatttttgcttttaatccagaattaatttttacaaaaactataaatttcaatgccatcatcatgaagtaggcattattgaccaatcaaggaaaaaattatgctatttctggtgctcagatttccctaagtttggccagatttaattggtctcataaaaatcttttatccccccccccctttaaaaaattgtcccaaattttccaagatatatggaattgttggacgaaatgtacaggatgagcattgactatgccgaggatggtcgagatgatgagaaggcgttcatattgaacatcagatattgcaggcaagtttatcggcaaaaaaaatggaaaaaaatatatattaaaaatggaaattttttctc

SEQ ID NO: 38919 - DNA, 898 bp, Heterodera glycines
ttcacttgtccccctatttttgggttgcctctgatggggctggttctgatgataccaagtgataattgatgtgataatgataattatgtgcctatttcaacaattttttctgatcgatgatcaatcggtcattcgcttcccccgtccgcgttccctacaaaattcgtctctattttctattttctgttacactttcaacatgtgtctattttatacattctgctttgctcttccctttaattatagattatcaattagttcattaattatctcgctaattggtcttccttcaatcattaggctgttactttgtgcctttgggcccgtttgattgattgcttttgaagttgccgattccacgcccactccccctacataattagtgttaatctcttttattcgctcgtttccttttccgttcattttacgtttttattcgtccctttttcaaattgtctcctctgtatttttcaaatcatttctttaattagtcccgtgactcctcttttattttaactgacgtcaactgtctgtcttttttttctgtctttaaattgccctaataaattaattaccctattaaatttcgttgtccttgaatttcctttctttccctctgcctttgcttggctttgttttgttcccccaaattcttaatccccacaaaatcagttcgaccgtcgccatcatcagatggatggatgtccttttctcagtttgcattgatttatttattggcttcccccccccccccccccctcttcgcttatcatttaaaaactcgttttctgttccattattttttgtgctgccattgtcgagagttggctaatggccgccgacccgagagtgggaaatttggggggaacagcagcacatgctgaggatgatgctgggg

SEQ ID NO: 38920 - DNA, 1256 bp, Heterodera glycines
ccccctcgccacagcgtactttggtcggccgccgacaaaatggcggcggcgattgccgacgggaacaaacgaataatgacggcaaagagacagccgaaggtgggggagggaggggggaggaggaggctaatgagctcagagttcgttttttgagtttgtttttgattcatacagcaaagaaacagcgtctttcccatgctctctggttctttcccattctttgtttttttaaagtttcgtaattttcagcgcttttttgcatttttaaaatgggatttcattttgtgtttaaaaaaaaatatttccgttactcactctgttgttgctggccatccaccgtttggccacttctttgcccatgttcagcgagttcattggcataaattgctacgataaatgaataatgatgatatcaaaaaggtgctgccatcgcgtgattatgctgtttgatctgctgctattgtgtgccgggtgatgggaaaagaaaaagcaatcattcgccgatcgatcgatgaacgcacggaccaacgaattgactgacctttgagaatcgattagtggggcaaaaagggggggggggcaagagcaagagggcatgactaattgacgaaaatgagggaggacaaatcgattcaattacgtcgcgagatccccatatcccctcctcttctcccccgctaatgggatattataataaaattgaaattggaaatatgtatgtaattaaaacagaaaagggcgcccggggggtcattttgctcagcttaaatttccaattccaaataaaggaaaacaaacaaattggcgagaattgtgcgaataaaacacacactccgccccattttatagtgctagcagtagcagtagaaaagaacctcggaggggaatcaataagtaaaaaaagggacagagaatgacgggaaagggggcgcgaaatgcaaagtgacaaaggcattttgcgattaattgggtcattaagcaacaattaccgacccttctcaattaaatctcgaaaaacaaacatttatatttttactctttagaggtcacaaaggtaattttatgttttttgaaaaacggcaaaatatggacataacgcaaaaaccaattttcaatttcaccaagctaatctttataaaaccatgttaaaattattttttggaattttctgagtcaatcgcatgaattcttaagcatttttcgcctaaaatgtgaaaatgaatttcttaaactaaacacgaattaaacagtaatta

SEQ ID NO: 38921 - DNA, 888 bp, Heterodera glycines
ccgcaaaaaaaaattgttaaaaatctgatttttgatcccgaatgcactgaaatttacgatttgcttatttcctccccaaaattgttaaaaatgatcatgggaggtgaaaaatataatatttgatacattttttatcgaataaattgtaaaaataactgttttaatgcaattttgcaaaatgttctgattttcgaccctaaaatctgattttttgggcctgatgttctgatttggaaaaattttcgatggaagccctgaattaaagaccaaatatgtatatttctaaggaatatgcaaattctgttaaatcttccgatcattcagatacagcccgggggcatgtgaactatttttaagtttcacgcgccgaggtcaaaatccgatagaaccggaaattaattcccggaatccgagttctgttccctcgagttcgaattagccgggaaaaattgtttggcgatttgcccggcctccagaaccggtccaaaaaccatcaaatttgaacggtcattttttcggaggcccaccgtgtcccattcggggcaccaaaagtcgcttatcaggaacccggaccggtccggtaaagaacaagtatttgtcgttttttacgggctttcttcggctaatcatccgatgcatgtattagggttttgtggcattcagtgtgaacttacaaattagttcaatttagcccggtaaaaaatcagcgtttgacctcggacaatacaggtacaggcatttttcaaaatgccaagccttaattttatcggaacagttttttgtcaatggtaattaatgaaactcaattttcagaaaaagaacggacaggaaatggtgtgaaatcaatcatatcatcataatatgatacaaaaaagtgtgctttttgat

SEQ ID NO: 38922 - DNA, 910 bp, Heterodera glycines
ttcgtctgacaatgagcaattcactgaaactttgctgctttttccgcttccgaatggcgaccttttcacgctgttcaatttcactgtttttgcacaccaagaacatgaaaattcaggtttttgaattcaagaatttatacattttccgggggacttttttgtttacgtcgaatcaaaatttctagagctcgacattttaaaaagaaacaaaatgcctctggattatattttttttaccagaaaatatattagacctggatttcctggaccaaaattcatgaaaagttaggtccagaaaaaatccaggctttccatgtcctggacccggattttttttttcatttttggcctagattcttgtccaaattcgggattttgtcaaaatggatgtcagatttgtaattagcgaccacaaaaacacccgtttaccaactttttatgacaaaaaaattttcaaaaccaaaaaaggacccctagtgtttttaataatttatctaaaaatctaatttttttttacaattttcaggtgctaatgccacaaggcatcggcctattcttgtcccaagtcttctccaacatttggccaaccaatttggcatcacggatttgcatctgtccattgcgcaaggcttttggcggccaagaatttggggcgcacaaatgccgtgcacagaagtgcccagtggcaacgaattaattgccaaatttgacacatgccaagtggctaattgcaggcaatatctataaatgccagaaaaaatttttattataaaattaaaaattcggcgatccggggttttaaaggtcgctaatcacgaatctgacatgtattttgactaatttctaatccctaacccgaaccgaataacaatcgaaattttgaatttttaaattatgattttttgttcaa

SEQ ID NO: 38923 - DNA, 892 bp, Heterodera glycines
tgtataatcccatccctaataatgtaaattgtcctatctccttcagatccaagcccgtcataaaaactttcgctgcctgttcttctcatcccaagcttaatcctttctctctgatttctcgtgccatttctatcccattcacctctgttgtaaatgccatccattttgtttttgccgtaattatctctaatcctatccaaagtccgtccctcctcccatggtgcagtgcgaaggaacaacaaaggcataaggacaacatttcaccctctttccatccttctctccctctctctctcgcttgctttctctttctctctcgctttctctttctctatcgctttctctttctctcctctccctctctctctcgcttgctttctctttctctctcgctttctctttctctatcgctttctctttctctcctctcgctttctctctctctctctttctctcctctccctctctctctcgcttgctttctctttctctctcgctttctctttctctatcgctttctctttctctctctctcgcttgctttctctttctctctcgctttctctttctctttcgctttctcttctctcctctcgctttctctctctctctctctttctctctgtttctctctctctctcgctttctatttctctctctctcgcactctctccctctctctgcctcaattattctgtctatcttttgtctcctctccccatctctggcacgcgcgcctccctgctgccgccaccaaagcgtgcgtcttcaacgccacacgaccgaaactcagacaaattaaatgcccaatttttatgtatggccaatggacgacaattgatcaaactaaaaaataaataaacaatcaagaattgcaccgcattaataagca

SEQ ID NO: 38924 - DNA, 1371 bp, Heterodera glycines
  misc_feature (1180)..(1180): n is a, c, g, or t
aaaaaaaattatcgtcaaaaaccaatttgactttcgaatatcttggaatgtatttgttttgcaattgtgcgggcgaaaatgataaagaatgagattttgtgggattttatgcaaaaatacccttggtttttccaattttttaacacatattttagcacatatacttgcattttttggtgtttttagcacatatttcagcatttttgagcacatatttattacatatttcaggatttttagcacataaaaatccggtctttagttataagactacaaacgaacttatttgtttgcataactaaaaaaagttttttttttttgcaaaagattcaaaatccaccggaaattactatttaaatcaattttctcacaacttttacattaaaattattttagatttactaaaaataatatttttgaaatgatatgggaatttcttagttgaattacgtaattttacgttggtggtggacgtgcttctaattgcccgtatataaaaaagtgaacagaaatgagaaatttcattataaaatttattatgaataacacaaatattgctaaagccttgttaaataatacaaattatatttttgtaattggaatttaatatttaaaaaaacactctaatttatctttaatataaataaattatagactctcaaatattttatacaaaaattacaatcatttatttttataatggaatttaatattttataaaaatatttttctttttaaattaaaaaaactctaatctataattaattttaaataaatattatgactattaaatatttgattttaattttatctttaatattaaataaagtaatatgacaattaaacataatatgtcacaaaaacacgttccccggagtaccataatacattatcatgaatatttggtttaatttggacaattccgaacccggagcaaaaaaaaagggcgacctttttcaaatccatttttggttcaacaaaccctcttctaaaacccaaatttagctaaaaattaattttaataaatgaatttagcgttaacttttttgattcagtgcaattgagttaaaaattccgtttaacaattttatttattttttttaaacaataattctctcatctatacataattgatgtaaatttaggttaattacacaatgtttcaagaataattaataanttgatttgggcatctacctttggttccgatgttaacctgcatttatcaaattgaattgccattattaaaattattttcattttttattttccggccactttccccatttatcaaagtccaccctgatttccccccatataaaaggggctattctttaaaaaaaggggacttttccttaattttaatttttc

SEQ ID NO: 38925 - DNA, 1267 bp, Heterodera glycines
ctatacgggaagctattcccgaaggattcggtctcccctctatctgggcgcatcggttcggggggactgccccgaacacaaaaaaatcgattttttcaagtgtccgtttggggtactcaaacaattattaaaaatttttagatttttattcatctccctttttgatagtgaaagcatctgagtgcctaaaataacttgtaaataaaatttggtgcgtttcagagcagtttgtgaaaaaatatttatgaattaattttgctaaaaaaataaaatagtgaagctttaaaaattaataaaaaattttaaattcagaattactggagttagcatcatagcagtgcttttccttgtctttttgatgccctcgcaaaatctggtccgcttctgatcagtttataaaaaaaaagttaagcctaaaatctttcgcaaatttaaaaagcaattaaaaatttttagattttttattcatctccctttttgatagtgaaagcatcagagagccttatttaacttttaattaacatttggtgcgtttcagagcacgttctaaaaaatatttatgaattaattttgcaaaataataaataattaatgaaaaagtcagaatttcgaaaaattttaaaaacaacaagcgttggcattttttcaggttaagttagtcctttacaatggagaaggcctgcaaaatttggagagattatatcgattttagcgcgctaggttcgatgaaactttttaaaatatgagcctaaactttttggcctgtttaaaaaggaattaaaaatttttaaaaattttattcatctccctttttgatagaaaaagcatcagagtgcctaaactagcatgtaaataaaatttggtgcgtttcacagcacgttctaaaaaatatttatgaattaattatgcaaaataataaataattaatgaaaaagtcagaatttcgaaaaattttaaaaacaacaagcgttggcattttttcaggttaagttagtcctttacaatggagaaggcctgcaaaatttggagagattatatcgattttagcgcgctaggttcgatgaaactttttaaaatatgagcctaaactttttggcctgtttaaaaaggaattaaaaatttttaaaaattttattcatctccctttttgatagaaaaagcatcagagtgcctaaactagcatgtaaataaaatttggtgcgtttcagaaccctttctgaaaaaaatatttatgaattaattatgcaaaaaacaaataaataatgaa

SEQ ID NO: 38926 - DNA, 1123 bp, Heterodera glycines
gccgcgaagcggccgaatgcttcccacaaaattaaaaaacgggcgcgaaagcgcccggtccccgtgaggtcgatgaattgctaaattacgtcactttctagcgacgcggcgaagccgcgtccctgagcgcgaagcgctttccccacagcaccaaaaaaaaactgttcacaccattgccaactgtgcaccctagtttctactatatatagagaaaaggtgcaactcgtagaaaaaattataagtgcccgtggtttgcccggaggctcatgaaagtgcggcattgcttaagcaactttttgaggcgcatctgggaaaaataaggatttttcggtccggcggccagttgagcgccagcggcgatgaaacggccaaataaaaaaaatcgtcgtggttttcgggctgtaacttttctcagggaaccgggagcggaaaaagtccgctgagagggcacaccccagacatgttggctacaactttgtcactgatcactttttgatcagatcaaatgccgagcctgtagaaattggcgactgaacggcgctcaaaatgccggttttggcttttcgtgaataactcgctgggggttaagcggagcgggttggcgccgcttgagcatttgtgtagtttttaaagctgcatccgatggcgttttcagattttgaaaattttcaaaatttttcgagctaagccccctcgaaaatttttcgtttttgaattttattattttttgccgatttttcccaggaaaacggagaccactttcaagcaaccgtttttcgagctctatcgattggtggcatttttgaaaaaatttcaaaattttccggaaatagaaaaattttccggaattgagctccccatttccgtttgaggcttataactcgtcaggcgttgattttagcggaaatttgtcttagagcttttttgtagagaattttaagctctatctaatgtgctttatctcatgtttttaccatgagtttaaaaaaagttataaaattaattgtgattttgaaactcaaaaccataggggggaccccatggttttgcatttcatgaaaaaattttttgctcctaaattagccaaaatgcatttttatggcataatttgaggtgctgaata

SEQ ID NO: 38927 - DNA, 1128 bp, Heterodera glycines
  misc_feature (14)..(14): n is a, c, g, or t
gggcataaatgtcncctccacggttagcggttacggcacgagcagcctttccgcgtaagcaaccgtggagatagtgagcttgtcgacgggctcaagggcggcacggtcgacggcactctcgaaactctgccaaaacgcgggccattccattggttcgcccgaaaaaacaggaagactgagctgcggcagccgagcagtggctaaaggcgcaggcgcagcaacagccggcaagtttggcacgatttgggcattatttggcaccaatggtggctgattggcatggttggcaacagcagctggctgttgaacattggcaccgccgagaaatgcggcattgttgacgaatggcacggctggcacgggtggattcacaacaacagctggttgctgtcctcccgccgcgatcggctggttgggttcatctgcgagttctgctgctatgtgagccaacatttctcgcgcatcttccaaccactccgtcaagtgccggtcatctcgaataaaggcagtgaaaagcgcttcctccgcctctctcgctgggccttgcagtccgttcatgatggcaccccacgcgtccagctcgacctccatccttgacaggatacgggtgatgtgcccccgttcctgttcaaggttttcggtcgtctcggcattgatcacgggctcgtccagcaaattttcggccgtagtgacatgttgccgaagtcggaacagcgcgggccccaaagccatccggcatcgagctgaagacatctttgtttgctaacggcaccacttgttggctcggacggcaaaggggggcaaaaaatgggaaggcgaaaggcggagagagggcggggtggaaaaagggggggataaattccgaataaataaaagagtttatttaataatataaaataaatatgtcagatgaaaggaaagtgctgaattgaaaccgagtctgcatggtcctgcctagacgtttcttgataccgattataagttattttgcactcaaatcgacagactgactctgacacacatttgcctttgatcgtattgtatctcctgtgtagataatacgaaattcacactcatttatatgcttatgccttttaactcaactaagttcttcttcctcaattccct

SEQ ID NO: 38928 - DNA, 1104 bp, Heterodera glycines
  misc_feature (944)..(944): n is a, c, g, or t
  misc_feature (974)..(974): n is a, c, g, or t
ttgaagtgcattagcaactgattatttgccattgctggccaagcatcagatggaacaactctgaataattatttgtaattagtgaacaaataattatattcaaacaattacatcactaataataacattttttaaagttcggtcgtcattttgaaaaaaaggctgcatttgacatgctgaattcctcgcttgacctctgtacgtacctgcacaggtatttgcttttttcgtaaccaaaaattcacttttatgaattaatttgttcaatatttatgtctccccaatagatataatcccatcctttcaactaatgctttccaaaacccatctttttgggatttgtcatgaaaattcgagcattttgcacctcagatagtatccgaactgctccttgtcgctcaaatccgtggtcgttgccgagtagccaatctgcggaatgcggaacacctggagcagattctgcaccgcaattgttgtggacgacttcgccggcccgacgatggccactacggggctcgacttcttctgacagccggccatttggcagcacgaacattgggtgaccccctcgcgcagaaaggcgatggtctgcagggaaacattttaaatttaaaaaatgtttttccattttaattttggcattttaaaaatgattctgctcttggcagcgaaaacagcggtgacctgctccatggcgattcgttctgtccagcacgagtcgcggatgctaatcccaagccgaaacggcaacactttgttcagctgctgcaccgttagcatggcaatttcggctcgttgaattcctaaaagagccgcccaatattaacagcactgcgatggaaattcgaattttgaatttacaaataccgctaatacacctaccgtactgttcccaaatggcaccgcacccctcggagccggcaatttggcgatgcattgggaanagtgcgccaatttgaatgtctcctggcatntcgcccaccaacattttggcggactgttgcaccgacgttttggtaatacgtcgacacgcgagcatcagcagagtacatgactgtacacatcactactacgtaggcgaagagaataaattatttaaattat

SEQ ID NO: 38929 - DNA, 1091 bp, Heterodera glycines
  misc_feature (28)..(28): n is a, c, g, or t
  misc_feature (57)..(57): n is a, c, g, or t
  misc_feature (84)..(84): n is a, c, g, or t
ggttcccgaatctgcgaggaactacttntttgagaatttctatagattattatttgncatgaatccttcgcttaaattcccatntatcttataaagtcagattaaattaattaccccgatttgttttagaatggtccaaacacgcttgctaatagctttctttcgaaaaagagaggtgaggaaaaataaaggttgcatccaaatgtaaatttttttacatttgaagcatttggatggcttgctgtttacagttggctaagtcttatttgcaagaagcagcacaacttttgtttgggccaatgaccccaaaccattcgaatagcaatcgattgggctgactagactccatatttgcaggaatagcaatggcaggtctatcttaaaggcctgacgagttatgtttcgacaaacatcctgtacaccataaatcgattagcaaatttagtcgaactatataaatttttcaaaaaatgattcatcttttttatggttagcgcatatgtctctagctttatagaaacggttcccgaatctgcgaggaactacttttttgagaatttctatagattattattttgcatgaatccttcgcttaaattcccatttatcttataaagtcagattaaattaattaccccgatttgttttagaattggtccaaacacgcttgctaatagcttttcttttcgaaaagagaggtgaggaaaaataaaggttgcatccaaatgtaaatttttttacattgaagcatttggatggcttgctgtttacagttggctaagtcttatttgcaagaagcagcacaacttttgtttgggccaatgaccccaaaccattcgaatagcaatcgattgggctgactagactccatatttgcaggaatagcaatggcaggtctatcttaaaggcctgacgagttatgtttcgacaaacatcctgtacaccataaatcgattagcaaatttagtcgaactatataaatttttcaaaaaatgattcatctttttatggttagcgcatatgtctctagctttatagaaacggttcccaaatgtgcgaggaactacttttttgagaatttctatagatta

SEQ ID NO: 38930 - DNA, 1323 bp, Heterodera glycines
gaagtcatccaattgtggaccgacgcggacagcgtcaaattgcgcattttctcattcaaaatgcgatcgaaaatgaaacgcgaattgggacggaggaagacgtggaaaaggtaagccaaacgaaccgacgaatgaacccaaaattttgcaaaggtttcatacaaataattatttcgcagcgaagggaaaagaaaaatagtaaaataaggctattttcttaagttcttccgtttggtcgattctctgctggccgaccaattggaaggacagactcagcgcgtgtccctcgtcggtgggtcggaggacggcgaagggctgacgaacggaggggccgacgaccaagaggactttgaggaggagcaggggttggtggccaaactcgtccatttggtacacaacgacgacttggagacgcattttaaggcttgttttagcatttttttaaattgcaatttttcggctaattttagctgactaacaaagtacgaaaggcgttcggtttgggcggaaaggcgcgacttcgttttacgctcccatcgctcattttcgccacccacaaattcgcgttgcgactcgcagaaaatagggaaacggttggataattttcatttgctaattttatttcataaaaaataggaaaattttgacggacggatgggcaaagtattcacattttgtatgaacacaatcaatgcactcagacaacaggcggaaaaccccgaattggcactccgattttaccttaatgtgcggggggggggtcaaaagtgattaaatgcagtaattttatttttagagtgctttggtttctgaccgaattcactttgatcgttcggcagaaataacttatgaattcatctcaaaggtattccaaaataaacgtaaaaacgcattttaaagtccgaaatgaaaaatacatttaggctttttcgttgtatgaagaagagatttccgaaagtcgagaacaagtccaatcgcttacgcttttgatcgccacaattactcaggtggaggggggggggggagacacgttgaaaaacaaccttttcccacccaatcttacaatccgcagtgttttgggtcgagaagcttttaaattctcaattttctttttcataaaataaacgtttcaacaaatgcgcattggttattttggcggatgtttcggattctgtttttgacattttcggcacttccctgtcaattatttattgtgccatttaagattgagcatttgaacgacgagtcccacgagcccctgcgcaacccatgtgccttatatgcgtcaaattgctgaaacgcccgaccaagcgcaatgctctg

SEQ ID NO: 38931 - DNA, 1308 bp, Heterodera glycines
  misc_feature (24)..(24): n is a, c, g, or t
  misc_feature (1267)..(1267): n is a, c, g, or t
  misc_feature (1278)..(1278): n is a, c, g, or t
ttaatcattttgctcttattatanaatgttctcaaattcagcgttggcacagacaatcaaaaagggccacggattatttatctgcaagagccgactgttcaccaaatttctcctagtcaattccgcaattttgttatagaaaataccacagatcccgaatggaaaggtgaaaatgtttttttaatttatattttattttaatttgaaattttagcaacaaaaaatgcaaatgaagcatcatcatcttccataaacatcccaattaacattgatagtgacagcgatgatgatgattatgatggtttggacagaagagatgcattaaggacaggaggcccattgcttttggactttttcaccggaaaggcatatcagcaaaacttaagcaggcaaaatcttggagaatattcaaaaagcaatttacttgatatgtcaaatcaaccaaataattcgaatcaaatgattttaccggttgtgagaaatcagccaagcaattctgatcagaccaagcaacggagtgtaaacgatgattccaatatgcttatgcgagtaaatccagctaataatttgccagaagtgatagcttcagtaaccaattctcagcagcttactgaccagaataatcagccgttgacggaaaatccaactgatcagtctgtaagatcaaatcaaaacaatcagcatgaaattcaagaaatattacatttaccaatgaaaaatcaacaaaacaataaaagagcagcagcaccaaattcacgacaagaatttggatttgatctggagaaagtgccaaaagcaaaaaagggtaaaggtttggcagaatggttgggtcatagcatagatcaaaagcagaaaattgctgtcgaaaacacgtctgaacagccaactattactgatcatattaatttatcgtcacagacaacccaattaaacaatttgaataatccaacaaccaatcaaaatgtggttgatttatctgacaaaactttaagtacgaagcaaaccaatgaagtcggtccgttaaactcaatggacaattctgatcatcaaatgatgggaaacgctgttgttcagcaagtcgcatcagatcagtcatgccagtcgacccagactgacaaattgtctgatcaaataacctttacaaaccaatttgacccgaacaatttggaaaataaattcaatcagtccaatttcatcaatttttcattatcagggcaaaatcagacaaataatgataatcactctgaacaatctgaaccagttacancacaaaattanagatgcacaaacacaaatattgccaaagcc

SEQ ID NO: 38932 - DNA, 1656 bp, Heterodera glycines
attttattaaaattactcaatttttagattgttttgtattgtttatttatttaggatcatttttatgaaatgacataatttttttctcaacgccaattgacttcacatcatgaaatatttataactacataaattattaagtcttcttgcagtatttgatgcattcattgtatgtcctaaatatttgtgttttggagaatcaaatttaaaataataattaattattattactcgaaattgttgccatttccgagtgcaccgtaataagtgaacagaaggcaattgtcaatgtctttcttgtagaagtaacgctgtaaattttcagtgcagtgttttcaatttctgtccaaaatttaccggcgtatgcgacccctggaaggcgtatcgtcccgtatcatattcaataccgcagacaatttcttttagggtgttaattttgtaagatatattacaattaatttttgcttaaagcgcgcatcgtttggtctctccccattttcaaaagaaaaaataataattaaaaaattcagttgaaattatgttttccgagtgttttcttggtcatttgatcatgaatcaagcattcacttgtgcaaattctgaaccctggaccgggaccgaacaaaaagtcgaaatttctttttagtttagaattatttaaatgatctttttgttggctttttagtttgtttctttgtatttaatccggacttgagccaaaaaagcgaatttcgatatgaattttcgactttcttcgaatttggatctgatattaagtaatggtcaaaatatagtttcatgaattttgaaaacaattttgcatgatgcgccatttccaaaattatttgtttggcacctttcgacgctggacaacagtttttattgccaacacatgtgtagccgtccgggcatttgtcagtgccggcacattcaatcactcgtgcatcagcgttcaccgctgcgcgaacaccaccagaacactttgctataaaagggcgtttttaaaataaaataaaatatttttttgtgcaactcacggactggcaaaaccattgaatgatgttgtccttcatcgcctgttgaactgccttgtgccgccgactcaaagttggcacatttctgcctgcattgtgccaatgaatcaaatcggttgccattcccgccacagcctaggagaatttggattcgaaaacagtaaaaattattttatattatttgaatcggagcaggacaaaccgttgccaaaaaaaaatataaagaaaatgcaagaaaattgtgataacattttttgaaaacactacatatatcgtatttcttcgattataagccccggggcttctattgttcaacccccctccaaagggggcttatattcgaggggggggggggtccaatcgagggggggcttttattgttcaacccctttccctgtataaattctcaaaatttttggcttttgcataatggtacaatttaaatcttaatctgaaatttttgaattgaaaagatttttcattttttggcccttggaaatttaggcgaatgtttgaaaattcataattcacttctaaatgaatcaattaaagtgcaaaaagcattaaaatagagaaaatctggagcttttatacttttttagaatttctatcttcaaaatga

SEQ ID NO: 38933 - DNA, 999 bp, Heterodera glycines
tgtcctaaaaagagatagccatttttctgagaattaacttcaatttccgcagctcttacggtaatggaaaaaattttgaagaggctctgcggaacagattagcatcggggttacgagatagaatattgtcctaaaaagagatagccatttttctgagaattaattcacaatttccgcagctcttgcggtaatggaaaaaattttgaagaggctctgcggaacagattagcatcggggttacgagatagaaaattgtcctaaaacgagatatccatttttctgagaattaattcacaatttccgcagctcttgcggtaatggaaaaaattttgaagaggctctgcggaacagattagcatcggggttacgagatagaatattgtcctaaaaagagatagccatttttctaagaattaattcacaatttccgcagctcttacggtaatggaaaaaattttgaagaggctctgcggaacagattagcatcggggttacgagatagaaaattgtcctaaaacgagatagccatttttctgagaattaattcacaatttccgcagctcttgcggtaatggaaaaaattttgaagaggctctgcggaacagattagcatcggggttacgagatagaatattgtcctaaaaagagatagccatttttctgagaattaattcacaatttccgcagctcttgcggtaatggaaaaaattttgaagaggctctgcggaacagattagcatcggggttacgagatagaatattgtcctaaaaagagatagccatttttctgagaattaattcacaatttccgcagctcttgcggtaatggaaaaaattttgaagaggctctgcggaacagattagcatcggggttacgagatagaaaatgtcctaaacgagatagccatttttctgagaattaattcacaatttccgcagctcttgcggtaatggaaaaatttttgagaagctctgcggaacagattagcatcgggggta

SEQ ID NO: 38934 - DNA, 1023 bp, Heterodera glycines
catgctatttacttcgggactcaatttatgacgaaaatagggctccaattattttttattttctactaacacttttctagtggatcaatttatagattcaggaaattcattgcatgaattgaaaagtatttatttttattaaaatttgctgcttattttccgtaagaaagtttttgggaggaatttcacaaccttgccataggaaaaactcatatctgactcgtataaaacataactcgaacagtaggtatatttgttgtgcaattttatagtccagccttcgctagggctctcaccgcggtgtattttaggtgtgtctttgatgtatcaaaatttctctcggccgtgttgttgactgaaaaataaaacgaacttaaattattgcaatattgtttagacgaagtcttttgatattattctgacgacttccatgataataaatacttatacaaagtttatctttttatatatttcctcatcccaaacatggatggaaaataggtaataaatcgacaaatatttaaaagttttgccatgctatttaactttcgggactcaatttatgacgaaaatatgggctccaattattttttattttctactaacacttttctagtggatcaatttatagattcaggaaattcattgcatgaattgaaaagtatttatttttattaaaatttgctgcttattttccgtaagaaagtttttgggaggaatttcacaaccttgccataggaaaaactcatatgagactcgtataaaacataactcgaacagtaggtatatttgttgtgcaattttatagtccagccttcgctagggctctcaccgcggtgttttttaggttgtctttgatgtatcaaaatttctctcggccgtgttgttgactgaaaaataaaacgaacttaaattattgcaatattgtttatacgaagtcttttgctattattctgacgacttacatgataataaagacttatacagagtttatctttttatatatttcctcatcccaaacat

SEQ ID NO: 38935 - DNA, 985 bp, Heterodera glycines
tctttttcgatccctcaggactttttttgattttattacttatccaatgggtccgtcaatagcatgcttttcctttttcaggttctccgaaaccgtaactgttttaaaaaaaaaactttggatttttttttggagcagcagcggggatttagttcagtggatcgggaaaatttgttaattgtttgcctgattatttttaatttattttttggcactcgcttttcccccaggcaaatgttttactcctcggcctgacattgacgtgtgcgttgtgcagtttctgcctcgattggagccgctcattcccaccgcttacattgtgcgatttgtgaaatatttctttttacaaaattccatttttttgaaaaatgggcaaattttagcaaaatttttgaaaattttataattttcaaaaaaatgagcgttcaattacttttctgtatttccacataaaatgttgtgtcccttctgtcacaggtggcggacaaagtgttccgtactcttttccactacaaacggcgctttctcggcaaggctgttcagctgctgtacccgcgggcggtggcgttggaaatgggccatcacctgttgacgtgggtgtgcccgcctattttgggtcaaaaattatgaaaaaatttaaatggggaactttctttcgctaagagagttagaaaactctaaaatttcacttttttaatatttttcggagacgccgggacggaacaggacaaattttcactgtggaaaatttttttaattttaaagttcgaaatctttgaaaaccagagtttttttagaagaaaggtttactatgaattagtgtgtttttagatccgctaaaaaaatttaagacttcttttccttggaatttcttcttttttaaaaaaattgtgttgggaccgaaagagttggcccgcaaatgttgtttttggctggtggccgcaaatgtcagggcaccacaaaattttacattttgtgtaggtta

SEQ ID NO: 38936 - DNA, 1089 bp, Heterodera glycines
  misc_feature (111)..(111): n is a, c, g, or t
aaatggatgtcagattcgtgatcagcgaccctgaaaaccccctagaaatgtttataaattgatttaaaaattattttttttatgggctgcaaacgacataagtaccaaatntaatcctagtcataatgaccgggctttacaagggcggcccggtaaaagtccgtctgggctcaagttagcagaattttgcaagaaatgaaaaatttttctttttgaaatactttcattcaacaaatggtaacaacaaaaaaggtgattattcaccgtaaacggtcccacatttctgactggtcttcgtcgtcttctttacgcgtgtccgtattgctcgagaattttgtcgaacagtgccgtctttggctttgcattttcgaccgccttcctcttcagcttcagcactgcctttttcttctcatggaaagcagcgcctctgacctttcgcttcgtctccaatttctctacaacgccttgatactgccaaccaacttcgtgagcgagacggccgactaaattgttaaaataatgagttgaatagtataaggaatataagtttttgtctaacaataagaaatgggggcactactgattatgccattcatactttaatgggaggaggggcgggtgggatcggaaagcttaattaattttgtacaagtgaaagggataattcatatttagctcgggtgctggagaatctgggctccatccaaaaaattatttttctgttacgaaaatagcaaaccggggggttttcgtggcttcttatcacgaatacgatatcagatttgtaaaatcattgattctatcattaattttgaaatcagattttcaaaattttaatcaatttgatcaaaagttgcactctttttcgagtggggcaaccatatatgtatgagcagcactatttattagccaatgatgtgatcaaagacaatcgcacaaataataagcaaaacatttattaccatgcaaataatcaatccataggaacatttgaccatattgacaaatcttgaaaatctatgactttcaaaatcaatgatagaatcaatgaattttgcaaacactgatatcgtattcatgataatgaag

SEQ ID NO: 38937 - DNA, 564 bp, Heterodera glycines
gggattcggtctcccccataattttgggcgcatcggttcggggggactgccccgaaaacaaaaaaaatcgattttttcaagtgtccgtttggggtactcaaacaaatatggggagcaaaaatccaacgcagaattaatgtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctactcccgaaggattcgatctccccataaatatgggcgcatcggttcggggggacttaagataaatcaaaaaaatctga

SEQ ID NO: 38938 - DNA, 547 bp, Heterodera glycines
ctagagaccgagccggaccggatccggtaccgggtttttctggatccagcaatccggtccggcgattttgggaaaaatctagattgaccggattaccggattgaccggattatgagagaacggatccggaatctggtcatttttgaaaatgccaatccggtccagtcggcgaatttttgaccggatccggtctggctcggtctcaaccaaaaaaccttcacttttgttcatttttctttgaaaaatatctctttggcataatgtctttaactttaaatggtcaaaatttcaaattttcccctggcggagcctgtcggcaccgccgaggctccaaaatttttttctttttaaaaaattgtacaaaaaagcaaaaaaaaggtctttttggtgaaaatctgttaacaaattgcctcaaattttcaaaatttcccggcggcgcctgccggcaccgccggccccactcccaaatttttttttaataagggcgccacaaaaaataaattattatttttcattaatcacaggttttcaaaaataaaaaacctta

SEQ ID NO: 38939 - DNA, 913 bp, Heterodera glycines
tctttactgactttgttgcgcagacttttccacttgccggctcacacaaacgaagttggcggatggacccctcgacgctgcacaaaagttcgctggaagaaaagcaatgaatggcgcgggaaagcgacggaatgccaaaagcgcacgtgaatttgaacttggagtagggagtgatattctcagcgaatattttgcacgtgtcgtgaaactgttgcagcaagtcgccgattctgatcagctcgacatgccgttggctttggcgcgcgtcgtttagcccaacgccatgcgaacttttggcaacgatcgctttggacaaaaggaaaacaccggcggattgggcggaaggggcggcgccggagggacatgccgaagaggggggccggcggttgtgcaattcgttgaagctgactaaaccgaaggaaaagcaagggacggtgacgcggaagaagcaaagcagtggacaaaccatccaattgaacgaacagttcttgcaggtactccttgctgaccggcggttgcgagttcagtcgctcctcttgcaaaacgaccaccggcaactcgtggtgatcttcgagcggtgccattggctccaccagcagagaacggcgctttacgggctcagaagaggaagaacaaagcggcgtaatgaaacgcggatctgagcggaagtcatttcattgctttaaaagtcggaatggggaggaactaagagcaaatccgatccgaccccgaaaagtgttgagagagagagagaaagcaagagagaaaaagagagagatgaaaagggagagggagagacattggtaaagcattggtcaggaaagacagagacgccgtccggttcaaaccagggatgggccaaaaaaattttttgggaggagggggcaggcggcggcgccggggaaaatttttg

SEQ ID NO: 38940 - DNA, 1130 bp, Heterodera glycines
aattgcaaaaaagtcataatttttgtgatttcttcataatagcttccttacaggtcaaacgttttttttggttttttgtaggtctaatagggcttctgaagggctttagtaatgataccaagattattagatttggtttgtcaaagaaaatagttatagtccaaaaacaaggcctggctccgaaacggcggcgccgaaacgagacccttttccacacatacatacatacaaacactcaactttattatataggattaatcatttttggactaaatcatcgaatattaatagaaattcagatttgattttcacatcacttttttcggagcgctttttcaaaaaacttttgggaaagaaggggtccggtggtgccgataggcgccgccggggaacgggtcgtttcggcgccgccgtttcggcgccgccgattcggcgccgccgtttcggcgccagggtcgtttcggcgccgccgtttcggcgccagggtcgtttcggcgccaaaaatcagaaacgcagaaatagtaaaaaaaattttgttttgtttcaaaaaatgaagtcaataaaataatagtctatattaaatttaatttctccattttcacgttcattttttgtgatcttgcataattttgtcgttaatgtttaggtgaaatgaatcgccaaattgatactaaaaggcaaaagtccaaaatcacgcatgaagggcacctttacacttttgataaagcaagtgcggacgggatgacaaaattttggagatgcgaattcaaggacctgtgcaagggaagaatctggacgaatttggctgatcaattcatacgtttggcgactccgcatacgtgtcctgcaaatgcatcaagcgttgaggtgcaaaaagtcaagacggcaataaaacggcgtgcgctcgccacatatgaaccgccagcagtgatccgttccgaggcacttcaaaatgtgccgtctccagcgggacttttcgttacacagaatagtgcaagacaggtactgttcaattaatgatagacaatacagcgaatgaattgttaagatcgttaaaagggcacgacatgaagtcaatgcaccacctgtggttcctaaaagcgttgaccaactgattgtgccgccggcat

SEQ ID NO: 38941 - DNA, 1145 bp, Heterodera glycines
gaatgtccccaagcacagccaggcccccagggtgcgcctttgccccagggagtgcctgggtcgcctggagtgccaggcatagatgccgatggaggagtccgtgggcagcccggcttgccggggcctccgggagcaccgggcgagccagggcagccgggccaacccggcgaaccgggcccagctgggataatgcagtgagaattataactaataatataagcataaaaacaatgaatattgccatgaaatttagcgaagttgacggaaagccaggaccgccagggccagcgggaccgcctggtctgccgggcacagagggcgcgccagggcagccaggcgccccgggtcaacccggcgggcagggggcagctggcgaaccgggagagccgggcccaccgggcaaaacaggcgccgccggacaacagggaccacagggcaaccagggcacagggtaagcgtggaggaaaacggggtaaaaatttatttttatttaaaaatcattgagagtcgaaatttcggcatttataaagtaatgaaaatttgtcccttctgaagaggcacttgcgaccattgcccgccgccgagaacagcgccgggctattgagttcgaaattagcaaatgtttttggagaggaaaatttgtcggaatttcttacccattttttaaaataaattttgtttatttcaaattgaataaaattttaaaattttttcgtaacacaaacgcaacaaatgtttttgtaccaattcatcacagttttgtggtcatgggttttctcagctattctcgatcacaattttctgttcgccaaagtctgggtttcgcttttccacaaggtaaaggttccgtttttcatcgaaagtaccgtcctcaggtttacaccaaaataatacatcggttccgttaacgcctagaggtaacaacggttctccggttttcacataagatatcggttcggttaccaacaagagataacaacggttctccggttttcccataagacatcggtttcgttatcacccagagataacaacggttccggtcttcacataaaacatcggtttcgttatcacccagaggtaacaacggttccggttttcacaaaagatcggttctgttatcaccccagagttaacatcggttc

SEQ ID NO: 38942 - DNA, 867 bp, Heterodera glycines
ctcagttgggcgccggcacgtttgggcgccagcatgtttttaggtataacttatttcttggtcaaccaaatccaacattgttgatatcattggaaagctctaagtgtcctctattaggctgcaaaatttaaaaaaaatttagtttagattcaaaaaagttatggccagaagaattcaaaaaaccaaattttccaacttttttggccataaattggttcaaaattatgagaaagaaaaaagttatagtggaaaaacatgtgctggcgcccaaccgtgcgcgcccaactgaggagaccgatttttagtgaatattaaaatttttgaaaaaaaatctcgggattttcggtctggagtctagtgaaattttcggttttgaacagcctagttatgatcatgatttggctctagtacagtttatgcgtccaatggtttttatgcgtccaatgcttttttatgcgtccaatcagatatttatgcgtccaatcagttatttatgcgtccaacaaaactaattgaatttctcgagaattttaaccactaaatttcaccttaactcctaaattgtcagcaatcattgacaaattcggctacaaacgagttaatccctggcactgttgcccaatatgtcctgacaataattcaatctacgaaaaagggcgttgcgtaaacgagtctacccatgagttggctattgatcggtacattcgcaacacaactcatatctttatgaccggtagttttgaaacttcacctaatgtaataaacaaaaaccaaataagggattgatgggactacaataggcacctatcttttttttttttggtagcctacagtacccttttggggggcgtgcgccggggggggacg

SEQ ID NO: 38943 - DNA, 728 bp, Heterodera glycines
attttaaattattctttaaattaaaaaacagctatttaaaaaattacatcgctaaatttggaatttttttgccattattttgtcactattttgccatttttttgtcactatttagttaattatttggggttttttgccactaaaaatcacagccctatttataaaatgctaacgattaaataaattgtttaaaaagatgatttttgccgaataaataggtttttctgatttgtaagaaatcaatagagttgtgatttttagcttgtataaaaacatattaatgttaatttatattttatttttaattcgttacgattttatcagaaaaatttcttattttttctcgaaatattaataacaaaaaataattttttctttcttcataaaatgcataataaataaaattgttaactaaaaaaatcatttaaacgatattaattagtttttttttcattaaaacataatcaattacaaaaatgatcttctcatcaatcataaaaaaatatggaaatgttattttattaattttatattttgcttacatataaattcttcacttattctccgaacacattttaattctaaatagtcgtcaaacaaaatagtttcacccttctgacgaaatattttttgcttttgtgccaaaaatgtgaattttttgaaaattgagtttttgactttttgttcgaattcgggtttggagtttgaaatgtgtcgaaatagatgcc

SEQ ID NO: 38944 - DNA, 966 bp, Heterodera glycines
tatcctttttcggatgattatggaattaatttaatttcttctctgatgggtttagaccccggcacctgggaccaaatccttaagtacaaaaatgggtgttttttaaagcaggggcggggtctggaccccggcccctgggaccttatactactatcacactttaataattatctttaatcatattttaattaacgtgttgaaacattttacccgccaattttcttttaattccagttcagaaaatttgatattcagctgcgtcagtaattaacacttttcattcattctgtttacattggaattataaattattataatgaaaattctgtctattgcgtgcctcggctttttgccttttgactaattacatttgcgcaatgacacttatccaatgtcagtaaacgacagtcagctatatctttatctatttcttacttttttgagaattttttcaactaacaaattaaatttgttaatggccacgaaaaagacatttgatgttgcaataatttttacatgtaaaatatacttgggaaaatttttgtgactatatgggacgtaagggaaattgaaaaaccctgatgtcatgacaactcgtacaaaaggcaactcgtataattgcttaggttaggcataggctttaggcttagactaaggcctaagctttcgtttgggcctaggcttaggcttgcatgtgcctcggcttaagctcaaaattatgatttgcgaaatgacgctttgtcatgtgccagtaaatggcaatcgtatggatttactcacaaatagatatttaaataaagttcgaaaaagaagaataaataaatgttgtatttttttatgaccaaagattttttgaaagtttttgttctaaaattaagtagagtatcatatgaatctctgcaagaactataatgcaaataaattaaaaattttggcttttgaaaaaggccttcaaaaattatataa

SEQ ID NO: 38945 - DNA, 1353 bp, Heterodera glycines
  misc_feature (142)..(142): n is a, c, g, or t
gctcgcccatgttccagactttgcaaagcgctggggtggtttcgcatggatcagtgacaggggcatcgaacaccttcaccacgtttgaacaaagcaggttggacagactcaatttcacagttcaaaaaccctatttttgttntagtctgagcgcttcatgcggtacaagggcgacgaactgctgctgaagatcggagaacatcagacattgctcaattctattttcgacagacaaaccggtttcctctgatcaacaattgttaggaatcattaattttattatccggttttgttaaaatattgttacttttaatatttttgataaaataaacctttcaaacacgaattatcaactaaaaattatgtttgattagatttgatcagttgggaataaaagatttttgaatttggcgccttcgtttcaatactcatttttttttataatgatacgcatttttattcaaaatgatgatatatgtacgagtcaagcatttggcgatgtgtgccgtgttgttttttcaccgccacagtcacatgcgcgctctctatggataatcccccttttcttggcggaaatgtgctgcggtaaattcatttgttgtttttttaagagggttataaaataaattaaagctcattttattatcaatattgggggaaggatcgggttgggaagaatgaggggaagaagcacccttaggtaacgcgtattgcgctaatttattcataaaaatggtgggaaggcagaaagcaaatgccctttcgttactttatgcaatgggaataaagattattacaattctacgcgcccgctgttgatttttttaaaattcaaattttggcctcaaaagcggaaaagtaccgattttttgctataacaaatttggaaatgtgtttttttattgtaaccaaaataattgttttttataaatctaaaattgtttttttaatcttggttaaattcatgtcttttgcattttttgtagcattttggcgttttatgtcctttttggcgatttcttatgacttttagtcgtctttttttagattattcgcgatttaaatctgttctcaagcgatgcaaaaaaatgaagggaaatgcatgtagacggtcggttaatcccgactcatcgggaaaagctcgtttcccctctctccgccggttccctgcccccccccccacgctgtgtaaaatcttcagatattttttgtaaaaatttttgaaaaatcttagtaattcaccatagaatatttagaaatcttttttccttgtaatctttctaagattttttcattgaaaaacccaatttccagaaattttttgtccttattttctttgtccatataatgcag

SEQ ID NO: 38946 - DNA, 762 bp, Heterodera glycines
  misc_feature (16)..(16): n is a, c, g, or t
cccccccccccctttncccccaaaatccctccaaattcggctcccctcgctctccctctcccgccccctcccgctaaatgcttcttcctccgcttcttcgattgtcccccgccccacggcgatttttgtctgtgctccaagtgcaaagtgcgctcgcgcatcactctctgatcggcgcggagggcactcgccgctttttcttttttttttgtttgccatgcgcgacaattgctcgccttggggcacgcggcaaaaatttcacttttatttatttttgcaaataaaatgtcgttttctaagataatttaaaatatgacgtcacttttgcgccataattcattgccaaccttgaggcgtttgctcactcagctgagctttcttcttttggcactttattcttcgtttgcagaaagccaattgcagggtaataaaattttaaaatttttggaaaaatatttcgccagtaattattgcagtgagaataaaattactttaaatgcatttcaggctttatcaataaaaaaatctacggcaattgaacattccgaaactcgaaaattgaaaactttacaataattttcctttcataacgcgaaatttaaacgatcaattaactaatgacaatgttttagcaagacctccctgtcggccaatttttgtacgttggccgcgcgtcagactgaacagcaaccacgtgagcgcacgcagcgcatcgctgccgctcaacgcatgccgcgacgcgtgcgcggacgaacgcggagc

SEQ ID NO: 38947 - DNA, 928 bp, Heterodera glycines
caaattttatactaagctgtcaaaatttaaagaagttttctttaagtttcgacggggcaggcgtcgctgagaaaattttcttgaaattttaataattttgctccaaaaattttgcaaaatgaggtcgcaatcccgaccacactaactaaagatacggtagcaagaaaatttatggtatccttttcccatagtctgctcagccgagactcaaatgtctcgagactcggctaaccgagacacgtaatttgaggagccgtgagccgaccattgtcctgcaactttaaactccgctgcggggctaatacgttctgcggtcgattgtgggcaaaacgccaatacttttgccattggtgaaagagtgcactcacagagatggcagaggaattattgattcccgctgggaatggacggaatgaatattcacaatgtgcgatgggtgggcggtgtaaggacggacagcgggggaattggaagaaaatggggaggggggcgattttaattatgcaaaaaagttgtatgaaagatttcgactatcttgaattctcattgtatgactattgtgtaattgcttaatcgcaaagcaataacttccaaacatggcaagcttgttgcgattgatactaagctaggggcgtttgatcggcaattaaaaaatgagacctaaaactcagctagtgtcagaatgccggctccgccaaaacgacccacattccaatatttcacatcattttttttacaaaatcactcattcaaatatgagtttcttggttccattcaaaagcttagtatcataaattataaaacaagaagcaaaactgacaataaaacaaaacccacacagagaaaagactacaaatgtagaactaaaaagatgaattgtcttgcaaatgatgtgaaaacaacccactttctggaacttgaaatcttt

SEQ ID NO: 38948 - DNA, 953 bp, Heterodera glycines
gtgccgccggtaaacgcatcgaagggacgcaatggcattgccaagctacacgcataggcatccaactgattggcctttttcaacgacacgcttggaggaagatgcacaccagcggacgaagtgaacagctgaacaaccaattaaaagggcaattagccgacaatttgggcaacctgctgagagaacaattgaggctttgctgctggtgttgtaaagtgccattcagagaacaggtagaattggaggtcttgtagcagtacacgcgcaacggaagcaaaaacgctcgagataattggcgaactgtaaatgagaaaatggtgaaaatctaataacaaattgcactctaatttcaaaattgacgtctatcgcgctgccgggtcccctagttccccaaaattaaaaaaacgtgccgcaacaaagcgtttgaaaaacccaactttgataagttaactgtgatcattcgaaatgggaaggaatggaaataaaaagattttcattgctgagtttccaaacttttctcaagtcgttccttatgcccccccccttaaacctcattccgctgtaccagcagttccatggcctgtcgctccagttcgattcgctcgcgcggcaaccgttccacttcttgctttgcacgctctctgtcgcgttcctccttttctcgctgctcccgcttaatgcgttcaatctgtgtaaaaggcggtctgttttcggcatggagttcgcttggccaacctccagtcgctcccgttcggcccgtccctgctccaaccactgctgctcgcgtctcagtgcctccgcccgctcgagttccaattcgcgccgcttctccaactccgtctcctcgtattggcgacgttcacgctcaatacgctcccattccttcagagaagggaacaaatgaaaggtcacttcacacaagcgaacgaaagaacgcaacgaaacgccaaaaa

SEQ ID NO: 38949 - DNA, 958 bp, Heterodera glycines
cgttttgagtagatagactagaaaaaatgaaaaattttgaaatcatgtttcccactccctttctcccaggggtattattttgtaaagtctttttttcccccaataaacttgtcaaccccccaatttttcgcaccgtgaatgttatttttatcgaatctgaaccgttttgagtagattagactagaaaaaattgaaaattttgaaatcatgtttcccactcccttctcccaggggtattattttgtaaagtctttttttccccaataaacttttcaaaccccatttttcgcaccgtgaatgttatttttatcgaattctgaaccgttttgagtagattagactagaaaaaattgaaaattttgaaatcatgtttcccactcccttctcccaggggtattattttgtaaagtctttttttcaaaataaacttttcaaaccccatttttcgcaccgtgaatgttatttttattgaattctgaaccggtttgagtagattagactagaaaaaattgaaaattttgaaatcatgtttcccactcccttctcccaggggtattattttgtaaagtctttttttccccaataaacttgtcaaaccccatttttcgcaccgtgaatgttatttttattgaattctgaaccgttttgagtagattagactataaaaaattgaaaattttgaaatcatgtttcccactcccttctcccaggggtattattttgtaaagtcttttttccccaataaacttgtcaaaccccatttttcgcaccgtgaatgttatttttattgaattctgaaccggtttgagtagattagactagaaaaaattgaaaattttgaaatcatgtttcccactcccttctcccaggggtattattttgtaaagtcttttttccccaataaacttgtcaaaccccatttttcgcaccgtgaatgttatttttattgaattctgaa

SEQ ID NO: 38950 - DNA, 1265 bp, Heterodera glycines
cgtcgtgctgatgacaaacgactttttgcctccaaatgtgttcacattgtaattgttgtgaactaacagttggtatgtgccggatggcaaaccatcagcgaacatttgagtcctggtcaattttcggcagggcttccgaaaatcaggcagtgcagcggtacgcatccaaatgacaaaatcggcattttgaaacccgctgtttgtcacatttgtgatgtccaaaaggcagaggtccttttgccagttgggcggtcggacggttaactgtcgcaaaagtgaacttttagaacaaattctacaaacggtttgacaaacaatcagttcaattgatttgttttctaacaatttttgtatgctttttaagataggattataaacatgtaatattcccgtcctgaatttatttggtgtctagaaagattcggcggaaaataaccagttaaaaatagaaagttatacggaaaatttgtgacacaattcagcgattgttttgcatggctggccatcacaagtggggtttctgaacttcgactccaaatcgaccggccagacgagcccttcgtgactccatgaaatatttgcataaccattgccattacgcccaagataattgagttggaatgaatctgcgttaaattgtttagcatcaaataaataatgaaaactgaaccattgaataacgaatttgctattgcgccacaaggggcgatcggacgaccgtccggagctttctcgaaaggagtacaatctttggtattctgtagaacaatttaggctattatgagagaaaccgtattatgtattactaaaaaatcaatgcccgataattgctgatcatttctgcttttcatataacgacgatgattttggaagaaattctcgagagcataataaaagtaaacatcgccctgaaattcaaattctgtagtaattaaaatcataaaacgactttgaagtcctcattcagagtgaagttcactgcgcattggccattcgcatggtagtctttgcactcgttggcatcgtttacatattgaacgacatattcctggacttaaaagaagcacataaaattgcacagtaccgtctcaccagattgacttatgcgaagaagaacaattccaattgggatgaacaaaatgcttatactgaaaaccaacggaatgaccgttttagcggtcagaataggctgcctaaattaaagcactaaagagaaaatgataatcaaaaaaccatgcaacgagtctctgttgtagtaacctcgt

SEQ ID NO: 38951 - DNA, 1040 bp, Heterodera glycines
atatctgaaacagcgaattaaataattgaacgagtaaaaaaagaagagtgaaaaagttctgcttttttctttgcgatttatttataaaactcacctttttccaattgaggacacgtttaaacaaaaggcagtggaacagtcgacatgacgaaatcgcatccggaacggcattttcagcagggacaaaaggcataagttcgaacaaaagttcgggcggaaggcacttgagggtcattagtaagcaaaatagaacgcagcaacagaggacaattcggtgtttaggattaattagcaatgagtaattagcatggaaagccgcagcagacactggagaatgtttttggtcttctcggcttggaatttgttgtgtttggctcgttaaagcagagcgaaggccggagagattggcgtagtgtctaccgcactgtctcgcttattctcttctctcaaatatctctcccactctttaagtgcacactatttcattttgtgcttttcttctatgctcttcttctgcgttctcaccagtgcgcggttgttttccttttactctctagaatgttagtttctccgcatgtttcgctttgccctaaatgcctgtctgcattgtctcattttccttgtgactcgcacatgccattctcattttttatgcagtgaccgctgaccaacggatcggggtcacttcgccgcggccatctcaccgcgagaaactcgccgcggggccaactcgccgcggcgctatctcgccgccgtccaactcaccgcggccaactcgtcgcgccttgttttttggccatctcgccgccagaatttttttcgttaaaaagtagtcatatctcaatatttcaattataaaattctgatgtttatttcaaaaagtcattaaataacaaaatcacgggttcataacacaattatttgaaattccccaaagagactcaataatattttgggcatcaaattttcaataagattcaaaattcgcttgtctgtcttccgaaacttatttcgcttcatcgatggttcttcgccgttca

SEQ ID NO: 38952 - DNA, 1059 bp, Heterodera glycines
  misc_feature (966)..(966): n is a, c, g, or t
  misc_feature (1009)..(1009): n is a, c, g, or t
catcggaggacaaatcgaagccgggacgacagctgcactggacagaaccctgggggaggaagctcatcaattaaacggcaccaacaattagtgagttaatcatttgtaattacagcccaactaacgtcgtctttaactgagcacaaatgttggcatttggcactttcacagttggcatctgctaaattcacgtccaattgttccgctcgactgttgttgctctgtcccttcactttacctccattttcgggcccaatggcaaccgcaacactttggtacggttgtgccaaaaggattggcgctgaatttcgtccgtccgtttcggcaacccctccccatttgtctccccaaattcaccgtttaattgcggcccttccgccgacgaattcccacagcatttgttgaaagagttcaaacagtccgggctgaacctaaacacagtgcgttttgtgctgtgcctttgccaacaactcaaaaccctttgggcgctgcgcatctttcgcccctttgcgacaattcataggccaacaaacaacaatcgcagcactcctccaaacttagctttaccttttgatcaagctttcaacaacctttttggcgcctcctgccaattcgctgatgattacggtagcgcacattttatgccgctgggcatacaatacgccggcttggcacgaagcatcgatcagagccctcaggcaacagattgaagccgaacggacacaggtgggcgttgatcctgcttcaacgcaacattttagcatgggcctatttttgatttatttgcttggcgttttatttggcaaaatggtttgttctgtcaaaatttgacctgcccttaatccgtggcaattgccgtgctcgcgcaaatgacgtgagccgccggcacaacaactcgaaagctcattagaagtgccgaaagaggcggtcagaaaaaagatgatgatcagagaagggaacaaaatngtcggatggtccatttttggataataaaataacatttaatttngagtgaattgtctaattatattgaacaaatgaagcaattgaatgaattac

SEQ ID NO: 38953 - DNA, 823 bp, Heterodera glycines
  misc_feature (800)..(800): n is a, c, g, or t
ttttcttaaatatttttagacggaaaattaattttaatggaatatgtaaaatcatccaccgtcatttcttctctcgaaatcggtgaaaatcagcagcagcaactgccgtattcatttgtggcaacatcttttggaaggcgatggcattgctaacactgacaataaagcaataaaaatcatttatttttgaaataaagataagtttcagtccgagtaactattcgaataattaaaatttaattatttaaatatattttttataatgttagtcaaaagtggcttttaattttaaacaattataaaatgcaataacccataaccaacttttcatcatttccgaatttggattctggaacttttgcggtcctttaactcggacaatttaaaattattcactcattcagctgggtttggttcaagggcaggggggggaggctgagggggctaaagccacccccctaaacccaagaaagtaaaaattttcagtagtttttttttaattttaagcaaaaattttggttttagccctccctcctcactctgtcccagtggcccaagtgcggcactctctgcagcattttcggaaacgatcccagcacttcgaaaagctcaacacatttgcgcattttgagaacttcgctgaacggggcgtacttgacaatgtccatgtccatgtcctggtcgaagtcctcctgtgcataaaaacagtgaaatctgatcagaaagaaatacacataaaatctgaatcccttttttggggcattgggtattaatatagagaaaaaattttccgtatgtgnaaacacttgatggtaatatttat

SEQ ID NO: 38954 - DNA, 867 bp, Heterodera glycines
tggttcgattggcgttcctgggcgagaattttcctatttggattcagaggacaaagccaagggggaggaccgatgggagaggcgggaaattgacaaattaaacaaagtgcgaatggggtggggtgggggcggaccaggaagaaacgtcgccgccgaacttaatacgaaaaatattctagaaaaattcaaaaaaaatgttatcaagaaaattcaaggaaattttaaagtttttgggttttttccgaaaattcagcaaatttagtttttattaacacttagattttcaaaaaactaattgtaaaatacttttaagtttttttgaaattttgaaaattttttaatttattttaaatgaaagagcattttagggccaaaaatagaggattttccctggtcttccgagtctgtacgagagagaattagcaataaaacatttcttttattaataatcgcttcattgttcaggccgaacgggaaaagcgacggaagcgcgacctgagacgcatttcggtactcgtcgaattggcctactccaaggacccgcgcgtggcccgttttaaagtcggattctgacgcgtctatgaatatattgcatttacaaattaacaatttctttttaaatcattttcaaaatgtcctttttatattctttaggaggaggacaaacggtcaaaaaatgcgcaaaaagagcggcggcggatggagcgcgaggcgcgcgagcgggcggaggcggacgaacggcgtcgcgcggaggccgaggcgtcgcggaagagcgaagcgcgggcggaggagcaacggagggaagcgcaggtcgagattctaaataacagagaaaatggcgcgacatttgtggactgattactgaca

SEQ ID NO: 38955 - DNA, 1004 bp, Heterodera glycines
tgcctctttagactgatcagagaagagaccaactatcgccgtgatcattcgctggactctgctaaagtgccgtcgtgccttatcagagaagtgccaattgtccgtgtgccgtacccgtcctctggttcatcttccgcaaccatcggcggatgccgagcatttccgtccgcgcttgaaattggcgattatcagccacagcggcgccaacatttgtatgagcggcgagaggaatttttccaccggacggcacaatgccaacagaatggtgcgagcagcacaaaattgagctgggagcagcggacagctgagttggaggtggttactcggatcagtaacagtaattagacatgagggaagcaaagtgattggggaggggtgtcgaagaaagaagtgatcaaggctaaactcggtcaattgagtcattaaatgtgacccgggtgagtgtcaacgagtgattgaactatctaagtgatcaggaaggatgtcgatgagtaatcaaaactaactctttatcattttaatactcaaattgatcatgatccaattacgagacccagagaccaacaccattctcgaccaattagtaaattaagaccaatcttgggatttctgggcaagaattgagactcgaagaccaaaaaattcattctcgagacgagagagactcgagagtttccgtgtatctccaacgatgaacacacatccgttttgctttactcataaaacaagaaatttgaatcttccaattttttaagtctcaaatatcactcaaccaaaacaaacatttccataggtcattcgctccattttcacttccatttgaccattgaaagcacccaaaacatttaggaatggatgcaaactcagccaatttcgttgcggaaattggaacagcacgaaaggatgcggttgatggtggcaggtgggatttgaaatgaacttcgaaatccccccataaattcgttgtattgcgtgcggaatgccaaaaaatttataactgaatg

SEQ ID NO: 38956 - DNA, 893 bp, Heterodera glycines
tggtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgcttgagtaccccaaacggacacttgaaaaaatcgatttatttttgttttcggggcagtccccccgaaccgatgcgcccagatttatggggagaccgaatccttccggaatagcttccctatagcctgtactttaattctgcgttggatttttgctccccataattgttgagtaccccaacggacacttgaaaaatcgattttttgtgtttcggggcagtccccccgaaccgatg

SEQ ID NO: 38957 - DNA, 1441 bp, Heterodera glycines
  misc_feature (1396)..(1396): n is a, c, g, or t
  misc_feature (1413)..(1413): n is a, c, g, or t
ttcggcagtatatgagccaaatggagaaaaattcgaaccaggaagagcagctgaagatcggtccctcctgacagcttcgaagtttcctctaccaattcaaaattgtccaattgttctgctgaatgttgtcggaaagtgcagacaagacccgctctcgcattcgttgacgaacgattctcaaactgctgcggcaattcagatagtaactgcgtttaaagacacaattttgtcgccaaatgtttcattagttgtgatttgtttgtactcttatcaaaaagaatcacttcaaactgaattcgaaaagcagagaattgaggtacttgtagtgacagttgatggatatcaagcgcaagaaagtgatttagtaattttggtcacaacaagaacgagtcttcgagatggggcattaagtgagaattcagaatttttgaaggattcgagaagagctacagtagctctaagcagggcaaaaagcggtttatttttgattggggacttcaaaactttaagtgagggtgaggtatggaataagtttttggaaacagcaagtgaggactctcaaattgttggtgaggaatatcttcagatcctacgaaatggtcgatacatgcgtgatcgatattggcaattaattgatggcattggcagagtagtccaggatctacagtggttacaaaagaatgatgaaaattggcgaacgatgcaacagcagagcacttcaagcagcatgtccacatttgagtcgagaaaaagaagagctgacgaacccgaccaagggccgagtgcacgccgaaatgagacatggaggccgcagcagcgtcttggacaattcagcggtgccgtttttgtcagaagtcgcgaaccaacgggtcctcgtggtgcttgctttgtgtgcaaacgtgtcgggcatttggcaaagaactgttggtatgcggatggacaatcagcaggacgtggtcaaccaaggggcaaagggcaatggaaataaataggaatgataaaaagggcggaaatgacgactttatgctttggcaataaatttaaaaaaaaatggatcagggacgatccttttagggaagggagtgataggtgaaaagttcataattcatttttattaattttgattttacattttaaataattttatgcaaaaagctaagaaaatttttgaagtaaattgcgcaaaattaatttatgcaaaaactttgttttaactgggtttcaaatctgagaccagggacggtctaaaaaggggtatgaggtgtaagacataagctaattaacataaattgccgaagcatttaagcacatttcacattcattttaatctcttttcattttcattttaatttatttatttttcccgttagcatcgatccgacactcctcccctttncatttatgtctattaangctgcgatctctccattgatattcactt

SEQ ID NO: 38958 - DNA, 1203 bp, Heterodera glycines
gtaggaaaccttttagatataatgagggcagtttagtataagagttagaaaataaaggtataggaagaccatctacctataatagttttggatcaacacttataaaaagaagatatgttatgcttgataaaagatctagtcagttttttcctttgcctattggtaaaaaagttaatgaatgatttacaaaataattttaacgatataattaatcaagattatacggctttattagaggaaaaacttgatgaaataagtaatcaaaaaaataactatcttaattttataaaaggtttttgatccgatttttcacctaaaataaaaaaaataaataaaaaaaacataatttgcaatttaatttacacacaaagccacagcaatcaagcaaagcaaaaaattttattaagctaaataaatattttatattggtttattttattttattttttgaactaattatatttgaatatgattaatcaatgaataaaagcaaatcaaatttttattttcatacaacttgatcagatcactcctttatggtgatcgagactcgggaaattttcgaaaaaattcctatggttagtaaaattttctgaaaattttgaatatgctcattggaaagagcacaaaattctctaccgaattgccttatgaatgttaaaactacggcttgtatataaagttatacttgggctgaaaattggacaactcaaaaatgatcaatttttgatcattttcctaggaattttttcaaatttttccaaaaagataagctagcatgaattatttcaggtttttaaatgaactttaaggtggtttttcatgtttgagtcaagactttttccgccatttctttgagtcaagtctgatcaagtgaatcaatctcgataatgaataaatcaaataaattttcttgttgggtgtggatgagtcatatattgagggtaataattatacaaaaagaaaaataataagtcgactttaacaagcaaaattttaattttacaaattttgtcactttgagtcaagactttttttcaatcacagtatttaacccaatgaaacaccgtactgatgaggccggtctctttcggttaaatttgcacgtttcgcgaagtgcccatttttgcactgtcgcgattcgcgaagtgcccacttttattgatttttatttttgaacttgtcgcgaaacgacgtagcacc

SEQ ID NO: 38959 - DNA, 1059 bp, Heterodera glycines
taagtaaaaatcgtaaatacgctcaaaaagctcctcaaacaattttagcgcttccaattccttctacaatcgcctttatacatcgcattatgaacgctaaaaattatcagagtgccgaaaatcgcatgtgatttaagcctagcaaaaaatggtgtaagtaaaaatcgtaattacgctcaaaaagcttctcaaacaattttagcgcttccaattccttctacaatcgcctttatacatcccattatgagcgctaaaattatcagagtgccgaaaatcgcatgtgatctacgcctagaaaaaaatggtgtaagtaaaaatcgtaactacgctcaaaaagcttctcaaccaattttagcgcatccaattccttctacaatcgcctttatacatcccattatgaacgctaaaattatcagagtgccgaaaatcgcatgtgatctaagcctagaaaaaaatggtgtaagtaaaaatcgtaattacgctcaaaaagcttctcaaacaattttagcgcatccaattccttctacaatcgcctttatacatcccattatgaacgctaaaattatcagagtgccgaaaatcgcatgtgatctaagcctagcaaaaaatggtgtaagtaaaaatcgtaattacgctcaaaaagctcctcaaacaattttagcgcttccaattccttctacaatcgcctttatacatcccattatgagcgctaaaattatcagagtgccgaaaatcgcatgtgatctaagcctagcaaaaaatggtgtaagtaaaaatcgtaattacgctcaaaaagcttctcaaacaattttagcgcttccaattccttctacaatcgcctttatacatcccattatgagcgctaaaattatcagagtgccgaaaatcgcatgtgatctaagcctagaaaaaaatggtgtaagtaaaaatcgtaattacgctcaaaaagcttctcaaacaattttagcgcttccaattccttctacaatcgcctttatacatcccattatgagcgctaaaattatcagagggccgaaaatcgcatgtgatctacgccta

SEQ ID NO: 38960 - DNA, 730 bp, Heterodera glycines
tcaaaaaaaaattaaaatttttaaaaatgcttaaaaacaggttttagggggttttcggggtcgctaatcacgaatccgacatccatttcgaccaattccgaaccccggacccgaattcgaacaaaaaatcaaaatttcatttttcaccaaaatgcacaaatgcacggaatagtcattggttgatgcaatgcgtctattcaattcaaaatctttggactttgtctatcgcttctgcattttgaacggcttttgtgtccaccagttgctgctgccgtttgtccttttgttttcggggggcggggttgtcgttcaaccatcggctgtcagcaatggtccactcattcccaatcctatcaaagtcccttccccaaaatggccctagaaagattccgaaaccttaacctacccaatttctatgccggtctcgccattcccgacaacgatttttatccatgtcaatagtgtttttcctttcaatgttgttcctactacatgcttttttgtgtgaatctcttatttgctgccattccgtgcatttttggatcgattttgtgcaataaatatgcattttggtgaaaaatgaaattttgattttttgttcgaattcgggtccgggattcggaattggtcgaaatggatgtcggattcgtgattagcgagcccgaaaaccccctaaaacctgtttttaagcatttttaaaaattttaatttttttttgaaaaaggggggg

SEQ ID NO: 38961 - DNA, 480 bp, Heterodera glycines
aattgtaagaaaaaaattgatgaaattttcttcgaaaacaaattttatattgaaaaaatttccaatattttttttattcaaaatatatctattttttaaagataggtaggtacttaaatttacaaattttaagggtcattatttgcttatttgttatttggattccaattttggtttttgtttttcagtttgtccgaatattttgactcaatttgccgtgaggcgcttgaacaacaacaacacaatgccaatgatcgccaacagcacacagcagaagcaacagaagcagaaggaaaaacaaaaagcgacgaatgcccggcgatcaaaaaattgaaaatttcacattttgtcaaataaaattacttttttttgtttgtttttttctttcttgttgttgattttatttgttgaagagagaatttgaaaggctttgcagttcataataattaactccaaaacaggaaaatatgggataaaaaa

SEQ ID NO: 38962 - DNA, 1049 bp, Heterodera glycines
  misc_feature (364)..(364): n is a, c, g, or t
  misc_feature (393)..(393): n is a, c, g, or t
aaatttcaaatttttttaggaaaattttggccgtatcccccccaacttttttcccatcagtaccctaattttattcatattctaaaaattaaaaaaaataaatttttataattcaaatttttgcaacctttacaaaagttacagtaagaaggaatgggggcgggaattcaaaaaaaaccaataacccacctttgtgggtcttcatatgcataacatcccggcaaaccgttcccgatataaaaaatttcagtttgcttctcggccggtttctaaatccgtttcgaaacatttagtaaaataaataaaaaataaatagataaattaaaatatccaaaataaaaattagttaaattaaaagatttanaattttacaaaatatttttcttggctgcngaacacggggaaaagcatttgcttctctcgctcgtcttccgttgtgcatttatggtaagccttgtaaattggcttcgtccataaggtttccaatgccatacaatgcggcaaaacggaactaaaaatgataaataaaagccaatggaaaagaaaaagcggctaatttgtagcacttttaatttgcatatttattttcccaaagtcccggtgctctgagattgataatttaatatccattaaagtaattaccatttgattgccatgttaatagatttagtccaaaaattacatttttacgattttaattgttaaaattgtgtttgaactcccatcgaaaaaaacattaattttgaaaaatgagaagaaaaaataatacttggaggggaactgatccaacgcaaaaataagtaacaaaaccaagaacacaacccgctgaccacgcatatattaacaaatttgaacaaaaaagaacctaaatttataaaaatagaagtttaccaaaggccaacaatcattaggggtgtaaaaaagtctcggtctcgagtctcgaaaatcgagaccgagacttgaaaacccgagaccgagactcgaaaccgagaccaaaaaaacccgagacttttctcgagtcgagaccgagactctcgagcatcactact

SEQ ID NO: 38963 - DNA, 732 bp, Heterodera glycines
gggagggggggcgggtagtacattgcctattccgtcgaacgtccttccctctgctctgcctttgggaggggtgtggaaagcgaccgccgccgatcccgagcggcgcgcgctgcgaagggcacaatgtggcggtaaaatttaccaccacatttgtggccttatactactagcaaatactggcattaaaaaagaaattacaatgagaaaacccggaattcatcatttccttttataatttttttttacaaaagcttctatatcccttaagcttttgtttaataccaagaatatacctaggtgtttaccaagtaagaaaaaagtaatggcctaagaaactgaggatggtcattcatgaaacgcataaaaccgaccagaaccgatgcttttgctaaaggaaacgtccagcgatgtaaatcggtgattttcaaaaaaaaaaaattcatttaggcaaaattattttttaatggcatcgcccgtcgcaaaaaagaaaaagttttcctccgccgaccaccgccaaatgaataatcgaattttgaggaaaatgtgagaatttttgggttaagaatttatgaatttcatttaaagcctctcagtatatttttctcgcatttcagttggatttgttccgatgtttggatggacattttccccctttttgaccgtcctcaactcggcctcaaattggcactcctttcaccacgtttcgatgttttagtggacacgcattttgat

SEQ ID NO: 38964 - DNA, 1042 bp, Heterodera glycines
  misc_feature (904)..(904): n is a, c, g, or t
  misc_feature (948)..(949): n is a, c, g, or t
  misc_feature (972)..(972): n is a, c, g, or t
atttaaaaaattattacacaaaaattaaatttctaaactaatatttttaattgattcttgttttccttttatattaacgtttccttttcttgtgttcacaaaatttctgtttaaatttcgtgaattaaataaaaaagccaatttttttttacctttttcactgaattgctttttccatcgccctaatgtatattttgaaatgcccaaaatatcgctcatttgatttccagttattctcggattttcctctttaattctatagaatttctctattatttcaattttttccaaattcgtgtaaattcgcatttctagaaaaaaagatatttttgttttttttaataattcacttaattccctccaataattattttgtttatttaaaatgatttaattaaattaattattataatgattataatttattaaaaaggggatttgaagctttatttttatttgccttaaatttcaaaaacttatttaattttgaataaaaaaaacttacttttcttctgtacattttcacatttgttcttggaatcattcccataaaattggtttttccaatttgttagggttcgtcccgtcacatttagaattttcccaattttttctttgtccaattcggggtgtttctttttaattttttcatacaatttcagcaattcttttttctcggcgtcattataacatttaactgacaaattttgggatattcgcattaatgactccgaaattctcggaacatttaattacaaaaaatcatgaaaattaactatttcgaaacaaaatccaccccccgtccattacaagtggccaaaattactcttttttgaaaaaatgatcatttaatataaaatcagggttttcagtttctccagccgagcctaggatcgtcacttgngctagtcagggattatggaagcgtttttgacacagtaattatgnngttttatgccccataaacccagngaccgtccctgagtcagtgaactaaaattgtgatacttttgatagcataaaaccccccggggggtttttt

SEQ ID NO: 38965 - DNA, 1032 bp, Heterodera glycines
  misc_feature (69)..(69): n is a, c, g, or t
caagtgttcgtttggggtactcaaacaattatggggagcaaaaatcccaacgcagaattaaagtacagnctatagggaagctactcccgaaggattcggtctccccatatatctgggcgcatcggtcgggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctactccagaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatgtggagcaaaaatccaacgcagaattaaagtacaggctatagggaagttactcccgaaggattcggtctccccacgatcagtcacaacaaaaagggaactccaagatttatgctcaaaacacaagagctctcagtcacaaacgataaccaaaatacgcctcactcactactggaggtat

SEQ ID NO: 38966 - DNA, 936 bp, Heterodera glycines
agaaagaaaatccagaaaaattagggtcgtcgctactattccgaaaatgtggttggaattcatttgagtgttgagcagaaaaagagatagacgttttttcaaaattttcagagccaaactcgcccagaaagaaaatccagaaaaattagggtcgtcgctactattccgaaaatgtggttggaattcatgtgagtgttgagcagaaaaagagatagacgttttttcaaaattttcagagccaaactcgcccagaaagaaaatccagaaaaattagggtcgtcgctattattccgaaaatgtggttggagttcatttgagtgttgagcagaaaaagagatagacgttttttcaaaattttcagagccaaactcgcccagaaagaaaatccagaaaaattagggtcgtcgctattattccgaaaatgtggttggagttcatttgagtgttgagcagaaaaagagatagacgtttttccaaaattttcagagccaaactcgcccagaaagaaaatccagaaaaattagggtcgcgttccgaaaatgtggtaggaattcatttgagctattattccgtaaatggggttggaattgtctagagtgttgagcagaaaaagagataggcgtttttccaaaattttcacaatcaaactcgcccagaaagaaattccggaaaaattagggttggcgctattattccgtaaatggggttggaattgtctagagtgttgagcagaaaaagagataggcgtttttccaaaattttcacaatcaaactcgcccagaaagaaattccggaaaaattagggttggcgctatcattccgtaaatggggttggaattgtctagagtgttgagcagaaaaagagataggcgtttttccaaaattttcacaatcaaactcgcccagaaagaaattccgttccggaaaaattagggt

SEQ ID NO: 38967 - DNA, 444 bp, Heterodera glycines
attatatggaaatccatatttttttcctggactgtgggaggcctgaaacgcacgaaaaacatgtttttagcttggtttgaagcttctaggaagaatttctatatccatattttccatatttttccatatttcgcgatttatgtccatatttccatatttttccatattttggcattttggtccatattttggcatttttcaaaaaaacctctattagaacggcccccagcagctaaattagcctttttgagcccaaaacccgaaaaatttttcaaaaaatcattttttcgccaaaatttctcgagaatattgaataagtttaaattttcttaaaaattaataaattatgtcaaaaataagcaaaaaagcgaaaatttcgcttttgttgttgattttgcgctaaaaaaattaatacattttagcttttatgttttttttctttta

SEQ ID NO: 38968 - DNA, 743 bp, Heterodera glycines
tttgttcctaagcggaattggtgttgccaagacttcgttaacggtaggaattgcacaatccttacagtaatccgcatcctttaccatctcagctttgattttttccaacgccttacggtacttttgagtggttctttttgctttggtgccattaccttgtgatttacctaaatgaaaatttttgaatgaatcaaatgtagaaaaacatgcaccaaaatttttatttatttttattaatttttatccgtttagtttggcgtatggtgcttaaatttgtaaattaaatttttaatgggttttgaaggaatttttgttaaattttatctttcttatgtcaattttagacactacttcttgtcattcttaataatccatagaaaaaataaattattcattaattgaatatttaatggacaaatatattttttaattttaaaaaatctttagaatcaaattacgctccaatgctctgctcattttaaatgccttgaccagtttctgcactttttcataattttctttattagcaaaattttgcgtaattttttcaaattcactaaggttttcctcttcaggtataatgttaaaatgtttgtatgctttcaacaatatgatttttatctccgaaatgttgtcgttcgaactcgagagaaatgatggcttcaacgccaaattctccaaaaggcctaaaaaatttttaaattttcggctttttcaaattaaaaaaaaaatatatatatata

SEQ ID NO: 38969 - DNA, 1336 bp, Heterodera glycines
  misc_feature (199)..(199): n is a, c, g, or t
  misc_feature (213)..(213): n is a, c, g, or t
tgacataattgtctggtgatgacataatgtctgaggtgcaaattcggacagggagagatgtcaaattttggaaaaatagcggaaaatcgatgattacatgaaaatttgtttaaaatatttttgcctgatagtttttacaaaaaaattgcgtttttttaaaccaataattgcattcattgtgtcggtggacacagctgcncaattttggcctcncagttcaaaaagtaaatgcatgtgtggcgaagtggtttttgtaagatagtaaagggacaaagggtggggttcgagtccgttgtgcaacatgaatatttttatttatttttgtcaaaaaaaattgaaaaattactatttttgaaaattatttttgaaggtttttgccaaccaaattggtcaatcttggtatcattcgaaagctcttgatgcggagaaggtttttctgctaaacaaatactaagcgatttgacaatttagaaaatagataaaggcgtttgaaattttgttttttgaataactcatgaactaacagataaaatcaaaaaataacagaagaatcgatgcagaaaatttttctctatcggtatgcaaaatttgaagcctatttaacatcaggaaaaagaaatttaaacatcacgaagtaaattcggtttttctctacttcgggatcaatgtgatcaatttctatcaaatccgtattaatgaataatatatatcaattatatctaatactaatttaaatattacataaaaaacattttagaaataaatgatgtttcaagctcaacgtttctcatttgttctacgtttagtccgcttttcggcttcatttgcactttgatgcaacgccaatgcctttcatcagcagaaaaaataattattaatttaaaattaatttattttttaccattatttgacggcgaaaacattgtgaaggaatcgctttggtcattaccatcaaatctgatcgaaaattgacgtcgattcaacccgacattgatgcttaattagtaatgttaaatcagctaattaatactaattaagtaattcttaacatttatttggtagttttttttattacttactaattttataatgaatgataatattaatttcttattattttcatgaataaacatttgagaggtaaatgatgtttcaagctcaaagtttctcatttgttctccgtttgggccacttttcggcttcgtttgcactttgatgccacgccaatgtcttccaccagcagaaatgccatcttttcccattttttcagagcattctttggcaattttgttgtcctatttaattaattgattaccaatgcctaaaataaattcat

SEQ ID NO: 38970 - DNA, 862 bp, Heterodera glycines
atcttagctaatttttatgttttaatatcattgaaatactattttatactaaacttagagtttactaaaccaacattcgaaaagttgagttccatcgtgaaatgacaagtttaatgagaactatataaacttaatttattcacatttccataaaaattttaaatttaaatttgttaattcattatatttacgcataactagtgtggtagattatgttatacaactcactcgacatgacatattcatatttacaatagaagaaatctaaagggttatttatccatattttattattaaagtcggttttttaatctatatttacaacttataaattttccctatctaaggctgttcattaaattataatagtttttgaacatttattaaattactggttttggagcagccacaacattacataaattggtacttattcaggtttctttaaaatttatttttagataccatgggtattttgttgagaaattttgccaatctatttttttcgtctcttcttcgacataaaattccatttttgctgaaacattttttgtcaagtccatcaacttaactacaatcttattttttttattatttataatgacctcaatttttttcctgaaataaattccagcccaaccgccggaagtgatccatggctcaaattgaataaaggaaaaattttaattttgaaaataaattctaaaaaagtaataattgttaatttgggtattatttatttacggttttaaaattataaaattatttttttattatttatgtttttttttgttttaattaatatattgttaattttaatttataatttgtcctcaagttttatttaaaattaaattttatt

SEQ ID NO: 38971 - DNA, 949 bp, Heterodera glycines
aaatccaacgcagaattaaagtacagactaaagggaagctattcccgaaggattcggtctccccataaatctgggcgcatcggttcagggggactgctccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggtttggggggactgccccgaaaacaaaaaaatcgattttttcaagtgtccgtttggggtactcaaacaattatggggagcaaaaatccaacgcagaattaaagtacaggctatagggaagctattaccgaaggattcggtctccccataaatctggacgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctactcccgaaggattcggtctccccatatatctgggcgcatcggttcggtgggactgccccgaaaacaaaaaaatcgattttttcaagtgtccgtttggggtactcaaacaattatggggagcaaaaatccaacgcagaattaaagtacaggctatagggaagctattccggaaagattcgggctcaccataaatctgggcgcatcggattcggtgggactgccccgaaaaaaaaaaaatctattttttcaagt

SEQ ID NO: 38972 - DNA, 1243 bp, Heterodera glycines
cgattcgtttctgtcccttcgattgttccgctgttaaatatttcatttggcgcctttttgccaggaaatgttttttggcgaccgaatgaagcgaatggcgcggggagaaaaatccccggggaaaagccaaagggaggaaaagcggagaaagaagcagaagcggcgaaggataaaaatgaagcaattggctgataaaaaataaaagaaatccgttggcctttattttatttaacaaattatccaaatgataaatgaatggatgacgtcatcgcatcgtccgtttcaatgaaccaattatctcttcaattggtaattaatttgactaatgaacttccatcttttccatttgagcacattgttccttcaaaatggccacgatttgtgccgtgtccgcccttcgctcgcacaaattggccaatgtttttgcatatttcataacgtacggactcttttgggtaattagttagttaattagcttttaaataattcccttttttacctttgagaaattaaaacaaattttgttgaaagtgtgcatcaccttaacaattaacaatgttcaaattgttcatttccttctctttccccccacttcgttatggcattccgtttgcgttattctgtcgcccccaaaagattcgttttgtccgttttttggcattatttcgtccaatgccttcccaattctctccatttgcgtgtccacataagcccgtttctaatcattttccaattaattgttaattattattaattccaatttccaacttcggccatcgccattttgtccctttgcgattgttccgtcagaattccaatgtcccgcgacggatacattttgaaatttgccggtgaattctgccaaataattccctcactttttgtcctttccctccctttttttactttattttttccatctgttttttgtccattttttgacttcgttttgccttggaattccgacaatctctccgtcattattcgcacatttccgaaccatttgacgtgactttgatcggtcaatcgtttaaccgaattgaattgttcggcgattgtttcgttgcgcagaaataactgtggcaaacaattaagttaagaaattttaagcaaaaatatttacaattttctattaaaaaacaaaaaaatttcggaatttcaatttggttttgttagaaataggtctacaacgagtcaactaataacagttgtggaagattggtacgaggcaataataaatgga

SEQ ID NO: 38973 - DNA, 1012 bp, Heterodera glycines
  misc_feature (847)..(847): n is a, c, g, or t
  misc_feature (905)..(905): n is a, c, g, or t
  misc_feature (914)..(914): n is a, c, g, or t
  misc_feature (918)..(918): n is a, c, g, or t
  misc_feature (997)..(997): n is a, c, g, or t
tgtatacgtcagctgctgaataggggttagagattgcacaaagatgcaaaacatttaaattttttaaaaattccatttggcataatgttttaaattcttagcacttttttaaataataaaactgcaaaaaataatcgtagtaatttacgcgctgcgaccaaaaatgcccaatcccgcttttatcctctcaaaaaagtccggtatccataagaatgaacgagaaaaaaaatttccctaaagcaaaggacgagaaatacaaaaataaaccgtaattcatagattaaaaagaaattctccccaaatttacttgttttcaaacgcttaattcagaaaaagaattgttttgcggttaatttctgttgaccccattcccggcttttgctcaacaacagatggtggatttgtacgagttcaaccggcagcgaccgttgagcagcaacagcaaaagtcggccccaaatgctttcccctcgtgccatcgcacaaaatcaaacagtagcagcagcagcggcatcaggcgccaatgtcggcacaaatgcggcgccggtgcgacgcttttggccctcgtacattgaccaacatgtggcccagctggactttgacgcctccgtgatgatgatgacgagtgccggcgacgagtgccaaaatgacgatgacgaagaagacgacgatgaggaagacgaggatggtggagacgaagatgatgttgtgcaacaggggggaggacgaccacaacaacggctacaaattgggagcggaatggcacgagggggaggaggggcggaagaaacggcacgggacggcaacattttcgagtaatttcggttttatggcactaccaaatttanaatgaactcattttcaattatccggcggtcgtttcggtcattacagtttctgggattntgatcatgnaaanccgtgtttcatggtccaattccaacccccacgatttgggtagtcttgtgataataaatctcaaatgacacttccacaanatgcaaaatccatca

SEQ ID NO: 38974 - DNA, 1126 bp, Heterodera glycines
aaaaaacggattagggtttttattactttggaatgttagggagggtgataaatggtttttgacctttttattcagtctctgttaatacacagctgcgccagagggctaaaaaatattgtggaagaattgagtttggacgaacacatcgacgtcaatttggaggactctgagggcaacacggcactgatacacgccgcgcaagcaggtcggagagagtgggacggacagtgccggcaattagctcaaagggacggaggaattagtcactaattacccttcgcctgtcttaggatacactcaaataattgaactactaattgaccgttttgacaagctcgagattgatcacgtgagttggtatttccaaatcaaataaaatgctttccatcgaattcttttgccaaggtaaacaaattgggccaaacggctctgatcaaagcggccatccaaggccgggccaattgcgcccgaattttgctgtgtgcgggtgagtctaagctgattagccatttagtgacggacctttaaggcgcggaccccaacaaaagggacaatgggcgacaaatgacagctttggaatgggccaaatttgtggggaggacggaatgtgggctagtgatcagagagtttggggagccgaagaggggcgaagacaaacaatcgctgcaaaactcagcccacagcaacttcaagcaggtcgaggggattcggactgattttggggccataaatgacttccaaagtgccgtcaggtcgcctgcgttgccgccatccctttggtgggccttcgcgaagtgtccgccctcgcgcggccccgcgtccgttccgcgcctccaacgcccgtagtgaacattcgaattacgccgccaccgtcgcccttttgccaaaacattgagacggaaggcacagcacaacaattcccattcaaaatgatatcaaagcaaaacaattcgtcaaagaacagacctctcagaactgaagaacgaccgaaaaagttcggtaatgtaaaaaaaaaggagggagagagagagagagagagagtgagagagggggagagagagagagagaaagagggagagagagagagtgagagagggaagagagagagagagaaaaagaaagaggg

SEQ ID NO: 38975 - DNA, 196 bp, Heterodera glycines
tatcatgctcgagagcatttgtatgtgtataaaatttatcaaaaaaagagatagccatttttctgggataacctctaaatataaaaatcctctgtgaaataaaatggcgattgtgcacagccctgcgggtcccttttaaggggttttgagagggataaaatttctcaaaaaaagagatagccatttttctgggata

SEQ ID NO: 38976 - DNA, 1031 bp, Heterodera glycines
ttaagatttttgactcaaaaaactgttatttgagccctaagttctaattttgtcgaattatttttcgatggcacgactttttcacagtttatgcaaaaaataaattaatttaaatcggctggaaaactattggttatagaaagtgatttcaatcacttattactcaaattcatagctaaattttggtacattaaaataaaatatgttttttaaatcattaaaaaatgaatgagcgtcaagcatattgaccatatttatttataatttatttattttaacttaaaaattttagtatgaatattaagtattttgaccaattttagtaatcaatttttaaaagaatttgttttttaatctttaacaattttgccataccgtactttagctggctgcccatttgcctgtgtctttttgctattaattaattaattaattaaaggtaaacatatccaagggatcttgtaattagctaattaattaaggaacagaacattgcgacccaatgtttacaattttttgtttattttcactcccaaacatttttctgagcatccgaatgcaataaacacaatatttcgttgcataaattgtgctgaaacttctctatgatattcacaaatgcatttagcatcaattagctaattcatttatttttgtttaaaattttatttatttatttttaattaaatttaatttattgcaaaaaaatagttgtaatattttaaaatatacggccttttcttggcgaattttagctatttgttgtttaaataacaattttaaaaagtttgccctattttttaattgccaaattcgacatggccactttcaatgtggcccatctcatcactttaattggcgttgtggtacaaaaatataaattaaaatttattcatattttttctaatatttatttttgttttagtcaattgcttcatccgttgttgctgatgagcaacaaaaccaaaacaaaactcaaaatggaggaggaggtttaaagcatttgttgggatcggatggtaaaaatgata

SEQ ID NO: 38977 - DNA, 1095 bp, Heterodera glycines
  misc_feature (959)..(959): n is a, c, g, or t
tgaacagaatgccacatttaacatgaacaaatccagcgccacaatcattcagcgggaaatgcaaaatggtaaagaattgaggcaaggggggggggggggggaattgagacgcagtaagcattcattaaatatgtgccatcgttttcatggcattttttaaacatatataaaaaaacaattaaaaatccaaaaatggcataataaaatccggcaaaattattcaattattttcaaagtcggcgtcgcggataaaaattgcttattaatagatcttcgtccaaaaatcaactgtctttttcttacatagattttttaatttagcgactgaaatgatccgtaattgggcaaatttaacaatttcatgggaagacaaattggacagtttgctgaaaggccaaatatttgaagaaaaggtaattaatattactactcagtgttgtcatggtaaattttcattttttcccccaaaaaactgaaaaaattacagtattccacgctagtactatttcaattacggtatttatttcactaatgatttgctaattatatacattcctccctttacagtatgcccattacattcgcatcatctgtaaatctgcttcactggcagatttttatgatttttgtgggtatgccgagacgcgaattcgtctccaattattgattgacattgaacgctttgatcacatccgattagcccatgggaaacaaattattgcaaatgaacaatccactgaagaaattgagaacgaaaacggcacaaaaaatgagcagaaaaggcaagtgacaattaagaaaatattcgttatatttgcgatggttagttaattggcaattttattttaatttgattatttcttgtcaaaatttatttgactttaattaacaaatattcaattttaagtttattacatttacaatagcagggatctcatatgagagactttagcttatangctgataattagagttcgcaaaaaaggcaccaaaagcgcaaaaaagcactataataggcacaaaaaaatggaaaaaagactttacaaggaccgaaaatccccaaaaaagcatgaaaaaagcatttaaaaatttttt

SEQ ID NO: 38978 - DNA, 1236 bp, Heterodera glycines
  misc_feature (78)..(78): n is a, c, g, or t
  misc_feature (164)..(164): n is a, c, g, or t
gaatctgcgaaaaaaagtataagtgatcagcagacacttaaaccaattattttaaattcactcaaaacccctccaaanaatattccggtgattataatgaggatgactgcccgatcacccatttggcctagcccatcacagagtcacaatttaaaaccccactncttaccgtgttaagggaaagtgcctgcgtttcactggcgacgctcactctgtgaaagggacaatgcattttggagtgatgtgaagggtaaatgtgactatttgtgcactttctgtgtctttccaattctgttccctctccgtcaatcatttccaccctttaccaatggcctaatttcgcacatcttttcttatattcccatccatttttatgcccccttttgaagtcgccctcctcaaatctcaagttccctagatggatcgataacttgacattttgcattgaattttcctcattttttctaataaatttctaaaccctttaagagttaaccgagtcgaattaatttgggtttggacacgacaataaacactcacacgcatcccatcgcaacgagcagatttttcaacacattttccgacatataaaaatcctgtacaatcggagaaattggcaaagtgaattcgggatctaacgataatggggaggggatgatttgtggcagtaaaatatttgaagtaaccgtcgaaaagcagcaaaagacaaagcaattcggccaaaatgcgactccttttctctgctgaaagttcgtagaaaacccttcctttttggttttgcggaattgctaaaattaaaaaaaataaaattatctttatgttcattttcttacataaaaattcctcgcggatatgacaaagcattttcggtggtataaaacttaatgattcgacttccttcaccgaaagcttccgaatttctttaacattgactttgtgaatggtctgaagtattcttaaaattagaaaagagcacaatattcgcacctgcgtcagtttggcaagtgcaacagttttaagggacaaaaaacaacggcgggacggatttccatagcgcaacggatttccaaggcgtttggcaacgacggaagatatgcctaaatcgggggaaaaatcacatcgattcgattcgctttgtcatttgcttacgcacccaaattgaccaatttttgcacactttcgttttgacggaaaaattgcatcgcttcctcttgaagctcgcgcaaatgaacttcg

SEQ ID NO: 38979 - DNA, 986 bp, Heterodera glycines
aaaattggaattctagaaaactttacaatttatctatttttgatataaaaaaaaattagaaaaataattaatttcgaataattgttgaattgttaaaattgagatagatatttgttttttgttttctaacattcatgcaaacgattttatataatatgaaattaaattcatagaaaaggatgaaagagggaacaaatgtcaaaatagagataattagtcatagaggttttagtgtttttaaacattgttttttgaattcaaatttttcgaaagaatcgtttttagtaggggtaaattttcagaaaattcaaaattcgcaaaaaccttaaaatatgtaaaaatgaaaatatcacgatgataatattgattaaaatttcaaccaacttttgctcagtgttgccttgctcaacatttaagtcgtaattttccctaaagttgttaaatggaaatatttattgtacacggaaaacttcacacacacgaagctaattaaaacgaatacaaaaaaaaagagagagagcgatgttcaaaatttagtagtaattagaaagaatggaatgttattcaccaaaaacataaaatacaataaatacacaaaataattaaggcacgaaagacatttacgatctctgacgcttaaggatattattgcgttttggttaagaattttagacaagttttgcgagttctgtgcttttttattattttttaaaatatttttaatgcagttttgattatgagttttgagacaaaataggcatttgggcgtaatgaccggggcggagtcgttatttaaaaaacatcataaagggcgttatttaaaaaaccatcattatgaaaatttttgtcgaaaaattatttataattttgctccaaaacaacaaaatttttaatgatggtttttaaataatgactaagccacctaatgaccctcccccccaccccaaaaaaggcaaaaaccgggattataaaagtcatccaaagaa

SEQ ID NO: 38980 - DNA, 1100 bp, Heterodera glycines
ttgagggcaaaaacgatgctattcataagtgattattatcagaagaatgggaaaaacatttattttataaaagaaaaaaaatctgatgtgcatcttgagacaacaaattttattgagtatatttggaggtggtcttccaaaaactaagcggagaatcggaaagacaaaagatgcaaacgaaggaaatgagaaatgaaccgatgaaagtagactttttaaacaagggggagggatggtctactgatccattttctaatattttccaatctcagcaaaagggaaacattgaaagaatgcaatttgtttgagttacgccatgagtatcaaaaaaaaaaatattaatttgaatttaagttggttgtttttaatcctttttttgtaaattaagcagtgagataaaaaaaagtgtaatacgttttagaacctcataaaatattttttaaatgagttgcagttaaagaacacttaataacggaaagggaaaaaatgcacaactgcactttagtattttaatcaggcccacattcagaaaaaatttcaggaggaggggcaccaacgaaagaatactttttgctccttggatttaattccgcggggataaaaataatttgtttttagcagttttggtgagagaaggacgctcctcctctccttcccccccccccccccgaatatgagcctgactaattataatccaggattaaaaaagagtttttaagtgttaaaggatggatgggcaagtgcaattgaacggagcaaaacagacatttatttacaaatttcgagaaaaagtgaggtaggctctaatgagacagacgggcattcatttagccagacatttgaaggcgaaacaaaaaaattaaaatactctgtcagttccgcgttgtttggcccataacgaacaaaaggcgaaaatctgttggggcgtcgaccttatccggttgtgaatgccaaagtgtctctgaagagttttctcatgaaacttgcaccgcgcgttacattttcagtggatcggagaccttaagaacgaagttgaagcagaaaaagaaagaaagagaaatggaaagctcaccatattcagaatccaacctccaaagata

SEQ ID NO: 38981 - DNA, 1187 bp, Heterodera glycines
ttttttttggattttgccgtgttttttcccttctttgagtcaatgcgaactgagggattagctgagcagtgaagggaataacgaataatatggtgcacaccggcatagggcggtggggggggagggaatcccccgggcgttgtgccgcccgcggtgagcggataatccccgtggcattgccccgctcatccaatgcgagtggcacggctaacaacacctttggcactgagcagtccatggtgaacatctctgctgactggtgattaaggtggtgtcacttttcagtttcgttcactctctaacttcgtctgcttctcttccgtcccctttgcccactcttttcggcttctctctctctctacatttttccattttcattccttcccctggcattccatcgattccatccaaatgccattgccatattctgccatctcatttttcattcgtggcccttccccccccccccccccccctcttctgttggtttccctctcttttttctcttttcccgtgccattgttcatttttccctttcattgtcctcaaaatattcaaagctcaatgataagagcaaaatgctttttccccgcctctttataagttgctttccgtgtcatccgaatgatttggccaaatgctcggagaaggtcattattaagggaaagcaaagtgaatttattcggcaaaatcagtcgagaaaattgcacagaatttattcattcaccgatgacgaactgttattaattcaaacaacttaattgcttctccgacgcttttcaataattaatctctttttgtcaataattcttttttcatttttcatttcatcctttttctctctcgctctcgctctctctctctcctctctctctttcactctcctctctctctcgatctctccacacactcacaactatgaaagcaaatgatcgcttgcttttaaacccacgaaatctttcaaaaagcccgagccacaccacttgaactttttaaagaaaaaatagaaataatggcgggtcggcgtgattgtttctccacatttatccactatttcactcatcccgacataaactgaatgttaaatgccccgtcggcatttttgccggagaaaattttgccaaaagcctaagcggggcggaaggggtggtgcccgctgccccgtggccccgcccgtcagcctcggt

SEQ ID NO: 38982 - DNA, 1522 bp, Heterodera glycines
ccgatcagcggtcacctccttcaccgctgataagcggtcccccctccacaccgccgatcaggcggtcacctccttcaccgctgataagcggtcccccctccacaccgccgatcaggcggtcacctccttcaccgctgataagcggtcccccctccacaccgccgatcaggcggtcacctccttcaccgctgataagcggtccccctccacaccgccgatcaggcggtcacctccttcaccgctgataagcggtcaccctccacaccgccgatcaggcggtcacctccttcaccgctgataagcggtcaccctccacaccgccgatcaggcggtcacctccttcaccgctgataagcggtccccctccacaccgccgatcaggcggtcacctccttcaccactgataaacggtctccgctttacattgccgaaaggcggagttatcacaccgcttatccgcggttttgtattcttattattctatatttagtgctgccatgagcacgaggagcagacagaattcgataaggcggattcggccgaaaaaaaattcgaagtgttgtctgcttctttgtacgacatcaaagaatgtgtcgtctgtagggaagagcgcaaatggtatataattaccttcaagcaagttggaagaaatgtgatcacaacgcgtggggcaaatgtcttcctccttgatgaagacgtttgggaacatgtaaataacgggcaagaaacaattgatttttaatcttaatttagtcgggctttttgttgggaaacctcttggcaacaatttatgctcgggcgctggttcataacatgttggacatttctcgagcccggcaaatgtaattaattactattttttataagttccataagatagaatttatatttagaacaattgtgttgaacaatacgcgccaaggtttcaagattgttgacactgggaacgcagcaacaccgccaccacaacaacaacaacaacatcatcaacaacgacaaacacaaacaccacaacaacaacatcatcaacaacgacaaacacaaacaccaccacaacaacaacatcaacaacgacaaacacaaacaccaccaccacaacaacaacgacaacaccatcaacaaacacaacaacaacaacaacagcaacaacaagaacgacaacaaacacaatctccacaagctcaacaacaacaacagattttgcgtccagtgccattgaatatgtttcaatttcaacctgtaaacgacgatctgttgcccggtacaagtggtacaacaacacacattggtatatatgtggggggagggacctaggggaattcaatttctcgtttcattttaagttcccatggcatttaaaaataattttaaatatttttctaggaaaaatggtctgtttttgatgttcaaattttgcttaaaatcctcaaaaaattttttgggggaacatttaaaatacaccagaccccccaataaaaaactgaaaaaattttttattaatcccatttaccccaaaattttt

SEQ ID NO: 38983 - DNA, 1022 bp, Heterodera glycines
  misc_feature (926)..(926): n is a, c, g, or t
  misc_feature (968)..(968): n is a, c, g, or t
tttaaaaaggaattaaaaatttttaaaaatttattcagtgtccgtttaggggtactcaaacatttatgggggagcaaaaatccaacgcagaattaaagtacaggctatagggaagctattcccgaaggattcggtctccccataaatctgggcgcatcggttcggggggactgccccgaaaacaaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcagggggactgccccgaaaacccaaaaaaaaattttttggataaaaattatttaaatgaactgactagataatatttaaaataggttatttctcttcctttcagtattcctgcaaagtttggtgcgcttctgatcagtttctgaaaaaaaagttaagcctaaactttttggcctgtttaaaaaggaattaaaaatttttaaaaattttattcatctccctttttgatagaaaaagcatcagagtgcctaaactaacatgtaaataaaatttggtgcgtttcagaaccctttctgaaaaaatatttaagaattaattttgcaaaaaataaataaaaacgaaagactcagattttcgaaaatttttttgagccagctagctcggcgctcatttcagtgtaagttagtcctttaccggggagtatccctgcaaagttnggtacgcttctgctcattagcaaaaatatgagtgatcgattntcactaaaaaagtaagcctacttttttggcatattaaaagcaactaaaaatttt

SEQ ID NO: 38984 - DNA, 1022 bp, Heterodera glycines
  misc_feature (1004)..(1004): n is a, c, g, or t
aatttttttttttaaaattatttataaaaatttttttttaaaatattcaaaaaaaaaaatttttaaaaaaacaatttgacgaacaaacattaattattggataaaaaaattattattattttaagtacttttgatgcagcaaaaaatgataaaacgtcaaaatcaccacaaaaaaaatatttgactattttggagctcggcgaaagagattttggaagaagaattatgcaaacttgatcgacgattatcccttgaagagtataaaaaaatgcttaaggatattatggaaccgctagtcaaatttcataaaggtaattactatttgaaaatgctgatcaattaaatttcttaattaatttgcaaaattaacggaattatttttagttgggattcatttggatttcaaattaaagaatttaattgttgttgaaaaaatgatgaaatcaaaacacaagaaaaagaccttatttggaacaaaggaatgtttggaaaaagtcaaggtcaaaacttttaagttgatcgattttgatggtaattttttttaattctatcattttaaataacagtttttagtatttaaaattcataaatataaattaaattatgaaatatatttttatctactcaaattttaagggtccgttttatatttgaacagagaaaaaaagggaaaaattgcttgggatttaatgggctacacagaagccttcagtgcacccgaactgcttcaggttggaagaatttaaaaaatatttacaatttcgataggttttccgtgaaatttttgaaaagttgtaaatgaaaatacctaattcggtaatattagtattttttgcatttcattattaaatacagattgaatttctgctaattatatcgttaataaaataatatttcagaatttatctctattcactgagggcgatattgaggttatttgaaatattaaattttgaattttaaaaaattcttgcaataatttatcaactcttaggtcaacccanaaaatggatgtttggtca

SEQ ID NO: 38985 - DNA, 1282 bp, Heterodera glycines
attaaatgatttagagtaaatttaaagaatttaaaaaaaatttttttttaccattccttcgttttacgtcttcaatctcacagcgcaattccttaaaataaaaataaaaaattcaagaaaaattggccgcttttttttgttgtgaaaaacggatacaaatttcgtcttttcttcctggcgttgtaaattttaaaataacacttaagtaaaaattttggaatttttgggccgtagaaaaaaaaattcatcccctccgaaattttctatggctacggtaccgaaaggagtttttggcctcccccataaccccgctcctgtccatgttcaagtcatactgtaatacccggggtttaaatttgaaaaagcaataaactcacataaaatctgttgttttccgcactttgcatattgtcccaccttaaaatggacaaaaattaatttctgtaagcaaataccaaattaaactacggtataccataattcgggtccaacccaacggactttaattctgaacacttcaacgaatccatcactgccactaaaatgcaaaggatagctccgagtccaaatttaaataatttaattagggcacctccccgaccctcgggagagagaaaagtcggggatcggagaggaaattccccgaaaattttgtctgtcaaaggctggagaaattattaaaaaaatatccgcgagcgttcaattggtgacattcgaatccccgagtcgggaggaacccgaaatttaaattacgtcgcctcattgagcgtgaccatcaaacggaggcgcctcacgggcggaggttcggtaatgcgtgacaaatttttgtagtggaaagacccggtgacgaactgaaatcaggaattcagcatttgttaattgtttaaatttgccattttaaattaatttaaacaaaaaaaaaattaaaatttttaatcatttacaatcaaaaacggacattccgtttgatcagatatctgttcggctcgtgaaagcgtatcgcaggaacacgccgacgagctgttgttgttacacaacaggcgcataaaatcaacagttcaacaacaaatagtagcacaaaattcattgtggaaccgaagctggcaatgtttttgaaaatgtgcttttatggcttaatgaaaatgtacgaaatttcgattttacacattttcagatccccgacttcagaaagctttttaggggcacgaaactccgatttccgaaaggttattctaacaaaaatacacgaaattcatcccaatttgtttttttatatcgacct

SEQ ID NO: 38986 - DNA, 879 bp, Heterodera glycines
agttacacaacaaaaaaaaaattttcagattttttgagtctgagttagggatttagttttttaggctaagaaaatgcctacctaaacattccgaaaatgaggattagatttaaaaaaaaaaaaaaacgtttgtagaaagcaaagactggtcccaaaaatttcgctaacaaataagtaggaattcagtaatactgccaatggcatttcatttttttaattattttttaaaaaaaaatgaaaggaaagagtcttgttttatgaataaaatttcttattttacatccctaaaagctgaaaattatgtcgctattcatcattttttttctcgacttttgtcacatttttgtctttcgagattgttgttacttaaaatcccgtcccctatcaactaataaaaaagaaaacctcataactaagcagctcattcattcacagcaccaaatatgcacaaacggcgacatttccacacttaacatgcgcaatgaatattggtagaacaatcaacacccacaaacagcatttgtgtttgacaacctgaaatagaaaaataagtgaaaatgtcaaacaatcactgaaaagcactacggattcattaaaagtcgcatttatttattattcatttttaaagttttatttattatttattttttttttgaaacgaaaataataacattacgccaaacattctatttattctgccaaaatttaaagcaagtgtctaactataattgcccttcttaaaacttcatattttaatctcggatttcagaccccttcaaaaccaaaagatcaatgctattttaataaattaattaaattctttagtaattttaacatttcatacaaaattttacaaaaaataaataaataaattttttt

SEQ ID NO: 38987 - DNA, 966 bp, Heterodera glycines
  misc_feature (800)..(800): n is a, c, g, or t
cagcttgatgcctgaggtcttttggctcaacaaatttgtgctttttagccccatagggcggagggaagggcaattaatgaaaagctttgctcaaccaatcttttttttctctaattagtcatcatccgatgatcaaacgtaaagccgtcgactgtgtgaaaatgcttttgaaattttggatcaaagattcacagcaccgacgggtgggcgattcgtcgatggcaatgacaacgacgacacaaaaaggacgaactttggtggacattcatggccaaaatttaatcactcatcagtcagcagagacggaaacttattttcaaatgttgaaagaagagtggaaatgatgcaaaaaatgaatttatgaattttctaatgatgtgcgggagggaaatgatttgcccgggatgataaatctttatgtacattgtaattacctttaagatatgtgcatatataattaaatagattttaaatgttttgtttcggcaaaagtagcaaacattgaagaagcacggaattccgatttccgaaaatttttggggcctcggaatgccattcctgtcatacagtttttggccataatttgccctgaaaatgccatgcttggtgattccttcgaattgcttcttcgtcttttcttccgactcaatttgtcattccatccgtcacttctgcttttcctgctgttctgctgctgtttttgtcccatttttcatgccttccatcggcggatgaaaatgaaattttaattacatttgcctctcccactggcgactgccaaattatgctctcctttttgngaccttccctttcattttggcgttgtgcatggaattccctctcattttcagtggcttattacccaaaaacattgcgacaaaatttgcattgttttaggcacaaatatccacagtttttcataaaattagataatcttttaaattttgctaattctttgactgacta

SEQ ID NO: 38988 - DNA, 1286 bp, Heterodera glycines
catttaaataatttttatccaaaaaatttttttttgggttttcggggcagtccccctgaaccgatgcgcccagatttatggggagaccgaatccttcgggaatagcttccctatagtctgtactttaattctgcgttggagttttgctccccataaatgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagtctgtactttaattctgcgttggatttttgctccccataattgtttgagtaccccaaacggacacttgaaaaaatcgatttttttatttcataaatattttttcagaaaatgctctgaaacgcaccaaattttatttacatgttagtttaggcactctgatgctttttctatcgaaaaagggagatgaataaaatttttctaaaatttttaattgctttttaaacaggccaaaaagtttaggcttaacttttttttcagaaactgatcagaagcgaaccagattttgcgagagcatcaaaaagacaaggaaaagcactgctatgatgctaacaccagtaattctgaatttaaaattttttattaatttttaaagcttcactattttatttttttagcaaaattaattcataaatattttttcagaaactgctctgaaacgcatcaaattttaattacaagttattttaggcactcagatgctttcaatatcaaaaagggagatgaataaaaaatctaaaaatttttaattgctttttaaatatgcgaaaaattttaggcttaacttttttttataaacttatcagaagcgaaccagattttgcgagagcatcaaaaagacaaggaaaagcactgctatgatgctaactccagtaattctgaatttaaaattttttattaatttttaaagcttcactattttatttttttagcaaaattaattcataaatattttttcagaaactgctctgaaacgcaccaaattttatttgcaagttattttaggcactcagatgctttcactatcaaaaagggagatgaataaaaatcaaaaaatttttaa

SEQ ID NO: 38989 - DNA, 483 bp, Heterodera glycines
cccgtcgtcgtccaccacaccttcgcattcccaaaaagcattctctccccccccccattcgtttatgaatgtaatcgctgctttatgtaagtatcttcccccccccccccttcccatctccagccaaacaataaaagaggcaagcgccgctcgggcggatggttgttggaatatgttacgaccgaccgccgaggggggcggggggggggggggaaatccctccttcccctcccccgctttcccatcctttcgagactgactgaggaagggaaggagggtggggtgggaggaatgcagcaatgcgatttatgtattcctttggtctctccgccaccaatttcccgatgatttgatggccggaggggacaaaaaaattaaaattttcaacggttacatccattaaaaaatacaattcgattagcactttatttgtttctccccattccattatttaatcaatctattaattgcttattcctttat

SEQ ID NO: 38990 - DNA, 945 bp, Heterodera glycines
aatccccgacccggactcgaacacaaaaaggtgaaacaattcaaaaaaattcggatttttgattaaaactggttaaacaatgatcggaacggaagccattttggattccgtgattgatcactgataaattacgccccgaaaaccaaccaaaattgccacgactttagaagtgggcaaatgcttactaatacctcgaaatccatggcccctcactccaaataaaaattttttcaattttttacgacttttccctccctctccttcaacagaattgtcgatatgatgggggcaaaggatgcgcaggcggtttttgacaaatttcttgatgcaaaaggccatcaccgacttgacaaatggaacaccacgcttcaggtgagtgggtggcaaaaagcacacgccgtagccccacgccgtttcctctggaaattttttaaaacaaaattttaacaaaaaaattttttaagaaaaaaaatcacagaccataaaaacctctctaactgcactccttagaccgtccccttgtggagcagatcgtttctctccattagccctccccaaatttcaaaaatattttccaacaaatttttcaaaaaaaatcctacagggaaccacccgaaaatttttgaggcccccatagctaaaaaatttcatttttttttaataaaccctccccttttgtgttgtccagtttaaactgcttgatggtgccaccaccagcagcactgaacaacagcatcagcaactgccgaagaaaatgacgacgacggcaccgtcgccgccaccgacgacggcaaaaccaacggttgttgttgttgctgctcgaagggatgccaacacatctctgtgctatgctcgtgatgaactgatgtcgttgaagaataaatgtgagaaaatttgtgtgcattttttagaggaaaatgaaaaaaaaaatttttttcaaaaaaa

SEQ ID NO: 38991 - DNA, 760 bp, Heterodera glycines
ttactatatttctcaaagttgataacacactttcgtactgtattcctcaaaattgactcactttcttagtgtattcctcaaagttggcaacgcgctttcttgctgtattccgacaacacactttcttactatatttctcaaagttgacaacacactttcttactgtattccgacaacacactttcttactatatttctcaaagttgacaacacactttcttactgtattcctcaaagttgacaacacactttcttactgtattcctcaaagttgacaacacactttcttactgtattccgacaacacactttcttactatatttctcaaagttgacaacacactttcttactgtatttctcaaaattgacaacacactttcttactgtattcctcaaagttgacaacacactttcttactgtattcctcaaagttgacaacacactttcttactgtattcctacaacacactttcttactatatttctcaaagttgacaacacactttcttactgtatttctcaaaattgacaacacactttcttactgtatttctcaaaattgacaacacactttcttactgtatttctcaaaattgacaacacacttcttactgtattcctcaaaattgataacacactttcttactatatttctcaaagttgacaacacactttcttactgtatttctcaaaattgacaacacactttctaactgtatttctcaaaattgacaacacactttcttactgtattcctc

SEQ ID NO: 38992 - DNA, 1097 bp, Heterodera glycines
  misc_feature (17)..(17): n is a, c, g, or t
tgaaaatgtcatttttngagcttttttggcgtaactttttttgaaaactgataaaaaaaattaaattctgcaggctaatggaaaacattaagggctatagaatgataccaaaaatatttatttggttaataatgataaaagttattagcaactgtgccgaaagtgttggcgccgaactgggaggttcccctttttgattcggtaatttgaaaaaaagttacgggtcctaaactgcaagcaaaatgttattgccatttcacattttcttggcattatgtttattgacacgtcatcactttcatcgcccataaataccgctctcttccctacttcctcgcttcggacttcattcattctcaattatcatttgcatttcacccccacacatatttatctctctctcttcacctctgacatttattgttattgattgtatttgttgttgttgataaacgacacaacaattataatcatcagtaggaatattctaaaaaaatcgatgctttaccaattcactgctagggaaatttttttgaaaatattcgtaaaagtaactttattaaagatatgcaattatttattaaatatttattcagttgaggttaagctagcgtagcacgccaacacctcggggaagaattctcggggagcagggagcgccaatattggccgattttgcgagaaaattttaacccaaaactgttcatttttgattttgggagacggagaaaattaattagacctaatgaatgatatttgttaataattttacaaattttaataaaaatttctccaattcttctcttctcaacttcgattacgaaactcggcaacgaaaaaaaagaagctcaaatttatgagcagattttcaaaaatggcgcgacctttggagacccgcatttaaataccggacctttagggatccgaaaaatttgggcaccgaaacgaccctttccctggggcccatccctgatataaagcaaaagaattacaaaatttcaggtttggatccgggtgaagtaagtgatttttctgtattatttttatgcttattcaacattcagtttataaatgtttagtatttattaaaaaattta

SEQ ID NO: 38993 - DNA, 825 bp, Heterodera glycines
tttttcgcaaaaatcaacccctgacgagttatgggcctgggactgaaatgtcccgctcaggccaaaaattttttctatttccgggaaaaaatcgaaattttttcaaaaatatcaccaatcgagagagctcgaaaaacggttgcttgaaagtggtctccgttttccccggaaaaatcgttaaaaaatcctaaaattcaaaaacccgaaaacagttttttaggcctagctcgaaaaattttgaaaattttcgaaatttttaaatttggaaaaatcgagcttttcaagctctacaatagtcccgctggcgaccccccgctcagatcaaaccataatgagttattcacccgggactgaactggacaaagttggtactgaaaaagtctacgcacctacagccttccctattataggtagaggcctggaattttttttaaattttagtcaacacttcaacttaggtccctaccagcggaaactttttgattcgggttttaggaaaaaagttatgggccctaaaatgagcgaaaaagtgacaaatcacttcccgggactcagtcgtccgcgctgatttttttcctatagttttcccggatactcctcaaaaagttgtaagacccttccaccaatttcagggcgctcccggccttcggccgggagataatggttttagcaatgaaaccccttgtcattctaacgtatatataattttgttcagtctcttcagttagtcacttacagcaggaaaacactgagatccggcggaaatcaagagacacacactttctttcagactttgacagcattttctccaatttgaatttggca

SEQ ID NO: 38994 - DNA, 1277 bp, Heterodera glycines
atttaaaattcattaaattattaaaaatgttttttttattattccctacaaaattcctccgcgtctttcactctctgtttgattgacgaggacatttttgattggaaatactccggatgccgcgagttgagtatgccgcgaaggcaagacaactcctgctcacgattgatgatcgggtcatccaactgaattttttttttaattttactatttttaatttctaaatatcaaaataaaaaaaatgggggtggggagcggagcaggtctttttcctccccgtcgtttccccccccccccctcgaaaaattaaaaaaaaaaatttcaaacagaaattaatgaacccaccctccgcctttttttgcaaaaaaaaaaacatgaatggtcccacgaacccctccctaacttttatcacacaatttttggcccattttttgtgccctccccctctgtgccacctgttgcaagtccgccttggccactcggctcgcgctggccatcagggcgcgcagcagggcacgtgcctgcatgttcaggaaagtacatttggcactgtccgagcaacgcgcgcgcagcaacgtcaccgcctcctccgccgtgcattggtgcggctgttgttgttgctgtgccgtcgtggcgctcggcaagttggcaccgtggttcaaccgttggaccagccgggcacagtccatcaccagacagtacccatcggactgtgctgcacgtctggccgagcgttcagcagactgtaaaattgtaaaaaatggaaaactgaggggcattcattgtctccctccccgaatctgaaattttaattttttccaaaaaaatggggcaatttttattggatttttttaaaatccagtgaattttgtaatttattttctcataaaaacatgtagtgaattcttcgaaaaaattttggttaataaaaatgttttcaaaccaaaattcggtccaaaattgtccattcctcgagtcgaatggtccacagaattgcaaaaagccaagcgcagaagtcagtgccttttgtgaagaccaccaactcagacaaacagaacagtgcctcataaaactggaaaatttgaaaaattaatgctaaaaagcaagtttttgaatctttaaaaacattttttaaccaataagttttcaatgtttgcaaaagaaaatttttttagttgcgttcagaaatttaattaatttttgactcaaaattcaaaaaaacgaaccctggcctcgagaaaacaaatgccgacaatgtatttcatgagttgacgcag

SEQ ID NO: 38995 - DNA, 463 bp, Heterodera glycines
gggatcccccgggatttcttcgggatcccgcgggattaaattcgggatcccgacctcgggatccgtcccgagcgattttttaaattcatcgggattgatcgggatcgggatttcatcgggatcccgaaccgggatcccttccgaccattttaccaatcccgcgggatcccgcgggattgaagtcacgatcatttttcaaaaaatcaccatttttaaattaagatcttgaattttaaattaaaaaatattgtcatttgctaatttttcttaaaaaatcccttacaaatcccaaaaaattttacaggtctccaaaattccactaaaattttcaaaatttgacgcaaaagttggccgttttgtgacttttgtttcttcataaaaagaattatttttttaatttctaaaacattattctaaatcttattaggtagttttatgtagagaccggacaagtggggggggg

SEQ ID NO: 38996 - DNA, 1010 bp, Heterodera glycines
aaaaaataattaaaaaaaaataatgctggtgtggtaagtgtgaagaactgtgttcctccaggcaaaaattctaagaaattttataagcatttgtagggttctcagcagtttccctgcaaaatttggtgagcttctgatcagtctagaacgttgtgtgataaaatgaaaaaaataatttaaaaaaaataatgctggtgtggtaagtgtgaagaactgtgttcctccaggcaaaaaattctaagaaaatttataagcatttgaagggttctcagcagtttccctgcaaaatttggtgagcttctgatcagtctagaacgttgggtgataaaatgaaaaaaataattaaaaaaaaataatgctggtgtggtaagtgtgaagaactgtgttcctccaggcaaaaaattctaagaaaatttataagcatttgtagggttctcagcagtttccctgcaaaatttggtgagcttctgatcagtctagaacgttgggtgataaaatgaaaaaaataattaaaaaaaataatgctggtgtggtaagtgtgaagaactgtgttcctccaggcaaaaaattctaagaaaatttataagcatttgaagagttctcagcagtttccctgcaaaatttggtgagcttctgatcagtctagaacgttgggtgataaaatgaaaaaaataattaaaaaaaaataatgctggtgtggtaagtgtgaagaactgtgttcctccaggcaaaaaattctaagaaaatttataagcatttgtagggttctcagcagtttccctgcaaaatttggtgagcatctgatcagtctagaacgttgggtgataaatgaaaaaaataattaaaaaaaataatacttgtgtggtattaattcataaatattttttttcagaaaatgctctgaaacgcaccaaattttatttacatgataggttaggcgctctgatgctttttctatcaaaaagccataaaagtaaattctaaaagatttttaattccttttaaacagg

SEQ ID NO: 38997 - DNA, 1563 bp, Heterodera glycines
  misc_feature (8)..(8): n is a, c, g, or t
  misc_feature (19)..(19): n is a, c, g, or t
  misc_feature (49)..(49): n is a, c, g, or t
  misc_feature (63)..(63): n is a, c, g, or t
  misc_feature (82)..(82): n is a, c, g, or t
  misc_feature (114)..(114): n is a, c, g, or t
aattattntaatgtttcanaattccatcgggattcgtcttcattatttnttctgtgtttattnttcgaaatttcttttcatntactggtacgtaacgaagtgtgcctttaagtntaaagtttgtttggccccctgggcattcgacaatgcaattcatgtttatgtcggccatttcaaagggtaaaatatccttttgttcatgtccattttctgaacattttgctaaaaatattggcccattttggcattttatttctgcttctgcttgaccaaattctgtttggcacacataatttagggttccacccgtgccgcaattgtaacagccgctaaaattagttggttttatgttgcattttgttccatctgtgactgttacaatttttataccattaactcttattgctaatttaactggagaatattcagtctcgcttaatatttttttaccttctttgcgaatatttaattttgctgttgtgaaaggtaattttggtgtcattttttctattgttttttcactgcatgcgcattcaacttctcctttttccctattaatccaacattctctgcacacttctttatttaatttgcatgaaaaattttttgcctcatttgggtcatcacatgtcaaatctgtcagaaattcttttccaccataaattatatcattttttgacactatgaaataatcatttaaaattggtgaaattggaggtgttaatccttccggtgtaaatgaaaatttactccatttaactgtaaggccaggaaacatggtcaaatctttagattttgtttcgtttccgattgttaatgttaaactcatttttaattcataatcccatccggtacatctaattaattcccaaattgtgtttgatgttggttctgcgtaagttctataaaagaaacattccgatgatgggagtgcgcatttatgaccccaaattgcgtctccttttttacagaaattgtttcctggaaaattttcataatcttccatttctggaattttttcatccattttaatgtttttacatttactttttgtgcatgagcccattgttggacagcgtctttttgaaataacatttattttatatgaccgtaaccattttaaagtttgttggttacagtgtaatcgtaaaaattgtaaaattaattctaatgaacccattatttttcctttatcatcttttaatgctaatgaaattgttaattcggttgttccactgactctacatacagaaccatttgattgtctttcacagtcttcggaagttgactgaattgatattacttcggcaccactgtgcactaaatcaggcattgtcaaacataaaaatagtaatattacaatgcttccaagtctatatagtcttctgttttttcttttttgaattttttctttttctcttttttcaaattcattaataaacttttctgtatctcatcgttaaattttttgtctaattttgggttcaagacccattttaacgccaaatattgcccataaaaaaaagttttaataatccacccatatttttatgataaacttta

SEQ ID NO: 38998 - DNA, 362 bp, Heterodera glycines
cctttctgaaaaaatatttaagaattaattttgcaaaaaataaataaaaacgaaagactcagattttcgaaaatttttttgagccagctagctcggcgctcatttcagtgtaagttagtcctttaccggggagtatccctgcaaagtttggtacgcttctgctcaattagcaaaaaatatgagtgatcgaattttcactaaaaaagttaagcctacattttttggcatatttaaaaagcaactaaaaaatttttaaaatttaataattttcctgcaccgaaggtactcactcggcctcttcgcggcctcgtggtgggccttcgccgccggaaaattattaaattttaaaaattaaatatacc

SEQ ID NO: 38999 - DNA, 1219 bp, Heterodera glycines
  misc_feature (34)..(34): n is a, c, g, or t
aagcggtggttttgttcaccaccaccaccgcccncaaagaatgaaagaacgcctcaaaaatgcgttcgttttgtcgtcgtccgtttttgttcgccaaagtgacacaaggaaatacaaaaatgtgcaaaaaaaaaaggaaaagatttttaattaaatattattattattattgttagtgatttgattttggggaagggaagtggcgtaaaatttggaaaaaattgggtgggtagaggagtgagttaaaaaaaattaaaataagggttactaaaatgagagtatatatttttttaaatttgattgctaatggtatgggatttttaggaaaaaagaggcaatagggaattttgagaaatttaaagcgagatgctaaaagatcgtaattgttaagcattaatgatccaggatttgagacaaagactcttgagtattaagacaatgtgactaatgagtgaaaaatccaaaatcgaggaccctcattattatgaaaatgaaatttcatcgggacggggtaaaaaaaaaatcaaaaatttacaattggaggctgtttgtaatataaatttagcaaaaaataacgaaaatatttttaaaaatttatttttaagatgaaaaaattagaaaaatcgtatatttatagtctgatgggggtgataaagtaattttcaatttttctgttttttgggtaatttggtaaacataaattaagggagaaaataatcaattgaactacataccataaacttaatctaataataatatgtaatttgaccagtacaaaaaaataatttaattgttttaaaatgcaaatttactattagcaaatttggcataaaaacggtttgaaaaaatattttatttgtttaaaaatataaattcaatttcagtttttataggaatttacatatttaccattggatttaattttaattgccttcggttgactcattaaacaaatgaaaaaattaaaatttaatttacctatgaaatttgttctttgataatcgtcattagttgaatcattaagcaaataaaaaaaatgtttcaataactaaatgaaatcatttagtgatttaatcgcttaaattatccaaaaatatttggggaatttggcgaaaatgtttcaaaattgaggacggttaacgaaatgagaaatggaatcagtccaaaataccgaattgttatgagttaaacaaactcaaaatggcgatgagtcggtaaa

SEQ ID NO: 39000 - DNA, 893 bp, Heterodera glycines
  misc_feature (801)..(801): n is a, c, g, or t
ccctctctcatagccaccgcggcacatcgttaagctttagcgtgcttcttaaattctctggagctgcgatcagcccgcaaaaaagctcactaaatttgtattccaaatataattatcaccctctctcatagccaccgcggcacatcgttaagctttagcgtgcttcttaaattctctggagctgcgatcagcccacaaaagaggtcactaaatttgtattccaaatatcattatcaccctctctcatagccaccacggcacatcgttaagctttagcgtgcttcttaaattctctggagctgcgatcagcccgcaaaaaagctcactaaatttgtattccaaatataattatcaccctctctctcatagccaccgcggcacatcgttaagctttagcatgcttcttaaaatctctggagctgcgatcagcccacaaaagaggtcactaaatttgtcttccaaatataattatcaccctctctcatagccaccgcggctcatcgttaagctttaacgtgcttcttaaaatctctggagctgcgatccgcccacaaagaggtcactaaatttgtcttccaaatatcattatcacactctctcatagccaccgcggcacatcgttaagctttagcgtgcttctgaaattctctggagctgcgatcagcccgccaaaaaggtcactaaatttgtattccaactataattatcaccctctctcatagccaccgcggcacatcgttaagctttagtgtgcttcttaattctctggagctgcgatcagccccacaaagaggtcactanatttgtattccaaatataattatcaccctctctcatagccaccgcggcacatcgttaagctttagcatgcttcataaatctctggagctgcg

SEQ ID NO: 39001 - DNA, 475 bp, Heterodera glycines
ccagtgattagaatgctgttgtgttgagtccgattgaaatgttggtgggttgagtcccagtgattggaatgctggtgggttgagtcccagtgattgaaatgttggtgggttgagtcccaatgattgaaatgttggtgggttgtcccagtgattgaaatgtaggagaattgagtgccagtgattggaatgctggtgggttgagtcccagtgattagaatgctgttgggttgagtccgattgaaatgttggtgggttgagtcccagtgattgaaatgttggtgggttgagtcccagtgattgaaatgttggtgggttgtcccagtgattgaaatgtaggagaattgagtgccagtgattggaatgctggtgggttgagtcccagtgattgaaatgctgttgggttgagtcccagtgattgaaatgttggtgggttgagtcccagtgattagaatgctgttgggttgagtaccagtga

SEQ ID NO: 39002 - DNA, 337 bp, Heterodera glycines
cgtagccgcccagtcggcatggcgcgggcgcagcgccgccagcgcggccgagagcgtgcaaccggtgccgtgggtgtggcgggtggcgacgcgcggcgcggtaaagcgctgctcgccttctgcggtaaacagccagtccgggctctcactttcgctcagatggccgcccttcatcagcactgcccggcagcccatcgccaacagcgcccgcccctgctcgcgcatctgcgcttcatcttccgccggcgcgcacgccagcagcgccgccgcttccggcaggttcggcgtaatgatcgacaccagcggcaacagctcgcgccgaatagacgccaccgcc

SEQ ID NO: 39003 - DNA, 1072 bp, Heterodera glycines
  misc_feature (51)..(51): n is a, c, g, or t
  misc_feature (105)..(105): n is a, c, g, or t
atggtcgcttttttcttcactgctttttcgtgctttcttctttatctgtcntcgtttgtttctcatttgccactgtttaaataataattgtcgtttattaaaatntattaaattgtttcttcaattatttatttctttcaatttcattttcatttaaatttctcgccttttcccatttctttccgcttgttcgcttaacgaatttctgttgcacatttgcccgtcacataagcaataattcacaaagccttaaaacattttaaattattatttttgtaatatctttgaattttcaccgtcataagtggcatcacagccaattggcacttcgtcggcactatgcttctccaattcttcagggaattgctggtaaaattggcgcgttgtcacacaacttttttccacaataaatgcatcttaacagaaattagagttaattaattaactaaataatattttttttaattaatttttattgccaattcacccatttaaagatttatcaattcatttgtaactttagcaataattaataaccttttccgttttgcgtttgcctggtcaaacaataggctttctcttcccgaattttatgtccgcagttttgggagtgcgcatttcgacagtccgacacggaattgctaaatagcacaaatatcaaaaacaaaataataaactaaaaaacggattttatagtcaaaaattagaataaaaggtaccaccaaatgtcgacttttatttaaggaatgagctgtaaatattttaaagtctcgggaatttaaaaatacaagaaaagagtaccataaatttaagcttttttaaagtaagaatgagttattccaaaaaactgaggatggtcattggttggatttgttaaaagtgcagcagagcctaataaaaattgactccaattcgacgtccaaacaaacggcgcaattcaaaggttcgctcgttgtggacaaaaagtgctcttccgctgataaatttggcacagattttgtggtcgaatcgaacgaagaagtggaaaaggcagcagaagaagaagaagtgatgagggaagaaggagaagaaa

SEQ ID NO: 39004 - DNA, 304 bp, Heterodera glycines
agctattgataggctctgacggaaaatttggtaaaaaaattacatcatcttaatttaaaaattaatgggaaaatttacggcataagtgggttaaatcaacgaatcaataagaaaatagtaactagattaaagaatagataatccattcatatataagataaaataaatacttataaaaaatttttaaagaaatttttcttttcccaactagacccatctttaggtggtgtatttttacttttcgctttttgggccaaaaaaatgaaattcgaaaaaaacgaaactcccaaaaaaggcgaaaata

SEQ ID NO: 39005 - DNA, 1325 bp, Heterodera glycines
  misc_feature (51)..(51): n is a, c, g, or t
  misc_feature (1301)..(1301): n is a, c, g, or t
tttcggggaagacaagcacgctgattttgccagtgtagcgcgcgtgcagcnccggacatctaagggcatcacagacctgttattgctcaatttcgtgcggctgaacaccgaaaatccctctaagaagttgtgcccacagaagcaatgagccaactatttagtaggctagagtctcgctcgttatcggaataaaccagacaaatcgctccacgaactaagaacggccatgcaccaccatccaccgaatcatgaaaaagctatcaatctgtcaatccttacggtgtccgggccgggtgagtttccccgtgttgagtcaaattaagccgcaggctccactcctggtggtgcccttccgtcaattcctttaagtttcagctttgcaaccatacttcccccggaaccggaagactttcgtttccgggaagctccccaccagggcgaataaatccgccggcggatcgctagttggcatcgtttacggtcagaactagggcggtatctgatcgccttcgaacctctgactttcgttcttgattaatgaagacattcttgccaaatgctttcgctgtagtccgtcttgctacggtccaagaatttcacctctcacgtagcaatacgaatggccccgtttgtctctgttaaccattatctcggtcagcaaaaccaataaaatcggaccgaaatcctcttctattattccatgcacgaacattcaagcgaaacgcctgtttgaagcactctgatttgttcaaagtaaactcgccagcccaccgacgccgaccggtaaaggccaacgccggggaaagaccggcagaaaagccaaccaaaccagtaacacacaaagtgtgcaccggacggctagcacagatccaactacgagctttttaaccgcagcaataattctatgcattttgagagctggaattaccgcggctgctggcaccagacttgccctctcatagatactcgttaaagggtttaaattgtacccattccgatgaccggcctcataagagatcggtctcgttatttctcgtcactacctcctcgcgttgagagtgggtaatttgcgcgcctgctgccatccttagacgtagtggccatttctcaggccccttctccggagtcgaacccttatcctccgttacccgtcatcaccatggtagtcagatacactaccatcgaaagttgataaggcagacacttgaaagacacgtcgccggtacaagaccgtgcgatcagcttagttgttctgagtcaacactggacgcccggagggcgcttggttttgtggcgaacanaatgcgctccgctctggggagatt

SEQ ID NO: 39006 - DNA, 1060 bp, Heterodera glycines
ctagggatgtgcgagaagtgatttttaccgggaaccgagaaacgagaccgagaccgagaaatgaccccgagaaacgatacgagaaccgagacccaaaaaacccgagaaatttctcgactcgggaatggagaaccaagaaatttaaatgaaattaattcaaatatatatatattttttttaatgatcaatttttacgcttttaacacaattggcgaccatttttacattcaaaaggctttcgagtccggcggtgccggcagaaatcgtcatccttaacagtgtaaaaatttctcggtttccgaaactaaaaacccgagaccgggaagcgaaaaacccgagaaatttcccgagtcgggaaccgagaactcttggacattcctaatcatacacacaaaatgtaccttcgtattgaattttgtaagcagatgggggggggggggggaaagcgagtcaggtcaaaaacttgtatgttattggcttcaaaatataaaatttttttcatatatctgtactcatttcatcatccgagaaagcaaattagcttgagacacgaacaacaggagtcggacggatcccgagaaaaatccgtggggtcccgctacatacatatttacttttgctaattactggtttttacggttcggtggtaaacagaacagatgaacttggaaattaattttatgctaaataggcacaaatgatactttttccccattttattttctctttttttttatcaaatttggccattttaaaaggtttggagagcccttttttcctcaaatttcgaaaaacagttcaaaaaccagttctttggcatttccgctactgcagacctatttttccgtgcttagctcctcgagacgaaccgtgattggtatatcatttagccatttttcttcacggggcgttacctatagtttatctccttcgttatggatatagaaatccacgctagaagcttcaaaccaagctaaaaacatgtttttcatgcgtttcaggcctcccacagtccaggaaaaaaatatggatttccatataattctatgccctactgacg

SEQ ID NO: 39007 - DNA, 920 bp, Heterodera glycines
tttttttttaaattttaaaaaatttttttgaaatttttaaaaatttccccgggtggttcccggttttttcttgcggtccccggttcccggtcccgaaaaaaaaatcgagggtccccggtcccgggtttctcaggtcccaggcaagtccccggtcccgggtttgggcaaaaattccccggtccccgtgccactctaatctttttgtatgcaggatttattttgaatgacctccgaaaaagtctctcgcatgaaaatctcgaacggcttatttttcttcatcataatattatcctttacaattttgattattgataatatgggaattttctaattatgcttttacaaatgtgcgatccgcggcgttttttgcgcgatccgcgatccgcgaccgcggcaaattgaatccgcgatgcgcgatccgcgaccgcgggattttttttgcgcgatccgcgatccgcgaccgcggcaaattgaatccgcgatgcgcgatccgcgaccgcgggatttttctgtgcgcgccccacccctggtgccgataggcgccgccgggggaaattttaaaaatttgggtgcaatttgttaacagattttcaacaaaaaaaggttggtttttgcgattattaagctcaattggtaggattttcatttaaaaaatgataaaatatgtatcaatttaaaaaaaaactatgagtaatcatattttctttataggaaaccacgagtatacaaaacaaaaaattgaaaataatctaatttctgtagagggattgaaccaggggaaagaagaagggaaagtcaaggagactagccattagaccatttgcacacttgggcagtgttacttttaaagaataggtatattaattattattttttatttttccctttgactccaattttcttcactaatttttcactca

SEQ ID NO: 39008 - DNA, 1004 bp, Heterodera glycines
ttttaaagcaaattgcctcggggatttgctaccctaaatatattaacactcccccttttttgcacgaaatttccgacaaaattaaattgcagcaaattttgcgcaagtgtcatagaaacgccgtgccaatttcggccaaaaataaattgcccgcccggtaagaagccccgttcccgtttagtgctgtctttcccgccaaaggttttttgtggcaaaagcttctctagggggtaaagagtggggaaagggatgaagcaattattaaaatgaaatgtgatcagaattggcaccaatttagagcttctggggccactgagtgagcttttcttttccgaaccttctcgaaagctcgcaaagggaaaatcttcaattaacacatttcattttaaaattattagtaataatttatgctgtttatatggcattgtttaatctcggagtttcggtatacgttagaaaatcattttaaaatatgtaaaatttttggaaagaaatttgaaactgagaattattaattccgtgtttaactttctattaatttttggctttggggcttcaattattgtgcccggcatcggaaacgattttttctaaaattttttggatcgcaactcttttttcatgttttaacttcgacataggcttaaacacaaggcaataccatgcctaattatcgataatttcgaaaattaaaatccgtaagttcgtttttgtattaagcacagattttattatggcctatcacaacaacagccagcagcatttgaacccgcctcgcctctgcttccaaaaccgttccctaagtgcccgtgaaagcggtgccgcggaagatgaaggccaccgattcgatgctaccggagtcgacgcattttggcaaagaaccgcaacgccaacaacggcgacgcgtggacggcgccaactgtccgccagcactgatcagttgcttaccggtgagttgcggtgttggaggtctgtgtccatggtgacgaatcacgggggctgat

SEQ ID NO: 39009 - DNA, 868 bp, Heterodera glycines
aaaaattctaaactactgaaaagaaagtgtcacgatccgatcacttgctaatcaaatctctcaactttgtgcaattttgtctagttttgttatagcaaatttagaacaaaaagtttataaaacattttaattttttctgtgttaaattaatcaaaaactaagctcggttggactttggaagtaacaagaaaaaaatgaaattttcttgataattaattcttatctattgcatttatgatcgtattggtttctgagaaaaacagagaaaagtgaaggataattaaaataattaaattttctaacgattgaatatgcttaattaaaagaaatatttttttgaaccaaatcattaactagaataattttttttacattttatgcaatttataaaattaaaattttaaattaaaattatatgctcacaaaaaccataaaataatgttgaagattggaattttataaatttgtgtatcgaattttccggccagcaggcatttgtttagattttattaattttaaattattaattattttttaaagttattaattttttttgttagaataatttaaattaatttaattatttttaaatttaaattttaatttgttttaatttttagttgatccccttaaaaagggataaaatcttggtactttcctgttttggggtcgcatgatgcaacaatattggtaaaatctcgtcaaggttcagcttgagaagggatgttgtgtgaatttgcgcgcctttttgttgattttttaaatttttagtgtgcgacactaaaaacaggaaagtaccgaactctttcataataaaaatatttcgcttaaaatttaattgtttttatcaatttattaatttcatggc

SEQ ID NO: 39010 - DNA, 890 bp, Heterodera glycines
taatttttaaaaaagttgtggggaatggaagatataatcattataaaaaatgtaaaatccgcgcggataggggggggaggtggtgcgctgccatcgtctttttggagatggtccctttaatcgatccacatggaaattgattggaaatatttaattttaaaaaaattgaaatttaaggacagaatcaaaagtaatgaaaaataattaaaaattaaggaatataataaatataaaaaaattgaatttataaaatcttataagaaaagagaaaataacaataattcgaaataattgtttaaatagtttaattagattgaatatttgaaagattgttgtgttcggaacacattatttttgcagttattattttactttaatttttttaatttgaacgtgaataatgatatatttaaaataataagtattagcacgtaatttacaaccatttgtgctactaaatttcaaatttactttatttagagttttttaaggaattaagattttttaaattttaatccctcctatatagactataaaatatttcatttaattgcgatgtaaattatagtgtgtataatatatttcataagccttatttattttggactgccccctacggtggggtgtaaagaatatttctcgctctacttgtttaggctcaagtattttttgaattaatttttctatgtcaattctaacattcgcgagttgattttgatagctatcaaaaaattcttggctttttttcaaaattttctctgctcgttggcaaatcatcaaattttttgtatttagacaattctcaattccgctcattgcaaaggcggtatttttatattcttgtgagattttctgaaaaagaatccagtctttctcgtcccgtttcaaaa

SEQ ID NO: 39011 - DNA, 756 bp, Heterodera glycines
  misc_feature (575)..(575): n is a, c, g, or t
  misc_feature (678)..(678): n is a, c, g, or t
tacaattttaaaaatgaataaaagtataaaaaagtgataatttggtggtttggctgactgtaaaacagttatctcccgatgggactcgaacccatggcattgcaattccgttgaatgctttaaagcaactaaactttacaagcattttttttggcccaattcattgattataagagatttttaaatatttttttaaaagctaatatttttaaacctctttacgccgaattttctccgccatttttttggccgacatgaacagaagcggctcctccgcctcgccctctgtccacgtcactttgctctttggccaaaagtgactgatcagcgtgaacacgcgattgatcaatgcataataaagggaagcgatcaaacacagaaccggataaagcgatcggatcactttgtaacgcaacatttcgtttttcacaatttatctgattaagacaatgagtttttaatttatataattaataaattggtcaaggaaattgtcgtaaaacgcccagagtgagtgagaaatttggcatgcctcaaagcaactaataaattttgggttaataggcattaatggngaagtattggattaatagaaccaaaatattttaatgcaattttaatttatttttttgctgttaaaaatgaaaaatattattttcaataataaaatatttgaanatttgtaggttgaaatcaaaaaatagaaaaagtttattggggtgttgaataaaaaaacgaaatttgcctttttaaatc

SEQ ID NO: 39012 - DNA, 1348 bp, Heterodera glycines
atagggaacgtgagctgggtttagaccgtcgtgagacaggttagttttaccctactaaagacctgttgctatgatagtaatcctgcttagtacgagaggaaccgcaggttcagacatttggttcatgtgcttggtcgatagaccaatggtgcgaagctaccatctgagggattatgactgaacgcctctaagtcagaatcccgcctaggcaagatagcaatattcttgctccccggtgtcgggaggcactacttatgcgccgcttgcggtgcagcacaaatgccccagcatctggcccgatgtgcgtgcttaattgctcgcacattgccaaagccgtagcactcgtgtgccatggtggaacgtcggggcgcaaaatcacttgtatacgacttgactactggtcagggggttgttagcagtagagcagcttttacactgcgatctgttgagacttagcctttgatcggatgatttgtcttctttttccccctttactttttgtgccaacaacattttaggtacaagtacatgagaaggaaggctctcttaagggagtcaaatgcctcgttgccaccatgaaattaggtaggataagttcttgactttgcttttttgtccatttattccaatcgcctattgctttaaggttttgtctttgactttgcttttttgtccatttattccaatcgcctagtgctttaaggttttgtctttgacctttttgtccatttattccaatcgcctattgctttaaggttttgtctttgactttgcttttttgtccatttattccaatcgcctattgctttaaggttttgtctttgactttttgtccatttattccaatcgactagtgctttaaggttttgtctttgactttgcttttttgtccatttattccaatcgactagtgctttaaggttttgtctttgactttgcttttttgtccatttattccaatcgaccacgttaattcattctctatacatttagtgtcttatttcatgaaattatatataatttaattttaaataaagaggcaaatttttacagaaaataaatagacgctgactaattagctaacatttataaagaaagtagaaatttgattaaatgcatatacaaaatattacttttttaaaatttgtataaagttcctagtcgtatgtgctttgcgttggttggttggcgtgggtgattgtggtggttggaccgtttttgcgatattgtggctggaaaaaagatgccatttcgctatggggagcgcggccgtctgggttcaagtgcttgcttgcgcttgtgctcggcattgaacggcgatggctgctgctgtggtgccacctttgac

SEQ ID NO: 39013 - DNA, 818 bp, Heterodera glycines
  misc_feature (29)..(29): n is a, c, g, or t
gacacattgccacgcagcagccatacacnaggctttaacatgtgcagcactgagcggtataccacagctccaacgtatggaagcaccccaaaagcatggctcgtgaggcagctgccccgtaatgttgggcagcgtccacaagtcagctcgaacgacctgtgcccgtcagcggacgggggcatttggtggtgccaacgctagcccaacaggacagcaggtaggtggtgaataggaatcacttgggtaatgatccagcagcaggttcacctacagctaccttgttacgacttttgcccggttcaagccactgcgattaaatcggttccagtctgcataccgaccgaagccggaacactaaccgtccccgaagtccgatcccaatcacggcaaattttcaccggtttaccaacccctttcggggaaggacaagcacgctgattttgccagtgtagcgcgcgtgcagccccggacatctaagggcatcacagacctgttattgctcaatttcgtgcggctgaacaccgaaaatccctctaagaagttgtgcccacagaagcaatgagccaactatttagtaggctagagtctcgctcgttatcggaataaaccagacaaatcgctccacgaactaagaacggccatgcaccaccatccaccgaatcatgaaaaagctatcaatctgtcaatccttacggtgtccgggccgggtgagtttccccgtgttgagtcaaattaagccgcaggctccactcctggtggtgcccttccgtcaattcctttaagtttcagctttgcaaccatactttccccggaaccgg

SEQ ID NO: 39014 - DNA, 1401 bp, Heterodera glycines
taaaatcccattccaaatgagtaatttccattccttttttgcttttttaaaattccaccatttctagtgtcgcaatacgctcaccgccgagctgcaaattgttgagcaggaaatgctgccaatctgcgaccaaattcgcaccgctttcaaggagtgtttgcgcgtcgactcggagtcgcccccggccgacccgccctgttcatcttcgactccgtttcatcagggtatcgttaaaccgtttttgcattccctatggcattcatgggctctgatatgacaaaaattagtccatttttaccatttcgaacttcggaagaaatgattggtgatatttctgaaattatggcgattcaaatgcgtccttttcagtctcatcactcggccggtccaacagcaggaagcagtacacctcgcagcataacaaccactgcagcagcggcggtggttcggtcggtcgtcacgcgttgcctccgaacaattcgctgccaaaacgacagcaaccgcaccaccacagccaccaccacatgaacaacagcagcagggggacaccgtgcaacagcggcacgggcagtgggaaaagcgcgcgcgtgcgccacgacgcggccgccgcgacagcgacgggacggacggcgaagcgaacggtggcgacgacgaacggaacgcaaccacaacggaatgacaacgcaaacagcacacacaccaacgccacctccaccaccgcatcagcaacaacagcaggcaataacatcgcaaaccacgcgatggacacaatggccggtggggaaagtggcggggagggggggggacaacggtggggaactcgaaaagccaaatttttggctcttcaatccaccaattcttccagtattattttacaaaattacacaccgctggaaaaaactgtatttttggctcacaaaaaagatatttttcaaaataatttgaggattcttttgaaacttgagaatttctcaaaatttggcgccctaagttggcgatggaatgaatgtgcgcttatttcagcaatgtccagcagtaccatcgacatggacttgctgcccgccgaagtgtcgtccggatacgactcggacctcgtgtcgcgcatccaagacgacataatgcagcagacgccgcctgtccagtggaatgacatctccgggctggaggaggccaagcgattgctcacggaggcggtcgttttgccgatggaatttccggtagagagggaatgcgggtatggcaagaataaatgccaacatcccccctcctcctcgtaggaccattttcgtggcattcgtcgtccatggcgtggcatttgcatgttcggccccccgggcaccggcaaaacattgttggccaaggcggtcgctaatgagtgccagacaacattcttcgtattca

SEQ ID NO: 39015 - DNA, 1089 bp, Heterodera glycines
aaactctcggcccggagatttgttcaaggacgctgctgatgatggggacaacgagggtgctgcagactcattggactctttaaaatcggcagcggagggacgccgaagcgacgaatccattgtttccaatgccgacggcttgaaggtggagggcgaaaggcacaaatcatcttgaacggggtggggatgatatgagaatgatgtttgtttttcatcccctacccaccggttgggaaaatttaaaaaacacaaaaattgaaaattttttcaaaaattatatttttacctatatatgttcgctttgctcatgttattgtataatacagacattaaaatgttacctaacaactggcgcatgtccagcattgggttccgcgcactattcaacactttggtcagcttttcccggtactcctccgtaagtgtgtcaattatgcgtttaactttcgcatccttaaagcaaaataaataaattagaaatataattgtcaatcagcgaatttaaaaaatgcaggagacatcgtaataaatattcaatattgggggggggggggggttaatacagcttcgaaaaaggcgtcggtagcccatccaagcgaaatcttggtacctttccagccttaggagacattttgtgggcggattaatgagcaatttccctggatttggacacaaaatggctcaagattctcggtgaacccggttacaccctttgccacccacacacgacacctcggcattcatcaacaaccgtttgccccatccgattggcaaacggtcggcgacggcggcggcactgtccctctcctcctctgctctttttgccccctcatttcgatgttcgtcaaaattgtgtcgataattggtcgggatatggaaggaaacccccgccgcaggcaattgccgtacatctttatcagtgctgccgttcgaaatttggtcaaaaaattccgccgattggacggccaatgcgaaaaagtcggcgtctacgcttcctgaaaaataaaaaagagaagaatcaatgattttggagaatgtatgaactcgctttacatgtcttttttcgggaacgccccaaaatctcgccgc

SEQ ID NO: 39016 - DNA, 1113 bp, Heterodera glycines
  misc_feature (1083)..(1084): n is a, c, g, or t
aaacaaaatatcaaaaaaactattagggtatttaaaatccatgtgaaaagtatggcgacaaataccaaagtatttggtaatactggagaatctggtatcacaaaaacaattttttgataaaaaactaaccttaacaaagaaatgaaatagaatcacctcgtgtaatcaaacacatagatttctcgtccaatgttatggcaaattctgtcgatgtatccattcatttcattagaatgccatttgtaattttcccttaaaagctcgtgatggtgtacatccgaagtggaaggcaaagcttcttcagcaaagcttagcctcgttactggaattcttaggaaggaaaaacggacgggtgtgttgcatacggaaccggcgacctcaaaaggtatgtaaataaatgatgtaaaaatagcatctcacaaatcttagggtttgcgagtggacaaattgtcttatcaaaatttattgttttttacctgattttgtatgcgattcgctctgaaaaattcgttgacagtcatttgccgatatattccttcaggtgtgacgaaactcgtgcgaatgggaattgaatcagttgtggcaattgttggttcggcgacaacgctgctttgattatagccgtataatggcgcatgcattttcacttttgatattgtttacactgaccattagaaaaacatgttttattaaataatttggtgaattttaaaaacaaactttgttgtcgttattaaaatgcgaaaattgatgtaattaatggcaaactccatagtcaagaaacagaagattcatctcacaaaacattaatgcatttcttgtttctataggcaaataccatatcaatatcaaaactgtttgaaaaaagcattttttctttttgtaaaagtgacataaaaccccaggttaatatattaggaaatgctagctttgttaaaaaagtagttaattcttaacagttaaaaaaagtttaactgatttaaatttgttcacaattaggaactttggcattttttgttttgattttttaaagccgtgaaatgtttccgtaggtcttctccaactcatttgctcattgtctannagtgaaaaattcgacatttcattcaaatt

SEQ ID NO: 39017 - DNA, 1234 bp, Heterodera glycines
  misc_feature (87)..(87): n is a, c, g, or t
  misc_feature (91)..(91): n is a, c, g, or t
  misc_feature (124)..(124): n is a, c, g, or t
tgttcgtccacgtagaagtcaaatcgacggctgatcagtgcaatttcgaggccaagtgagaaaggcgcaagaaagtcgaccaccaanaagncaaccaatcggcgcagataaagctgaaaaattngaagaattttttcgaaattttcaaaaattttttggtttaattttatttacatttcttttttgggagggcgtcgtcgttttttgacatgctcaaaaaagaaccaaagaatgctggcacagacgaccaacagcagaagaagacacacgtcactccaactgaaaaaatgaattgaatggaaagggagggaagccaaaagtgaaattttattttaaatccaatgaagctaattattgtaagcctcaaaattaagtgaattttgaaacatttaaaagttaagcaaaagaaatgtaaaacgtcagaaaaaagaagaaatttaaacgtaccgaatttttgaaggcatttgcagcaacaaaatgaccagggaaaatatagggagaatgaatgaataatgaatggaatgaggaagagaggaagaaaaaaaagcatttttatattaaaatattagcgtaacgccccgagccctcggggggtgggaaaagtcggggtcagcatttgtcggggatagacgattccgtctgggtgcgcaccaaattggtcgggttttctaattatcgcaataaaaaaatgcgtcagttgcttcgcgattagacaattagcaaaaaagtcatgaaaattgcgaaaaagtcgaaatttgaagtttttcttaacaataaatttttccaggcttgaaattatgtgtctttcaaatttttatgtcgttataactagagctggtcgggaccgggatttttgacaaaaaccggacttttttggttgaaaaaccgggtctttttggctgggaaaaccgggaatttatcggtcccggtcaaaaccgggagcttggtactcagctgtcccgctattttcagtaccaggtcccggtcccgaccagctctagttataactcatctcctaaactgctaatttcaatcaaaatgctaaaacgaatcattcaacttaatattttcaacagaacaaacaaattaaatgtattcaaacgaaagaagcaacaataaatacacataaatgtgaggagcaattatatatcagcagcagatcaatttacattcctaatgatcaatcatttgccatttccaaataattcattcactttttctttcgctgggcccg

SEQ ID NO: 39018 - DNA, 945 bp, Heterodera glycines
  misc_feature (894)..(894): n is a, c, g, or t
ttcaatacatttggaaattcgcagtttttggggtcaataagcatcgtttgaggaattggaaaacgcccctccccaatgaccctcaggcggtgtcagaatgttcgggttcggctgctgttcgtagctcattgccatcatgttgttgttgttgttggtgctgccaatctgtgcctttgccttcatttgttgaatttcgatctgtgcctgtctcaatttcctctgctgtttggccaattccgactgatacgaattggtggcgaatgctttgtcttttaactctccgcgtttcttctccacttcgccgattaatatttggttgattcggtccttttcaacgattgactcttctttctaaacggagagtgactcacaatcagtcgcaaataacaattaaaaaataaatgattgggcacttgccatctgcaacagactgcgcaactcttcgatttggtgaattttgtcggcaatttgtcccgtcaaatcgtcttgaacactttccctcgtttgacatgtgctgcatctttggtttgcggctaataaacaaaacttacatttttaatttatgggtccaaaattctgttatgaaattttgcaatttttatatttgttatccacctcaagaaatttaaaacactaaatcttatagcccttctgacaaataaatttcttctttttaattataatttacccaaaaaaagtttgtcgtgcattttctgtcggatttcctgcgcctcgtccaatgcgttgcactgttccttcaccgccactggggctcgccgttgctccaattccaacgcttcttgaagaaggcccaaattttggtagagcaatttttttttcttccttaacaaacgaaaatttatttttatgttgtaaaataaacattttaataanaattaattgccttcaaagctttgttcttttcttcttttgcttttgagtttt

SEQ ID NO: 39019 - DNA, 1060 bp, Heterodera glycines
  misc_feature (1006)..(1006): n is a, c, g, or t
  misc_feature (1015)..(1015): n is a, c, g, or t
tgttcaaaaatcatttgttaaaaccaattttatcatgtagagcatactcgattgtatttttttatactttaatttttttaaatttcaaaaaaaaattacaatttttttagctatttttcaaatttatggttgattttttatattaactcttttcttacttttattactggttttttatttacaaatgcaaaacaaatgaaaaatttgatggaattacgaccaattttcaagatttactaacaatacgttttttttaattttcaacaaatcgctgaaaaaacttttttattttttttcgtgtggaatcctcccccccccaaaaaaaattatttttttctcgaaaaattgtacatccagcagagaaagatgaaaattaatgtttttttatttttaggcaattttaaatttccgccagaattattgggatgccaatgcttgtcatgagaaactcgaaatcattggcgacaaaagtctcattgtccattataagagaaatgagaatggtattttatcataatttacttagttatattatatattctccttaaaagatggtatgtgttctgttttcgctaaacatccgattttgctgttcaataattcgtccgacattttttactacgaaatttcaatcggaaataagaaaaagtaagagattttttattttttgaataaatttattaggaatataaaaatttaattatttttattattattaataataaatttccagttttatgttattcggattcgccgtcaaacagcagacaacactgtatggatatgaaaagggcacttatgcatatgacaattatggcaatattttcattaacggagaacaaaaggaatcaaatgtcaaatatttctacggtgttggcgataccgtaggaattggcgtcaattcggccactcggcagatcattttcacaaagaatggacaacgtttgggttggtaaacaaacagttactaattgaattattgtcagagaaataacctatttaattncctattttncattaatttaatgttatatttaaacttattgagaaacctttaact

SEQ ID NO: 39020 - DNA, 1576 bp, Heterodera glycines
cgcaaaagcgtaaggccggaggccacaagccgcgaccaggcactagcgcaccagccccaagcacagggctgagcactagcaccgtgtccaacctttcgccgtcaagcttcaggccggaggccacaagccgcgaccaggcactagcacgccagccccaagcacagggctgagcactagcaccgtgtccaacctttcgccgtcaagcttcaggccggaggccacaagccgcgaccaggcactagcacgccagccccaagcacggggttgggcactagcaccgtgtccaaccattcgccatcaagcttcaggccggaggccacaagccgcgaccaggcactagcgcaccagccccaagcacggggttgggcactagcaccgtgtccaaccattcgccatcaagcttcaggccggaggccacaagccgcgaccaggcactagcgcaccaagccaatatcaaaacaaaaaacataaaaatgaatgaatgaatgaatgatgaaaaatatttagacaaaattcaattcagtaaatattaatgcatgagaaaggtcagagaattgctggacgggcaaaagaaagagggggaggagagaacggggggttaattatctcataattcagttctgtacgatttttatttaaatatttttttttataaataattttaaaaaaactttttagatttttaaaaaaaatgttgtgcaaatgcggcgaatgcttcgaatgcgaagatgaaaagcgccgcctcaagcgcaatcgggagctcaatacccgcaaagagcaaattaagaactgcacaggcaatcatctagcaccggctatgatggaactcaaacgccggaatatgaaactgtttaaaaaggcttataggccggtgaagggcgtcatcaataaaataaccgggggtgagtttaaaaaagaaattgaaaaaaaaaaaattttttaggcccttggaatgtagaatgtgaggtctgccatgagaccttcacatacttcatggtggagtgggaaaactcccggaccgacttctcgtggggtcccgggaggaccatggtcgaagcggataacatagtaaaaatttttgaaattttttccagttaaaaattaattttagaatcagaaagaaattttggctcactatgtaggccaaaatgatctactccagaatgaagtggactattatcagaaccttggtaataatcctccgttgaatgtgcccccaatgggggaggatgctataattttgaccagggacgatggtatgccgattggtgcagaggtaaaatatttaaaaaaaaaagaaaaaaaaacaaaacaaaacaaaaaattaaaggcaaatgatggggcacggtcggtggccggggaaagcatcgttagcaaaagagggggagggcagagaaagagagagagagagagaaagaagagggcggaagaagcgaagaaagcacaaagagatggagcggaagaagaagaagatgatgactttttcttctttgcgagaaatgggggagagaaacgaggggaaatggacatggaaagcagggtagtgaaaatgaaatataaatttaaaaattaaaat

SEQ ID NO: 39021 - DNA, 680 bp, Heterodera glycines
aaatcatttaattaaaaattttattaattgagtaccgttacttaaagaaattagcgaattttgagttctttctataaaaataaatatagattctcttcactaagcagcaactggatgattgattggttggaaaaaagagaataaatgaaaatctttaatttaaataaaaaaataaaaattcttaattttcgcgatttttaaaaaataattaaacaataagaaattttaaattattttttcataactttattttgaaatttctatatttacctttagattcgattcatgaatcagtctgattctataaaaaatttaattaaatgcataaatataataaacaaggaaaagggattaacaattttacatttactgtaagagaataaaggaaaaataatttacaaattaatattttttaattgtaaatttatttaacaaagaaaaaaaatttaaaattactcaattaccttttcaagaagataaactgcgcgagaaacagaacgagattgagatttaaacaaaatattcagagttacccgtgaattgatagaaactaaatttccaacaacaatgttttttttaaaaagaataacacttatagggaaaataaattaatgaaaaagaaaatgaaaattttgacagaattattaataatgaaaaaatcaaataaaaatacctacatg

SEQ ID NO: 39022 - DNA, 944 bp, Heterodera glycines
  misc_feature (886)..(886): n is a, c, g, or t
tgatgaattttctttcttgtcgttatccttttcttattaacaaacttgaattagctatgatataattatatgacaattttttaatttttattcatttttcataagaaatcatttttttgttatacagaattgcagatattatacagaaaaattataaaaattaataatatttgaaactttattaccatttattttttcaagcatttcattttacttggatttttcaacaaaaaaaacattgacgaaaaattcaaataataacaaatgtatttaaaatactatgtcttaattgaatttagtaaataataaaaaattctaaatttttataaattaccatttacataccatctattcggctccgacggcagctaaatggcaaatatattaaattttttaaggatgtgaacgacgaatccaattcggagacggcgtaatttcctcatgctgacatataaaacacttcgcacgcaataataatgattagtagggctgggaatttaagtcaaattttttttttgctggctctaaatggccttaagatgacttaaaaagtgttctaaactttgttttaagcttctaacatgcattttttgggacttttttgacttttttaaattttttggaatttttatgacttttttgagtttttgcgacttttttcgtgatttttttttttgactttttgaggcaaaatcttaattttagcgaagaaaatgcagaaaattaaaaaaaattccttttttacgcctattttaggtacctatttataaaattaagtgccaaaaatacgattaaatgttattctataaattattaaaaatgggatttttttaactatcgcataatttttcagaacttttttgcatttttacgtgctttttttgantttttgtaactttttagctattttttcagcacttttttcaatttttcgtgactttttt

SEQ ID NO: 39023 - DNA, 647 bp, Heterodera glycines
  misc_feature (429)..(429): n is a, c, g, or t
tccatatttggccatttttggcctttttagtccatatttcgggcttttttagtccatatttaatgtacatatttcgcgttttttagtccatataatttacaaccctactaataattggcaaattgtttttatatgaaataaaaaaataaaattgtatttttttcgtcatttgaaggagttggtcacactgtggatgctgaacgaaatttgatcaatttgtatccacaatgccatctgatcactgctgatccgtcagcagaaattaatgacgcattgacacatcaaattggtggcaaatttgttcatgcagcaattggtggcaaaacagcaatgggacagccggtgaatgttcgacgagaaggcatatttagcaaaaactaaaaaataatttaaataaaattattattatttttataaatatcttattanattctcaattaatttaaataatccactattttaaatcatactcttttgaaaatatttaaatttatttttcaaccctaaatttggaagaaaaaaaaaatttaatttacccaaaataggcgctaattgctaatttaaaaattttaaaaaaatggctgccagtgggactcgaacccatagcccatccaaaccgtgaaatcttttctaaaagccattgaatg

SEQ ID NO: 39024 - DNA, 368 bp, Heterodera glycines
tcagcggcgcgcaacagtttcatgccaattcttacatatttcccctcccaaatctggtgccaactttagccctctcaaaattggcacctccccccccccctcctattgtcatgccaagactccccataatgccaatttgtccatgcccactgtcatgccaatttttgactcacctcatacacttgtgtgttgtccagctcagcggcgcgcaacagtttcatgccaattcttacatatttcccctccaaaatctgatgccaactttagtcctctcaaaattggcacctcccccccccccctcctattgacatgacaagaatccccataatgccagtttgaacatgcccattgaaatgccaattattgac

SEQ ID NO: 39025 - DNA, 530 bp, Heterodera glycines
gaggaggaggagtgaggagaggggaggaggatgaggaggagtgaggagggggaggaggatgagggaggagtgaggaggggaaggagaatgagggaggagtgaggaggggaaggagaatgatggaggagtgaggagggggaggaggatgagggaggagtgaggaggggaaggagaatgatgaggagtgaggaggatgaggaggagtgaggaggggaaggaggatgagggaggagtgaggaggggaaggagaatgaggaggagtgaggagaaggaggatgagtgaggagtgaggaggatgagggaggagtgaggaagggaaggaggatgagggaggagtgaggagggcaaggagaatgaggaggagtgaggagaaggagtgaggaggaaggagtgaggaggagtgaggagggcaaagaggatgaggaggggggtaggagtgaggaggggaaggaggatgatggaggagtgaggagggggaggaggatgagggaggagtgaggaggggaaggagaatgaggaggagtgaggag

SEQ ID NO: 39026 - DNA, 1101 bp, Heterodera glycines
  misc_feature (157)..(157): n is a, c, g, or t
  misc_feature (181)..(181): n is a, c, g, or t
  misc_feature (251)..(251): n is a, c, g, or t
tggaaaaagcgagttcataatgtcaagcagcagaagttgaaaagccaaaaagaaagaggtaaatctttataaggcttccctttgaaattatcagtgatgagacgtgggcaataaaacagttaaattttgcattagaatgccttaattttgcattcanaattgttttctcttaaaaatatanaaaatttattaagaagaaaaatgtaagtgaattcttatcaaattctgaggaatgatggaagtgtcaaagncaatttgtcggagggaagaggaaaaaatttttgttgaatttggcaccggaaattaaaacaaatttcattcttcaaagcgaaagacagcaaaaattcaaacaaaatggatgaagaaataaagggagggaaaatttcgaaagaattggaaaattaccatgaacttttgttgcgtttatttaagatcaaattcaaacaattgataaatcaaaatgacaaatttgtggaggaaatgttgactaaagagtgggtcattgaattggtgggaaaatatttgcccaaattgacaatgtgaccatttgggtgagaatttcggactgctttttgttttgaatacataataccatttctcatttgcagctttgtcgtcaattcaaaaagagaagcattaagaaaaatgactgttaggcaattgattgaattttcaaaaaaactattctgaaattctcattttatctgttgttttttcattataaagatggcattttggagaagtaaaaatttctcaatgaaatatgcttcattttatgtaattcctacattttttttgtttattttactaaagtgcgctccttttcgaatgaccaccaatcgtttatttattagattattagtttcttaattgctttggttatttgctcgtctcttttgttggataaatttcttttctttttttttgatctatattttataataatataatattattgttgctaaattacatatgttctctgcttctgctactgagttttcctttttgctttttccattttttctcctcccatttttctgtccccaatttttgtccgcctcctcactgatcaacgattatccaaatccgttgcgcgagggg

SEQ ID NO: 39027 - DNA, 1149 bp, Heterodera glycines
  misc_feature (28)..(28): n is a, c, g, or t
  misc_feature (71)..(71): n is a, c, g, or t
  misc_feature (1099)..(1099): n is a, c, g, or t
accccgaccccgaaccatttggtcaacnccgaccccgaccccgacacttccaaccccgacgaccccgaacnccgacttttccaaccccgacggtcggggacgcaacccctagtcctcgactattgaaaagtcaaaatgaaaattttataatttaaatagaaataaaagaatgaacatttaaaatttagtgaaaaaataaaaagaaaagattaaagataaacctaaaacaaataaataaatacgaaaacaattaatctgacctaataaaaataataggttaacaatatgataataaattattggttaaagatttattttaaagaagttcaaataagaaaaatcaaacaaacacagtctcttaataactcaaaataggaaagcaaacaaaatgaaatgaaaaaaataatagaaaaataaaaatgattacaaatatacataaatatttatgtaaaataatgttttagaaatgttatagtcatatataatgtttaggaactatattttaatatatttatttaaagcaccaaaataaaataataattctgaaaaatgcaacaaaccagtttgacgccgttaataatgattatgctcccactgaacagtcattttgcatcatatttctccacaaattcattaagtatttcccagacattttatttaattgagaatttttcttcaaataaattttcaatctattataatttttagtgattaaaatcatgaatcaacaggaaattttttaaaccaaatttactatgtttagtgcaaattttaataaattaagccaaatttcaatttctttctaaccggcccggccagctagctcgagaccagaatcggaccaactgggaattttaattaaaatattttaaacataaattttttattaatttgtttttaaatgcaaatataagttttactattttattttataaaagaaaaaattaagcaaaatatacgactttaatgttctttttcaatgatttaatgttaagagaaaatttatcaatgtaaaaatataactccttttacgaaacaataaatgaatttttgtcaaactaaaagttaattaaaattgataataataaccaaaatcgantttatgataatagtaaataatacgtaaatatcaagtcttaaatatctata

SEQ ID NO: 39028 - DNA, 1087 bp, Heterodera glycines
  misc_feature (47)..(47): n is a, c, g, or t
  misc_feature (118)..(118): n is a, c, g, or t
ttccaaaacatagtttttcgagctctatcgattggtaatttttttcnggaaatttttcgattttttttcggaaatagaaaaatttttttggcctcagcgggacatttgagtcccggcnccataactcgtcagggtttgattttagcgaaaaatttccttagagcacaattgtagagctttcaaaatgctatcgaatggtgtactaaatgtcgaaaaattttcaaaaattttcgagctaggccccctagaaattttcaaaatttttttttgggttgaaaaagatggtgaaaaatatttttctgggctactttgaggtgctgaatacgaatataatgtttattttaagttttggaaattttagaattttttaaaaattcgaaaatatttttcaattttttgacccttgggattttgggttaatatttgaaaattcataactcaatgaagaactggtcaatttaagtgaattaaagctttaaaaatagagaaaaatcaggagaattttatgggatttatttgggttttctaacttcaatatgaaagaagttattccagaaattctggaaattttagatttttcagaaaaaaattcagaactcgcttctgaaaggtcatactgtaaaagtaaaatactacaaaaatccgcaattttttcctctataatataaattttattttacatttttatctctcacgaatatgaaatcagatttcagttataacatcgttaagacctcagaatccctgtgtgattggggattctgaggcatccatcttctgggggggggggagttcggatccggtcggtgtacattatttttctatttatttttgtgttatttttcagtgcgtttaatttatatttaaagatttgttgtaaattaataataaaagaatttatgtaaaaaataataattatgttttaataaagaatttcctattatttttaaattgaatttattaatttcatattaatttaaatattcaattcttgcacatttcaaaattctctttttaattaataaaaggaataattaattttattttttaacacctataataaattgatttcaactttcgtacctct

SEQ ID NO: 39029 - DNA, 1260 bp, Heterodera glycines
taaaagggaaaaaataaatacatattgctttatgttcattattagaacccggaaacatagtaaaatgcttatggccaggagcttggtaaagacagggtttaacccatttgttcgtttccgagtcctttcgaaattttttgtttggtcgcgcttttttttttcaaatttctggctttatttgcaattctgctaatttattaacattttaccaatttattttacattttcaaaaaagtttttcacttggtttcgggcggaaaaagcgagctcataatgtcaagcagcagaagttgaaaagccaaaaagaaagaggtaaatctttataaggcttccctttgcatttatcagtgatgcttcgtgggcaataaaacagttaaattttgcattagaatgccttattttcgcattccaattgttttgtctagcaatataaaaatatattaagaagaaaatgtaattgattgtatcagttgggggggggaattattgtcaaaagactatcgatggatcagaaaatgcatcgatttatacgccggggggggggggattggagcatcggacgaatgtcaccgattctctcaaatacattggggagcagtgactgattgagcagtgtgtgattctgctgctcttccaaacgacgaaatgaccaaaaatagtccccccggcgggggggagggggtgccctcgggggtaaaaagacaaattgctaatttatcaaagggaatttggggtgcaaaatcaggcgaagagagaagagtgagtggggaggagaagataagcatgggatgagcgattgttgaacattgacgaaatatgtacaaaatgaaaaaacgctgacggagagagaaaagggaaaggaattttcggggggagaaaggagaggctaattgatcatcaaaagtgaggaaaaacggaaaaacggaacaagacggacgaaaatggaacaaagaaatgcaaaatattgtctaatgaaagagaggaagcacaaaagggaccaaagaaagccaaaatttaaaaatataaaatgtaaaatgagagaaactgtgaagggctttagggcaaataatttgaggagaaaggggcaaaaataatgtgaaaagagaaaagacggatggataaagggggggggggggaatacggaagagagcaaaagagaaatgggagaggagagagaggagaagccatgaaattactcggtagatggaataagcactggaaagccggcggagctatttttagcagtgagttttatcctca

SEQ ID NO: 39030 - DNA, 1136 bp, Heterodera glycines
gagatgttttcacctcggaggatgatctaaagaatgatgatcaactcaatacatttttcggattgcatttgatcggcatggatgattcatcaacaccaatcgatcgcgacgaagtaatggttaacttcaagagaaacctcgcattcatcaacaaccggtaccaaattgcactgccatggaacgacagagtcggaactttgccgacaaactaccatcaagccaaagctcgactgatcagcctgatcaacaagctccgcgcactcaacttggtcaacgaataccaagcaattttggatgagcaactgcagaagtccgtcatcgaattggtcgactctcccgagcaatcaattggaccagttcactatctgccgcaccgtgccgtcgttcgtaccgacaaaacaacaacaaaaatccgcattgtgatggacgcctcggcaaaacccaaacacagcccatcagcgccgtcactcaacgaatgtctgcacaccggacctcttttgctaaaggacttaactggaattttgttacgcttccgccgtatggaacatgtcctattggcagacatcgagaaagccttcctacaacttggcgtacgtgaacaagacagagacgcaactcgtttcctatggctaaggaatccaacaaacaacgacttgaactcgctgaaacgagaagacattttggtcttccgtttttgtcgtgtcagttttggcctgacagtctcaccatttctgctcaatgctacagttcgtgaacacctggcattattcgacagcaccttagcaaaaaggattgatgagaacctttatgtcgacaacattttgatcgaaatgtggccaaacgagcaacttcaacccgtcgtggaagaagtcaagtccattttcaaagccgctggaatgaacatccgcgaattctacggcagcaacatcgatggtataaagcaattgccatctgaagaccaggccaaagaactcgaaaacacgaaagttcttggcatcacttggaagccaaaattcaaccgaatcgtcttcaaaatgccaacattcgacggaaaaatcacaaaacgaacaattctgtcacacatcgcgcaagtctacgaccccgctcggttttaatgtcaccccgcgctactcccc

SEQ ID NO: 39031 - DNA, 1028 bp, Heterodera glycines
  misc_feature (887)..(887): n is a, c, g, or t
tttgctacgcactgtatgaaatacctaatgcgcaatttggatacaaaaaagagatagctatttttgggcacgttacgatttttctgtcggtgtccaacaccctactaatgcttcgtttggccggataagaaaaggcaacctgtgctacgcactgtatgaaatacctaatgcgcaatttggatacaaaaaagagatagccatttttgggcacgttacgatttttctgtctgtgtccaacaccctactaatgcttcgtttggccggataagaaaaggcaacctttgctacgcactgtatgaaatacctaatgcgcaatttggatacaaaaaagagatagccatttttgggcacgttacgatttttctgtcggtgtccaacaccctactaatgcttcgtttggccggataagaaaaggcaacctgtgctacgcactgtatgaaatacctaatgcgcaatttggatacaaaaaagagatagctatttttgggcacgttacgatttttctgtcggtgtccaacaccctactaatgcttcgtttggccggataagaaaaggcaacctgtgctacgcactgtatgaagtacctaatgcgcaatttggatacaaaaaagagatagccatttttgggcacgttacgatttttctgtctgtgtccaacaccctactaatgcttcgtttggccggataagaaaaggcaacctgtgctacgcactgtatgaaatacctaatgcgcaatttggatacaaaaaagagatagccatttttgggcacgttacgatttttctgtctgtgtccaacaccctactaatgcttcgtttggccggataagaaaaggcaacctgtgctacgcactgtatgaaatacctaatgcgcaatttggatacaanaaagagatagccatttttgggcacgttacgatttttctgtcggtgtccaacaccctactaatgcttcagttggccggataagaaagggcacctgtgctacgcactgtatgaaatacctaatgcgcaatttggatacaaaaa

SEQ ID NO: 39032 - DNA, 969 bp, Heterodera glycines
  misc_feature (821)..(821): n is a, c, g, or t
tattgcgcaccgccctccctatcatgctcgagagcatttgtatgtgtataaaatttatcaaaaaaagagatagccatttttctgggatagagtataaatttaaaaattccctcaaaaataaaaggtctattgcgcaccgccctccctatcatgctcgagagcatttgtatgtgtataaaatttatcaaaaaaagagatagccatttttctgggataacctctaaatataaaaatcctctgtgaaataaaatggcgattgtgcacagccctccgtctcatacgcaagcgcttttgtgaggtataaaatttctcaaaaaaagagatagacatttttctgggatagagtataaatttaaaaattccctcaaaaataaaaggtctattgcgcaccgccctccctatcatgctcgagagcatttgtatgtgtataaaatttatcaaaaaaagagatagccatttttctgggatagagtataaatttaaaaattccctcaaaaataaaaggtctattgcgcaccgccctccctatcatgctcgagagcatttgtatgtgtataaaatttatcaaaaaaagagatagccatttttctgggataacctctaaatataaaaatcctctgtgaaataaaatggcgattgtgcacagccctccgtctcatacgcaagcgcttttgtgaggtataaaatttctcaaaaaaagagatagccatttttctgggatagagtataaatttaaaaattccctcaaaaataaaaggtctattgcgcaccgccctccctatcatgctcgagagcatttgtatgtgtataaaatttatcanaaaaagagatagccatttttctgggatagagtataaatttaaaaattccctcaaaaataaaaggtctattgcgcaccgccctccctatcatgctcgagagcatttgtatgtgtataaaattatcaaaaaagagatagccatttttctg

SEQ ID NO: 39033 - DNA, 1708 bp, Heterodera glycines
  misc_feature (116)..(117): n is a, c, g, or t
  misc_feature (190)..(190): n is a, c, g, or t
aaaattttattttgaagttattgaacaaaaaaaaaaaaattcaaaaaccgggccgtttgattacggtactaccgtatacccttcgctttatgggtgtttaccttttttatttatcnnttaccatacaaataaaagaataatttgatacaaaaataaaattaaaaattattaaagaatgatgatagatagngaattgggggaagagatcgtcgtcagaggacagttgaaatgattaatgaggatgttcataattttcaattaaaaactgatatccaatcattgaggcctccttaaaatttcaaggtccgaaaatggattttttggggaattttaatataaatttttatctaagaaatggtcttatttggaattgagtttttcattggctttcgttggttttttttttaaaatttccaaaaaattatgggaggcctcaaattttctaaagtgtaaggcattggcttattatcaaatcaattcaacaattttgcagctatcgctttcttgccgcgatgatgatctttcgcacacagaaaatggcagttagggtgaagagaattgcttaaatttgtaggaaattattagaaatttttcaaaaattaaaaattttttaaaaaataatacggcatcatatttacccaagagaatgacaaagatcagctgcgctgtcataatggcgacgcccaatttgactttgaacagacactgtaaaaaagagtagattaaataaatctgatcagtttaaagtgatcaggaatcaataaataattaatgagcaaggatggtgatcaattggattgaaaatattgtctcgaaagaaattttggttggccaaagtgatcagacttcaaaaaaatgtttgaaataatttgatcgtcactttttgtgtaatgccaaagtgatcagggactataattttgaaataatttgatcaaatgtctttattttattattttcaattcccaaaaagcctgctaaagtgattagacattagaaaaatttggaaagaatttgatcaaaagtttctttttttaatttaataccccaaaaaccctgacaaagtgattagaaaaattttgaaacaatttgatcagaaatctcttttttttcaattttaacatcgcaataaaaaccctgcctcattgaaatacgctttgtgctgcttttgactgtgcttcatccggtccatgtcatattcaccaatcaagcaatagtaacggtcacggcgcgaaattggattatgaatgcctttgtaaaggccggtcaattgccagttcctgcaaattatggcacatttttttgaaattatgggttgggagaagtctaagacatcggtatttcgtgtacaggcagttaagatgctagagtaagtaagacgcaaatttccaaggacgcccttgacatggatcaaggatgcagaattaagtgcatatttggcgacgattaaaaaaaaattaagaaaaaataaacaaaaaaattttcagtgttaaaattttttgaagtaatttcatcataaaattttttgaaaatcgccagaaaaatttttaaaatatttatttaaatttttttctaaaattttttaatgaaaaatttctgtttgaaattttaaaaagattgggcggaggggggggggggggaacgagctgttttcccggctggcacctgtgcgagattattgcgcaaccaatgcacaacaaaatggagacca

SEQ ID NO: 39034 - DNA, 1641 bp, Heterodera glycines
  misc_feature (24)..(24): n is a, c, g, or t
  misc_feature (51)..(51): n is a, c, g, or t
taggggaagtgagttgtgttcaanaaccctttcagaaaaaaatatttatgnaattaattttcaaaaaaaatagaaaaatttttttaaaataaataatcgtttttcaggttaagttagttctggtaccggggagtaagcctataaaacttggtgcaattttattaattatagcaagagttaagttcgataaaacttttaaaatttaagcctaaaactaggcatattcaaaattttgaaaaccaataagcgttgaaatattttaatttaaatactcaaataattttttttattacatttactacggcatttgtatacggtaggaatggtcgatgctccaagccgatggccgaacaaagccaatcggaataatcctcagcattttgttcattttttggtaaaagtcctttttcaattgcatattcctaaatttaaaaattaaaataatttttttttcaaatttttatgcctttaattcgttgtgtaattttgtctgaatttgttgatgcaaaatcatgtaaatgaccataaagtgcaaagtatttgaattggtttcctagcaatataaaataaattaattaattaaaacataaaaaaaaattaaataatatatacgaatacatttgctgccaaaaagaagtcaaaacagagcgatcgaagtgaatccatactgaaatgattagttttttttatatgcaaataatcggacaaatttaaaatttttagaaaatccaaaacgatattaattattactgattaattaaaaacagattaacatcagggttgcgtcatcattcagaatgaaaataccgtaattattcaaaactggcaatcgaaaaacaagaaaatttatcgaccgttttttacgattaaatatcaaaaaatataaatcgaaaactcgatttaccgataaaatcgaccgtgcccatctctaaaaacacatatgcatgccaaataccatttcacgtgggcatgaatactctttggacatttaattaatttggtatctatttaatttgtattagattgatcttttgacaatttaatgttttgccccgagttcctccttccattttctagtatcagtataatgattattaagttttactgatgatatttgtcctgattgaatggcatttcgacatgcatatggcgctcctccattcgctggacggcatccacgaaattgtccatgcagagatgctcgatccccatcgccgagaccattgtggcgataccattcactacgcgttaaaaggacaccaattttcatgaataacagaaataattagtgaagttataataataactatcattaattattattttttatttaaatgccactacaatagcagaccactttttttatcgattgattttcaccgccaacctattggcttctttttgggcgagagagtgcaccgtctaacctctccagcgacgagagagtgcacagtctgacccaccagcagacccgtgcctatgggctgctcggtcccgcctcgacacgaattggctgctcggtcccgatagtatccgagatctcgacacgagatctcggctattatgggttcgagatcccggtctctgtcgtgtggtgcgcgagaattcagcagaaatttaacaactgaagtggactcgaac

SEQ ID NO: 39035 - DNA, 1368 bp, Heterodera glycines
  misc_feature (1012)..(1012): n is a, c, g, or t
  misc_feature (1025)..(1025): n is a, c, g, or t
ccttatcagtcttatgcaatatttcaattggactcgcttcggctttgtgcttcaaagtgacagcaacggagtcagcggaggttaacgcactcaaaaggcgaaagaaatttccatgtgaataattctaattttaggctgcaatttattcgcccgcgacatcgatgtactgtaaaaccgtatagcattgactgttttttttttaaatttattttttagaaagcgatgggtgaaaagtcttcggtcagtatcacttacaaggtacgcattttcaacacccaaacgtccgatttgaacacaattgtcactggactgcgcaatagggcacggagtgagtggccggggagggggggggcggtaaaaagggaatttgggagagagcgagttaaaataaaaagggattaaaaaacgaaacgggatttaattaaataaaagtaaattaaaaaacataaatatgcaaaaacacacatttccattgaaaatgtcagtcattttgctttgcttcgatgacgtcactcagttacgcactttctttgtttgacggtggactgaaaacaaaggtgcgtgggttgccaaattacgctaattggtcaattaatcgatcattaaggattatttgtacatcatcccggataatgatctgatcctttcatgtttgtccaattaatataataattttattcatttatttgtcctttgtatgcatatttagtcaatttgtcgcgaatgcctttttggaagcagggggcacggtgaattgtacaaattgtgcaaatgttatttactaaaagcatttagcgatttggtgaatgtaacaattgtgaatgacggaagagatgccgatgccgaagtgattggccgattgacatttcgggtcggtctgacaaatttttgtgagagtgtggatttatttctgtcggattttatgctatttcaaatcaaaatggcatttaaaataaaaattgaagttctatgactgaattaattttggcatatcttactgtatttactgttntaatgaacaaatntagtggcattatgacatcactcagtccgcgctgtccaatcggaattatttgggctatttcgggcgagtgatcaatcggacgcgcgattggcccttttattgccccgagtcggactgtagcaatgttgcgaatgtgctttgaatttttttttttgctctaaattagtattttggcactttaccagtttaggggtccgtatattcgcttcttttgtacgacgcaatttacaattacggaatggcactgaacgaaactttccgccaatttggcattcggcccgaagtgtaccgaaacggcactcttttggcacagaacaatagaaagacattcatgggcaagaaat

SEQ ID NO: 39036 - DNA, 872 bp, Heterodera glycines
ctagggaaaagaaggcaggggatgagaaattggctagggaaaagaaggcaggggatgagaaattggctaggaaaagaaggaagtgagaaagaatccttgggaaaaaagcctgcggttgcgagaatggcaaaggttgaagagtagagagtggcaaaggcagatgaaaaagcacaattaatgtgacacatttttttaaaaataattttcatttatttgtttttccccaaacttaatgatgaaaaacggctcgaaaagggtttggacagtttctcaaatgtgggcgaaaaaactcagcgaaggttagaatgaagtaaaaaatcagcgagcagtccgtcatttttctgtctaacgatggttgtccccaaggccgcggagaaggcacaactgttcgttggtgttgacaaagtggtgtcggttcttctcgcgcagggccccccaagcttcgcgatggggtcaagaaagtggatgccctggaaaattttaggaaaatataattaaatagcaagggtacgaataaatgaaatatagtcaaaccgtggggtttgttggacaacaaaccggaacagcttacccaattttacatgcattattattcactgttaggtgaaaaaaaaatttttgtgtgggtgggaagattcagcctttttaggccggaagcaaaaacgcgcaacggaaagcaaaaatttttttgtagtgcctgttaaggacaaaatttttaaaaaaaggccggcccgggctgattattttagaagtaaaacacatggtcgacgaatgagcgtgaaatgcgatccatgaccgcctcgtgcatttcgaacgtgtccacaacagctcgggaaccgcagcgacatgtgtacgcaaccgcgccaaatgga

SEQ ID NO: 39037 - DNA, 1028 bp, Heterodera glycines
  misc_feature (16)..(16): n is a, c, g, or t
  misc_feature (937)..(937): n is a, c, g, or t
agagaagtgtcgttcnaactctgcctttttgctattgtgcactcttttgccgaaaacagacgatcccaatgatttttttgaaaagcaaaccttctgactcaaaacacctcaaaccctagagaagtgtctttcaaactctgccatttttgctattgtgcactcttttgccgaaaacagacgatcccaatgagttttttgaaaagcgaaccttctgacccaaaacacctcaaaccctagagaagtgtcgttcaaactctgccatttttgctattgtgcactcttttgccgaaaacagacgatcccaatgagttttttgaaaagcaaaccttctgacccaaaacacctcaaaccctagagaagtgtcgttcaaactctgccatttttgctattgtgcactcttttgccgaaaacagacgatcccaatgatttttttgaaaagcaaaccttctgacccaaaacacctcaaaccctagagaagtgtcgttcaaactctgccatttttgctattgtgcactcttttgccgaaaacagacgatcccaatgagttttttgaaaagcgaaccttctgacccaaaacacctcaaaccctagagaagtgtcgttcaaactctgccatttttgctattgtgcactcttttgccgaaaacagacgatcccaatgatttttttgaaaagcaaaccttctgacccaaaacacctcaaaccctagagaagtgtcgttcaaactctgccatttttgctattgtgcactcttttgccgaaaacagacgatcccaatgatttttttgaaagcaaaccttctgacccaaaacacctcaaaccctagagaaagtgtcgttcaaactctgccatttttgctattgtgcactcttttgccgaaaacagacgatcccaatgattttttttgaaagcaaaccttctgactcaaaacacctcnaaccctagagaagtgtctttcaaactctgccatttttgctattgtgcactcttttgccgaaaacagacgatccccaatgagttttttgaaa

SEQ ID NO: 39038 - DNA, 372 bp, Heterodera glycines
cttttttcattttcactcacaaattcccttttctcctcgccctcttccacaacaattgtctctccgttgtttctacactcttccgcgcttctcagctgcccatctccgcctttttctgttccgtcttcccaaaatgtgccgttcatttcattcgctgccgaaggcgaagaaagaaatttgtgaagcattcgcacgttttattggaaataatttagtaaaaataaattaaaataaatttattcatttttatgacccctccaattaaaattctttttccatctgagaatttgagcggtggggcgaggggtgggagtgggcgatcggtgacggcagcgccgccgaatcggacggacagcggcggggggggggggg

SEQ ID NO: 39039 - DNA, 973 bp, Heterodera glycines
tatttaatggctgggattaaaagctaactttgatacccatcttcttctgcgttaatacattcaatttccaaaattcttccgagttttacgcttttttccccaatttttgtcccatttgaaaatttggtgcctttcgcgtcgatgagcacccggtcgttgctgagcagcttcttctccgcctccatctcggccatcgcgtgctcatagtcgatgccaatcaccaccaaattgggcagcgtttcctccagcaaaagcgcactctttgcgattccctccgttttgccgagtccgtccaagcgcaaaaagcgcagtttggagagcgaacggaggccgagcagtcctttggggacggagggggaaatcaacggttgtcagggggagatggccttgaattttttagatacttaaaattttgttttctcaggaaatgcagcaaattttatttttcagtaacacctaggtttttttttaaatttttatggcaattttgaaaaaagttttatttaattttttttgcggcgacgttacgtccccgcgaagccggcgacgttttgggggtgtacccacacacgagggcccgggttttgaacaatcccagacagcaactgttgctgctgcattcggaccgggttcccggatcactattctcgaactgacctttggccgatattctgtgacagttgctcaggtccaacatttccaaagtgttggcgaacattccgccaattcggctcagcacccaatcgtcgatccatcgacagtccctcaggctgagcatccgaaggaattccaagtcgtacaaattgtcgaagccttcgtgtgagggaagtaaaaatgtttttttggaaggggataagtgccatataaaaaaaacaaaaacaatcgcgtaaaaaataaaattattagttaaagccaagctcagaaatggggggtgcatttcattccctcctctgccccgtcgttttccccacat

SEQ ID NO: 39040 - DNA, 944 bp, Heterodera glycines
gtcatcttccgccaaatattcgcctctcgcgtctaagcgccgttatagtcaaaatgccgcgtctaaaacgcaaaaagctgcaataataaacacaatgtcgagactattgtgagtctcggctcattttgctgtccctatgccttttggacccgctcatgtgcactgcaactgcgtctgtgccgacatcgtccggaatggccacagtccgtcgaaaacggcggatcaccgaagtgcgctcgtctaaaagcacttccctttcggcattgaccacaagccgaccctcactcatcagcacctggaaatgccaaaaaggaggtgaagctgaagcagtgcttggccagtgaccacctcaatgtcctccgggcggaagatgttcatgtcgatgctgagcgcgaacttgcccggcccactgaccgtcttcacctcgacggatgtaacagttagcacagtttgaccccttcatgccttttatttatctttattggcactttgttctttttagtcccaacaattgtccccatcgctcttacagccctgtcccccccccgctttagtctcccgctgctctccactattcaaccccgcccaattcagtcccgtctcttcagtaccgtcaccggcgcctccctgagcctggccaactcttcgtccattcttcgcactttttcatcctcccccgtactttctcggctcctcctccttctccacggttcgtcctcctcctcctcctcccccctcgtccgcttcttccatgtccctcccccatcctcctcttcgtcagtccatcgattgctgccggttgagccccacgaggatggagaggcggcggcactcagtcgggaatactgcccaagcgcacacaacgggccgaagcttttcatggcggtccgtggcattaattgcgacggaaatgcatatctttggcacttttgcactatgctgac

SEQ ID NO: 39041 - DNA, 727 bp, Heterodera glycines
agaaagggtagactaatggctaaatatatgagtgaagaaaggacttgtaaaaggaataaatgaagagtgaagagaacatatgaggatattgaccaattagtgcgtcattgaatggaaggataattaattgtggaagtaagcgataatgaaaaaagtcagaaatggatagaggaatggtataaaaatcagagttagatgaagaaagacaattttagatagagatagagaccaacagtgaaaataagcagatatagaaagagtagaaaaaatatattaagaaataggaaaataattcaaataaacttaacccctataaataggccaaaaactaaatactggagtttgtaacaaaaaccaaggaatgtagctttcttccatatgttatcttttagaggaatggatttataggataaagggatgccgtgacctcaccccctttctcctcaagtttttttttttggttacactcttcctcatctttgcccttcctctccaacatattctcattcttactccttaccggcgaaaactcactctacccggtcccgttttcagcttcctttaacaattcaatgggaaatgtgtttttactaaaaactctatgaaaaaatcgaattgtttgccagcacaaccataccttgtgggacatggctactggagggacaagcctaatcagatattggctaccggagagccgagccttgtgccgggaattggtttctggatg

SEQ ID NO: 39042 - DNA, 818 bp, Heterodera glycines
  misc_feature (33)..(33): n is a, c, g, or t
cgttcgacagaagctttttgcagtttttcaagntaaccctcccttgagccccccaccccctattcataaattcagaaaaacccccgccccaccacaaaatggttattaaatacaatagatactaaatttggcttgaatcagcttagcacatttttaaaatgcctattttatttaagaattacattttacaaattaatgacaacaactaatatactaacaatattttaattttaaggaaaaacaaactccaaatgaatccttaaaataatactgtgggcataaattattttaattatttcaaagttaaaaactgatatagaggaataaaataaaataataaactaataaaataattttggcacgatattctatagacataggttcatataaaaaaagagaagcaaaagatcgtttgctcaaagatttctccaagttatgttttattttttagatccggttttgcgaaatctgaatgatttaatcaaagtacgaaaaaagcatttatgcttagatataaaagttttggcttgaatcagcgggactcctttcttgaattcatgttttcttcaaaaaccttgttttaaaactttttctgaatttatgaataaaaagccctaaaaatcaaaaattaacttgaaaaactgcaaaaagcttctgacgaacgacgttgtgcccttacttttagtaaggatctgttccaccagaatgttgggcagagattattttattatgctcgatagttcttctccattaaattattacactaacaataactgaacattttcaccaatgttgctaaatatttacatgataattta

SEQ ID NO: 39043 - DNA, 895 bp, Heterodera glycines
  misc_feature (812)..(812): n is a, c, g, or t
  misc_feature (873)..(873): n is a, c, g, or t
  misc_feature (881)..(881): n is a, c, g, or t
attaaatctttttaatgattaattgcttattttaacgaaaacaaaaggtgaaaaaaatcttttgggtttcattcgaaaatcttttagaaaaagttgcaaatcaaaaagggcccccattttgttactgttagcaccatatgctataaaagtgccattcccatccgttcgttttggtctcaaatcaaaggaaaaagttcaaatttatttttggccgaacttcccaatatcaaaaggtaatttttaatgatttaaagaaatatcaatgatcagattgttatattttagtcactgtttgcatttgttgaatgaaacgaataatttatttttaattatttgttttggacttaaatgacagcagcgaaatgtggacaaaaagtggccgagttattcaaaaaatgaacccaaaatggccatttgactaatcttggttagtttcttttgctgagacattctccaaattagccaattggccaacattaagcggattaagcgccaataataagagaagcactgtttgatggtaagcacaatgatcagacaatgatcagaatgttaagccaatgtcagtggtcactaaaggctaagaaggcacaattttaatgatttcggcatggtaaaaaattaaattcaaaaataattaaaatatttaaattaaaatattcaattcttttatgtatgaaaaatcattcaaataaaatatttttgtaaaggataaaaataatatttttattaagaaacaaaacttggatcattcacattttttccttctatcaaaattaaggaaaataaatttgtatttgcattttctttanaattcccattttaacctttgcttttttttttaaatgtatattttgtctttttacccaattntgtcattntcttttttttgtca

SEQ ID NO: 39044 - DNA, 893 bp, Heterodera glycines
  misc_feature (189)..(189): n is a, c, g, or t
aaaattgaatccataattaaaggtaaacggactatggaagaggcggaattccaacgggttggactttcgccccaacatgcctattcgctgttggatgttcgccaaaccaacgatgggcatcggtaacttgggaaacaggcaaaataatggtctatctctgtccaagtagactggtactgttgcgcaacncatggggagaaaactttgtttggcgcggcgaattcagcagcgaatggcttggttggactcaccagctgagaagggaactcgccgcggatgccgtgtttggtccgggcacattttggatgccttttgaacaatttgtgttttatttcgacgcggtcgacattacgcagctgagagaacatcatgggtggacagcgacgcgctattcggtggacatcggatgggaccagcaaaattcatggtgaccaaaagcattcggtgccaatgtatatgttttcatttagcatgattcgactgataatcgacgaaccaaccgaactctgtgcgactcttttccaacaacatgctcgtaccatgttggaccaagttgacattatgctgctgctccatagacaggacggcgaggctacgcctggtaacttcagacggtgttttccaccgactgccattcattcctttattatcaggtgaattgatttgccggtcatcgcgtcgagttttgccgtgtgtgcgaattgatgacacttttttgccttgtggagagtatttgctctgtgcccattcattttcaaaatttggagaacaaatggtttcggggactattgtcatacacaggtgacgagaattttagagtatttataaaattagatacccattgatttctcatacaatttaagttcacgggaaattcaaaccatgaaacttcg

SEQ ID NO: 39045 - DNA, 784 bp, Heterodera glycines
atgttagtttaggcactctgatgctttttctatcaataatggaggtgaataaaattttaattgctttttaactttgggaaaaagtttaggcttaactttttagtgaaagtttgaattctcatatttttctagtctaatctactcaaaacggttcagaattcaataaaaataacattcacggtgcgaaaaatggggtttgaaaagtttattggggaaaaaaagactttacaaaataatacccctgggagaagggagtgggaaacatgatttcaaaattttcaattttttctagtctaatctactcaaaccggttcagaattcaataaaaataacattcacggtgcgaaaaatggggtttgaaaagtttattttgaaaaaaagactttacaaaataatacccctgggagaagggagtgggaaacatgatttcaaaattttcaattttttctagtctaatctactcaaaacggctcagaattcaataaaaataacattcacggtgcgaaaaatggggtttgacaagtttattggggaaaaaagactttacaaaataatacccctgggagaagggagtgggaaacatgatttcaaaattttcaattttttatagtctaatctactcaaaccggttcagaattcaataaaaataacattcacggtgcgaaaaatggggtttgacaagtttattggggaaaaaaagactttacaaaataatacccctgggagaagggagtgggaaacatgatttcaaaatttttgttgaaatatttgtcgtgctctgaag

SEQ ID NO: 39046 - DNA, 985 bp, Heterodera glycines
atggagtttttccggtgccaaatttttgtgaattttctttcggcccgtcataagcggattgtttgggggcaaatgaaaacaaattttgtgttattcgaatgcgctagccgagctctacattttcaaatgtaacaacaaagggtctatctccactctctggcgagttatgtccagccaaagcagagtgggccataaacacgaattttttaatctttggtatttcctctattttgagcctgctctacatttatgtattgtgccaatatgcctattgcaactgaaatttattcaactttcccgacaaattgttgagataattattctagacgatttttttatatctcaaagcttaactattgcctttttgtatgataactggtagatattgggagtaaaaaaaagtttttttgtgactatttacaataaaaatttatgcagcatttctaaaaaggatctaaaaataatttcttgcgtaatattttttacattatgttgttgaagaatttgaggctgcttctgatgcgattgaaaatttttcagcttttcttgaaaagttttttcccagaatttatacagctttcccgacaaattgtttagataattattctagacgatttttttatatctcagtgcttaactattgcctttttgtatgataactggtagatattgggagtgaaaaaaagtttgtttgtgactatttacaataaaaatttatgcagcatttctaaaaaggatgtaaaaataatttcttgcgtaatattttttacattatgttgttgaagaatttgagtctgcttctgatgcaattggaaaatttttcagcttttctcgaaaagttttttcccagaaaacggatgggtcaaataaaaaactaaacatctcacatgaccaatttaattcacttacattttggtttactttattatgctggcccataaaaaaatggaagttttcccggggccaaatttttgtgaattttctt

SEQ ID NO: 39047 - DNA, 1421 bp, Heterodera glycines
gtcggcccagggggagggggagggaggaaaaggaggccgaggcaatcctctcagaacccgtgggtgttactgatgggtggggggtttgtggcctccttttataccggcagtttctgcttgaacaattgttgccaacttggcatgtccaaatttctgtccctaacatttgccaattttactaaccttttctcattttccagtttgtgccactttagccttttccagttttcttaacattttacaatttctttaatatcattcacattttgtctcattttaacatttgtttaaaatctgttatttcttttaacgttcaaattattcataattaaagtttaacatttgacaatttttctaatggaaaaattgtgacagaaaatgactaatgatttttctttctttcaattcattcatttcgttcacatttaattaattaatgtttagctgtttaatttaacattaatttaaatgttttttgtttttaatgtttttattttttaaattaaaaatcctatttcgcgtagtcgcgacattaccccgaaaaaagagatagtcgttttttgaaaaaaaattataacgagcaaaaccaatccaggtattcgttagggagtcagcaattattttttccaaggacgtccatttattttggcattatttcgtattaccccgaaaaaagagatagtcgttttttgaaaaaaattataacaagcaaaaccaatccaggtattcgttagggagtcagcaattattttttccaaggacgtccatttattttggcattatttcgtattaccccgaaaaaagagatagtcgttttttgaaaaaaattataacgagcaaaaccaatccaggtattcgttagggagtcagcaattattttttccaaggacgtccatttattttggcattatatcgtattaccccgaaaaaagagatagtcgttttttgaaaaaaaattataacgagcaaaaccaatccaggtattcgttagggagtcagcaattattttttccaaggacgtccatttattttggcattatttcgtattaccccgaaaaaagagatagtcgttttttgaaaaaaattataacgagcaaaaccaatccaggtattcgttagggagtcagcaattattttttccaaggacgtccatttattttggcattatttcgtattaccccgaaaaaagagatagtcgttttttgaaaaaaattataacgagcaaaaccaatccaggtattcgttagggagtcagcaattattttttccaaggacgtccatttattttggcattatatcgtattaccccgaaaaaagagatagtcgttttttgaaaaaaaattataacgagcaaaaccaatccaggtattcgttagggagtcagcaattattttttccaaggacgtccatttattttggca

SEQ ID NO: 39048 - DNA, 795 bp, Heterodera glycines
tccttctgcggcgtgcggtcgcgttgttggtcccatcttttgcggccacctttagggacggaaagagcataaaaggtgccttttttaatcattccgttgggatttcgccacctccgaggacgaaactgtccacttcgcgcagcttcgacagcccggcaattcgactttccgcccgactgctggggagcagtgagctgactgaagcaatgaattgaaaattgcttttttaatattttattttgttcattttcgaccgttcgccgccgctgccgagcgacggtcggccgaactccgtccgccgtaattcggtcggctgcctttccgtgtcgtctgttgttgcattttctcattttctttcttcctttcatgctgaaagaaacaattattttcaaaatgcatttttaccatttaaaaatgagtgtaaaattccatcatttatttaaattcgtttctctttatttagtaattaaatgttcaatttaattcattgttttccctcacctcaatacgttccatttcgttcacttgctgttccttctccgcttcttcgtgtacttcttcgatggttttcggccccttttcgcccccgcggggcatccatttgttactgcgcaattcctttgaaaaagtgatgaatcatttttgaatttccaattaatttttgaattattctcccccccccccccccgctgacctccacttccaaaatggcaaaacgaattcggttggacatttcctttttcagcgtcgaagatgcgagaaaatcttgtcgaggctgaagctgtcctaaacatg

SEQ ID NO: 39049 - DNA, 869 bp, Heterodera glycines
aaagttcctagtcgtatgtgctttgcgttggttggttggcgtgggtgactgtggtggttgggccgtttttgcgatattatggctggaaaaaagatgcgatttcgctatggggagcgcggccgtctgggttcaagtgcttgcttgcgcttgtgctcggcattgaacggtgatggctgctgctggggtgccacctttgtcgtggcctcagtttctccagcgattggcagctgtcgaaatgaataaacatgcagctcgtctgtgtgttaaagaaatttggcgagttaattgacttgtgtaaatgtggcctaaggcacaaatgctgtggggaactcagcactggggatgctgaacctaaagttggtggtggtgttggtatacgagtgagtggcgtattgccatggttgacaagccctatgagttcgtggatcggaactccttgcctggggaccagtgtgcttgcattcgaaaaaacacgagacataagcgcccgaaggcctttggcctgaggaagtgtcctaaccgggaaatccggagtgctcgtgtgagtgcctgtgcactgccctcggagctgtgtccagcggcgagatggttcttcccaagtccgggaagctcggatgcctggccagcgctgtgtcattaccacttgctcggtctccttcgctgcccatgcgcacgcttgcgctaaaccggaagtttgtttctgctgaaactatccgtctttacaagacggctgtattaagcggcgcttggcaacgctcgctagcagtaacctggttgatcctgcctgaactgattgtgtcatttcaaagattaagccatgcatgtgtaagttttaacctgccagacagggaaactgcgtacggctcatt

SEQ ID NO: 39050 - DNA, 1143 bp, Heterodera glycines
tgttgctgccacgttcaaagagatttaaatttatgaaaactgctaaaaccattatgcgatattgttatagaaatctaagagctttgaaaatggcattcacagattggaagatgaaatgtgaatgacttcccccccccccatttaactcttttcatcaaattttttcactgtgattttagcaaaatgattcttaatgactctttaggtgtgtgatttgtgcaatttaagccaatgtgattgaatcgcttttctctctgttttattttggcgcctttaaattctttgagtaaatttcagcagcattttgtagtcatttttgtgccaatcttatctcaataatttttggcctgaatatacaagggtcaatggcaactcgtacaaaagacagttcttagaatgttgtacaagggcaatatgtttttcgtgcttatctgtgcgtatgaagtgtgaagtgcgcaaaaattttaggcttttgcctaaaaatcacagccctagtcattacacaaatatacaaggattaagcagaccgaatctacgagagctaactgtccggtcaaacagacccaaatcccccccccccctacacaaccatttcaattgaagcacagagcatttagatacaacaatttatattatgggggacaaaatgacaattttgggacggtgggatgggatcctatcatgtccatgttgagctgacgaagcgttcttccatcagatgttgtactcgatgacgagttgcttcttgcgcttcggtttggtggtcttgaaggcgtagccgatgcgcttcgtcccaggttgatcaccttaatttaaaaactttattccgcatgccatgtggaacgcgtccaaacgtacccgcacgtagtaggtggccttgttgtcgaacggtgcgttgaagacgcccttctgcgtgggcagtgttgcgatgtcctccagcggaagttgcgccattgctgttgtcgggctagctttgtgggcgcttaatgtgtgatcgttgagaagtacaaagcaccagtattaccataaactcgtcgtccggccaagcgttggcccaccattcctcctgctcctcctcgttctcaggagctggcggtggtggtggtggttgtggaggatgaaatctgcaaacatttatattta

SEQ ID NO: 39051 - DNA, 1007 bp, Heterodera glycines
  misc_feature (110)..(110): n is a, c, g, or t
gtcggtcgctaaattgtgcagcggttgcaaaaataaaaataaaaataaatgatcagtaataaaatgtgatcacatgattaacatgatcagtagagcagaacatactccangggccaaaaatttgcgcaaattttgaaatttttggcgaacaaattaattcatctaattaagaaatttaagtacaaactaggaccgggaccgggatgtagagataatttttgaacaattgtatgaaaaattaaattaaagtggtaattttcgaaaaaataaaattgcttttagacaccattttaaaatatcgaaaataatttttttttttttgtcaagaatttataggcttaaatattattgcaagcaatttttgacattgaattttaatcaaatttaatcacagactaccgtataacaacaacagaaaaatacgtttataccgtatagaaagaaaaaaaaaatatgaagaaatgttgggcatggaaaatgggaccaatttaagcatcatcacagtcattttttttttttttgttaattgaactcattcctccgatcagcgatttgagtgtgccaaaaatcattttgaagccttctcgtccacatttgccgtcccatttttggtggcgccagccgccaaattattagtgacagccgtttccgacgacgacgacgacgacggcaacggcaacggcacagccttttgccgttccacccaatcgttcatcacctgtggcagcaattaataaatatatggaaaaaaaaatttttgttgttaactgttgcgcaatttccataaaatcttcaaattattttatagtgaatttttagaaattttttgaaaaaactttaagtgggataaacagttggccaaaaacaaggacaaaaaaatggcacaacaacaaattttttggattttaattttgaattaaattatattccagggcgggccagttttttttttcaaaaaaaaagacaaacgaggctaaaacaaagatttggaccccaaaaaaaaaaaa

SEQ ID NO: 39052 - DNA, 1470 bp, Heterodera glycines
  misc_feature (69)..(69): n is a, c, g, or t
  misc_feature (78)..(78): n is a, c, g, or t
  misc_feature (87)..(87): n is a, c, g, or t
cacttttacagtatctcaagatgatatataataaaattattcgttagttttttaatagaaaaacgtttnttgtcaatntaaaaattnttatattcacaaaagctaaatataatttatattaatgtagaaaacacaaatatttgttttataaattgttaatttcataaattatttattagatttaacttttaaaacaatttttattttttttttatatttctttcataaatcctaattgttcttcatcccttctaattacaagtttatggaaggaagaaaacggcactttcttgcagccaaaaattagaaataattttttcggtagaattaccgaaaaaatatttatataataaaataggaaaatgactaaatcaaattaataaattcaattcaacttttaaaaatttttcgccttcggcatcgccggactaaatattgaaattcttttgtttttcatcataatctcaaaatcaaaatttaaagggaagtcaatttcgagtcattattatgtgaaagtttaacgaataaatgagaatttgaaaaagatgttttttacatttttattatttattgcaataaaataatgctctgctttataaaattggtaatttgccaattaatatttaatacatttaattaatcaaataaataaaagaacacccaaatatagattaaaaatggtcgataacttagcatttaataaatgaatttaaattatatttttattttcataatattgatttaaaaatgattttaaaagtttaaatatttgtcgatttaaaaacaatttttatacttataaaatggaatatcgatggcttttcgtcgtcccccccccccgaattattgttgtacttttttttaatcataaaatgctggcctgtcatttttatgttatttttgactaatatacaattttattatttgtttgccaattagtcatatcggagaaaaacatttatttcttcatttttccactttttcagttttttcttccatacagaatttttgttactaatggcccttcaatgcttttatttgtcaatcagtcacattcgtcgaaacatttacgttgccattttcacgcatattaattcgttcaccaaaattaatgtattactaattgcatgggtgtgagagcaaacgccaaaacagccctttaaaaagcgcacaaattggagcaccaaatcattcattccgctcaaaaattaccaatttcctccccacaaaattacccaattctcattaacaaacctacgaaaaaaatgcattctttcaagctttttgcatcgctctttcttgtactttgtgtggtaggttttaaattttttaaaaataattttttcccattttattgaattatcttttgttttttagatttcacttgtcatctgccaggacaagccagcagcagtaaaacgggggcatcttcttaattagaacaattagttaacctaaagaaaaaccaaa

SEQ ID NO: 39053 - DNA, 1747 bp, Heterodera glycines
  misc_feature (1715)..(1715): n is a, c, g, or t
  misc_feature (1722)..(1722): n is a, c, g, or t
  misc_feature (1729)..(1729): n is a, c, g, or t
  misc_feature (1736)..(1736): n is a, c, g, or t
gagctcccttgttatgctcacccgcccgaaatagctaatatctctttagtttatttattattatataaaattatataaatattttgttcaatcaattgtttttttctttgctgtcatttggtgactggaataataaaattgtaattgtttctcgtaccggagttcagcgtattatgcacttgagttgtgataaaaaaaggattattttgctaatttttacaaacaaaattagttttttcgttttaaaataatttaataaatatttttgaaacttatttcagcgtatgttttataggcacttattccattcctgtcacatgaattgctgggttaaacgtatgagcgtgttttattttctttaaataattatgtgattttggtaaaatttaaaactatcttaagcattattcatttttctttattgttatttgaatttattactgaaaatgatttttcctttcaactataaattgaacaagtaatgtatgagaattactcttattattagatgttttattgtatttttttaataatataaaataatttatattattcttaatggtttattttttagcttagagtcaacatttaattctttttttttacctttatagtgtgaattgcattgcgtttggttcgttgttcagcaagtgcattattttttcactttttgagttaagttcaatttttattttatttatatttttacatattttcggatttttctaaatatatatttacatattttctacatgtttttagcagtaaattaattaattgaattgattaaactagagttgagcggtaatcggtaattgtaaaaaaaccggtaccggtactgaccggtaatgcaaaaaccggtaccggtaccggtaccaactttttccaccggtaccggtaccggtaccggtaaaaaccggtaattttccaacgtaaaaatttttggacaaaatttttcaaatacaaaatttttattcagttttcgcgcgagtgcctgtttattagcattagaattgttcagaagtatatgtatattcaggttgaccaagttttttttttcaaattcaggacatagaacactaaaattcagatatagacctcaaaattcagattattgcaaaacaagggatcagcggccaattttccaattttgcgaaggggtctccggccatgtaaattaatgtaaatcaatgaccttttttttgctttcaacaccgctttttacgcggcacgtttttccaagacttttgggggacaaggagggccggcggtgccgataggcgccgccggggaaaaaatttgtaatttttaatgcgatttgttaacagaatttgtaaaaaaaatgaccaattgattaagttttgggtttttaggatgcttaacatgaaagaaaaaagttggaatattttttaaaattaaaattttaattaaaataatggtaaagaaaatgtgaggaatattctatccaagtggggaattgaacccaggcgaaaaattatgaaaggtagaaagtttaaccactacaccacatgtgcatgtgtgtactcccatgactaaatgaaataaaatttaattttttctcaaaaatttctccttcttcaccaatttcctactcttttctcgaccagacccccattcttaccagtgcaaatttttaccggcggtaccggtactagacaaaccggtaacggtaatttcatttttgaaaaaaccgngtaccgngtaccgngtaccgngtaccgctcaa

SEQ ID NO: 39054 - DNA, 1038 bp, Heterodera glycines
  misc_feature (35)..(35): n is a, c, g, or t
  misc_feature (967)..(967): n is a, c, g, or t
tttgtaattttaatgcgatttgttaacagatttgngtaaaaaatgaccaaattttgccacaaatcttacattttcttgttaaatagtgacattatgtcataaaatttcaaatttttaattattaaaatgtgattgaattcccaccgaaaaaggaataattttgaaaattagaagaaaaaataactacttgaaggggaactgatccaacgcaaaaatgaataaaataaccaactgcacaacacactagaccacgcatataaacaagtaaatggagcaaaaagtttctaaaattacattaattttaaatttacaaaaaaccaatcattagggctgtaaaaaagtctcggtctcgagtctcgaaaatcgagaccgagacttaaaaaccgagactcgagaccgaaaccaaaaaaaacctgagacttttctcgagtcgagactcgagaccgagactctcggacagcactaataatcgtatcgcacattcagacttttttccaagtgtttttggtgtctctgatcaacactttgaccggctccctttacgtgtacatgcaaagctactcagttaatcagtgggtgatcactctcgccgaatttgcgtggtcagttttggcacttaatccgaagctaaatttcccaaaaacactttcaggttgaatgttcatggtaatatttttaaattgaaaaacaaaaaacgattggtttgctttattttttgtttgtttttcccaaggattccccgccgtaatttatttggcactgaacaaaaccattcgcgacgattgccgcatgctgtacatgaaagtgttcaggaagaaccgtgtcagctttatcggcggggttactgtaatccgtcggacaaccgacagaaaattggccaccattatgtcggcaccattatagcgaattccgaattctggaaagacgacggatgcccatttcaccaccatttcttccattcattttnaaaagacatatagccaaaacctatgtcgttttagacaattttatatttttttaattatctattctatcatg

SEQ ID NO: 39055 - DNA, 1130 bp, Heterodera glycines
  misc_feature (1057)..(1057): n is a, c, g, or t
  misc_feature (1074)..(1074): n is a, c, g, or t
tgttccgatacgtatctctgcaaaatttggtgagccccctgatcaattacaaaataatttatggacgatcaaattttttgaaatttttttaagtgcaaaagtggtgggttgtctgcaaaaattttcaccggggtttaataaatctaggaaaattagtaagcttttgtagtgttccgatacgtatctctgcaaaatttagtcagcccctgatcaattacaaattatttatggacgatcaaattttttgaaatttttttaagtgcaaaagtggtgggtgtctgcaaaaaattttcaccgggtttaaaaaatctaggaaaattagtaagcatttgtagtgctccgatacgtatctctgcaaaatttggtgagccgctgatcaattacaaattatttatggacgatcaaattttttgaaatttttttaagtgcaaaagtggtgggtgtgtctgcaaaaaattttcaccgggtttaataaatctaggaaaattagtaagcttttgtagtgttccgatacgtatctctgcaaaatttggtgagcccctgatcaattacaaattatttatggacgatcaaattttttgaaatttttttaagtgcaaaagtggtgggtgtctgcaaaaaattttcaccgggtttaataaatctaggaaaattagtaagcatttgtagtgctccgatacgtatccctgcaaaaattggtgagccgctgatcaattacaaattatttatggacgatcaaattttttgaaatttttttaagtgaaaaagtggtgggtgtctgcaaaaaattttcaccgggtttaataaatctaggaaaattagtaagcttttgtagtgttccgatacgtatctctgcaaaatttggtgagcccctgatcaattacaaattatttatggacgatcaaattttttgaaattttttaagtgcaaaagtggtgggtgtctgcaaaaaattttcaccgggtttaataaatctaggaaaattagtaagcttttgtagtgttccgatacgtatctctgcaaaatttggtgagccgctgatcaattacaaattatntatggacgatcaaattntttgaaaattttttaagtgaaaaaggtggtgggtgtctgcaaaaaattttcaccgg

SEQ ID NO: 39056 - DNA, 1040 bp, Heterodera glycines
  misc_feature (30)..(31): n is a, c, g, or t
aagaaagagcgccgacaccaccgcgaaganntttcgatgatgccgcgggggagttctgtcgccaacagcgacagatccaatcgatgctgttttcccacgcttttttgttagtgatagtccaattaagtttgttttgctccgcccccctcgcatttttcggcctataaaaagggcaccatttccacccttgcctcactcaccccttccacatttccattcatccattttctttgctgctttaataaatatatatttgtgcgtaatcgggggatttggtcgggacggtttcccctcccccttctgctgctctcgtctctcgccgtcgtcgttgtccgacccaccaccgcttcgtcggtcttccaccgcaggagtcttccactcctgcgggccttcgcttcttcggctcgtccgtcccttccctccatttgggaaggcacggccgagaaagggaaaggagggaaaccacagctgattttgcctttggcaaagtcggctcccgtctccctccctccccacaaagtttttgtcgcctccttggctgcgacaagaagcttaataaatttaaaggttatatcgtgaaataataatgaaatttacattttaatttttatttaacaacagttcaacccccaaaaaaataaattaggatttatatattttgtcgataaatttatgtaattcatttacagccttcctcttgattgtttcctcagtatatgatatgaacgagaggtcgtacttctttgttttggttttgttgaataaaaattgttgaaaagccgcgttataatcttaattagtcattgggtatatgcccattgggggagtcattgggtatatgcctaatggggggagtcattgtgtatatgcacaatggggggagtcattgggtatatgcccactgggaaggagtcattgggtatatgcctaatggggggagtcattgtgtatatgcacaatggggggagtcattgggtatatgcccattgggagggagtcattgggtatatgcccaacgggggagtcattgggtatatgcc

SEQ ID NO: 39057 - DNA, 695 bp, Heterodera glycines
ttcttatttttgttggaatttgttgacattttttacatatttttaattaaaaaggcaaatattttctgaaagaaaaggtaaatgattttaagcaaataaattcaattaaatgcactgaatatttttattgatatattcaattattttttagtttattatacgataagaaaatgaaataaaaatttgtttgttggaaaatttaaaaaaaaattttaaatttagttgaactaacggacaaaggaatttgccttttataggaattatacccccgcctatttgtcattgccttccccaccccattttcttgcatttcatctcatttcctttcaaattgggacagtgaaatgaatctcgacgagggatgagagtcgagaattggcacagaagggggggggggggggggaaatctctggctcgagagattttggaacgcataacatctctcgaaacacgaaatagtcatacgtctgggatataacatacactgtcaaattctcccagagattaaatgccgattgcgcaccgcccttcctatcgagctcgcgaggatatgtaccgtataaaatttctcacaacaagagatagtcaacgtcacggatataagataaattttaaaatgctctgagacaataaatggggattgcgcaccgccctccatctcacgctcgaccgcttttgcatcgcataaaattgct

SEQ ID NO: 39058 - DNA, 1307 bp, Heterodera glycines
  misc_feature (91)..(91): n is a, c, g, or t
  misc_feature (114)..(114): n is a, c, g, or t
  misc_feature (156)..(156): n is a, c, g, or t
  misc_feature (162)..(162): n is a, c, g, or t
  misc_feature (182)..(182): n is a, c, g, or t
  misc_feature (299)..(299): n is a, c, g, or t
gcaaatgggaatggacgaaggctcacattttgcgcatttctcccaaaaattccattttcgtgcatttaaattttttttttgtttcccatgncggtaaattccataaaataaatntaaaattaatttggctcgctacaaaaacgccctattagcccnccattncttggaaggccaaaaatggnccatttgcagtgccaaaaccattttccaaggattcgtctagctttatgaaaccattcgccattgattcccccattcttctcccatgccaatgccattggatgatccctccaaatgcngcagctgctaattttggagcccaattggcgcaatgtttccttcccccggtccacgccccgtcggtttaagctgatggattcatggaaagttgagcgccgtcattttaattttattcctcccaaaagccaaaggatcaatgatcagtacagcaatgtttgctgatcaatggcacaacacaaaaatgaggggagatttttgttttattttttgaaaattaagaattgctttggaacatttagtccactataattattttaaatttttacagataaattatacatattcaatttttaaatttttattttaaattgccctttaattcaatttcaattttaaaaataccatttttgaacattgaaaaccatttacccaccaatcctttctgactcattatcattcattaaaagatgccacgacgaccctttggccgcttgttttgccaaattcagtgaagggtgcacaaaaattattgccatgccggtccctcgccccacgtgactgtccgtcttggcactttgtctgtgccagtcattcaaaagccacctgctgctgttgtgccaacccctcctcctccctaattaacctctttattggggcaaggggcaggtggccggccagcggaaagaacccgatgaaaaaacacccacggcagggagcgacgctacgctaattagtctcattaaaaataatagtactaatgctgctgcgcacatttggcagcaacgggagcacactagccaaataacgaaggtggaaaatctcgtttgagataattttatgcctgatttttttatttttgtctcgcttttttttgcttttattctttttggcaccaattaagccgcctgccttcggcgtgggatatcctcctagcaaatgccaagcattgtttagctaatttgccatttattggccgacaattagcttttgttccatgtatttggcactttggcgcgtggtgatcatgacaaaaaaaatgctgtcataaaatgggaaggaagcagggg

SEQ ID NO: 39059 - DNA, 515 bp, Heterodera glycines
aatcagttaggttttagtgactacatatgttcttaaaacaaatttagaagatttgcttgttgcttagaatttgcaagacacttacttattctacattttgtgacgccaatcaattgaaaaaggccaaagttcgctaattatcgcaaaaatgaatcgacggtatgaatttttttcaaaaaacttgttttttacctattttttcatgtttcatttgtccagttgggtgtgcaacgacgtgtggatggacattttcccgctgtttgaccgtcctcaacttggcctcaaaatggcactgatttcgccccgtttcgaagcgctggtggacaaacattttgaaggcaaaagcgaggtaatactgaaaaatctgggctccgcccaaaaaaatttttttctgttatgaaaagaccaactcgggggttttcggggcttctgatcacgaatatgatatcagatttgcaaaaatcattgattttgaaaatcagattttttaaattttgtcaatatgttcaaatgtt

SEQ ID NO: 39060 - DNA, 1176 bp, Heterodera glycines
cagtgccaacaaattgccgtgcggcaagcagcaaatgcgaatgtgcagcagagatttcggacagaaaatggactcgatgttttcgtgcagagacgacgaagtgcccttggcattgtgccctttttgttggctttgtttggcacggcaaagcaacaccaaaggcatcagttgttggagcagcagtgactcgtccaattgggaggagtgtccgacctaaagcggacaaatgatcccattagtaaattcgaatttggcgaccctttccgctacctccgccccatttttctctctcaaaaagtcccttctctcttcgttttttctctcttttccttcgtttcctttgcccctctttttatcattttctgtcgccgctggtgatgagcaagtggtcgacgtggaggaggaaatgccgctgctgctcgacgacgaagtcggcctgaccgtctccggtgccgtcgtcgtgtcgaattcacttaacgcatcgttggcacttttcgatgctgcgatggaagtgaaacggtcgcggaattcgtcgttgccgaacgcatggataagctcgttgtattcggagagaaacacaacgcctaacattttaaaacgaatttattttatatcgctaaaattaatttaaaaatacatttagtaattacattctgtaatagcattccaattttggcctgccatttccaaaagtatttgcatgtgtttttgtctgatagtaaaggggaaagggtggaggttcgagcccgctcaacaacattactaaatacataatacttaaattaacatatttttatttcctagaaatgaaaatggcatttacaaaaatgatttttgaagctttttggtttttgtcaaccaataagacattcctggttggtaagcaattggaaaacacagaagaggggaaactttttctaagcaaatcataaaaaattggttggattagaaaaaaaatatgggccgtgtgataattattaatgaataatttttcgaaattttcgaaataatttatttaaaataattcgacctatcattagattcagaaaaccaaatttgtgtgattttgacccctttaaaagcttaggtgcctccattttcactcaaattttcaagttttaaaccggttcaaaaaccggtttaaacgctttgccgcgcagttttttttgatggttt

SEQ ID NO: 39061 - DNA, 622 bp, Heterodera glycines
ctcactcccataattattaaatccgtgtaattgtcaccatacggcgcatcattcattcattcatcgtccatttttgtcactatttattgtatttttattttccttccgtccgtttttctcccttttttcattcattccgggtgagtcttttgctttgttttgctgaacctattcacattcgaatcctttcacttacataataaatgatttattctaatttataaatgctcagagcaattaattgtttaattaactctttggcagtttaatcgatttgaaaagaaaatgttttcatcgactccccattaattattttatcctaaaagttccacaaattgtgtcaagaaataaattcgactttgtttccatggtaatttaatggtgatttatccgagtggtgaaggaaggattttttattggatgattcgcttttaatttgtggagtgaatgatttgttaatgcgccaattaagctaatggaattgaagcaaagagaaggaatctcaacggagaatattaaagaaaacgatggaattttattatttttttttttggaaacgattgaaaaatgagataatccgacaaagttttggtggggaaaaacggaaaagcatttcaccccc

SEQ ID NO: 39062 - DNA, 898 bp, Heterodera glycines
tgccgaagggcgtggtcgactacgacaaaatttccccttatgtggtgcgttacaaagtcgatgacggtgaaggagcggcggactcagctgtcggtggaggcccgtggaaattcgtgagcaaggtgttgcactttgtagggaaggtggtgctcgagagtgacgactcgagaaaactcaagttttctcggtctcggggtcaactcttgggaggtattatgtcccgagtatcactggtggccagaggtttttggtgatgaaattcaccatttaaccgccatatttccttttcgggagtgcgacagactaccaatctgaaacttgaaaaagaaaaaaaaaattagtcaaaattttaggcaaaaactctcagagatgctcccggcattttggcttggagggttgaaagggtaccaataaggaaaattggaaatctaattcttgtcatttttggggttaaaattccaaaaaagaatgtaaactggggtccggcgatgccgtaggaaccaactggaatgcatttggttaagtaaattgatttttaaaaaaattttaaattaccactcttactgaaaaaatttttctcattcggcgggcggcaactgcccccgggcctgggagtacgtgtcctgcgtacccccatccctggtaccgtctctgtaatgtgtgtatatctcactccaactttcgaaattctgttctattatggcacaaattggcgccgtcggatccccaataattaatgcttatgatggtgccatttccagcgtcaacatgttgcagcgaaagaatatgaagacatttgcaagccattgtgccctggcacgtcatacaaaatttgcatttgggtggaggaccgccacggggaaccgcttcatactcataaactcaatgcgcggaccaa

SEQ ID NO: 39063 - DNA, 1024 bp, Heterodera glycines
  misc_feature (46)..(46): n is a, c, g, or t
  misc_feature (66)..(66): n is a, c, g, or t
  misc_feature (85)..(85): n is a, c, g, or t
gacccgaaatattgggaagtgaaatttatttatgcaaaattaattncaataaaacaaaatgtgttnagaaaaaaattctaataantatatattactactaattaccataaaaattcaaatcaaaaattcccctagcgaaatagttaaaaaagtatatataagatactgttctatatattataaaaaagggcaatagcggaaaaataaaacaagtaatcattaacttatagaaaaaacaaagaatattaaatgaatgtgatcttaagcatacacttaaattcaaaaaaaaaatgtgaaaaaattaatttaaaatgataacttttaaataaattcactgaatgaattattgattaatttgaaagtaaaagttaaaagccagaaaacaaatacaatcaattaatcgtaaattaaactcagtaaattgctcacataaaatataaattaagctggtatttggcattatgttaaataaatattaatatatttcaaccacacgcgagaaaaaaaaaaatttttattatatactcttaattattgatattttatataaaaataatatgtaaatcattaattgtaattaatatttattgagtatgaatttaaaatgatatgataatagaaaactaattcatgcaattaattatcgaaatttatttaattttctgttacttttaaaattaaaaaatttaatatttgtaattgaactttaaacaaaaaatatttaaattattcccacaataaaaattaaattttaattttcactttcatagcatgtcataataaataatttataaataagcttatatttgcaaaggaattcttcggttcagtggcgagtaattaagaaatttataaaatattaacaaatccgtaaagaatattacaaaagttgtttaaaaattcttattttttattaaaattggaaaaaattgatttttcgctaaaaataaaaaaccatttataaaactaaacaaactaaaagctgaaactaataaaatgaataacaaacaataaaataatgtaa

SEQ ID NO: 39064 - DNA, 1359 bp, Heterodera glycines
  misc_feature (76)..(76): n is a, c, g, or t
tgatcaattacaaattatttatggacgatcaaattttttaaattgtttatagatttttaaatgtttgcattttttntggcttaccaaaacttcatcgacctgggttctttctattctctttcaaatcgccccaaattttttttacagccacgaggccgcgaagcggccgagtgagtaccttgggcgcaggaaaattattaaggaggagggttcattatttatttatttttgcaaaattaattcataaatttttttcagaaactgctctgaaacgcaccaaaatttatttacaagttgaataaggcactctgactcttatattatcaaaaagggagatgaataaatattttaaaaatttctaattcctttttaaacaggccgaaaaagtttaggcttaactttttcagcgggtttaaaaaatctagaaaaattagtaagcatttgtagtgctccgatacgtatctctgcaaaatttggtgagccgctgatcaattacaaattatttatggacgatcaaattttttgaaatttttttaagtgcaaaagtggtgggtgtcttacagcttaactaggcccaattaagcttatttccagaaaatctcgcatgaattgtcatttttaaattttttatagatttttaaatatttggatatttttttggcttaccaaaacttcatcgaacctggctctttctattctcattcaaatcgctccaaattttttttacagcttaactaggcccaattaagcttatttccagaaaatctcgcatgaattctaatttttaaattttttatagatttttaaatgtttggatttttttttggcttaacaaaacttcatcgaacctggctatttctattctcattcaaatcgccccaaattttttttacagcttaactaggccctattaagcttatttccagaaaatctcgcatgaattctcattttaaaaattttttaattgctttttaaatatgccaaaaaatgtaggcttaacttttttagtgaaaattcgatcactcatattttttgctaattgagcagaagcgtaccaaactttgcagggatactccccggtaaaggactaacttacactgaaatgagcgccgagctagctggctcaaaaaaattttcgaaaatctgagtctttcgtttttatttattttttgcaaaattaattcttaaatattttttcagaaagggttctgaaacgcaccaaattttatttacatgttagtttaggcactctgatgctttttctatcaaaaagggagatgaataaaatttttaaaaatttttaattcctttttaaacaggccaaaaagtttaggcttaacttttttttcagaaactgat

SEQ ID NO: 39065 - DNA, 1035 bp, Heterodera glycines
ccggaattacggcaaaaaaatcattttgcaaatgatttttaattgttttagacaaagcctcatcctcgaatgtcgttgaattcgcgtctcagcaaccacactggcgacgaagttgttgacaatgagagtcattcgccggcggtggcgacgccgccggtgccgaaaagcaaaaagcgaaccgccgcctcgctcaagcagaacgacagcggcaacaacaagtcacttagcacattgattgaggcggccaaaatgatggagggcggctcttcatcggaagagcatcaccaggacggagtcagcatgcccaactcgccggcggggagcagtggttgaagttttcaatacctcggataaaactgacaattttgacgatgactgaaccggattatgcaggattttttctcaaattcgcttgcttcaagcgaggattctctcccttattttatttgtttccgttatccaaattttccattttatgctgcatcataaccttgaccaagtacagactataacttaaaaattgctttctttgatatgaacattgtttagccaaaccattgaaataaaacattgcttgactcttatcacagttttagtttttctatcacttgttaattaaaatatagtcaaaagattagcaaattcatcagttgttgacgctatgattgtggtctttgttgccggtgttcctccatttcgccactttcctcgagaaaagtaagagcgagtggaaggaacacgaaaatgaccaggactacggcgacaataagccaaacatctgtagaatatttgaaaaacagtttaattttgccgtgaaaagctcactcgatgaattgtcgggcacaccggcatcgacgaaatgaaaagcgcccccctcaagggaaggggagggcaaattctgtcgaacggtcgccacattccgatccgtctcatccaaaatgccctcaatcgcttccttcgcgtaggctgccaaactttcatcggagctccgcagcgcgtcgttttgtcgaccattgagtaaagcaccgaaatccc

SEQ ID NO: 39066 - DNA, 932 bp, Heterodera glycines
acatattcgctggaggcggtcatttgcgcgaccgctttgaactgtgccaaaaagcccttttggtgggcgacggatgagcgtctctccgtggcccaaatttggccaaaacaggtggcccagtcgctggcgtttcgcaccgcgcattggtttatctgctgaatgtgtgcacccgtgtgcagtccgctgggcccgaacagccccgacttggggtcaacgtcttaaatgaaatattgggaaaacgcattggaccgtaataaatgttaaaaaatcaacgaaaaaagggagggctaaatgctttgaatctacctaattaaatattgaaattccaaaaccggacctacgaccacaacgccaccattgtttgcgtagaaagggagggaaaggacggggagcagcgagagaatgagcactccgaccagcgccagcagaacattgtgccaaatgccggcgccaaaaatgcgcaacttttgagcacacgaacaacggtctgaaaataattaataatttgtaagcaataagtgggaaaagatccaaattaaaatattagaagttttttataagagaattttttaaaatttttctcactagtttttaaaatttttctaactattttttaaaattttatgaagatttactttgttattaaaaaaatacccaaaaattcgctgaagagggaatcgtagtgcaccttgttatttgtgcctcgaataatttatgccgaagacatttttaattgtcgcaaatggtcaaaaaaatatgaatcgcaaatgtttgaatgaaatcccggattaaaattggattggaactttagatacaaatgagaaactgacagacgacgcacccaattgttcgggttcgacctcagtgaaagcgccggggtaaatggcgaacagaaacacaccccaaccggtcacccgcacattggcgttggc

SEQ ID NO: 39067 - DNA, 1146 bp, Heterodera glycines
tgtccgctcggaagcagaattcaccgggtgcaagatgttttcttggacttcattttctggcctagcaactgaaagaattgagaagaaacgtcagaactcatgggggataaacgccgacttcgaattgggcaaaggcagtgcatcggctgttttcaggcacgggtttgggcctttcctgaacaatgttttttctctctctgttctctttatctctctctcaccgcgttgcaaaagtcgccctgacacacgcacgactccgtcctcagcagatcctccgcccgcttcgccactgtgtgatgcattgcgccggtgatcggtggcatcatacacgcgccagccgaccgtcgctccaccaaaggcacggacgaattgacgcagccgcgttccctctctttgctgcggtgattggtcacgaaggtgcaaagttcgcttgggaaagagtgccattctctgtttattctccgccaattggtcgcttaccccgtgcacgtcttcttctcccggcaatgggtcccttcacaaatgcaagtgaatctaaagggacacagacggatcagcagctgattgatcagtgccacatacaactgaatcggctccatttccgtctttcgcgacggacgcttattacagtaatcctttccgtcacagaaacacgtgaaaggctcctgacagttcaagcagttctttttttggttccgttccaccaattctctcgtcactctctgcacttttccttctctctcacctttccctctccgtccgccgtttcgcagtgcgacttcaccccacgacgaagcattgttccgctcagacagcctttgaccaatgtcggctctccccacacactcgtcccccaacgcggcgcataatacgactgaatggagcaccaatcacaagaacaagtcaagtcatggtaacgaggtttacagtgcctcacaaatataaattgattttggttggttttatgcgtacagaatgtttttgttcttttgcaattttgtttttcgaaacatcaatcggtcggagacttaacaactcccgaatcgcccaaatggctctttagttcttcgatttccgtaatgtgcaaaagccggaacccgtcagttgggccctcacgttgggccccagcaggtttttggactaact

SEQ ID NO: 39068 - DNA, 680 bp, Heterodera glycines
tgcataaaaatcaaaagaacagaaaggaaaacatacactgactcaacgccaacaattctttcgacgagcaaaaacaatttgtccgagtcgtttctgtccaacgcgtggcaaagcgacgaccgacggcaaaacaacgaaagctaaaacgttggcatgtgccatatttgtaataattggtttgtttctgtgtgtctgtcacctccgcattttccacactgtcttgcccaccctctgtcgcccccgggccattcattttcttttcgattgattgcacaaattggcggaggcgaaaagtgacgaaattggtgccgaacatttgctgttgttgctgtgcatcaaaatccgagcaaaaaaatgtgaaaatctgaagaaaaaaacaaatggtaggaatgagcgataggaaaaacgcaaagtgaaaaatttacagaatggacgtaacaattgaacaaagcgacaatcgactcgacggagagttcagcggacgaccgcaaaacggtggccatttgaaggaaacggcctaagggggggggggcaggggcgtatctagaaacatttttcgggggcggggacccgacctgaagacctttttctattaaattttcgtttggggggggaattcgaaaaaatttccattatttgctggaaaatttttaaaaattttcatttcggggggggggggg

SEQ ID NO: 39069 - DNA, 1640 bp, Heterodera glycines
  misc_feature (1423)..(1423): n is a, c, g, or t
  misc_feature (1430)..(1430): n is a, c, g, or t
  misc_feature (1439)..(1439): n is a, c, g, or t
  misc_feature (1501)..(1501): n is a, c, g, or t
cttttgccagaggcgaaaattctcaattgtaagtaacaaatatgtaagaagagacatgggagtgttaatggcattgtttgaagtttcccacggcatcgcccgaaacaaacgacggacggaccaacgaacgaatgatgcgggggtgggggagaggaggacaagcggagaccggccaagggacattaatattaaaataaattaattggatttgtaatttaaaaccgttaaaatttccaatttatttggcactgaactttttgccagatcaattgtcacttcgcaatttggatgatctcactttcattaagttgttgattctttcgtttattttttgtttgtttcccctttttttgtccgttttcctttcgttgcgccatcgccggtcaaagggtttggtgcccttaagggatttgtgtaattccttaggcgattaaccctctgacccctaattaactccccgccgccgcatcaaagggcggcagaattggtagtcggattcggatgattatgcgatggattgggcattaataatatttggggggagggaactcttttagacgaatgattgctttttgccatatgttttggttcattcccttctttgtttcgggaaacacaaccatctcttaagtggaattaaagcttacttgaattgtttataaagtcaatttatgcccttttaatcaatggatttccattggaatttccattttctctcattttcctcatattccctccccccgtccccctttttttgccaacttcgcccccggcccttttcccgtgccgtccgtccctttttccctttgcgcccattctgtgccactctctccgatgaatgaattgttttcgcgtcgtgccacaatcggatgagttgcaggacgacgaatcttccgccacaatgagttcattcagccaatgccgtcgaaagtgatgagaattatggcaatggtcggcgataagcaaaattggatggagagaaaaggggggagagggaattgggaaacattgtggcgacaagggattattatgccaaactcatttcgagtccatttaaatattattttggatttgaatgtttgagtaaatccctttcttccattgtctgtcttcgatctgttcttcttctgctgtccactctttcaacagattgccaatatttgcattaaattagtccgtccgtttgcctttgcgtggcggtaaatcccccgaagggacaaacaatgggcgtccgaaacaaaaggccaccgaatgacccgcgcccaattgagtccaatttcctttgtcactcagtggaagcttttcatgaaagaaaaatcccaaaaatgtccatgacaacggaaattgggagaaggaagggaaaataaaatggaaatggaaaaaatgatcaagggaaagaaaaaatggaaaaaagtgatcaggngaagaanaacgggaanaatgatcggggcgaaagaccctcccgcccccctcagaaatctctgtatgttgaatcaacccnttgcggcattgacaacgaatgagtgccatccccttccgacttccaattgcgtgcaaattgacgaaaatgggcagaaaaaggaacattaagacggaaaatgggggatgaaaaaggaaacggggaaaaagaaaagggaaaa

SEQ ID NO: 39070 - DNA, 1454 bp, Heterodera glycines
actgatgtacctcttctaatcacttttgtacctcttcccccgtggttgtacctcttctaatcactttgtacctcccgtggttgtaactctccagcattcgatttctatccttattttttaataaataaattccttattttatttaattttgaataatgttgtcctgtttcaataatgttgtacctcttcccccgtggttgtacatcttccccgttgttgtacctcttccccgttgttgtacctctgcccccgttgttgtacctcttccccgtggttgtacctcttcacccgttgttgtacctcttccccgtggttgtacctcttcccccgttgttgtacctcttccccgtggttgtacctcttcccccgttgttgtacctcttccccctggttgtacctcttcccccgttgttgtacctcttccccgtggttgtacctctgcccccgttgttgtacctcttccccgtggttgtacctcttccccgtggttgtaccccttcccccgttgttgtacctcttccccgtggttgtacctcttcccccgtggttgtacctcttcccccgtggttgtacctctttccccgttgtcgtacctcttccccgttgttgtacctcttccccgttgttgtacctcttccccgtggttgtacctcttcccccgtggttgtacctcttccccgtggttgtacctcttcccccgttgttgtacctcttccccgtggttgtacctcttcccccatggttgtacctcttccccatggttgtacctctttctccgtggttgtacctatatcccgttaaaatctcttaacaatccatagcttgttaattgcatttgcaaagtattatttcgatttatttacataaagagtaatttaaaaaccttccacaatgaagtaaagtaattatgaaaatgaaaaataactcgcaattatttataatgatgattgcacatcagtaggattatccaaatctattttttacttcacataatttgcatatttttttaaatatgcaattatttaaaattgtaattgatcatcagtaggattatccaaatctatttttcacttcatataatttgtatattatattaaataatgacgcagatatttaaaattgtaattgatcatcagtaggattatccaaatcaatttttcacttcatataatttgcatattatattaaataatgacgcagatatttaaaatgatgattgatcatcagtaggattatccaaatctattttttacttcacataatttgcatatttttttaaatatgatgcaattatttataatgatgattgcacatcagtaggattatccaaatctatttttcacttcatataatttgcatattatattaaataatgacgcagatatttaaaatgatgattgatcatcagtaggattatccaaatctattttttacttcacgataatttgcatatt

SEQ ID NO: 39071 - DNA, 624 bp, Heterodera glycines
  misc_feature (616)..(616): n is a, c, g, or t
cgcgagtttcgctgctcaactctcggtgtgcgcgagggggcggggcgtcgggaatgtgccgctcaaaatggctctagaggaaaaattcttttgccgttcggcttagggggtggtggatagatgtcctgtgaaatttaaagtcaatcggataaggggtgcgcgagttttgctgcgcaagtcttggggtgcgcgagggggcggggcgcgggaatgtgccgctcaaaatggagctagagaagaaattctttcgccgttcggctttgggggtggcgaattgacgtaccgtaaaatttgaggtcaatcggacaaggggtgcgcgagttttgctgttcaagtcttggggtgagcgagggggcggggcgttgggaatgtgccactcaaaatggcgctagagaaaaaattcttttgccgttcggcttaggagatggtggattgattgccccttaaatttggtgaaatcggacaagggttgcgcgagttttgctgcgcatgggggagggggcggggcgtcgtaaatgtattgctcaaaatggtgctagagactaaattctttcgccgttcagcttagggggtggtgaattgatgactgcaaaatttgaggtcaatcggaaaaggngtgtgcga

SEQ ID NO: 39072 - DNA, 1095 bp, Heterodera glycines
  misc_feature (958)..(958): n is a, c, g, or t
  misc_feature (973)..(973): n is a, c, g, or t
  misc_feature (1027)..(1027): n is a, c, g, or t
  misc_feature (1044)..(1044): n is a, c, g, or t
aaaaattgttattactccattcagagaagagatgaaaaaaaataaaaataggtttagagagccccgtgaacagctgcattggatgcaagtgccgccgttgctgtacgcctaacagttggtgagcaatgacggaaaattgcttaaaaaagaaaccaaacaaactcatcaattgttagctcccgttgacaaaccgaagggtacattggggcaatggatgttgggctaccgtatcagttattaaaatttttgtttttcaaaaaggatactaaaactgggataaccccattcagagacaagtcaaaaaaaaaataataggcttggactaccatactaattagaaattttagaatgtgtctgttaaatgcaaaactgttgtgaaaaattgttataactccattcagagaagagatagaaaaaaaataaaaataggtttagagagcccgtgaacagctgcatcggatgcaagtgccgccgttgctgtacgcctaacatttggtgagcaatgagggaaaattgcttaaaaaagaaaccaaacaaactcatcaattgttagctcccgttgacaaaccgaagggtacattggggcaatggatgttgggctaccgtatcagttattaaaattgttgtttttcaaaaaggatactaaaactgggataacccattcagagactagtcaaaaaaaataataataggcttggactaccatactaattagaatttttagaatgtgtctgttaaatgcaaaactgttgtgaaaaattgttataactccattcagagaagagatagaaaaaaaaaaaataggtttagagagcccatgaacagctgcatcggatgcaagtaccgccgttgctgtacgcctaacagttggtgagcaatgacggaaaattgcttaaaaaagaaaccaaacaaactcatcaattgttagctcccgttggcaaaccgaagggtacattgnggcaatggatgttgngctaccgtatcagttattaaaattgatgtttttcaaaaaggatactaaaactgngataccccattcagagnacagtcaaaaaaataataataggcttggactaccatactaattagaatttt

SEQ ID NO: 39073 - DNA, 1089 bp, Heterodera glycines
taattaatttaatgtccgcttcgctttgcgcttcgctcgtttctctccctcacggcactgctcgtcgtccgatgctccgccgatgagtcatcgtcgtctgaggaagagcaaaagcgtcccattagcgatgccgccgtgccatcgtcaagcaatgaaatgccgcaagttgtacctgctgcggttgctcgtcgaaagcgaagcattttcggtaatttctttgcggggcttttccatcgcaacaatgagacttcgacggaaggtcgtcgcccgtcgaacggcacagagtcagcggaagaagcggaaaaggtaaaggaaaaggaggaggagaaggaggaggaggaaaaggaggaggagaagaaggagaaggaggaggaagaaaaggaggagaagaaggaggaggaggaaaaggaggaggaggaaaaggaggagaagaagaaggagaaggaggaggaagaaaaggaggagaagaaggaggaggaagaaaaggaggaggagaaggaggaggatgaggaaaaggaggaggaaaaggagaaggacaatgcgactgatcagtccgccgttgggcgcgagaagcgcagcccatttggcattttcatgaaatacaaaaagaacggaaagcaattgagcattggtcaacacgcaacaaattaaaaggaataaattttaattgacttgtctaatttgataattagttttttaatgattgattattattttaaaaaaattaaacacacgaaaatatttccacaaataattcttctatttaattgtatataaatattacgaaaattgccattttaaaataaattatttgtgaatattttttttcgtaccacttgacggatttaagctaatttaaaaatgcgctagcattctctttaagttaaatattaatttttataattttcacatgtagcaaatttcgacattaagcaattttaaaatgccaccttaaatctaatcattggcgcttcgaaaagcctcaactttcaaaacccgatacaaaacttaaaccttagacgcgagaatctccagccattttatttatccaaagattatcccactatggtttttgacatttcttttatt

SEQ ID NO: 39074 - DNA, 1048 bp, Heterodera glycines
  misc_feature (989)..(990): n is a, c, g, or t
tctagagtcgttcgcgcagttcgattcccttttccattgctttacttttttgcttcttcttctccttcttctgctgccggtggagtcaatggcctaaaatttaataaaacaatttgaatgggataaacactttggatcaaaaagcaatactgaaaacctgtaaagctatttttagctcgaaaaagtttttgatcagtcattacttaactaattaattagagattggcacaatctaaagccggtagtaaaatcggaccggaaatcccgtaaaaagtcgggtccgagactttcacaaaattcccgagggagtcccattcaccccatagggctagtagtcaaattttggttgccagatttttaaaattggaataaaaatatatttaaaattccgtaaaaaataaaaatagaaaatccgtcttaaaaaaatttactcacccaatacaattgatgttgccgtttaaataaaaggaaatgctgttcaatttgttgttccaacctccccaccgaaccgccgccgtcccctcagaaattgagcatcgattcattatccatgagctaataataagctcctcatttcctccccattttttcttcaatgtcagcttttcgttggtccgtccgtttaccaattcaaatggctcaattgtcgttgggcttctcagtttaagaaaaatattgaaactgacagaagaatcggtggcacgaagaaatgcctaaaaacaatgccaaattgagcaaatcaaaaaaaagcaaatgcggcggaccaatttgctaggaaattttcgaaaagtttaaccaaaaacagacgaaaattattatttcagcaaatttgaaaaattgctttataactttgtgctaaatggccgttttcggaatgtgcatttacgacctccttgaagttgttgacccattccttcggttcctcataaatttggaaagccaattgcttcggccgtccatcggttgtcggatgtgcaccattcgaacanncgttggcatataatcttgcccattatatcaccagtatccctcgggaacagatcatgga

SEQ ID NO: 39075 - DNA, 1374 bp, Heterodera glycines
attttagtataaaaatgacttttttcttctcctctgcctcattccattcattcattcgtccatttccgttcattttgttgctgcaaatgtcttcagaaattctgtacgtttattatttctttttttctgatattttgcatttcttttgctcagtttttgatcaatttcgatattaaaatttcaaaaccaattttggatttcctcgctttgacctttcattgcttttcccttcctttttccattaattcatttccccaatttattttcagttggtgtgccgtgtttcttctgctgttgatcgtttgtgccaccattctttggttcttttttggctatgtcaaaaaacgacgacgccctcacaaaaaagaaatgtaaaattaaattaatcaaaaaatttgaaaatttgaaaattttcagctttatctgcagcgatggttgggttttggtgttcgattttcttgcgcttctcagctcggccttgaaattgcgctggtcaaccgtctctttgaccgcatcgtcgacgaacatttaaagacacgcaaatggaaattgggcaaaatgcgaattgccacacaattgaagagaatggcaccaagcaaatgcaaattgtcaattccgatggaaatccattaccaattccgcaaaatccgctgccgaacaaagtcaccggattccgaggcattcagatcaagtaaaatttcgattagattggaatttttcgtcatttctgattttcaggtacatcgatcaaaatgtcgtcacatttctccgccgttttcatcgtttttttgccgtttgttcaacggatttgtaccttaccacgggcaatggtcacattttggactttgttttgctcaacatttggccaatgtttcgccattcaatgcatgtgatgtttttgagttccatcgcttttcgtcgtctgcgccaattggccccgtcacttctcaacgattgtccatcacttcacactattttgtttgatggcgacattctccctgaatttccgcccgatgaaagtgccaatgcgtcggatggccaagcgcaaatggttgtttacgcctcgtccgaatggtatgcccaagtggctcagatgctttgtgaattctccggttggtcaatggtcgtcaacgatggaacagattaaagcggtgattatccctatttaatttgtttttctctaattttttttaatcccatttttaggcattccaatgcttcttctcctgttactttttacattgactttctgatgtcttctcagattgactcgttatgctatttgatcggatcaacgaagttactggagagaaattggcactggaacaagaagacacagatgtttggctcacgcgttgtccaattgtatgggat

SEQ ID NO: 39076 - DNA, 629 bp, Heterodera glycines
aaaggcacgaaaatcccgaaaaaggcaaaaaaaggcataataaaagtcaacatagaagcctcaaacaaagtggaaaatgcgttatttatgcttaatatatcgaaacaagtgcgcagaaaaaaaggcatatgcctcaaaatgcgagctctagtcataatttagactaattgaccaaattttttaataaaattattgataattttaaagattttttgaaaatttttgtgaaaacctttgagcttctgaagaaattctcgagaaaaacacagtaataatcattcacataattaattatccttttgaattttatatcattagaaagaggagacttcattggtataaaacgaaatttttttataatttatattaaaatttaaattttttgtgaattttttaattttacatggacgggacaaaatacattgggttggcaccacggatgaatttacgatttcttcccttagtttcatcgtatatatgatgtcggatatacgagggtcggttggtaattgaaacaaaatatacgacatcggacgttttgtccatgatggtacgatgatcgtatatacgacatcgggacgatgaattgaaacagaaatatacgacatcgctgtttttgattgaaacag

SEQ ID NO: 39077 - DNA, 352 bp, Heterodera glycines
tttctgaaaaaatatttaagaattaattttgcaaaaacttctaaaaacgaaagactcagattttcgaaaatttttttgcgccagctagctcggcgctcatttcagtgtaagttagtcctttaccggggagtatccctgcaaagtttggtacgcttctgctcaattagcaaaaaatatgagtgatcgaattttcactaaaaaagttaagcctacattttttggcatatttaaaaagcaattaaaaaatttttaaaatttaataattttcctgcaccgaaggtactcactcggcctcttcgcggcctcgtggtgggccttcgccccccccccccgcgtgcggatgaatgtattt

SEQ ID NO: 39078 - DNA, 994 bp, Heterodera glycines
tttccctgtaaaaaatggtgcgccccggggatgcccacggcaccttcccaatgggctgccgaagtgagacggccacttgtttccacgcatttgacacgtcggggccggagcggccacgctgagtccgcaccgccgtcgtccggcgaaggttgaagccttagaaaggcgcaaaactcagattggcatgacacgcgaacacaatgccaaatgccaattttgactcgcctctccagtgcccattccaactgagcacggcacattgaggcccgggaagcgacggccaaatcggcgctgcttatcaacacattgttggcatttgtcctgctgctcgttctgccgtacacattggggacgcacaacggcactgatgttgttgtggcacgtacggtgttcaaaatgagcgccaaattgcgacagaacgccaaatgctctcggcgtcggaggtcgcggctgagtgcgagcagtgcacaacggatgaactcgctgcgcacgaggaaatggtattgccacaagctctgaaaatgaattcccaaaatttttgaatccatggattcaaattcctgacatttcgatatgccggttccggcatttcttgaacccatgggcttccatttcccgacattttttggttcggctgccaattcccgacattcttgaatcgacgggttgaaattcccgacaattttttattcggcatgccgattcccgacacttttggattcatggactcccaattcccgaaatttgctgtgatcggtgccaattcgtgaaatttgaagcttcggattttaatttcccatttttcccggctgatcatatccgatttcgacatgccttcaggctgttcatgtgcaaatcgttgtcgtcgtccaccgccgccgtttcgccggcgtcgcaaagagtgcgcatttcgtcgcccacaaaattgaacaacaaactgtcccgttctttgctgaaaacgtgccaaaattgttaaatagacatttgaccaaag

SEQ ID NO: 39079 - DNA, 1001 bp, Heterodera glycines
cgtcctgtccaagccaatcttcgttccccattcagcagaagtgcttgatcattgtccctctgtcgatccgatgtcgtcttctgtccatccggtcactgcttgtgaaaaattcgcaaataatccgcagaaatgccaaaaacaaacgcagccaaacggggcacagcaaaacttccgctggtttctctcctatcgaatgttgaccgcctcaatgctttgcttgtgctttgcctccgtgcatatgatgaacggaaacatgggcatggcgatggtacggcggcccattggtctttgaaagacggggagacattccttccccacccattttaaaggtgtgtatggtggagaatggggggaccggaagaggaggcaatgggacgacggaggacggaggaaaggcacaaaacagcggacggaacggtgcacccaaggcgaaatggtcggccgaggtcggtttggtgccgagttggccattcattggcactcactgctcaggatcagggatggatcttcgccgcattcaatgccggactgttgtgcatgcttttgaccggttttatggccgacaaattcaatgccaaatgtccgttcgcttttcctcccccagcccaaatgcttctcgctcctccgctgttcagatatgatcatcgtcagtgtgctgctcgcttcccttgccaacattgtcattccgctgactgtcacttggcagtgagtcaacgaaatgccaaaaatggcaaattgtttcttcattttcttttttcagcgttggctttgccatcgctgcgcgtttctttgttggtttggccgaggcattgctgcacccggcaataaattctttggtctgtccatttttagaaaatgtcaaaaaatttggtacattttttgccaaattagcttttaattaaaacataacttacaactttgaacatttaccctccctttctttcttttactcctcccgttggtaatgaattctgaacgttcttacgccctcggctggccac

SEQ ID NO: 39080 - DNA, 1008 bp, Heterodera glycines
gcctgggtatcctttttaaaatcaagaacaaggggcgtgtgttaatgtggagcacggacagcagcagccaatgtctactgctacaccttacatagagaacaaaatagagccaaggtccacaaatcacacactgctgctgtgaatgtttctcaagtgtcgtctgctgacagtacagcatccaaaaatgtttcttccaatattaacagtgcaaaaccaaaaaagcaacaacagcacaacgactaccaagaactgattgattctttgactgtagcgtcaacattgctcccttcccaacccgaacagcatcctcccattattgcacaaacaatggatactcaacccatggactttgttgacacaatgtctgcaatgacgacatttcttccctcccagtctacaaccaactcggccccagttccaaaatctcagcagtcagaaactttggttgatgttttgtcggcagctgtcagctttctaccatcggaaggtgagaaaacaaaggagcaacagcatcaaacagatgatgatgtgtccaccgtaaaagcaaaccttgacgtaaaggaggaagattaagcaatagagtcaataatgaaacattaaactgattagatgtatttgtgtgcacgagtgtatataaagtagtaattttccgttatttgtaaccgtaaaaatgaacacttctacagcattcacagataaagacttgcaattaaaactgccttttggtatgataatttcgggtccctcatcatcgggaaaaagcacctttctcttaaaacttattgcggaatccaaagacttaattgatccatcaccggttgagattctctactgctttggtgaaatgagttctactgtcccggtgttgcaaaaggcaggcatatccgtgtatgctggagtcccaccagaagaatttattcgtcgccaatcaaagccgcttctgctcatccttgacgatctgttgacgtctatagatgagaagtatctgtcagaattgttcaccaaaaa

SEQ ID NO: 39081 - DNA, 1096 bp, Heterodera glycines
taggtgttgtcaatgtactgttagagtggcttatactgtcccaacgagccaaaagatgaacacagcaaagcggtgttgttgctgcatattgttccagtgatcaacaatgagaggcacgaaagtatctgcgtcgtagccatccaagtccattggtgctttcacctgcttcatgagctcaactgcatcatgatggagttgtccctgttgtccatgctggttattcaagtagcggccaaactgccatcgtggccatcctctggttttggcgatcattgttgctagtaaagcgtaaaacaagcaatagttgtcaccggtatgattgttaatcttgattaggcattgatcattgatgcgatgatggacagaagctatttttcggcgtgttcctcctttgacacgtcgtttaaattgaagtccggagcgatcgactgttgttattgtcaccgtgaacggatcaccccacagtgaaacgtttttctgttgtttactttgagccaccttcagaaacaaattgaggatggtgtcgatagtgttgtcggagatttttcgagtaggaattgttatagctccttccgacaaaagaggactgcttatcaaacatccaaggtgagttggctcgatttcatgttcacggctgtcttttgtagcactatcaatacaatgttgaaatattccagccaaaagcctctcggggttagaaggaacatccgaaatactgaagcgagatttcattttggtgtagtggaatttggcgacatgttcaacagaactacccaatttctgcacgtaatcctttggagcttcttttgaagatgatgtctctcctcctccttgttggacgacacccaaaatttgattgatgactaagccttggcggggctttttggagggaatatgatcaatacggtagttggaaggacgtttaggtgaacggttttccattgatatcgaattatattttaaaaattgctatggtgtgatggatggattttatatatttttataatgaaaatatatggggagcaatagaaattttcgttaaaaacacaataataaacagagaaactgaaaagaagaaagaaaatagtgtataaat

SEQ ID NO: 39082 - DNA, 765 bp, Heterodera glycines
  misc_feature (746)..(746): n is a, c, g, or t
cggaaaaaattttcaaaaaagtgttccgaaaaaaagagatagtcgtttttacatacgaatattgaaaagaaggcgtaaatggctctgaagcgtccataggccgcagaccacaaagtaaaatgggacaacattcataaaaaaggttggcctcaaaagggcccattcccaagctaatttcggaatttgctgataaaatcaaatagcctaaattatatacgcattataaaaaggaaatgacagaagcctcgaatgttagttatattgcgtgtcacaaaatctcttccggaaaaaattttcaaaaaagtgttccgaaaaaaagagatagtcgtttttacatacgaatattgaaaagaaggcgtaaatggctctgaagcatccataggccgcagaccacaacgtaaaatgggacaacattcataaaaaaaggttggcctcaaaagggcccattcccaagctaatttcggaatttgctgataaaatcaaatagcctaaattatatacgcattataaaaaggaaatgacagaagcctcgaatgttagttatattgcgtgtcacaaaatctcttccggaaaaaattttcaaaaaagtgttccgaaaaaaagagatagtcgtttttactacgaatattgaaaagaaggcgtaaatggctctgaagcgtccataggccgcagaccacaaagtaaatgggacaacattcataaaaaaggttggcctcaaaagggcccattcccaagctaatttcggnaatttgctgataaaatcaa

SEQ ID NO: 39083 - DNA, 1032 bp, Heterodera glycines
  misc_feature (46)..(46): n is a, c, g, or t
  misc_feature (879)..(879): n is a, c, g, or t
tgcgtttccttcacgcaaatattagttttagaaaaatcttattttntggggtcagaatcagtttttaggccattttgtcttattttgaaaaaaaaaaacttgggaactttgccattaagagaaaattgaattattatttttagtgtttttgcttttctgccgattggtgcagcaatgctcgggggctgaagcgcccaatctcccaatgcgtataatgacggacggcgcagtttgctggtattacgacaaatttggagcaaacgtcatcgttgaatgcccacactcaacaacaacaacgacgacaacaacaacgacgacaacaacaacgacgacaacaacaacgacgacaacgacaacaacaactccatcgcctccaaacaaagaacccacttctttggatgtggcaattgtggtcggcggctgtctggcggccattgctatcattgcgatagcggccgataacttgaggcgttttaaaaaaaagtaagctatggcttcccttaacatttttccaatcgacaagcgggcacaaaattaatgctgggcaaattaagcgattatttttagagggaatttatttattttttgtaaatttctgggagcaggcccttttcctctcccggttcgccacccccccccccccccccgaaatggtttcaaacctagaaactttttagtaaaaaaaatccttagaaatttcttaataagaaaagttcaagaaataaatttttgaaaaagttttcaccgatttttgaaaaaacttagtagttcatcataaacttttggaaaaatcgctgaaaaaattttcaaaatttttttttttaaattttcttacaaagaaatttcttaggaatttttttataaaaaatttagatttanaaattttttttgaaatttttttttgggggaacgacggggcggggggggggaggacgacttgctccctccccatataggtatgcatttttaatggattatttcagttttcaaaaagtattcgtttaattgattatcagattttgaacttttttt

SEQ ID NO: 39084 - DNA, 650 bp, Heterodera glycines
ttttttcaagtgtccgtttggggtactcaaacaattatggggagcaaaaatccaacgcagaattaaagtacagactatcgggaagctattcccgaaggattcggtctccccataaatctgggcgcatcggttcggggggactgccccgaaaacaaaaaaaatcgattttttcaagtgtccgtttggggtactcaaacaattatggggagcaaaaatccaacgcagaattaaagtacaagctatagggaagctattccggaaggattcggtctccccataaatctgggcgcatcggttcggggggactgccccgaaaacaaaaaaatcgattttttcaagagtccgtttggggtactcaaacaattatggggagcaaaaatccaacgcagaattaaagtacaggctatagggaagctattcccgaaggattcggtctccccataaatctgggcgcatcggttcagggggactgccccgaaaacaaaaaaaaaaaattttttcaagataaaaattgggctaaatgaactggggagataatatttaaaataggttatttctcttcctttcagtatccctgcaaagtttggtgcgcttctgaccagtttctgaaaaaaaagaggagcctcaactttttggcctgtttaaaaagg

SEQ ID NO: 39085 - DNA, 1539 bp, Heterodera glycines
ttttcaaaatataagcagcttttcctcattttgtagcaacacccgccgaaaaacgccactaccaattcgattggcttagttccaccgcccgcttcgtcctcctcagcttattccgcttccgcttcgtccgcttccgtttcttccgcttttgcgccccctccgttgccattttggctgttaccgtctttttctcaatctctcgcggccgctgctgctagtctgtcctcttccgctgcgtcttccgttgttgccacttctgctttccactctcatctgctacagtaccctctggtcggcaacagtcagtggctttttcagtccacaacacctaccgtacccccaccgctgaccggctgccacggaacatttccttgtgccaatggtactgtaccgtaacaaggatgtctactgtttgtcatcccatattttttcctaattcattataccgtattccttagtgttggttggactacgtttacttttcagtgtccccccccccccctccgtttttgctttttgtcttcaaattgtcccttttttgcgcagtttgaaattttaaattcattttttgaagtgcctttttcgttttcaaaggtgccaatgcgtccgtctcgcctttccctcctccgtcttcttcttcttccgcttttgcgtcgccttcgctttcttcggcgactctttcggcttcaaataatgaatttgtggaccgaagtaaagaataagcttatgtttgtttctcatcattcggctcattttatcttttaaatttccaaattaattaaaatttaagtcggcgagtcggcccgcaaccgttttggccgcccttacatttcgggacggccgctgctgttgtgcgaccggcagaaaatcatcaaaatgtaccgggagggacgccgaaagattgcaatcgcacgcgaaattggcgtcacacattcatgcgtttccaaagtgatcagaaggtaagtgagtgatcggagatgaccacggaagagaaaagacggccaattgagacggattcccgcagatttgaagagaccgggatgttggagagcaaaaactcgcggaccgcctcttgcgcatgccccggcgacgcggaagggcacggtgagcgattaaaggcaaattgggaattggcatttgcattaagccagctttttatccgtacattttttgtccttccttctttgattaaattttcttccgtcccttcgatttttgcaaattttactgttttaatccatttttttaaaccaaataaatccccgcttagacccgcgcatttgtcggcacgcccgcttcgtccatttcgccgcttcgtcctcctccacccaattgccttcgtacgaaatgaataaaatggcacccaacagaaaaccaatcattcgaagcgatttgccgaagaagttcagcatcgaatggtttttgatcacttgaattgcttagtaattaataacttattaactcaattaatttggcttattaaacgttaaattctttttttaggattctcagtgatcattgagcacctaccgtaagcat

SEQ ID NO: 39086 - DNA, 1248 bp, Heterodera glycines
tagacgggggacagttctcgacggggcccaacttggttgaggggggtcgggttgaagacgtggtcggggggcgaattggggaaggggtttcgggcgatagtgcggatgcgtgcagaagaggaggaagatgaaacagttcgactcatgtttcgacgttgtggagggaagtacgaacgattggaaaagggaggaggaggaggaacgaggggggaagggttcgacggagtgatgtcacgagagggggagcgggaacggtggatggggcggtgaagcggttgacgacgggactcaacgggcggtcccgcgggacggccgtggcggtttcccacatttgtcggttggcgcgccagcggcggctgattgttcggaacttcgccgtcggggggaggctggcttgagaccaactccccgaccctcggaatgtgataattgggcaggggattataaatttgccgaggaacttcgtcgtcgctttcgtggccggggggaggacgaattatgggacgtttagacatatcttctaaattgacaaaggcgtattgtgaagttaatggttggggggcagaaaaagggggaaggatgaagacatgcggaagggtaatcgtaggaggttggaagaggtgtgaaatgggaggggggctgatgattacgccgggggggaaaaccggggggcacacatgggcaatgcggggagcagaagccacgggcccttcggtgccaagatctggatgatctcctcccaagtccggggccggggcccgcccctcggatggaggagccaattgttcgaaacgacggtacaaggggacggagtggcggttctctgcatcgtccccgggtgaagagttacggggggagggggtgtaattagacggacttctcgacctcggtgctctgtaccgacttgttggggggaactcgacaacgatcagcgtctcaagcggaaaatagtcgtgatgaggtgcgccgcactgccagggcggaaacccattccgtatccgccgggcgcgacttcgggcggaagtgccccgcgttcccctgtgctggacgagtgctgggagttccggccgtgtcagaggtctgcgcagagctgcccaatgatcagcgactgaacgactgggcgcaacgagacgggaactggccgggaccgagtccatcttgtgccaaattacaacttggtcgccggagatgcggtggaggcgagtttggatacagcacttcttcggcctgttggcgtccatggtcact

SEQ ID NO: 39087 - DNA, 904 bp, Heterodera glycines
ggtatttaaccggctcacagaaaatgcgtcagtgatacaatctctttaaaaataaagtttctgtagcattatgtgttgtagtaatacaaaagttgttcgaattcggatccgtggttcggaattggcctaaatggatgccggattcatgtcagcgactcgaaaaacccacaggctaacttgttttatgacataaacttttgaaaaaaaatttcgaataagggaggctatagtattaccaattcagaacgaggtttttataatattttgaccttttgttctacaatacttaatgctaaaagcactttattttaaagtatttgtatcactgacgcattttccggttacatatttaatagggactgtattcgtgatttttagcctaaacacagatttagccaagtacaaattcatctggaaaaccgcaaaataaaataccgaattttaaatttgttcacagtttgaaattagaaaagttgggtacaaccagttaagtgaaagtttgaaaaaatcgagcaattttcttgcatttattttaaatctcattttcgatttacaaaaatttaagaccaacggaggaaaataacaaaataaaatgaatgaggggaaagaccaggagggagggaatgaccgtctatttatgggcgagtgacaacaacaaaatggcggggatttgaatagacagatcgccaatataattcaaataggctcatccgaacacctccccttttgagcggctcacggcgaagtacctttgtggggcacgtctattccgttgcgggtatcggcgtggctgaacttgctgatctgcttcttcggcactgaatttcgtcgttgtctgactgactcagatcattctcgagtcctgctcttggcgggaattggttgggctcatcctgagcttcca

SEQ ID NO: 39088 - DNA, 465 bp, Heterodera glycines
tgcatgcgctatgacgagctgcgcttcccatgccggcgccagggcggcgacggtagcagcggcacgttctgccaacactgccgcttcgtgttcccgaacgcgaactgctttgaggcgcaccgccggcgcgtggatgttccgccggcaccgcctccggccgccgccgccgccgccgccgctgctgtgcctcacggtggtgaggaagcaacgggtggagacggtgacgaccactgtttctttagttgctgctgttgacgcggctgtcgcgccagcgtttgcggaccgacgtcgcgggcggccccaccgttcaatgtgtgaggagaggcgcctgtgtgagtggtgcaatgtggttgtgtgtgcgcgaagcggtccgcacgtgtgtcgccgccgtccgcagcagcaacagcagcagcagcaggaggatcgcgcagttatgcagcagcaacagcagcagaaccaccacca

SEQ ID NO: 39089 - DNA, 967 bp, Heterodera glycines
  misc_feature (20)..(21): n is a, c, g, or t
taatataattaattttaccnnaataaattcacgtgacgatgcggaataataattaaacgtggaatcattgaattagcaaaaatactgtgttaattttcattgaaaagattgaattttatattagctgattttcaaaatcaaataatcctgctgaactcctgaaattattatttaatatatgtaattttttaattagtttatgctcaatggaatataaaatttttgcatgatgacattttatttttatgcttgcaaaaaataatttaattataatttttgtttgatttattaaaacattcttgtaacatattataattaattttaataggtccattcatttatttgaagctaaattatcctatttcctaatagatggcgaatttataatttcttgattaaaattgatatttaatttgtattgaatattgatctttagtttctttatataagttttattgttcaaaatcatatatcaaaatataaataatttaataaaaaatattttttatattaaatgatttatatttaaaaagaggttctatcattttatgcattacactaattcataaaattaattttatgtgtaaacaatatatattattcttatctaatatgcacaataaatatggctccttttatatatactttgattaataattattgtttttactttcatgccattttaagggaaacccattcacataactcttcaaaaaatataaaaaatattttgaattttgaacatattattattatttttttaatattgtttacataagcactgtttataataaattataaattatcaaaataaagaaaaaaaaacataatttttcgacatcataaatgattagacaaataatttattttaaatttttttaatgtttacgatatttattcttaaattcaatataaatcaacaaaaaatccagaaaacaatttcgaataatgtatgcaaagatctttt

SEQ ID NO: 39090 - DNA, 962 bp, Heterodera glycines
  misc_feature (868)..(868): n is a, c, g, or t
tctctgctatttcatttgctttttatctctgccttctctgttctctctctctttctctctctccctttctctctccctctcttttctctctatcatcgtgctttaatcattattttgccgcccccaccggtggcacaaaaaagaaaaaagtacacacactgatagcgcatttaaagcaactagacaaacagagtaaatggcaaaataacacagtgccagaggcggaaaagggcaggaaatagtgtgcatttttggggtgagtgaatgcgtatgtttttttctctgctgcccattgtcagcagcaacagctgcagcaggtgtcttctgtatgtcttacaattcaaaaacaaaaaattttctcaaattttccgccgccgccgcagggtataaatttcgctgctcggcgctgcgcccattgtgtctttttgcatattttatcaatgggccgaaggccaagcgccatccgtcccccccccccgggggaaaccgagaagaatttgtgattttggagggacatctgtggcgctttattctgctgatgtgctctgttgcgaaaaataggggagacaaagcaatctttgatttttttttttgatcattttccgttccttagggcaacgcaaaaaattatggtaatttttagagctaacattttgaaaaaaaaaccgggacctggattttcttcatatttgacctggatctgaatttcctggacaaaaatccaggtccaggaaaattccaggttgccgaaaaatggcctggacatggacctgggaacccaggaaaaatccaggcctatatgtatctaggcccaggtcgagcattttaatttataatttttttattcggttccataattgaaatttanatgggaaaagcattgacaaaaagtaagtatacatttattttatcaattgctaattagcctgaaaaagagtagtctaaagttctaaagcaaaaat

SEQ ID NO: 39091 - DNA, 989 bp, Heterodera glycines
caacatatgtccatgggcatggacaaaggcgaagcgactcaatgaccgaccaactcattaatataattgcagaaaaaaatgctattgagcacctgaacaataccaattgtgtggacagcagcaggacaacacattgttcaatgtgtgtgaattggaatggaataatggagaatcggcaattggttgttgggtgggtaaatgaataaatgaaaagaatggggaatatgtaatgattgatgacgacgatgcactcactgaactgagagggaaatggacgagaaaaaagttgccaaacatttaatgaaaatgatttaatttaccgaacccaaaaaatgcccaaaaagagagagagaattccttcgccaaaaaacaaaggaaacgaaaatgcgtaaaaatgtaattgttgttcatttgcactcaaaattctgattaatgtgacttttgcgacgaaatgtcacaaaatttgtgtgcattttggctaaggaaatgccattaacgagattggaagtggcgaaccgttcttcccgccccacccttcattaaattgacatgcttacaacggattaacacttggttgccgcgcgcaatcagtgaataatacacttaacgcatatcccaatttcatatcccacatcccttttcttgggcctattattctttgttcaatccaattccaaagtgggttaggagggaagggggagagagagagaggaaaaagagagagagagaggaaaaagagagagagagaggaaaaagagaggagagaggaaaaagagagagagaggaaaaagagaggagagaggaaaaagagagagagaggaaaaagagagagagagaggagaaagagagagagaggaaaagagagagagagagaggaaaagagagagagagaggaaaaagagagagagagagagaggaaaagagagagagaggaagagaggagagaggaaaagagatgagagagaagatatagcaggggaaaaacgcag

SEQ ID NO: 39092 - DNA, 1154 bp, Heterodera glycines
aaaatttgcgtaaattagtataataatttgatgtatacgattaatgtttgctaagtaaatttcgacataaatatcattggaggatggggggatacagtattaccatatcccccgacaatttgtttaccataccctccgccaaattttaagtagcatatgaaaatttggttcagccaatggactaccgtaccaccacacattggtgtgggaagaggtaccgtaacgcgtaccgtaaccccacccacaaataaatttcactgcccccgatgctaacacaacaaaacgaaaacgtacagcaggaggggcggcgggaggtggactcgccggcagcttagcagtagtcactgcctttttggcggtggtctttttgccctttgtcgccgtcgacgatggcacgggcgctttcttcgccgccggcgctggcggcggtggtgcggccactttgcgcgcgatggctttcggcgccttcttcggtgtcggctttttcactgccacttttttgaccgccgctggtgctggcacttttggactcgtcttttttggcaccgccgcgggcgctggaggcgccgctttcttcgcctttttgaccggacttttcttcttcgctggcgacgccttggccaacgttggctgcgtgccgtcgcccaatttgaaggagccggacgcgccgatgcctctgacctgtacacacaatattaaacggtaattaaacaggcattaaacatttattttcggaatttttgaataggcatgaaatctcgccgaaacattttttaacttttcgtagtggaagattttcaaaaaaaaagcaacaatgcgagactctaaaaatttgaagtttcgactttgtagcatcggtactattaccgaatgccattggctttgtgccatcattcatcatttctcacctgtttcaggtcgccggacgaaacgccccgcttcagtgcctgcttcagctgcatattggccttcaaaaaaaaaacgattgatttacacatttagccaaaaaaaaggcgcgccaatcaaatccattcttacgcgaagttggttgccgccgacgtcaaagttggacatgatgtacttcagaatggcacctttgctggcccccttcttctccttcaactcgccaagcgccttcttgatcatctgaaaaa

SEQ ID NO: 39093 - DNA, 985 bp, Heterodera glycines
  misc_feature (933)..(933): n is a, c, g, or t
  misc_feature (936)..(936): n is a, c, g, or t
gtgcgcaatcgccatttaatttcacagagaattttcctttttatcttatatccaagaaaaatgactatctcttattttgagaaattttatacgttacaaaagcgctcgagcgtgagagggagggcggtgcgcaatcgccatttaatttctcagagaatttttaaatttatcttatatccaagaaaaatgactatctcttattttgagaaattttatacgttacaaatgctctcgagcatgataggaagtgcggtgcgcaatcgccatttaatttcacagagaatttaaaaatttatcttatatccaagaaaaatgactatctcttattttgagaaattttatacgttacaaaagcgctcgagcgtgagagggagggcggtgcgcaatcgccatttaatttctcagagaatttttaaatttatcttatatccaagaaaaatgactatctcttattttgagaaattttatacgttacaaaagcgctcgagcgtgagagggagggcggtgcgcaatcgccatttaatttcacagagaatttttaaatttatctatatccaagaaaaatgactatctcttattttgagaaattttatacgttacaaatgctctcgagcatgataggaagtgcggtgcgcaatcgccatttaatttcacagagaatttttaaatttatcttatatccaagaaaaatgactatctcttattttgagaaattttatacgttacaaaagcgctcgagcgtgagagggagggcggtgcgcaatcgccatttaattcctcagagaatttttaaatttatcttatatccaagaaaaatgactatctcttattttgagaaattttatacgttacaaatgctctcgagcatgataggaagtgcggtgcgcaatcgccatttaatttcacagagaatttttaatttatcttatatcncangaaaatgactatctcttattttgagaaaatttatacgtacaaaagcgct

SEQ ID NO: 39094 - DNA, 924 bp, Heterodera glycines
aaaatattaccttccaaagggcttactctaattttcaaaacaaaaaaattcccaaccccataaattttttttatttgatttttcatataaattatatatatcattcgatcgtctcgatgagacaaatcgaatgaaagagtgacctgatcaagttgccgaaaagatttttttgatcaacatggaaattgattagcaagaattttcaggtctttcctacaaaaaatgtcaaaacattttgacgcttaatttttttctgttaaaatttcaaaaaagtttatgattataaacataaccttgacggtatatttaagaaattagaacaaaatttggtcactactccaagatttggaccctccaaattaaaacagttctgataaaacaaaacagatacaatccctgatctatatgttcaaaaaccctttttgttcgaaatcgagtccgggcttcgcagttgtcaaaatgaataccatattcatgattagcgacccagaaacccaaagaatatattttcataatattcaaacatagacaaaatttaaaaacccgactttgaaactttaatgatttaaacgaaagggtccgattttcccgcggctgaaaacccatttaaaataaacagaaatatttaaaaaaaattattaacaaattttacctaattcgttatgcactatcaaattgcagaacataaggcgaagaaattggggcagggtcgtttttgtacgagcacaaagaattcaaaaaaccagattttccaacttttttggctctaacttttttttaaactgaacaaaattttttggaattttgcaggctaatagagcatcttaagggctctcgaatgataccaagatcgttggattttggttggaaaataaaaaagttatagtcaaaaaacatgtgctcgtacgaaagcggcctggtccg

SEQ ID NO: 39095 - DNA, 547 bp, Heterodera glycines
aaacaggggaggaagtggaatgtaataaacgagacggaagtgggtgaatattctcgttttattgtatagacgaaattacattagtacaatgtctttgtagacaatcggacgtttatcaatgatcatgatcatcatcattcatcttcatttgttagtccactctgacccacctaaaagtatgtgaaaacaattttcgaaatgggaaaaacaacctaccctaactgcgctgaagacgctccgcgccgtaataactcaacgcatcccaaggtgcgaccggatggttctggacgacgatcaatggaccaccattgacgggctttgcaacagctttctccaactgttcatcacagtaaagaacgcagcattacctaacaatcatgttcaaaaatgatgtcgctgggcgaaagatatgtacccccccccccccctaaaaaatgtatgtccctgatagcctaaacagaattaaaattaagaaaatacagacttctagtttactaggaacattaattaagttgtttgaataattgactatttttcaaaaatttac

SEQ ID NO: 39096 - DNA, 950 bp, Heterodera glycines
ctgatttggcaatatatttggttttattttcagcataaaaaataataaaaattcgcataaattcaccgatttctaaatgtatgccgacaaccctcggggggtcagcaccaactctgcctgcgggcaaaatacagaatttgattggagcaaccccgcctgcgggcaaaatacagatttaaaggtgaaaagtgaggatcaaaatgtagtgatcaatcgacctgtgtggcgcataaacatgctgagccacctgaattcgaacttggaattatttggagaagagtcagtccacgcttttgatgattgggctgaccgatttaaggactatctgtcactaacagggaaaaattggaccgaagatgaaaaggtcactcgccttaagctggccctcaaggacacgccgagggaactattcaaagaactcaagtctaatcaaatcactacattcaccagcgctttggaagcactgagggccaaattggactcgcctcaaagacgagaagtggcgaagcggaccctttcagtttgccggcaacgtgaggacgaaactgttgcccaatttttgagacgtcttatgccattaattgactcaacaaatccttctctaacgggtgatttgcgcaaagaaaaaatttgtgaggaatttctgggcagattaagaccaaacatgagctttttgattcgtttggtcgggcttacgcaacccaaaaatttggaaatggtaaaggcccaagcagaggaacttgaggcacttcttctcagtactggaggcggtgttacgcaaatcacacaactcatcaattcaatgacggaacaacgcggaaatgaagaaccgaatgaacaaaacgaagaaaattcgaacaacaatggagcgacaatggtggggaattcagaaatgccacttcacatgacgcgcagtgctcgtacttagaaaacgaaggagtgaaggtaac

SEQ ID NO: 39097 - DNA, 1142 bp, Heterodera glycines
caatgattttttgaaaaacgaaacttctgactcaaaacacctcaacacctagagtagtgtcgtacaaactccgccattttcgctatggtgcgctcatttgccgagatcgtacgatctcaatgattattttgaaaagcgaaacttctgactcaaaacacctcaaaccctagagaagtgtcgttcaaactactccatttttgctatggtgcgctcatttgccgaaaacgtacgatcccaatgatttttttgaaaagcgaaacttctgactcaaaacacctcaaaccctagagtagtgtcgttcaacctccgccatttttgctatggtgcgctcttttgccgaaaacgtacgatcccaatgatttttttgaaaagcgaaacttctgactcaaaacacctcaaaccctagagaagtgtcgttcaacctccgccctttttgctatggtgcgctcttttgccgaaaacgtacgatcccaatgatttttttgaaaagcgaaacatctgactcaaaacacctcaaaccctagagaagtgtcgttcaacctccgccctttttgctatggtgcgctcttttgccgaaaacgtacgatcccaatgatttttttgaaaagcgaaacttctgactcaaaacacctcaaaccctagagaagtgtcgttcaacctccgccatttttgctatggtgcgctcttttgccgaaaacgtacgatcccaatgatttttttgaaaagcgaaacttctgactcaaaacacctcaaaccctagagaagtgtcgttcaacctccgccatttttgctatggtgcgctcatttgccgaaaacgtacgatcccaatgatttttttgaaaagcgaaacttctgactcaaaacacctcaaaccctagagtagtgtcgttcaacctccgccatttttactatggtgcgctcttttgccgaaaacgtacgatcccaatgatttttttgaaaagcgaaacttctgactcaaaacacctcaaaccctagagaagtgtcgttcaacctccgccatttttgctatggtgcgctcttttgccgaaacgtacgatcccaatgatttttttgaaagcgaaacttctgactcaaacacctcaaaccctagagaagtgtcgttcaaactacgccattttgct

SEQ ID NO: 39098 - DNA, 1072 bp, Heterodera glycines
  misc_feature (47)..(47): n is a, c, g, or t
ccatattttttttcaaaatttcatgaaattctatgctatttttgatncatatttgggcgcaaatctgtgtacaattacgctcaaatttttaatgtttttccggcgccacttaacggcaccgacggcggatcaataaaaacaaatttcttaacaaatcgcacctaaattcctagcgtaaccatcataattttttggataggaaaataataattagagggtttattgaaaaaatttttttgaaaaccctcataggatccgggtcctaaaagttgaacaggacccggaatcctgttaaaacaggaagttttgtacggagtcttgttctggtccgattttcgagtttttcttcaaaactccgggatcgttggagttaccaaaaaaaatagttatacgtttaatgggtttttcatccttttttctttcataacatttttattgctaaattttaaagatttgtattgacattgatgaatgtgaacaaaatgcgacaatttgtggtcagttcgcagaatgtcaaaacacaattgggtcatatcaggttcgtttttttggttcattaattaactcattaatgaattattatttcaaaatttcgtttttattaattaattaattaagtgtctgtgcaatgttggtttcattgcgagacctgacggccaaggctgcatcggtaaaaaaataaaataaaaaataatatcattttaattttctatttcatatttttgttgcgcaatgaatcaattttatttttttattttttttgttaatttcattaattaattatttatttggaaatcgtattccttaaaatacttttcaataccgtatttcataaaatacagtctcccacacaaattaggaccatccctcctataataaagcgccctattttcgagtaggggggggggtaaaaacgggtccacctcgtttcggcgccgctcgtttcggcgccagcccagtttttggactataacttttttctttttccaccaaatctaacattgttggtatcattcgagagcccttctgatgctcagatgttttgcataattacaaaaaatttgatcaattt

SEQ ID NO: 39099 - DNA, 733 bp, Heterodera glycines
  misc_feature (7)..(7): n is a, c, g, or t
cgaaacnttttcgccaagtacaagcaattgggctgtggtggacatggccatttggcaattggactgtctgatcacccctttctttctccctctctctctcctctccccatctctctctctctcttttcccctttgttcattacttttgagtctgatcagttcaacattttgaccctttccgatcatttatttccactctgatcagcagttcatttcccaatgtttccctcccatttaaccccccccccctccgatcattcttttttttgaccttcgttcatcctttccaaattgtccggcacttggggaattcgttcgtgcagcactttttggcgctcctccgcacgctgctgttgctgcaacttcaggtcctccgtggccttcagcatcaacagcttctgtaaaaggccctgaaggccattacgggcgatcccttcgcccgtcgaccctttggccgtcacttacgcgcagctttttcttccgctccggcgtcaggaagcccttcttggcctttttggccctgcccgcctcctccaatcgcttgcgcacctccgccttcttgcgctccctgtctgccttcagcacgcgcttcaaactttgtttgattgccatggttggctttaacttaccccccccccctttccgtacgcttgtccccccccattctctcaccttctcctccctctcttgatagattccactgactaaggaaaacgactatctgttaaccatc

SEQ ID NO: 39100 - DNA, 1130 bp, Heterodera glycines
  misc_feature (1025)..(1025): n is a, c, g, or t
ccattttgcatggtttttgtctgactttctcatggctctttacaggttgcactgatcacttatctgatggaggtgaagaaagtgaacggcccctatctgatcattgtgcagttgtcgaccatttggattgtctattaattgtgtgatactaaattctttttgacgtttagttgattcaacaacttaaagtggccatttgtccatacaaaataattcttattacacatttatataatgatattggatgtttattgtttgttttcgttgctaataattttttgttttcaattaaattggaatggatcaactgactgaaggtggggaacgtgcccaaattaacgccgacaccggtcaacgagtatgttttaagaaggatgccattttggttgaaagttaaacctaggcgcttattgctttgggtttggtcgattcgttgtaatttagtgcgagacgcgaagcacgaaatttgtgttgtgggcacgacgtcaaattggacagacatcaacgccgctgaaccatttgaaagggccgttggactctcagacccgtttgaagttgaccgttacgaaatgtttgcacaataaaaacaatacattaaaaaaaatacttgctcatatcaaaattcttttcattacagtcgcttcgcagccgagctcgacatcactttggatagccattcattgacttatttggcttctcagtcaaactctctgaccggaggcggtacatcgcgtgcttgataattttataatttttgtccagacattaagcgtatcattcaactgtcacgtaatgaaggcgattcccgaaaagtgtctgtcgatttgaacattgttgacgagacgagaagtattgcttttttctgttcatttgtaattatgttcaatcacagtgacatatttgagcggatcgaacgtggccttggaaataattttgtcattgccggacagatggctggcgggtgagacttgtcttaatgttataaacttgagtgtgaacaatcaattaagtgctccacgaagtgnggcacgcgtactattcactgctgaacccccacgccaagaaaatgagctttgtcacgtgcgaacctttgttttggaaagcttggacatgtaagttaactgacacga

SEQ ID NO: 39101 - DNA, 911 bp, Heterodera glycines
  misc_feature (701)..(701): n is a, c, g, or t
aaaaaaattttttgggtaaaaattatttaaatgaactgactagataatatttaaaataggttatttctcttcctttcagtatccctgcaaagtttggtgcgcttctgatcagtttctgaattaaaaaagttaagcctaaactttttggcctgtttaaaaaggaattaaaaatttttaaaaattttattcatctccctttttgatagaaaaagcatcagagtgcctaaactaacatgtaaataaaatttggtgcgtttcagaaccctttctgaaaaaatatttaagaattaattttgcaaaaaataaataaaaacgaaagactcagattttcgaaaatttttttgagccagctagctcggcgctcatttcagtgtaagttagtcctttaccggggagtatccctgcaaagtttggtacgcttctgctcaattagcaaaaaatataagtgatcgaattttcactaaaaagttaagcctaaactttttggcctgtttaaaaaggaattaaaaatttttaaaaattttattcatctccctttttgatagaaaaagcatcagagtgcctaatctaacatgtaaataaaatttggtgcgtttcagaaccctttctgaaaaaatatttaagaattaattttgcaaaaaataaataaaaacgaaagactcagattttcgaaaatttttttgagccagctagctcggcgntcatttcagtgtaagttagtcctttaccggggagtatccctgcaaagtttggtacgcttctgctcaattagcaaaaaatatgagtgatcgaattttcactaaaaaagttaagcctacattttttggcatatttaaaaagcaattaaaaaatttttaaaatttaataattttcctgcaccgaaggtactcactcggcctcttcgcggcctc

SEQ ID NO: 39102 - DNA, 1122 bp, Heterodera glycines
cccggacaaatgttctcacctcttttctcttcgtttttaatgtccctttagttttcgactagcccggacagaaatttaaaatgtcagacttctttacttgcgtgtacacgtctttgtttctagccctcatgccagggagatctcccacaaacttctgccggcttacccaattctcagcttcgtcgtcaatgatgggtcgtcgtttcccaaaatgggaaccatccggtgctaccagtgagggatgcgcactgtgcacccagaccaactatgcaccgtttatctcggatggagtttgggagggaatggggaaaagccaaggcgcctttgaccaagccccgaacccccaaacgactcattgactgttaaagatgtgtttattcattcgatgttggatttgaacgaagtgagaaatcggaataataattgaagtctgttccatcacaactaccgactaactgatcactggggaaggagaaatgtgaagagaatgggcggagaaacattacaatgagaaaaggaaaaacgtgtgaaaaggataaatgtgattgaattgataatggctaatgggaaataattaaatgagggaaatgcgtcgaataatccttacaacttcccccttcccttaggatcgtccccgatccttaaatgaaaaatgaagtgaaagtgaatgaatggaccaaactctcggcttcgcccttcgtctctccaatccgaacttccacggccaagctgcgcacaaaattttttacaggacaggatccggcaggattaatcctgcaaatcctgcaatcctgcaaatcctgcatttaaaatctgcaggatcctgcgcaggattgcggattttaggaaatttcaaaaaattctgtattaataaaaaaaagtccttcaaagtataaaaaagtgttcaaatatatttttaaaccaaaaactgatgaagatgaaaaaattaataagagaaattgacatcaggaatagaattgtgtaaaaagatcaacatttcggccgtttctggggagatatttgaccgacggtagtcatatacgtctcttgccacactaaaaagctgttcactggaaatgcttgtgcatggtggtgccaaataacgacacgcaatctttgaaa

SEQ ID NO: 39103 - DNA, 944 bp, Heterodera glycines
cagtttgatgcgctgttacgccgtcctcacatttttcgaggtgtttttttttgtaaaaatgccacgattcgattgtctctcatccattcaatgtccgttttatcttcctattcctgctgctgttcagcttgacaatcgcggcaaccatttcctccccgtctaacgttctctgcccaatgttcccgccgtcgcgttgtgccgtcgcccatttgtcctttcgtcgcctcccaatcagatcatcttcggttttccaggcatttttttattgcaattttttgaaattttcattagccttcgcgtgggtgacattgtgtcggtggtggaaattattgagacggaatgtgatgaaaaatggatgcgcgggaaattgacggtgccgtctaatgacagtgaggagaggccaaacgacaacagccgaagggtgagtgccgtcattgatcatgctagaagaatgggtactgtaatttctgtaatttagaagggggcgggggcttaaagagaccaaattttgggatacagtacccttatttcaccatcccgcttatacagtatcattctgttatttctttggtatataatcgtatcccccccccttccctcccctctttggcgttagtttggcatttttcccgcccattgcgtccgtttgttttccgaccgtctttcattgggagaacagctttggatggcttcaaattccgctgcgtcgacaacggcacattcgcttgtgcgccgatcgttggcttcgttttcgccatgccaacgcccaaatggagccatcggcagcccctctctgttcagctatgctttgatcaggcattttttgataagaaaaaaaggaaaaacccaaggaaacggcgggccagccccatttgagtaccaaaaacaatcttttgcctttcaggtccttcatcgtacgacttttcaaacatgcttcttcttct

SEQ ID NO: 39104 - DNA, 923 bp, Heterodera glycines
aaattttaaaaaaaattttcaaaaaaatcgctggaagttttttatttttttcccttgaattttctaagaataatttttaaagattttttcatgaaatttttttaaattttttccaggatgtgttatgtctcggctgtgtttctgcggctgtgttttggggtgcaccgggggggggggggatcatcacctaattttatgaaggggataagtcatgtaaatcgccgacaatagcgcactttttccaaaacttttggagacaagggagatgcgatgccgataggcgccgtcggtgaattagaaagtttgggtgtaatttgttaaaagattttcaccaaaaactgctagattttcgcttttgagctaataaagggaaaaggggaatcaaagtgcgcatggattgggatttaacattcccagctgtaagtcggagaacgtcttaaaagatataccattggatagagcagatccaactgcaaagttggggaattaataaaaataaacaaaactggcaatagactttacggtttttgaggccccataactttctcatttcttaatatgggcaggtatgtatttatatacgttttccgacttgcatgttcccttgtgagttgccaggaagcctaaccctgggcttgggccgccccggggaaatgccttagcaattgctcgcgcgtgctatgcatcagcaatgcgtgtccgttgtgcaccgggttgcgcaattggaaggcgaatacgcagtcactctgtcgcgcggcaaattcgcgtcggagttccgcaggcgtttttctgtacgcgtccaatccgtccccatagacaattcgttcaaaaacctaaagaatacgggaaaagaaatggtcggatataggcggatccaacatgaacttctccgcccagcagccaatcgccgctgtccaaatctg

SEQ ID NO: 39105 - DNA, 919 bp, Heterodera glycines
  misc_feature (855)..(855): n is a, c, g, or t
tttcgcgcgagtgcctgctttttagcattagaattgttcagaagtatatgtatattgagggtgaccaagttttttttttcaaattcaggataaagaacactaaaattcagattattgcaaaacaagggatcagcggccaattttccaattttgcgaaggggtctccggccatgtaaattaatgtaaatcaatgaccttttttgctttcaacaccgcttttttcgcggcacgtttttctcaagacttttggggaacaaggagggccggcggtgccgataggcgccgccgggaaaaattttgtattttttaattcgatttgttaacagaatttgtaaaaaaagacaaattgattaatttttgggtttttaggatgcttaaaatgaaagaaaaaaagttggaatattttttttaattaaaatttcaattaaaataatggtaaagaaaatatgaagaatattctatcccagtggggaattgtacccaagcgagaaataataaaatcagaaggtttagccacttgaccacttatgcatatgaacaaatgctttaaatgaaaataaataatttaattttttttttctcaaaaaatttctccttcttcaccattccctactcttttctcacccagacccccattcttaccagtgcaaatttttaccggcggtaccggtactagacaaaccggtaccgatactttgatttttgaaaaaaccggtaccggtaccaaaaaacccggtaattaccggtcggtaccggtaccgctcaaccctactatatttagctatttttgagattttttgagattttttgcttaaatttaacaaatttgaagaatttgtaaaattttgcccttanattggaaaaatttatatgcatatttttcactttttatgtgcatataattggatgccctactgat

SEQ ID NO: 39106 - DNA, 1514 bp, Heterodera glycines
tgccatgtcaattttagggcaatggccgtgccaatcttttattttagggcaatggcagtgccaatgtcaatgttttgagcaatggccgtgccaatgtcaatgttttgagcaatggcagtgccaatgtcaaattttagggcaatggccgtgccaatgtcaatgttttgagcaatggaagtgccaatgtcaaattttagggcaatggccgtgccaatgtcaaattttagggcaatggccgtgccaatttcaaattttagggcaatggccgtgccaatgtcaaattttagggcaatggccgtgccaatgtcaaattttagggcaatggccgtgccaatgtcaatgttttgagcaatggcagtgccaatgtcaatgttttgagcaatggccgtgccaatgtcaaattttagggcaatggccgtgccaatgtcaaattttagggcaatggccgtgccaatgtcaatgttttgagcaatggccgtgccaatgtcaatgttttgagcaatggcagtgccaatgtcaaattttagggcaatggccgtgccaatttcaaattttagggcaatggccgtgccaatgtcaaattttagggcaatggccgtgccaatgtcaaattttagggcaatggccgtgccaatgtcaatgttttgagcaatggcagtgccaatgtcaaattttagggcaatggccgtgccaatgtcaatgttttgagcaatgacagtgccaatgtcaatgttttgagcaatggcagtgccaatgtcaaattttagggcaatggccgtgccaatgtcaatgttttgagcaatggccgtgccaatgtcaatgttttgagcaatggcagtgccaatgtcaaattttagggcaatggccgtgcctatgccccggcgactgacccttcagcaatttgcgtctgtcccgtttggcactgtcaaattacaaaatgtttaaaaatcattgagtgtttgaggaatcaaccataacagatcaatgtacgaataagatgttgtcgatcggtcgagcattttcacattggcgtggagggggcggagagtggccacaaatgagcgacaactgtacaccgtattaggacgacaactgtggtctgtacaatcggcgagtgactaccgtactcgctaatgacccaccgtatgcgcacaggtccaaatacaatcctttgccaatttccttaaattttaaatttttaacttttttttgccgttctttccgtgccattgcctacctactcacccttaagtaatgcttgtcgctgatggcatgccgattgatgaaatcgcggcagtgcagctcaaacaccacgtccttcggcagcaatgcttttggctcgtaaaatcggatgagtcggccgaatatttctgtgagtgtccgccgttgtttgtcaaattgtccaaatccccccccccattcgcttaccctcaaattttcccattgcgaagctgtctttctcgatgttttttgtgtgtgcccaaatgtccatgatattccgtctccattgtctg

SEQ ID NO: 39107 - DNA, 1021 bp, Heterodera glycines
ttttatgacaatattaatttaatatctatatgaaaatcttttttatgcataaacaatattagttggataacaaaaaaaaataaattaaataaaaaataatgccaaaaagagtcatggtatgaacagcatcggaaagaaattgatttgaaaaaattgtaagtcgtttttaataaatagggagactgagagagataatatgggagagagagagatgagaggaaagaagattgataaagggaaagataaattttttgagcacatttcttcatagcttacattcagaaaaaatatataaatctgtatattttataaccctatttataaaggaagagacattcccaaaaattcattatgattcgtattaatctcattatattaccgtatggaggcttttgagtttattattagttttaaaagaaaattattcgcaaatcgatttatttatgaaatcaataaatttaaaattcatatatttttggaaaaattttcaagtattaaaaaatattaaatcattttttggtttaatttaattttacttgtatacttctctcaaaagaaacatgctaactaccgtaatttaataagaatagtcaatttatgtaatttatttattaaaatttaattattatttaatagttgtttgcattaaaatttttgattattagttctctttcttagcttacttttctcgcccattctcctcctttctcccattcttttcttcggtccctctccgtttgtctcttctcatttgtcttacttttctcactcaattactcttcttctctttttgggtcggggtcggtttagtacgagcgcaagtttttggctataacttttttctttgccaacaaaatccaacatttttagtatcgttcgatagccctaagtgtcctctattaatctgaaaaattgcgaaaaattttgttaagcttcaaaaaagttatggccagaaaaactcaaaaaaccagattttcaaactatgttggctcaaactttttttaaacttaataaaattttt

SEQ ID NO: 39108 - DNA, 1350 bp, Heterodera glycines
gaaaatggcaccgaattaggcaaatggcgaacaaaatgggtccatcgaattcaacctgtacaattattggataaaaaaattggttgatgaacaacatgaagaaattgaaagaattcaaagtaatttcaattattatacagtttgacatggcggcctttaaaaaatttttgaattcaccagggattttatgtgaatattttttcgggaattttcaccccgatccgagacttttatatcctcgaataacggtgatgaaacaagattaaaaaaattaaaaaattaatgccaggattgattttgtgtgaatgttgtgaatgttttgtcgggaaaatttatcaccgatccatgacttttctctcccaatgtcggggatgaaatctaagttaaaaaaattaatacccggatttatgtgaatattttgtcgggatttttctccccaatccgtgacttttatctccccgaataacggggaagaaccctaaaaaaaaattgttatgaaaattctataaaaaaatttataaaataaagtagtttgttattcaaaactcgaaaatagggacagtcatagaaattttaggcatttgggaagctctgctcttaaatttttaaaattaatttacaattaaaaacaaattatttaaaaatagtttttttatgcattgaaaaagatgatttaaaaatcgcaaaagcgcaacaaattggaataaaaatggcatttatggcaattataatggatttttggtgcaatattagccgaatattttggtataatgagaaaaaaattcggcaacgaattgagcaattattaagcaaaattaaaggcaaaaaattagatgatatcgcaaaagcaatggtcaacatcaatgtggatgaagacgaaaatcaaaaaggcaaaaatgtaaaattaaatattatgtaaattaattttaattaattttaaaatataaaatttgaaaaaattcatttaccgggccagggttttgtctctcttttaaatttgtataaattatactaattttcaagttagtttgatttaaataaatcagactacaaaatttattttatttttcaatttttaaagtttttaatttgccaaaattagaaaaacaaaaataaaattagccaaattatttaaaaaaattttttattaatgaatgtcaatccgatttatgttcttttagttgaaagaattgttattgtgggagaacggacccgagaacatgtcaatttatagagcactaacaatctgcattaaaaatgccatctctgaattcaataaaaggttaattaagcaaaaagtgtaaaaaataaaataaattatattcgatttaaataaattttacggtaatt

SEQ ID NO: 39109 - DNA, 882 bp, Heterodera glycines
cgccgttcgtcagttgtccatttgttgcagaacgtccgtcttttcattgagcaagcggaaaaatttgaaaaggaattgtccatggagaaggaaacgccgaaattggcacgggcaaacgcgcgactgcgcaagttggaccaatgttttgtgaacccgacgatgggtttggcacgagaagagccggagaagtaaggggacgatttggggaggggaggggagtctttttgaatgcttgtccatattttcgatcatcacattggtcccacatttctttgttttatttcgctttttccccatttttttgtcaggcgccacgtgctcttttcaatggccaaaggtgactcttaccaagtggacgtgatggccgcagttcagcagaaggtaaatgtacacaccaatcagcttcggttccattgcctctgattatttgctcaaataaattaattggccgactttttgggaaaatttgaaattcattcggttggcttttgttacgacagattgtgcaattggcgaatgccaaaagtgagaagcaaagggccaacagaggacgcgaattggcattggaactgacagtcattcagcaggccacgctttgtgcggtgagaacactcagagagacaatttgagcagcgaaagaatggcgaagaaacagacaaataaatgaccctaattaactaattaatggaaagtgacacattttgagatggaattgctgacgattgagaggcttttagccacaaatatttattccagtggataccctcgactaatttcactttctttccctttccgatcattttcaccgatcaaaaggatttgcccttttatttaataatccgtcaaaaaacccatttttattcaaatgttttgattggtttt

SEQ ID NO: 39110 - DNA, 1213 bp, Heterodera glycines
  misc_feature (35)..(35): n is a, c, g, or t
gatgcagccaggcgcgcaaattacccactctcacngcgaggaggtagtgacgagaaataacgagaccgatctcttatgaggccggtcatcggaatgggtacaatttaaaccctttaacgagtatctatgagagggcaagtctggtgccaccagccgcggtaattccagctctcaaaatgcatagaattattgctgcggttaaaaagctcgtagttggatctgtgctagccgtccggtgcacactttgtgtgttactggttcggttggcttttctgccggtctctccccggcgttggcctttaccggtcggcgtcggtgggctggcgagtttactttgaacaaatcagagtgcttcaaacaggcgtttcgcttgaatgttcgtgcatggaataatagaagaggatttcggtccgattttattggttttgctgaccgagataatggttaacagagacaaacggggccattcgtattgctacgtgagaggtgaaattcttggaccgtagcaagacggactacagcgaaagcatttggcaagaatgtcttcattaatcaagaacgaaagtcagaggttcgaaggcgatcagataccgccctagttctgaccgtaaacgatgccaactagcgatccgccggcggatttattcgccctggtggggagcttcccggaaacgaaagtcttccggttccgggggaagtatggttgcaaagctgaaacttaaggaattgacggaagggcaccaccaggagtggagcctgcggcttaatttgactcaacacggggaaactcacccggcccggacaccgtaaggattgacagattgatagctttttcatgattcggtggatggtggtgcatggccgttcttagatcgtggagcgatttgtctggtttattccgataacgagcgagactctagcctactaaatagttggctcattgcttctgtgggcacaacttcttagagggattttcggcgctcagccgcacgaaattgagcaataacaggtctgtgatgcccttagatgcccggggctgcacgcgcgctacactggcaaaatccgcgtgcttgtccttccccgaaaggggttgttaaaccggtgaaaatttgccttgattgggatcggacattgctattattgtccgtgaacgaggaattccttgcaggggcgagtcctcaactcgctctgaatacgtccctgccctttgtac

SEQ ID NO: 39111 - DNA, 1122 bp, Heterodera glycines
  misc_feature (122)..(122): n is a, c, g, or t
tgatgagaattaaatttaaataaaaaaatttatggtaaaaagaaaatgatggaaaatttaactcctgaaaatgtacaaccgttaattgagcggaaaaatggaaaactttgcaagaaaatgtntagtgaaattggcgtcaacaaattagcaggcaataatttttcttattcgtttttttaaattttttattttgtttctatttataagattttaattttaaataattttttattagaaagatagatgttaaatttaattttttttttaatttttagatttgctggatgaatcaattttcaaaaagatttttgaaaattttttggaaaaacattgggaaccccaaagcatggagaagcaatgcttggaatatttaggcacaattacattatttgccagagcaattcaagcaaaaatgaattttattgaacaaatgtcgaaacattgggcaaataaatcggtgaatggaattgccaaaaaatgggaacattttatttttaatcaaaatattgtattcgaattcgaacagtttgtacaaatcaaattgtattttttgcaaaatcagcttgatgaatacgcttttgagttaatattaataattcacaaattaattcattaaattacaattaattttatttgctttttacgtagttaaaaggtttttttaattaaaaatattattatttaagtaaattattaattttgtctaatctattttatttaatccaatttatttttattcaggcaatcaataaattttgttgaaaattttattcaaataattgacgaaaatgagacagacaaaatcaaaaattatgggaattattcacctcaatcaccaaatgatcaccaaacaacccaatttggcacatataattctgatgaattcaatgcaatttttgccacattggaaatgcatgaatgttcgatgctaattgcaaaaggagtgatcaattttgaaatgatcaaacaaataaaattggcccattatttaaacggtgaaacattttcaaatgcgggaaatccgccgcccaaaaaatgcttgtgtgttgatgctaaaattgagcagcaatatgtcaacaagctgcagaaaatgctgaatcagaaaaaattgggtaatttttt

SEQ ID NO: 39112 - DNA, 1838 bp, Heterodera glycines
  misc_feature (160)..(160): n is a, c, g, or t
  misc_feature (338)..(338): n is a, c, g, or t
ggcattaggtaattaattattaagggatgcgtttaaattgggaataaaaagaataaataataattaatggtcgaaatcaaacaatattttttcttcctttatctttatcatattttttagttccgttcaccttttttattttttgatttgggtctgtttnttcgcttcttttcagtttttttaaaaatttaatggtatcattttgccaatatttttttattgaaatgttttgtccacctccgtctccatgtgttgcgatatgcttgtggtggtagccgaacggcacaggcgaccgcccatctgctggtggttgttaggtctggcactgtttccgaccncagtgccaagccaacagtcctcctcgaagaagatgccgctttcgggcgagcctatcgcatcgctcccggttactgtatgctcagtactgtactgctggcccgcctcagcctcatcagtttcgtccgtggagtcctcatgctcggtccacagtcgcttttcctcggccaatttggcacggtttgcacggcactccttcttgtccatttctgtcctcgacagttcacaagcgaactgaaataggacgaaaatggaattgaatatgataagcatttttggatcggaggttatcatgaattttcccaccgaaatgattaaaaaaaagagtcaattttagcccacctgttggatgagttgtcgtgaaagtgcgttctgttcggatgccagcaattcgcgcacaacacgctccaagttggacaacgactcgtcattgttcgggaacatcaaatactgcttgatcttcggcagtgtccggcacagttggagccttaaaattattgaaattaaaattagtaaaaaattacaaaaaaggtgtaataaagacaaaatacgaatgatggaggggggggggattttcactgaatattttttagcaatttgcatttttaaactaataaaaaagggaacaagcataaaatttgaaaagaatcaattatagtattaattctaacagaatctaacatttttagtttttttaattttttttatttgtgtgctgtaaatgtacagtataccaaccgtatgtttgagattgggtcagcggacagtttgagcaccgcgggcaaaaatttgtcgataaaaaattcacggctgaagtactgtagaagcaacggtacaatgtccaacaaaaggcgccggcgatagcaactcgaatggtggccaatgtcatggacgaaaaagtcgacgatggtttgccgggcgcgacttgtcgcgaactcgcgcatcatcaacaacaatgtttgggcagcagcaattcgacaaggtaaggcacgctgaaaaaaatatcgtaaattatttaaaaaaatatatattctatttaaaaaaagtcgaaatatttctttttggaaaaaaggatttatatttctttaaattttataaagatatgaagaaataaaattaaaaaataatttgttaattaagacatttttaatgataaatttttttaagcacgagtaattatttttgtatttcttattgaaaaaaacgatttaattgggtactcaattaataaataatttatttggcaattaccgcggttagcacttcctgcttgagcaatggcacaaagttggacagcaaatccttggtgctgaccaaatttcgcaacactgcaatgccattcaaatacgcctcgtgggctcgccatgagccggtggaccctttcatcaaattgttgcaactgaccaaaatgcgatccaatttagcaaatatcaaatgctaaaaaggggaaaataattaataaaagggaaaaaatattgaaagaaaagaatttcaattgtaat

SEQ ID NO: 39113 - DNA, 1112 bp, Heterodera glycines
cttctgttccccaaaagttttttttgaaaaagagcgccgcaaaaaatggtggtcaaattcgatgttgagacgagttcgcaaaaatttcggttaaaccccacccttttccacgtatttttaagccagggcttccatcgaaaatttttaaatattaaccaagccagaaaaataagattttagtattaaaaatatgaacattttgcaacatgtttctaatcagttatttttataatttagatcaaattttatatttttagtctcctattatcaatttgggtaattttggggaggaaagtgcaacattataaatttcagtaaattcgggatcaaaagatcaaaaaaattttgcggcagaccttaaaatttcttgaaaaatagtgacattatgccatataatttcaaaactataagtatatttaagaaatcagaataattttagtcgctacacaaaaatcagaacattcttaaaaataagaacaaatggaagccctggtttttaggccaactttgactcattcttactggcgctaacgaaatcagatgattaaagtgaaaaaaggaagatttacgagcatttaaaaagaaaattggtttttgggttaaaataaaatttggtcattccccgatcggggtccccgaccccctacaattgtgctcctccccgccccgacccccaacatgtcgccccccgacattttgccccccgccgaggggtcgggaagcaaccctaattcaaattgtcaatgtggttatcccccagcgccccccccccgccgaaagtcgggccataatcagcaattactcgatgcagtcgaggatagtgagtcgatagaagattgctgttgctgaaagcgctgcctaaatcggttaaattgttgttgatgcagcggagtggtgccaatcggatgttgcggaatgttattggccggcgaagaagaattagaatggacggagttccaaaaattacgcgctgactgcgcaagcggtgcagtgccaggaggcgatttcaaacgtggattagggtccagaggagatggggactttccatagtcaacggattgagatttgggtcgatcctggggcaattgttggcgcagtctctgacaatgagt

SEQ ID NO: 39114 - DNA, 1068 bp, Heterodera glycines
ttggtatcattcgaaagctgtaaatctcctctattagcctgcaaaattttgaaaaattatgtaatggttcaaaaaattatggcccgaacaactcaaaaaaccagattttccaacttttatggccataaatttgttcaaaattgacgaaattttttggaatttgcaggctaatagagcatctgaagggctttcgaatgataccaataatgtttgatttggatgacaaagaaaaaaagttatagtccaaaaacatgctggggcccaactgacatagaccggacggcggggggggggggggcgagcggcactttgcccaataaaatgtcattttttgatttttcgttcgaattccctatggttggccatgcttttcttctctcggcacttcccattggatctgttgatcattgcttttgctctttcagtttgattattggttgaacaatgcttttttactttacttccgttcccttttttctttgtgtccctctcttttcccctctttttccaattgtttattcccattttatgtatgtttatcaatcaatagaattttccaattatttcgatatcaatttccccgtgaattttgcatacaaagcacacctttgccaatttactaattgacaagcaaagccccggccaaattcatccttaattagtgttgtaattatgtgctaatcgtcgtccccatgcgctttgtccctttcttcttcttctgccgctgtgcttgtccttctcatccgcttgccttctctgttcagttctgccaattcaaagtccgattttgtcttccctttcgttttcgcattttctcctccattttttgtgattttaacagaattcggcccttttgattggcacctctcaacaccaaagataattccactttggccataatcgctgggcaacaaattggaggcaattgacgagagtgaaaggcgaagcgatgtttagcgcgtgggcagtgcccttttggtgggggagttccttaaattggcatctgtcccacctcaagatcagaaatctctccgtttattggcaggacaataagctctagaggtcccc

SEQ ID NO: 39115 - DNA, 1398 bp, Heterodera glycines
tgtattctttattaaaattaaaaataatattcattgatatttaataataataatttccatttaaatttaattaattttacattattacacaatttgattttcactttcacgatgtcggatacgcggacatcacatcacgcaaattgaattgaaacagaattacatcatattcacgatttttcgtcgtatttacgatttttctcccatcttataaaagatgatcctaaatacgatgagacgtcgtgaaatgatgggaattgaaacaaaattttacacgatatgacgtcatatcggagatacgacgggaattgaaataggcccctggtatcgtttgaaagtacttgaaaaaagatataactgcaaatatagaatttttttgttcatgtacaaaataatcaaggtaaaatagttcgaaaaactatgtttttgattttttttttctctttttaataaatgaccaagtgaaaaaaggttggctctattgcactttatgaggacaaccgattcgaaagcacaaagatttcatcgtttaggcaattgccaaaaaaattcattaattaaataattggtttctcggttttttggatctcgagtctcgtggtcaaatctcggtctcccggctaggttctaaagtctcctgagaattttgaccctctagcagccctagagcttagaaatcctaaaatccatttattcatcatccaaatacaatacaatgataaaatgaaaatgtctccccagaatttcttcccattcccatccttttcaattcttcaaaaggtccctgtccccgtcatttttcaaccaccaagcattcatttttcagtcatcccttcgtccacctcccccccccccccgtacattctcattcattcataaaaatgggtggtgcggaatttattgatcgtcggcggatccgtccgtccatccgtccggcgcggcggcggcggtgtccgtgcgaggccgcgatgagcagtgagtgccctgctctgctggagtggtgctgctggtagtggtggtgattttgatctgtgtgtgtgtgtgtgtgtgcggaaaatgaagatgatgaacggcgaaagtattgggactgaagcggccgggcgcacttggaattggtcgatcgtcgtttcagtttccccgttttttgggccaaaaaaaccaaaatttatagaaatttttcgttttcccccctccccgcccccgacatctctgaaaatatgactgactcctcatacatcctgctctcgatcccatacattttacgactcattcttggcgggacgcaatcgaccagataccaaattcaccggcggtccccgcggattgagtggtgcccccccgtccccctcccgctttttgagtgggtggtgaaatgagggtccggcccgcgggaggggg

SEQ ID NO: 39116 - DNA, 642 bp, Heterodera glycines
aagcattgttgctttgattttctaaaaattgttttcatttcgccgtcccctttaggaaggtgtgccaagaaatgtctccaaaagtgccgttttcccaagaatcaaggcgccctttttgggcacattttttgaattttctacgcgggggcggggcggacgcagagcggctgatgaagttgtacatggaccaactggtgatgcttgaccacccggtggacgaacatgacgcgttccatctgaaaaccgcgttggagtgggttaaatgggcgccaaattccagtgcaaaatggtgtcacttttcctttcaggtgctatggcaagtggaaattcgaaatcggcgcccgtgtcaaccaccggtgtgtgtctgaataatcaaatgggggggtattctatctttataagcaaattattatacattacgacaaaattttgtaaaaggatctgcgattttaaaagtgaataatttaaaatcaaacttttcctcggcggtgtctacaaaatgcttaattttccttataaattggtttagaactttttccttttcccctactatttcctttatcagttctttggaatgctcacattgttctctcgaattgattccgtcgaccattgaaccgcacaaattcaacgaattgcgcg

SEQ ID NO: 39117 - DNA, 998 bp, Heterodera glycines
ctctttccttcccccccccccccactttttctctgctttttgggacaaaacaggaaaagatccttcccttcttccatattctcagtcagtccgtccgatcggccccccccccctcctcctccgcttctttcccttagggccttcttcgctctcaaactttgtggctttccgcagccggtggcgtggggatgtacgcccccatggagcggagggtgcagcattcgttgcctctccgttctttttcgtcccctcgcccatctaccgattttatcgaactttgccatctccatcggggtgacgaacacttccccccctccccaaagatccgtcctattttttctcctatttttgtcaatttttaaatgagcagcacataaattctcgaaaaaacaccattttacaacggtcaaaatatgcaacattcgcacaaactgtggacgcacaaaaaataacaacgaaaacaatattgatcagatcagctcggagagattctcagaaaacgatatttagtacagtttaaagtcgatttgctctttttaaaattattagactgcgttcatttcaatgattaatgtttcgacaaaaaaattgtcggagagcaacggatgcctttccctttcaaggctatcgtccccgccgggtgtcggcatgaagacattggttctgtctgtcccgtttttttgacagctcacaaaagcttatttttaatgcgatttgctaacagaatctgtccaaaaaatgacaaaattttgattttttgagcaaattttgcaagaaaattaaatatttttagggtccggcggtgccgataggcgccgccaggaaatttttaaaaatttcagtttaatttattaaaagaaattattaaaattataaattttttgaaaaaaaaatttgaaaaaatttgcgaaaatttccgacttttcaccaaaaatttcggaagtcggaattccgacgtccaaaattttttcggaaatcggaattccgtgccatccctg

SEQ ID NO: 39118 - DNA, 714 bp, Heterodera glycines
atactctctctcttctttcgctgtctgcgctctcactgaaactaatgcagagacgctaaaatttgtttttattttagtgtttctatgtaaaaaacttttgcatggcaaaaatgtttaaatttaacttttacactttaattatttaattttttcttgcagagcaaatgaaaattattgtacgaaaaaaaatggcagcaagatcttcgcatgcagaccggccataaaccattgtctgatgagggttcgtgtccctttacggaaaacttggatacagtattggaggaaatttgcaagcagaaaaacaaaacttcagtatgccaaactggagatgactggaaagcacgcgctaaaagtattattactaaagtgggtacgttgtcaatacctcctattgaagcgtatgttgataaaacccgtaaacaggtatgaattgcaaacaaaaccaatttagtgtattcttatatttctaatttaagcttggagctatgcgaatgttgcaacggcacttgctatagttaaaaaccgatacgcatgaaaactcttcaagaaaaagataaacttaaatctaatgaaagtttaaaaaactgcgcacaattctccaaattcttttcactcgacaagaaaaataaattaaaatagacaattacgagttgatttcaagagaataaaatttaaaacaaaagtttaaatggtccttcataatacaaaatctaa

SEQ ID NO: 39119 - DNA, 1088 bp, Heterodera glycines
ggaatttctttctgggcgagtttgattgtgaaaattttggaaaaacgcctatctctttttctgctcaacactctagacaattccaaccccatttacggaatgatagcgccaaccctaatttttccggaacggaatttctttctgggcgagtttgattttgaaaattttggaaaaacgcctatctctttttctgctcaacactctagacaattccaaccccatttacggaataatagcgccaaccctaatttttccggaatttctttctgggcgagtttgattgtgaaaattttggaaaaacgcctatctctttttctgctcaacactctagacaattccaaccccatttacggaataatagcgccaaccctaatttttccggaatttctttctgggcgagtttgattgtgaaaattttggaaaaacgcctatctctttttctgctcaacactctagacaattccaaccccatttacggaatgatagcgccaaccctaatttttccggaacggaatttctttctgggcgagtttgattttgaaaattttggaaaaacgcctatctctttttctgctcaacactctagacaattccaaccccatttacggaataatagcgccaaccctaatttttccggaatttctttctgggcgagtttgattgtgaaaattttggaaaaacgcctatctctttttctgctcaacactctagacaattccaaccccatttacggaatgatagcgccaaccctaatttttccggaacggaatttctttctgggcgagtttgattttgaaaattttggaaaaacgcctatctctttttctgctcaacactctagacaattccaaccccatttacggaatgatagcgccaaccctaatttttccggaatttctttctgggcgagtttgattgtgaaaattttggaaaaacgcctatctctttttctgctcaacactctagacaattccaaccccatttacggaataatagcgccaaccctaatttttccggaaattctttctgggcgagtttgattgtgaaaatttagaaaaaacgctatctctttttctgctcaacactct

SEQ ID NO: 39120 - DNA, 1266 bp, Heterodera glycines
ttaaattaaaattaaaatgtcaaagaatccatattttggcttcttctccttgctatcatcaaacaatcatcaattcattgctgattgtgagcaatttcttcaagcagttttggcattccttttatggtcgtcgttggaccatccgaaagtgttgccaattctgaggaattgaacggatggccaacaagctgaataattttaaaaaataaataaacaaatttgaaaattcaaaaattaaccgcgtttaaatatgaggggtcccacacgcgcgtgtaaaagtaggagaacagaaggccgggcaaagacacaacgcaaaagtaggcaattacagtcagacagcgaatccaactgaacaaaaacaataaataaaagatttactgaaatttttcaaagatttagtaaatatttttttacattgagtcacggcacgccattttcaggggacaaacaaaattacagagggttggccaatttggccagcaaaatgaaaagttgggatgggcatgggttggatgggccatcgatttgcaagtttcaatttcccaattcccccccccccccattaaaatggctgtccttccgtctttttcgtcaattacttccttttaccgtttccaattttcccatttaattgcgcaataaaatcaaattttctcaaaaaaacttcattatattaaatgccattgttaaattgaatgacattaaattttgccagttcttttcttctgttttttgtcttcaaaattagtccctgaattttgcttttttttcttttaaagtggccgggggaaaggacaaaaaggtcaaaaaaggtccattaaaactgaatttcctacgtctgcaactctttgttcttccgtcctccgcgcaccccaaaaccgtaagtgaacggccgcgagcgtcgcggttggccgccgctataataaaaaacggtcgacgcgttggagcgcagcgttgcggaggagtgaagcggacgatgcgacggaggcgccccgccgaggggacatttgccgctgttacggatgcacggcggatgaacagaagcggaagaagcggtggcataaggcggcgcagtgttcggcacaaccgatgccaccgccggattagcggaggccgaggagctgccaaaggacggcgaagtggacgaattgcgcatgacgggagatcaaagagtgaagaaaattgttgaatgattgaaggaataatttatgtataaacacccaggaagttttaggttaaaaaaagccaaaattaattaattaatta

SEQ ID NO: 39121 - DNA, 1110 bp, Heterodera glycines
actgccccgaaaacaaaaaaatcgatttttcaagtgtcgtttggggtactcaaacatttatggggagcaagaatccaacgcacgaattaaagtacagactatagggaagctattcccgaaggattcggtctctccataaatctgggcgcatcggttcggggggactgccccgaaaacaaaaaaatcgattttttcaagtgagtgtccgtttggggtactcaaacaattatggggagcaaaaatccaacgcagaattaaagtacaggctatagggaagctattccggaaggattcggtctccccataaatctgggcgcatcggttcggggagactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacatttatggggagcaaaaatccaacgcagaattaaagtacagactatagggaagctattcccgaaggattcggtctccccataaatctgggcgcatcggttcggggggactgccccgaaaacaaaaaaatcgattttttcaagtgtccgtttggggtactcaaacatttatggggagcaaaaatccaacgcagaattaaagtacagactatagggaagctattcccgaaggattcggtctccccataaatctgggcgcatcggttcagggggactgccccgaaaacccaaaaaaaaattttttggataaaaattatttaaatgaactgactagataatatttaaaataggttatttctcttcctttcagtatccctgcaaagtttggtgcgcttctgatcagtttctgaaaaaaaagttaagcctaaactttttggcctgtttaaaaaggaattaaaaatttttaaaaattttattcatctcccatgttgatagaaaaagcatcagagtgcctaaactaccagtgagagaaaatttggtgcgtttcagaaccctttctg

SEQ ID NO: 39122 - DNA, 925 bp, Heterodera glycines
  misc_feature (842)..(842): n is a, c, g, or t
ccggtatttcccgaaactatgagatgcgaccctagtctcacccatgttgttattgttaaatttatgcattttttacatcctatttatgaatgggaaattaaaaaatgataaaattttggttcgattagttagtcataagtttttctaattgaatctgacgcttgtacaagaactcgtacgaaaatgtcccccgtacgaaaacggcggtacgaaaacgtcccccgtacgaaaacggcggtacgaaaacgtcccccgcacaaaaacggcggtacgaaaacggcggtacgaaaatggcggtacgaaaacgtccctgaccgatcattttcagtctgtccgttgaatacgaccatacgtattcacggcagccgttgtagtttggcatcaattcacccgccccatcaccaaaatcaaaatttgtatacaattttcccaatccctaggggtttttctcctacccctgcaatacggtagaacaatatcaaaaatttcagtgctggacctttcgccactggaatgagagtttgcagatgccccttttgtagaagtctgtgccattctttgaggcgaggtactgccccaccgcctcctcgaccttggcatgttcttttatgtttctaccccataaggaatttttgagagaaagactttagcggtaattttagtctatagggaccagcgggtggggtatcacgccctagcagttgttttccatagagttagggccaatgaaatttggtgccaattggggtcttggccataactaaaaattgaaggaaaacttctttcgaattttttgtaatacataacatagttaagattttaagagctcattttcaactttnaaatatgtaaaaccgaacggactaattactagggctgccaaagtatgcaaatgcatatttttttcctggcttctcatgctcta

SEQ ID NO: 39123 - DNA, 1000 bp, Heterodera glycines
  misc_feature (834)..(834): n is a, c, g, or t
  misc_feature (881)..(881): n is a, c, g, or t
ggtcttgtaagcgagggacaattggggtgctactttgaaaccatttttcttcaaaacaaatcatttaatctcttcaggggtatattttccggtttttaagcatttttataaaatccaaaaagccaaaatattgaaaaaaaagttgaaatattttcgtataatattttatttatgaaagttcaaaataagacgtcaaaataaaatattttcggctaaaaattatgtttttttgagcatttctcatcaaaataaagcttcagaaaaaatatattaaataacctatttattattaaattaaatctaaacattttgtgcatattttatttcaaaagcatttttagcaaaaaatttaagttttaaaattctgatttctttatttctgcatgggtatatttttggttttttaagtatttttgtaaaatccaaaaaagccaaaatactgaaaaaaagataaaaatattttcgtataatattttatttacggaactcaatttaagtttaaaattcttatttttaaaattcatattaaattgatttctttatttctgcatttattctatttattatataaaatatttataaaaacttcgcttaaaaccatgcaaaaatacaactaagcacgttcagcagttttcttgttgcttcggttttcgaaggtggataaaaatgaataataatttttttataaaaatatctaattataagtaataaaaataaatgaaaatcaatcgttggttgtgccgttcttggctcgtgaaggtgtatcaatcacatggctggagcatggacggacgacttctccattccgctcatggatggtggtaatggaggggntatggaggggtcgatggggcatcttctggcaatattaaccccacaanaatacaaaaatagcacatggtgcacaatcattctttcacattcattttcctattttcgtccatcatttttcattcatttttctttgaaataactttcattcattacataattaattgac

SEQ ID NO: 39124 - DNA, 807 bp, Heterodera glycines
  misc_feature (70)..(70): n is a, c, g, or t
ctctagtctcggctctaccaatacactcagcacgatatttaccatttaatagttgaaaaaaattattgangaaaaaatgggtatgtcttttttctcttggggatttgaccgcaaacttggtaccaacatttgccttctctagtctggctctaccaaacactcacacgatatttgaaatgctaacgaaaaaaattcttgccgaaaaaatggctatctcttttttctcctggggatttgaccgcaaacttggtaccaacattttccttctctagtctggctctaccaaacactcacacgatatttgaaatgctaacgaaaaaaattcttgcccaaaaaatggctatctcttttttctcttggggatttgaccgcaaacttggtaccaacattactacataaggcacctatctttttttttttttggtagcctacagtacccttttggggggcgtgcgccggggggggggcgcggtcggcgtcgcgggggggggacgcggtcgtcgtcgtcgtcgtcgtctgtgggggggggggacgcgggcggcggctgtcgcttggggggggggggcggctgcgacgcgtcgggcgggcgggcggcgctctgctgtgtgcggttggtggcggcggcgtctcttgcggcgtacgcttgagctacgcgtccgaggcgtacgcattgattttttttttttttggggggggggttgacgctttggggggcgtgcgccggtgagggggcgagtggcggcggcggcgctggtggcgtacgccctgtcgaagcgcctgctaccggtggcgtgagcgtacgcctcc

SEQ ID NO: 39125 - DNA, 1268 bp, Heterodera glycines
  misc_feature (31)..(31): n is a, c, g, or t
ttggcgatgacgcgtggttcacgtcggatanggactctctcctcctcctcttctctttctggtcgccaaactcaaaaaagcgatcgttgaaaatctctgcattctcgggtatgttcacccgacgagccgagaagaaaggaccttctcgaaagggaataggcatttcccttatgtttgaaaaaaatgtggttgggtgggaaagctcccaccccttttatacaatcatccatcacgtaaatcacgtgatcagactttgaattgaaaattttcgatgaatcattcgtgtgagttcgtgatgactcatgtttgaagaattttttcgtggtggggaagatgagacgtgattccgcattaccacatccgaaggatcctccccccgccaagtacagtattaacaatactgtaacaagattgtgctctcctctcatcagagaccaggaaattaatttccaaagtctatagaagggtgaaattttaatgaagatgatgaggcaaataatgcctacaccaataatcattaagaatgttaaggatgattggaggccaattaaggaccaaagtgtggccttccaatcaaaattccaattcagccaatttgaatggccgatttgttttttggaaagattagaattaaaatcttccaattgttgatactggacataatgcaatgttccagcaatttcaaatgatgtttttcctgccaaacattttgtttggcacttagtttgaattctggctttatcgaaagccaaaattgtttggtaaattgtggcgttggaatcacattttgtggaaaaatgtgttccatcgtcgcatgtaatttcagcaagtgcattgccaaagttggttgagcacacatacttaaattgtgctccggttgaacagctgtaacagccagaaatgttcaatggcaaaattgtgcaaagactttggtgtaattccaaagccatttgaagaccttcgatctgaaggttcaattgaacaggactaaatcctgtcaaagcgagaatttttcgcccaccgtttctcagttgataatttttgatgtttaatggaagtcttcgctcaggactttccattaatttttccagattgtgtgaacggcaattgcagttcactaatcctcccgagtgatcgggtaggcaatctgtgcatgcttgtaagccaagactgcaattgaattcaattgcttcttggcgatttctgcacttgaagtcaatttctatgggaggtctcgttaaggccattgtgttcccgtcataaacaaa

SEQ ID NO: 39126 - DNA, 1030 bp, Heterodera glycines
ttttatttaggttgaaaatgcgcttaaattttcaccaaatgttgggccaatttgtttgttcggcctcggttgacttaatcaataaataatgaatatgcgttttaatgttttttttcttttccattaagatgcatccggaaacgacaaatttggcacattttcaccattaattaattcccaatttattattgctggttggggcttaactcagccaatgtgccaaaaatatccaactccaaaactaagtgaccaattaatggttggcaaaatgcgaatgatttcaatggaaaaatgcattgaatatactagcaaagatagcaacaaagaatgtaaaaaataaataaattatggaaaaatgaattaattatttcatttagtcactaatttgtctaatgtccttccttttgtgaacaacacccgtgctttgttaactgaatttaattcagcacatttgaaggacaaactttgcgtgatagctgaacccagcttggctgagaaggtgtatttggaaatacgccattactcaattaatcaataaaactcaaggattaaaacacattagtgaattaaatgtaaaaattctcgaaatgaatttcggaaaatgctcttctttttatgaataaaacactttcgctgcacaaagaatttattatcgaaaactcgaaagataaaatttgtgtgatacctgaacccagcttggcggaaaagttacaataaacatcattaacattacttaaatcacttaatcataatttttttttcagggagacagcggtggccctttgatgtttaaaactggcaaaaataataattgggcacaagtgggcgtcgctagcacatcgacgtgtaacccggaaaagcccaaaagcaccgacggtcttacaagtaattatttctataaaaaaatttgtatcattatataaattatttttagtccaaaaagtttagatttcgtaaccaaaacaaaaaaatgtataatttggtaaatcctaaggaagaaaattgcgtagttttttgaaatagcgggatt

SEQ ID NO: 39127 - DNA, 991 bp, Heterodera glycines
tttcggagaaaaccctctcgttggagactgtagataaaagagatagccacttttctgagactatctattgttagtaacggagccattttccaaccgaccatttgtagggctcaaccgcatatagtaatgcgttttcggggaaaaccctctcgttggaggctgtagaaaaaagagttagccatttttctgagaatatctattcttagtaatggagccattttccaaccgaccatttgtagggctcaaccgcatatagtaatgcgttttcggggaaaaccctctcgttggaggctgtagaaaaaagagttagccatttttctgagactatctattcttagtaatggagccattttccaaccgaccatttgtagggctcaaccgcatatagtaatgcgttttcggggaaaaccttctcgttggaggctgtagaaaaaagagttagccatttttctgagaatatctttcggggaaaaccctctcgttggaggctgtagaaaaaagagttagccatttttctgagactatctattcttagtaatggagccattttccaaccgaccatttgtagggctcaaagccattttccaaccgaccatttgtagggctcaaccgcatatagtaatgcgttttcggggaaaaccttctcgttggaggctgtagaaaaaagagttagccatttttctgagactatctattattagtaatggagccattttccaacagaccatttgtagggctcaaaggcattttccaaccgaccatttgtagggctcaaccgcatatagtaatgcgttttcggggaaaaccctctcgtttgaggctgtagaaaaaagagttagccatttttctgagactatctattcttagtaatggagccattttccaaccgaccatttgtagggctcaaccgcatatagtaatgcgttttcggggaaaaccctctcgttggaggctgtagaaaaaagagttagccatttttctgagaatatct

SEQ ID NO: 39128 - DNA, 1181 bp, Heterodera glycines
tttgttggcaaaatgtgtaccgtgatggaaggactgccttgcagagcgaaggaactgatcaaaacgcgaattcaaatcactacaagcggcaacggagggagtccattcattgaccaagtgcccccggctttgcatttacggcattttcattccccacccatttacagatgttgagcgatgctataaccgatcgaattaactctcttgaggtcagtcaattttttgtagcgttaatgcaacaattttttttaatactatgaattaattttttttttgtttttcagaaattgtcggacaatttgttgctcattctccacttggagctgcgcttccattgctttttccatttgatcacaattacacaaaaccaaagtgcgcattcgctgctgtcccaagacgagatcgaccgtgacgtcatggaatttgggcgtgaccttagccaactccatggcactttgcacgcgcatctctctccaaccaaactgaaatatttgttcgatgggctcggctacctttgctcgtccattttcatccattcctggtcactcaaacaatttaaaatcttacaatttacactttcttcttgcagccaataccttacaaaattgtccgacatgggccgtaaaagaatctgcagagccatattttctgtacaaaaatacttaagccaaatgtccgggtaaagataaactgaacgttgatgaaaaaacgaaaaagtaaatttagacgccccgaaactgaacttcaacgggctcaaatattcttcgacttccttaataaggtataagtatccttgatgggtcggtccttccaatttcttcattcccaggacttggaccaattatttgcgacaattatcgaacgcggcgccgtcttttccttcatcgaatattccattttactctcgctcctcattcggtcacatccaacactgaattcgcaggtaaagccgcggtttaactcgttcagtgtttcctagtttagcccggggttctggaagcggcaacaaatcaattgagggacattctttctcagcaaaaagaaaagcaaaatatgaagcaagcataaaagatttggtcaccctcatacatatttattttttgtttgtatatcggtcatcctcatattcgtattaatttattgtataattttttgattgactttgacttacggcttaatat

SEQ ID NO: 39129 - DNA, 998 bp, Heterodera glycines
atggagacgttccttcagggggaagggatacgccattctccatctccgacataccatccttcatcaaacggcgaagccgatcggtttgttcgcaccttcaaagaaggaattggcaaaatgttggaagatggaaagagcatcaaaattgcgcaatttattttcctgcaggagtacagagcgaccccttgctttgcggcagaaggacaaagcccttctcaaaaatttttgggaagagaattgcgtacggagttggacaaaataaaaatgtcagcaagtgccattgagcgaaaaaggcgtctgttgcccgaggcaaatcgtgaaaagaatttggttacgaaaaactttgagcccggagacttggtttggataaaagagccaaatggcaaatggacgcctggtgttttattgcgcccaattggtgaaagaatttgggaggtggagcatgagggatgctccattagaaaagtgcccatttggaccagttaaaagcgcgacgcgcagtcactcgacatcattaatacagcacgtaaatgcaatttgtatatattcaattcccccccccccaaaaaaaatataaataaatataaaaaaaataaatttaaaaaaaataaataaaaagaaaaaaatttttgtttttgtgttccaattttaaagcaaaagcatttctccaatttgaaaactaattaaatgagcaacgaaaacactccgccaagaatgacctggaggccatggaaaagaagctcttggaggggaaaaagctgcgcggaacgcatttggggagttgaagcgcaatttggagcaaatgagcagtgaaattcgagccgcaatgaaagaacaatttgagacgatgtgggaaaaattggagccacgtttggttggccaagaaaggtcacagctgcgttatccgatgccctggatgagttcatggccgagaagccggtgacagtgaacagcgggagagacgacaaggacaaaagtcaatcgtttggaggatgacc

SEQ ID NO: 39130 - DNA, 1250 bp, Heterodera glycines
  misc_feature (122)..(122): n is a, c, g, or t
tatcgttcatttttgggcatatattttctattcaattattatacaattcgaaatcacctcccttccttattcagcattttgccaactaaaaatgttaaaattttcaataatacatcaatatntacacctcaaaatattctaaaagtcttatatatttcccgaaaaaatttttgaatttacttttttttaataaaaattcattttaaagctaaatttggtccaatcaatgttggcttcatcccgggccccaattaaaattttcattaaatttagaacaattgtagtcccattatctatgctgaccctttttccacaattaaaataattaaacattttagtatattaataaatttcattggctaacctgaggcccccatttacctacctaaaatttaaatgaatatttaaaaacaattctttttctataatattatatttcatttaaacatcacaaatttggaacaaccaaccatcagcagccaaataatacacatattaatcaactgccgcttttgcgttgcttaaatattttcataaaattttttttgataaattctcattttaaaaagcaaattggctttaacccgggccctaattaatttttatgctcaaaactttcatttttgggcatatattttctactcattattatacaattcgaatcatctcttgcccatgcattttccaactaaaaatattaaattgttcaataatacatcatttttaccacatcaatatattccaatagtcttatacattttgccgaaaaaatttttaattttattttttttgataaaaaatttttattttaaaagctaaattcgttccaaccatttttggtggcttcatcccaggccctaatttttccttaaatttaagagaattttagtagcataattttatgctgatccatttttccacaattaaaataattaaatgttttagtatattaataaacttcgttggctaaccctgaggcgtttccattttcccacctaattcaataaaatttttaaataattctttttctataatattatatttcatttaatcatcaccaaatttggaacaaccatttccagcagccatcctcccccatctccaccgatgtctcatcccttcccccctgcccccgtcttcgtcccgtccgtcccttcccgtcgtcaattcgcttttttttgtcccctctccccgttttgcaacaattctttcttctcatccagggccattcattcattcatacattcttc

SEQ ID NO: 39131 - DNA, 837 bp, Heterodera glycines
  misc_feature (688)..(688): n is a, c, g, or t
tatttataatttataaaattacaaggctcagtctgttcaagacttaaaattttatcagtttaaattaaatagaatttgacgagtctcttgttattttgggccaaactaagccgcgtaatcaagtctaagtccaaacagaaaccagtacatgtttaattctacgtttaaacatccgtaagaattgactaaatataagattgccaggtctccatataaaaaatttttaattttcaagaacatagaaatttttgagcacaagggttgttaaatttactaaattttaatgatttatataacattttatatatttatattgttttatttttttgaaatccctccctctggtgcccaagcttcccggcgcccaaatttctggtgcccaaacttcatgtcgcctaaaaaattgccttaaatttttaaaatttaaaaaaaatcccgcgcatcaaaaccaaaaacaggacgtggaaccgatcattctgtccgttgaccctagtagtaacacccccgtgaccgtcgccagctgacgctaattagaagtgacaggtggagggggaggggtgtcaattagtcactaattggggggggggtactaattggtcagcggtcaagagggcactaattggtcagccgtagggtgtggggtggggggtggcaattaattaattaattagggaaacccaaacctatngggaggggtgtgtcaaattgtcatgtacttgtttgacagaaaatttgattgatttaaaaagtgacagccgaggaggagggggaatttgattggtcagcgaagtgacagatgagggaaaattcaaatttcggatgggcgggggggatcgg

SEQ ID NO: 39132 - DNA, 1011 bp, Heterodera glycines
caaaagacaaaaagttgatgtccaattccccggtagggatttaatagtgactttcagagatagccattttttgtcaagaactatttttcgtgcgttttcaaacacactattagtgctttattcaccgatacaacagaagacaaaagttggtgtccaattcccggtagggatttaatagtgactttcagagatagccattttttgtctagaactatttttcgtgcgttttcaaacacactattagtgctttattcagcgctacaacagaagacaaaagttgatgtccaattcccggtagggatttaatagtgactttcagagatagccattttttgtcaagaactatttttcgtgcgttttcaaacacactattagtgctttattcagcgctacaacagaagacaaaagttggtgtccaattccaggtagggatttaatagtgactttcagagatagccattttttgtcaataactatttttcgtgcgttttcaaacacactattagtgctttattcagcgctacaacaaaagacaaaagttgatgtccaattcacggtagggatttaatagtgactttcagagatagccattttttgtcaataactatttttcgtgcgttttcaaacacactattagtgctttattcagcgctacaacaaaagacaaaagttgatgtccaattcacggtagggatttaatcgtgactttcagagatagccattttttgtcaagaactatttttcgtgcgttttcaaacacactattagtgctttattcaccgctacaatagaagacaaaagttggtgtccaattcccggtagggatttaatcgtgactttcagagatagccattttttgtcaagaactatttttcgtgcgttttcaaacacactattagtgctttattcagcgctacaatagaagacaaaagttggtgtccaattcccggtagggatttaatcgtgactttcagagatagccattttttgtcaataactatttttcgtgcg

SEQ ID NO: 39133 - DNA, 1052 bp, Heterodera glycines
  misc_feature (18)..(18): n is a, c, g, or t
attcttttagaatattantttggttgttaatacatttctttaataatagaatttgaaaaaatctaaaaattaaagtattcaaaaattaatttatcatatatattaatgtaaagaattaattttaaaaatataaaagcaaatgcaaaatgttctaagttgatggtcacgacagtagttaacattgaaggcagagtgctttggtgaacattatctcgatgaaaattatgttttgttaaactatcaattatagaaactaatttattaatagcagcaattgttttcagagagatcaaataaaatctttatataaactatctattctataatttaaaaaaaagactgcattacctcccaaaattcctgcgtcattccatgagaaaaaaagacaaaatatggtagataaataaaataaaatataatttacagatcaacaaaagattaattaaaaggtctaaatgttattaaaataatcttaaaataataaaagaaaaatatgttaaaaatagtttgtttatgttaaatgaaatccaaattttcaaatataaattacttattattaatattcttttttattattaaattaatgatgaaatgaattaaaaataacattcccattaaaataccaagaaatacaatcatcgataaattataataaatgaaaaactaaaagctttgtattcatttccaaatagacaaaaaattgaataataatcaacatcatcagtgaattaaatagcattagtttaaaaagaatttattatgatcttaataacttcgaataaataaatatctaaacaagaagggctaattaatttcatctaaaataaattcactttgttttaaaaatgacactgaaaaaagtatattataaaattaaaaaaaaatttttttcaaaaactcaggccaccttttgaatcatcagttattccaactctttaacaaaaaaaataataaataacaattcataagatattaataaaaagtatcttcacactacaatgcgatggcgcatttataaatccaacataaaatttttaaattaatttattttt

SEQ ID NO: 39134 - DNA, 1035 bp, Heterodera glycines
  misc_feature (1027)..(1028): n is a, c, g, or t
attttaataactgatacggtagcccaacatccattgccccaatgtacccttcggtttgtcaacgggagcaaacaattgatgagtttgtttggtttcttttttaagcaattttccgtcattgctcaccaactgttaggcgtacagcaacggcggtacttgcatccgattcagctgttcatggtctctctaaacctatttttatttttttttttctatctcttctctgaatggagttataacaatttttcacaacagttttgcatttaacagacacattctaaaaattctaattagtatggtagtccaagcctattattattttttttgactaatctctgaatggggttatcccagttttagtatcctttttgaaaaacaaaaattttaataactgatacggtagcccaacatccattgccccaatgtacccttcggtttgtcaacgggagcaaacaattgatgagtttgtttggtttcttttttaagcaattttccgtcattgctcaccaactgttaggcgtacagcaacggcggcacttgcatccgatgcagctgttcacgggctctctaaacctatttttattttttttttctatctcttctctgaatggagttataacaatttttcacaacagttttgcatttaacagacacattctaaaaattctaattagtatggtagtccaagcctattattattttttttgactaatctctgaatggggttatcccagttttagtatcctttttgaaaaacaaaaattttaataactgatacggtagcccaacatccattgccccaatgtacccttcggtttgtcaacgggagcaaacaattgatgagtttgtttggtttcttttttaagcaattttccgtcattgctcaccaactgttaggcgtacagcaacggcggtacttgcatccgattcagctgttcacgggctctctaaacctattttttttttttttctatctcttctctgaatggagttataacaatttttcacaaccaagttttgcagaccnntgcaggc

SEQ ID NO: 39135 - DNA, 541 bp, Heterodera glycines
  misc_feature (30)..(30): n is a, c, g, or t
ggatgatatcctcattgccatcttgcccgngaggcttttttggtacaggaagcctatcaattctttttccctgtacagctcatgtagtgaatggtagcgctgatctgagcccttgctgtattcgtgatcagcgacccccaataccccttaaaacttattttcattaatttctaaaacacatttataggcatttgaaaatgcatgttaaaagtatcatgtaaactgcacaagtaccacccccccccacctcttttacaccggcccccctcgatgcgaaatggtcccacattttgggcctttgcgggcgaaatggggcggggctcccaaatgaaagtgatgatgaaaaaataaaaccaaattttgatcgaaatttatactaaatgctatttaatttatcttttggaaatgaaaatgaaagaccaattttcaaattagtttttcatgtattataaggagatgccaattctcagcatcgaaggatttcttccaattccctgaccaaatttccgagacttttttttgcatatctgtgagaaaatac

SEQ ID NO: 39136 - DNA, 1433 bp, Heterodera glycines
  misc_feature (1373)..(1373): n is a, c, g, or t
  misc_feature (1414)..(1414): n is a, c, g, or t
cccaaaagttttttagtaaaagcgccgcaaaaaaatcaacgatttttcacgctcatcagtagggagtgtaattatatggatataaaatcgcgaaatatggccataaaatatggaccaaaaatcgcaaaatatggacataaatttttcaaaattgagtgcaaaatttcttcaaatttattggttgaaattgcatatgagatacatttccaaattttttgactcggtaaggcgctttgacaaagacggctttcgttttgcaattagtcggtcaacattcggaaattggtctcgaattttttcggcaattacgtgcaatcattttaaaagaaaaaaaacataaaagccaaaatttattaatttttttagcgcaaaatcaacaacaaaagcgaaattttcgcttttttgcttatttttgacataatttattaatttttaagaaaatttaaatttattcaatattctcgagaaattttggcgaaaaaatgattttttgaaaaatttttcgggttttgggctcaaaaaggctaatttagctgctggggccgttctaatagaggtttttttgaaaaatgccaaaatatggacataacatatggaccaaaatgccaaaatatggacataaatcgcgaaatattgaaaaatatggatatagaaatccttcctagaagcttcaaaccaagctaaaaacatgtttttcgtgcgtttcaggcctcccacattccaggaaaaaaatatggatttccatgtaattctattccctactcatcgaatttcacaaaatgcttatttcgaacaaaaaattgatcaaattgaacatggacaatcaaaaatataacatttgaacattttaaacgtgttttgaataaactttataaaaatgaggcttttggcatttgaaaattttgatctgggaaccactgattttgactgtgttttttcgataactttcacttcatttggctgccacaaaattattttttttattaaattttattttttcatttttatttcgactgtcattattccatcactgtcatttttttttcatttttcattgtttccatttccatttgcacaaatctatgctttaaaattttgaatatttaaatctgagaaaacaatgtccctatacagtaaacatgccgtgtaaaagtacaataatattttggtgccgggacgtttccaaaaattccatcaaaatgggggcgcttattcgaaaaaatgctgaaaagtactttcaagaaaaaacgacggaagtgcaattcttgtaaattatttcactgaagaaattaatagtaacgaaacaatcaatgacgaaataagggttaaaccccgacccttgggagcgaaaagtcaggaaattctacgacaanaatttgtcggggatgggtgaaataatttaaaaaatgtcatnttcggtagttttataaatt

SEQ ID NO: 39137 - DNA, 197 bp, Heterodera glycines
ctttgcaactgattgttctgctgattaaattgtgctgtttgttgttgaagccatgggaactgcgtattttgggcatttggcacggagtgcggcgatggaaattgccatggcgcagcggaaacggcggtttgccgggggaggggctgaaaatcgaaaatgcggatgataaaagctttgttttccgatgtttcggctct

SEQ ID NO: 39138 - DNA, 1193 bp, Heterodera glycines
  misc_feature (21)..(21): n is a, c, g, or t
attaaagccatacagcacgantcgggctgaacacacattcgcacaaaacacatcataattgtaggacaaaacttaagacgaaacaacaacatattttattggaaaattttcgcaaaaattaatcgccaaaatttcatttttttttcttgataaaaattttaggtctaaaatttttcctttttcgaaaaacataataaagtatataaatatgatttaaatgaccaaaataagttacttcgttaagttttaagtgttttgctcacctaaattttcaaaaaaatcgaataagaatgacgaaaaatagtcaattaaaataatcttttttacaaaaaaaatccgcagatccaaaatcggcataaccaaaaaccgggggtacggtaacggttaataacgggtcgtgtaacctaccttaattttagacaatttttcatttattctagcaaaatggaattttatttatgtaatttttcattttttctggcaaaatggaattttacttatgtaatttttcattttttctggcaaaatggaattttatttatatatcatgttttttatattcaaggttcataaataaattagaataaaatatattttttaatctaatggattttttgtttgttgcccataactttagcctaacgaactaagtatgtacataataaaatgctcaccttgctgaccataatgtacaaagtgagccgttctcgagccaatttgaccatgggaaaagcgcaaattatgagaaaaatgatgaaaaatagcaaaaaagtgttctgaaagcaatcgcgcactttcccaagagacgatttcatatcaaagcaagcggacaccattttctgttgccgaaatttgaaaaaattggtgaatagataaaattaaattagatgcccatcggcactagagaccggacgggatcgggatcccgcgggattaaattcgggatcccgacctcgggatccatcccaagcgattttttaaattcatcgggattgatctggatcgggattcagtcgggatcccgactcgggatcccgccgatctcagttgtccggtctctattcggcaccagggatgggcgagaaacttcggcttcgaagagttcgggttttttgggcttcgagttttggagttcggctcgaataaaaattgggcttcgccttcggcttcgagtgctaagccgagcttcgccc

SEQ ID NO: 39139 - DNA, 1383 bp, Heterodera glycines
agcggtgtgtttgtgcttgctgctacgtccgtggccgtgatgagacgacgcggtagggcccgtgcttggcctagcacgtggcttaagactcaatgagtgtcagctcgggcaccgccagctttttctttttttcattatttttttacacttctgttgaagaatgaattctagtcttatcggtggatcactcggctcgtggatcgatgaagaacgcagccaactgcgataattagtgcgaactgcagaaaccttgaacacaaaacattcgaatgcacattgcgccattggagttacatccattggcacgcctggttcagggtcgttaccataaaatgcactgcttgtgcgttgcttcgtgggatcatgtacttgtacgtgttcttacgttacttgctcggctcggctgtggggttttggtgtgcaggcgcgaacttgtggttctaattcgcgttttacggaccgtaactcgggcgcaccaatgcttcgcatgctgtggcggagtgcctggattactggcattcctgctttgatttttcgacctgaactcagacgtgaacacccgctgaacttaagcatatcagtaagcggaggaaaagaaactaacgaggattcccgtagtaacggcgagtgaactgggaagagtccagcgctgaatcgcagctcctctggggttgcgaggtgtagcgtatagaccgtgagcatgggttggcccgcttgttcaagtttcccttgaccggggctccagagaaggtgcaagacctgtccaactggcggtgcctacccatctttacgtgtcttggagtcgggttgtttgggatcgcagcccaaatcaggtggtaaacttcatctaagactaaatacggccacgagtccgatagcgaacaagtaccgtgagggaaagttgcaaagcactttgaagagagagttaaagaggacgtgaaaccgatgaggtggaaacggacagagctggcgtatctggtctgcattcacccgtttgttgctgtacgttgggctgctagcctccagactggggtttgctgtccttctttctgttcagtggcgaatggggcatttgcaggcggagtgcgctgagatgctcggagtagctgcgtgagctcggtcttgaggccagcctttcggggtctggtacccggatcgggggagtgctgtttactctgggtgaattgtgcaatggtttcgggtccgtgttgactcgagctgggggtcggtggcggtcgcgtgcgacacgtaccagcaaccagttcggtccagctcgggctctcagttgtgcgttctcggtgtaaaagccggtcatctgttcgacccgtcttgaaacacggaccaaggagtttagcgtatgcgcaagtcattgggtgttcaaaa

SEQ ID NO: 39140 - DNA, 1041 bp, Heterodera glycines
  misc_feature (41)..(41): n is a, c, g, or t
tttcagtttgtttcaataataaaaaaattaaaatttttttntaaatttttttaaaatgtataaaattcttacgtttttctacaggacgcgaaaacagtcaagaaagtaaaaatttcattatttttataaatttttaccattatcattaaaggaaaacaccgtaacaatggtcgtagaagtaaattttattaaaaattattattattaaaaactttttttccttattttaaggaagcggaagcggaagccgtagccgtcagaatgaggaatcggactaaagaaactgagaagcaatttgtggatttttggaaatgattttagcgtttttcaaggaaaaaaaacgaaaatccaatattttattttacgaattttgacactttgttttcattgtttcaattcattttcaaaaaatgtgcaaattcaaaaaattcatttatttgctatcgaaaaattttgtgagtaaagggatatatatatagaaaaggtgaaaggatcttttggcaccagcccagttttttttttggctatgacttttttcagggtccaccaaatcaaagaatcttggtatcatttgaaagccgttcacatgttctattagtcttacaaaaaaaaacacaaagattttcaagcatataaaaaagttataaagaaaaacttcaaaatttcgactttttttttgcaattttcttgtcttaactttttgataatggtctaatcgcaaagcaatagcttaaacatagtttctaaacatggtaagctttcaaatgataacagattgttgtgtttggttgacaatgaaaaaagttatagcccaaaaacttgggctggcgcagaaacgaccccagggggggggggggggattttaagagattcaggttatatttggtggaaaattatactaaaacgatttaattgaattgccttgcttcctttggaagtagaatgatttttgactagaagattacaaaaaccgtaattgacgaagtgcaagaagagcgaatgacccaatattatataacattataatattctaattacaaa

SEQ ID NO: 39141 - DNA, 556 bp, Heterodera glycines
  misc_feature (534)..(534): n is a, c, g, or t
gttccccccgcgccactggaaataaagccgctcgtggatttgtgtttaaaaacaaaatccacgggggctctattttagaaaatacgatatttgaaattaaaattttaaaatagataaaactcttttttaaagaatttattttatttttagcaacaaaaattggaattgcaaaagtatgagagcatttggggaagggattaacggaggagcctaataccttatgaaaaaggacacttttctgagtgttccgcgccagggggcgaaggcccaccacgaggccgcgaagaggccgagtgagtaccttcggtgcaggaaaattattaaggaagagagttcattatttatttgttttttgcaaaattaattcttaaatattttttcagaaagggttctgaaacgcaccgaattttatttacatgttagtttaggcactctgatgctttttctatcaaaaagggagatgaataaaatttttaaagatttttaattcctttttaaacaggccaaaaagtctagactgaacttttttttcangaaactgatcagaagcgcacca

SEQ ID NO: 39142 - DNA, 892 bp, Heterodera glycines
taagattgtttgatagggccagacaagagaaggcaactgttggtaccaattttgcgttaaaaaaatgagaaaaaagagatagccattttttggtcaagaattttttttgtttgcgtttcaaatatcgtaagattgtttgatagggccagacaagagaaggcaactgttggtaccaagtttgcggtaaaaaaatgagaaaaaagagataaccatttttggtcaagaattttttttgtttgcgtttcagatatattgtttgatagggccagacaagagaaggcaactgttggtaccaagtttgcggtaaaaaaatgagaaaaaagagatagccattttttggtcaagaattttttttgtttgcgtttcaaatatcgtaagattgtttgatagggccagacaagagaaggcaactgttggtaccaattttgcgttaaaaaatgagaaaaaagagatagccattttttggtcaagaattttttttgtttgcgtttcaaatatcgtaagattgtttgatagggccagacaagagaaggcaactgttggtaccaagtttgcggtaaaaaaatgagaaaaaagagataaccatttttggtcaagaattttttttgtttgcgtttcaaatatattgtttgatagggccagacaagagaaggcaactgttggtaccaagtttgcggtaaaaaaatgagaaaaaagagatagccattttttggtcaagaattttttttgtttgcgtttcaaatatcgtaagattgtttgatagggccagacaagagaaggcaactgttggtaccaattttgcgttaaaaaaatgagaaaaaagagatagccattttttggtcaagaattttttttgtttgcgtttcagatatattgtttgatagggccagac

SEQ ID NO: 39143 - DNA, 1585 bp, Heterodera glycines
  misc_feature (10)..(12): n is a, c, g, or t
  misc_feature (54)..(54): n is a, c, g, or t
  misc_feature (62)..(62): n is a, c, g, or t
  misc_feature (85)..(85): n is a, c, g, or t
  misc_feature (94)..(94): n is a, c, g, or t
  misc_feature (102)..(102): n is a, c, g, or t
  misc_feature (114)..(115): n is a, c, g, or t
  misc_feature (230)..(230): n is a, c, g, or t
  misc_feature (258)..(258): n is a, c, g, or t
  misc_feature (362)..(362): n is a, c, g, or t
  misc_feature (368)..(368): n is a, c, g, or t
  misc_feature (413)..(413): n is a, c, g, or t
aaaaacgcgnnnggggggaaaattgcgctaagttttgcgggggttcgcgcgatnaaaattcnaataaaaaatataatttataacnaatgtttcntgattcancaattagctganncattaatacaaatgaaagattttcacgtttgtttaaaaaaactcaaataatttataaaaaaaaatgagggcgaattatttattttcccgtaatcattttttcctattggaaatanaattatgaaaaagcaaatgtttgtttgnaaacttattaaaaataatcataagcagcagtagcagtagcagctgaatgatgaatgcaaattgtttgcctcattctttggttccgctgctcctccgtttggctntatttntgctgtcttttgcttttcactttttttctaatggatttgcctttngataaatgttttgtggattaaaagaagtgaatgaaaggagagagagagagagaacgaataataattgtacaaatgagtgaagtgggggcaaaaagtgaaaaagtgatggccaacagcaaaaagaaagaagcacagaatgacagagacaaacagaaaaaaaaacaaatgaaaccggacggatggccaaaagaaagaaagggaaaggaataaatttaaatgccttgcggggacacttttgaaaaatgtaaaaaaagggaaggggtgatttgaatggcccttcagcaacagaagaggcgcaaggatgtgtaaatgtattcaaaaattacaatggcaggaaaatgaaaaaaggtttaataaactgcataattaataatggatgaaaaataaagaaaatggaagaaataagaagaatgattacaattgtaaatatcaactaaatgtggagattcttataaaaaattacaattgtaaatatcaattaaaatataattttccggtagtaaaatacaattgtaaatatcaactaaatgtggagattctgataaaaaaattacaattgtaaatatcaattaaaatatgaattttccggtaatgaattacaattgtaaatatcaactaaatgtggagattctgataaaaaattacaattgtaaatatcaattaaaatatgaattttccggtaataaattacaattgtaaatatcaactaaatgtggagattctgataaaaaattacaattgtaaatatcaattaaaatatgaattttctggtaatgaattacaattgtaaatagcaagtaaatgtggagattctgataaaaaaattttccggtaataaattacaattgtgaatatcaactaaatgtggagattctgataaaaaaattacaattgtaaatatcaattaaaatatgaattttccggtaataaattacaattgtaaatatcaactaaatgtggagattctgataaaaaaattacaattgtaaatatcaattaaaatatgaattttccggtaatgaattacaattgtaaatatcaactaaatgtggagattctgataaaaaattacaattgtaaatatcaattaaaatatgaattttccggtaatgaattacaattgtgaatatcaaataaatgtggagattctgataaaaaaattacaatttaaa

SEQ ID NO: 39144 - DNA, 1013 bp, Heterodera glycines
gagagaatataatatcatttgaatcaatcaattataaaaatcgaaaatgtcctgacttgttcaaaatttgtcctgattatatggaacaaattgaaaatcccaaaaaaaattttcctttcaaaaaattgcacaaaaaaaagaaaacttattttgttataagttttgtcagttttttttattgcattttcagcaacatttttaattggtgtttcgaaatatcttgaaatttaaattggtaaatttctaggcttactaaaggggtatttgaccagaaattttgttaaccctgatcatagttgtcctttatcccttttaaatcaagagaaatttgttttcttcaaaaacttttaacaaaaaagcacattaataattttgaaaatgttcaaattccccttttatgaaatttaaaagattgaaatcctaggatttttatggaaattttttcaattcatcaccggacaattttcatttttaatattatttgaagctcccagaacccaagcatatcttctcatccttctttattgcttcattttttgagcaattaattctcattttttgctaatcattttggtcccttttctttaaaggaaaaacaaaaaattaatttttaaaatttttcaatatttttttaaaattaaaattgcaggtccaacgtaatgaggtggaacggcatggcctcccgttgacggacaaagagcacgagcagtgggaaacaatggccatcggtggtggtggtgctgatcagcaacagcagcaacagccgctgcaggaccatttggatcgactggcacgaagccgtgaagcgatggtaattgacggagagccgcagcaaatgatcagccatgacgagcatgggcagcccattggcatgacgacagtgcaggtgggggtcatcaacaaattcataattacaaattaaaaataagtaatttttaataaaaaaaattttattaaaaatttcaagaaatccaaataatttttcggttttttgttcgtttttttttgcattt

SEQ ID NO: 39145 - DNA, 1108 bp, Heterodera glycines
atcagtgattttatccgccaaattttagccagtgtgtcgaagactgtccatcggcggaacggctgcaaccaccatgtcattctgggaaaatttttcgcccacccaatgaattgttatgctaaatttttcatttaaaattttatgaaaaaattaatatgcctttcaagtggttgggaatgggttggttggctccatccatccgatgtaattgcataaaaatgagaacacaccccgattcgcattttggcacatatctcatccgccattttcggtattacaatgcgcctaccgactgccaagcgcataaaataatttagttagatttccattttggtctcattaaaaacctacaaattcggatatgcctttgcgtaaagcgctttcaggtccttatcctgaaaaaaaaagaaaataattgttttgtcggatcataattcgggcaatttgttcttcggcttcaattgtggcatccttttttggcacaatgaatggcttaattaattcctgtaaaataataagattatcaataaacctttgttccctttagaacagaccttttcctttttttgctctccatttccttttcagcatacgaactcttcatgtgcaatccttccaaatgccaccacatacttttagctgatccatctttcctgcctatctttcctgcacacattttacaattaaacttcgtcagcaaatttttcaaagtatttccaaatattaatgataattaaaaaatccacaattaaattttaaattttcataaattaataaaaaacgtacaaatttgtaaattaccattaaaaattttaatctatttatctttccctcaattttggtcaactttttcctgacccccattcttaacagtgtatttttctaggtggcgcaaatatccatttttgctaggtggcttaaatgtccattttcgcagcggtgcgcaaatgtccatttttgctaggtggcttaaatgtccattttttctaggtggagcaaatatccatttttgttaacggcacaaatatccggtttcgctgtgcggcgcaaatgtacgtttttggaaattgaatggcaagcgaagtgaaaaggagaaaagttaggaaaa

SEQ ID NO: 39146 - DNA, 1005 bp, Heterodera glycines
aaatggcttccaattacttggggtttggttttacaccgttatacgaaaaggatgaacccgcctcgttctatacagacaaaaagaaaaccgaagaaaaggctagtcgctttaagtattcccatatcattcatcatagtcatcttacaccattttctaatccaggctaagctcggcctcatgctcggcgtgtaccttccgaccatccagcacattcttggcgtcaccatgttcatccgtttggcgtggatcgttggtgtcgctggcgtatcgcacacttttatgatgctcttcatttgctgtctttgtgtagctgcgtttttttaactcgattttttcacatgtccttcagacgttcctcacctgcattagtgtgtcagcggtggcgaccaatggcgtcgtggaaggcggaggagcatatttcatcatatcacgcaatttgggacctgcatttggaagtgcggttggcattctattctatctggccaacacagttgcaacttccatgtatttggttggaggaattgaaattcttctggtgaattcttccggtcaatccattgactttttatccgtaaattttcagttgtacctttatcccgggatgacaattggcggtaaaaatgcgcacacggacactggtgagttacatcagcacaaggctaaggcaccaaaggggtaccgacagaaaccaccctgggggagggcgacgcaaattccccccttgaaaagtcgcttattttagtagcataaatacttaccctcgacagatttcttggggatgatgtccaacaacatgcgtctgtatgctacttttctgctcattgttcagttcaccatcgttgcgatgggtgttcgttttgtccaacttcttgcacctgtaacttcttcgatttctttccccctaactttgtccccctaatttccctaaggtttcgctcgtctgtgtcattctcttcccgttttggcttgttacgctggagccgctgaaaaaacgatttccggaag

SEQ ID NO: 39147 - DNA, 1276 bp, Heterodera glycines
tgttgggctcgaagtcaactggcctaagccctggtcttctaagcagcattcaaattggagggcgcggggggaatccccataaaaatatttaactctaaaaaacaattttcaggttcagaaaatcctgttaagtgttttcctagaggtttttgaaaaaaatttctggaatttaagtaggcccaattgtaaagggcacaaaattctctaccgaattaaaccatcaaaaagtgcaacaaaaaaattaggaaaaagtgctaaaaagtccaaaatatttaccaaatatgcttaaaatccagaaatatgtaaataaaagtcccaacaaatgttcgcaaactcaaaaaagaaagtgtttttcctattgtttagacatggaagcacccaagaaaaaatatgtatttacataaaattagcacgacgaccaactaagccaaattcggacgtttcgccaactcatcaacaaaaaaaaagacattccgccaactgacatttcaccaactggacagcaatgactgactatttcttggtgagaatatcagaattagtgcaagacgggtggggcgcggacggaaaaataccgcggtcgcggattcaaatctcgcggtcgcacatcgcggaaaagaaacgtcgcaaatcgcggtcgcgtcccatccctggtgcaagaatccctactagggctccaatttttaggcaaaaggctattttttcctgagctccccgtggcctaaaacgtacgaaaaacatgttgttttttttgggctgttgttaagctacttttcgagttattagtgcctattttctaggctttcatttttagcgcctaaaaaacctaaaaaaattttgaaagagcctatttttgcctattttggcgttttgccgaaaatttgttaacaaaaatgcaataaaaacaaaaaaaatacacccctaagcagagattcaaaaatttctgaaaataaatcccctaagaaatgaaaattttctcaaaaatcgtctttacaattttttttggacaattttttcgatttaaaaaaataatgtaactcaatactgattttgtataatttttttttagcggtttttagtgcctataaattggagccctaatccctacgtagcagggatgttgcaaaaagaaaaagaaaaagcgaaaccaaaataaaaagcgaaagagaaaagacgaaagcgaaatgcccaaaaaagcgaaaagcgcaaaggtgaaattttttttccaaaaatattcataattgaaatcataaatttggatattgtggtgcaaaaa

SEQ ID NO: 39148 - DNA, 1088 bp, Heterodera glycines
gtcccaatttgcgtgatatcataaaatatgctcctccgccttccacgacgccattggtcgccaccgctgacacactaatacaggtgagaaacgtctgaaggacacgtgaaaaagtgaattgaaagacgcaaagttacacaaaggcagcaaatgaagagcatcagaaaagtatgcgatacgccagcgacaccgacgatccacgccaaacggatgaacatggtgacgccaagaatgtgctggatggtcggaaggtacacgccgagcatgacgccgagcttagcctgtatcagaaatgacgacaatgaatgaaatgtgtgcgaatggcttagagagactaacccgttcttcgattttctttttgtctacatagaacgaggcgggttcttccttttcgtataatggtgtaaaaccaaacccttggtaattggaggccatttctactaccgttttttctgtaaaaatttgtagaacccgaaattttgaactcttgagaatcgacccggggggggggaattgggggcaggacaggcacttttaaaaaattatgaaaaaaactgaaagccaaaaaaataataaaaaaatattttaaaaataaatttgaattttaacacactatcccgaaaatgagctcctgtacaaaaaagaattaattgcatgtatggctaaatgttttttgaagatagaaaagggagaaaggcgtaggttcgagtccgttcaaaaatgttttacttattttttaacaaaaaatttgtctttgtctctgttcatttctacctttttgtgtttgctcgcctcgcgttccattgggcccggcgtcgtatagccgctgatatacggagcaataaaattgtgtgccggctcgttgtcgtaaagggcaaaatcgccgttttccgttgtttctgtgtttgcctttttacgcaaggaactccacgagagaaagccatgctctccaactggaaacaatcggactttagcggaaaagcaatgtttttgattagcattcggagaaagggacgggaaggggatgtacggcatttggtggcaattttctgtcttttatgctttaccaagtgctgaggatgagcgag

SEQ ID NO: 39149 - DNA, 669 bp, Heterodera glycines
ttttttagatcatttcttaggggtgtattttctgaaatttttttagatcatttcttatggatgttttttctgaaattttttagatcatttcttatggatgttttttctgaaattttttagatcatttcttaggtgtgtatttctgaaatttttttagatcatttcttaggggtgtattttctgaaatttttttagatcatttcttatgggtgttttttctgaaatttttttagatcatttcttaggggttattttctgaaatttttttagatcatttcttaggggtgtattttctgaaatttttttagatcatttcttatggatgttttttctgaaattttttagatcatttcttatggatgttttttctgaaattttttagatcatttcttaggtgtgtatttctgaaatttttttagatcatttcttaggggtgtattttctgaaatttttttagatcatttcttatgggtgttttttctgaaatttttttagatcatttcttaggggttattttctgaaatttttttagatcatttcttaggggtgtattttctgaaatttttttagatcatttcttaggggtgtattttctgaaatttttttagatcatttcttatggatgtttttttctgaaaattttttagatcatttcttaggtgtgtattt

SEQ ID NO: 39150 - DNA, 1233 bp, Heterodera glycines
aaatttggagatcatgtttcccccttccttctcccaccgggtattattttgtaaagttcttttttccccaataaacttgtacaaaccccattttgcgcaccgggaatgatatttattctctctttcgcaaacgctgtgattattaccagacacagaaaagtatctttttccaactactgtttcccacgcccttctccccagggtgtaatgtaggaaagactatttatcatctctagactttcctctccccattattttcagcgtgactgatattctcatccaaatctgaaccgcctcgagaatattatagtatgacatatcgaccacttcgacatcttggaccccactccctgctcccaccggaattatgatggaccgttactttatctatccacttatattctcaccctatttcaccgcatgtgaaggatatgtttactcacggcacaatggcaactatgaaatgaaagtgcaaagaggtgaaatcttcagacaatgcatcccactcccgtctcccaggggtattattttgtaaagtctttatttccccaataaacttttcaaaccccatttttcgcaccgtgaatgttatttttatcgaattctgaaccgttttgagtagattagactagaaaaaattgaaaattttgaaatcatgtttcccactcccttctcccaggggtattattttgtaaagtctttttttccccaataaacttttcaaaccccatttttcgcaccgtgaatgttatttttatcgaattctgaaccgttttgagtagattagactagaaaaaattgaaaattttgaaatcatgtttcccactcccttctcccaggggtattattttgtaaagtcttttttccccaataaacttgtcaaaccccatttttcgcaccgtgaatgttatttttattgaattctgaaccggtttgagtagattagactagaaaaaattgaaaattttgaaatcatgtttcccactcccttctcccaggggtattattttgtaaagtcttttttccccaataaacttgtcaaaccccatttttcgcaccgtgaatgttatttttattgaattctgagccgttttgagtagattagactagaaaaaattgaaaattttgaaatcatgtttcccactcccttctcccaggggtattattttgtaaagtctttttttccccaataaactttttcataccccatttttcgcaccgtgaatgttattt

SEQ ID NO: 39151 - DNA, 729 bp, Heterodera glycines
cctcgcttagtgcattcaataaatcattactactttcttttactttatcactgcgatttctcaaagaccctcattttcctatcacactttcctcttccggatcgcttcccttctccacccatattgatcactctgatcacttaaatgaaaacttttgttggcatgccaattcgatcggcacattggtgccacttccccgggcaagcaccacctccgccactttttggctggcccgccaacgacggagcgccggcgctgtcccctgccgccggtggtgccgttgatgaatcggatttttttgccaacttttttgtgccacggcgcactcgtcgcgagaagcggttggcacgttgcagtgagaaacgcagcgtggcaggaaacattttgacagtttagcagaaggaacgtctcagtttgggaaaggcaaaaaatatgggcgcaatgccaatgttcaaaataatttttaaaaatggaggaacaataaaaaaaataatagaaaaaatttgaaattaatggaaaatttcaaaaatttcatttcgttttttttgcaacaaatttttgaaccgatttaaaatgcaattggattagggcgctaattcgtaagtctctgttaaaaaaaactcggaatttccgcttcatcttaaaagcttggtgtaatatttaaattttgggctcaacactcgaccgcgtctcttaaaaattaacgataaccagcccttgccagcgggg

SEQ ID NO: 39152 - DNA, 1079 bp, Heterodera glycines
  misc_feature (1067)..(1067): n is a, c, g, or t
gcgaagcggccgagtgagtaccttcggtgcaggaaaattattaaggaagagagttcattatttatttgttttttgcataattaattcataaatatttttttcagaaactgctctgaaacgcaccaaaattttatttgcaagttattttaggcactcagatgctttcactatcaaaaagggagatgaataaaaaatctaaaaatttttaattgctttttaaatatgcgaaaaattttaggcttaactttttttttataaactggtcagaagcgaaccagattttgcgagagcatcaaaaagacaaggaaaagcactgctatgatgctaactccagtaattctgaatttaaaattttttattaatttttaaagcttcactattttatttttttagcaaaatcaattcataaatattttttcagaaactgctctgaaacgcaccaaatgttaattaaaagttaaataaggctctctgatgctttttctatcaaaagggagatgaataaaatttttaaaaatttttaattcctttttaaacaggccaaaaagtttaggcttatattttaaaaagtttcatcgaacctagcgcactaaaatcgatataatctctccaaattttgcaggccttctccattgtaaaggactaacttaacctgaaaaaatgccaacgcttgttgtttttaaaatttttcgaaattctgactttttcattacttatttattttttgcaaaattaattcataagtattttttcagaaagtgctctgaaacgcaccaaatgttaattaaaagttaaataaggctctctgatgctttttctatcaaaagggagatgaataaatattttaaaaatttttaattcctttttaaacaggccaaaaagtttaggcttatattttaaaaagtttcatcgaacctagcgcactaaaatcgatataatctctccaaattttgcaggccttctccattgtaaaggactaacttaacctgaaaaaatgccaacgcttgttgtttttaaaatttttcgaaattctgacttaatcattacttatttattattttgcaaanattaattcataa

SEQ ID NO: 39153 - DNA, 1120 bp, Heterodera glycines
acatatgttaggggtattttttgtaaatgggaagcgctttattaaagtgaaaatttagaaatgagacaaccaaaaactgtcatgaaattagcatttgtacatattaccaaaataattttctataacaatcagttttttgtgcttttcaattaattaggctctttatgcatgtggcgaattcctgcgttagccgaacaaatcttagtggtgcacatcattttcttaagcagcatttccacggagataactgtcgacaaggatgtcgaaaagggaagggtcaatgagcggaatacgttttttggctacggacgggcggaatatggcgaaaaggtaggcgaacgaaggccagcttcaacgctggatgcaaatcttaatgtgaacgcattggcagatggatgagtttaagaagatacaaaaagaaaaatggtgggcaaacaggtgagtgaattcctggggttggacataacagcccgtttttgtcctctgttcaggacgtgttccaaaggctactcggacaccttatttcctggggtcagttattcaaacaaaagtcggtactttcctgatttggtgtcgcatgccaaaaatgtaaaaaagcgcacaaattctgaatgcgcggcatacagcattctaaaatcacgtcaaatgaatcatcagcaccttgagaatattagttgtatgaatttgcacttttcttgattttaaaattttgatctccgaccccaaaacggaaaagtacccaaaagtcatgactcatgagttcgaaatgacgtcttttgtttatcttaatccaattaagcattgtagccaaaagctcctttcttaattaagtgccctgagacaaagccgcaaaagtgttttggcattgaaatcagttactcgcaccgggtcgaaactgacgaaccatttccgcattgggctgaatttttacaacactttcccaagtttgtatggtactttgtcctgttttgtatccctttttgccagttaaaaagttaaaagtctttaaaatgttttcacttacttttacaaactgaactaacactgtttcgttttctactttaggtgttggagtatgttcgctcctttggtttgttttgtgcattaccgaccatgcgat

SEQ ID NO: 39154 - DNA, 827 bp, Heterodera glycines
ggtcattaattaaccccacaaaggctaattatgcgtgacgaattccaagcggaaacaaagcgaacagcgcaaaaaggtggcgcgaaaagggcggacgcggaagaggcattccttcgcagttggagaagggacccatcgcccgccatggacaatggccacaaacaatcctatggtccgtggcaagactcaccccaaagcgctgtttctttctcaaccaatattctgctatttaactttcagcatttgatcagatcggacagttgcgtggtgtcgattacccgtggggcgaatacacgggctatagcgaaatggtgggggaggggggggggagcagggaatcgctggaggggactttccatcagccgttggtgccttttggtaattttaggttcgttatatgcgaactttggagttttattacccgaatctggttggttttgctgtgacacttttgtttcccgttgcaccttctccggtccatcacaggtccaactcgtccaattgggcagcacccacgagggacgctccattgagggagtcaaagtgcgcctgggaggggcgaagcgaacgcactcattttgccccccccctcctccatccattcgtttagattggctataacggacagattttcccacagccgtcaaattcggagcataaaccgaaaaactcgagaaaaatgcgcaacaaacgtgtgttttggattgacgggaatatgcacgcgcgggaggttcattaattgctttgattggcccccaaaggctttctcgtccctccctttgtcagtgggcaagtggacacacagctttggtcatcgtttgttttct

SEQ ID NO: 39155 - DNA, 1003 bp, Heterodera glycines
taccaagattaaaaaattcgtgtttatcccccactctgcttttggctggccataactcgccagagagtggagatagaccctttgttgatacatttgaaaatgtagagctcggctagcgcattcgaataacacaaaatttgttttcatttgcccccaaacaatccgcttatgacgcgccgaaagaaaattcacaaaaatttggcaccggaaaaactccatttttttatgggccagcatagtaaagtaaacccaaaatgtaagggaatttaaattggtgatgagagatgtttagttttttatttgccccatcctttttctgggaaaaaaaagctgaaaaattttccaattgcatcagatgcagactcaaattcttcaacaacataatgtaaaaaatattacgcaagaaattatttttacatcctttttagaaatgctgcataaatttttattgtaaatagtcacaaacaaactttttttcactcccaatatctaccatttatcattacaaaaggcaatggttaagcactgagatataaaaaaattgtctagaataattatctcaacaatttgtcgggaaagatgaataaatttcagttgcaataggcatattggctcaatacataaatgtagagcaggctcaaaatagaggaaataccaagattaaaaaattcgtgtttatcccccactctgctttggctggccataactcgccagagagtggagatagaccctttgttgatacatttgaaaatgtagagctcggctagcgcattcgaataacacaaaatttgttttcatttgcccccaaacaatccgcttatgacgcgccgaaagaaaattcacaaaaatttggcaccggaaaaactccatttttttatgggccagcatagtaaagtaaacccaaaatgtaagggaatttaaattggtgatgagagatgtttagttttttatttgcccccatctttttctgggaaaaaaagctgaaaaatttccaaattgcatc

SEQ ID NO: 39156 - DNA, 884 bp, Heterodera glycines
ttttaaatgtctttttatttctttgacagagacgcctcccaaaatagtcagagtgatggacagttcgtcgacggacagaagccgagggatggacaacggcagaagagggaacggaaggggcggcttcggcagagcgaacagaggcggcggagggggcgcagcgggcggaagcggcgcattggcatttattgggggaggcggtggcggatttggcgagggccgaggcaggggtcgctttttccgaggcggaggaggcgcggggggagcacaaatgtgaggggagagggataagatggaaggggaaaagaagaggaaaatgccgaggaaaagcaaaaattaaaggaaaagcgaggaaaagccatggcaaattaaaaaattgaagctaacggaaaagaaaggggaaaaatatgacgccaattaataatcccacgagtgagaaaagctaagtagttataacccgactcaattgcattatttaggaaaaccaaactcaaaaattacttagcaaaaatactaaaaaattatctcgggagaaaaattcaaagggcaatttttataattcgacttaattactcatgttgaaaagaaaataataatgaaattttgccgtattaattttatgaataaggaaaaattgcaaaaacaaagaaaagcttaagaaaaaataaaaaaggaaaacgaaacataaaatgtattgtgctaattaaattgtaaatgcgtttcaataaaaaagaattaataaattaattattgatggaaaaagaaaagaaagaattaaaaggaaattgtttatttcggaaaggcaaaaatgagaaaagaaaagaaaaagtgaaattcaagttttgtttgatttttttgtcattaatgtaaaaatttaaaaagcg

SEQ ID NO: 39157 - DNA, 905 bp, Heterodera glycines
aattaaagtacaggctatagtgaagctattccggaacgttacggtctccccataaatctgggcgcatcgggtcagggcttctgccccgaaaacccaaaaaaaaattttttggataaaaattatttaaatgaactgactagataatatttaaaataggttatttctcttcctttcagtatccctgcaaagtttggtgcgcttctgatcagtttctgaaaaaaaagttaagcctaaactttttggcctgtttaaaaaggaattaaaaatttttaaaaattttattcatctccctttttgatagaaaaagcatcagagtgcctaaactaacatgtaaataaaatttggtgcgtttcagaaccctttctgaaaaaatatttaagaattaattttgcaaaaaataaataaaaacgaaagactcagattttcgaaaaattttttagagcaagctagctcggcgctcatttcagtgtaagttagtcctttaccggggagtatccctgcaaagtttggtatgcttctgctcaattagcaaaaaatatgagtgatcaaactttcactaaaaagttaagcctaaattttttggcatatttaaaaagcaattaaaaaatttttaaaattttattcacctccattattgatagaaaaagcatcagagagccttattaacttgtaaataaaatttggtgcgtttcagaaccctttctgaaaaaatatttatgaattaattttgcaaaaaataaataaaaacgaaagactcagattttcgaaaattttttttgagtcagctagctcggcgctcatttcagagtaagttagtgcctttaccggggagtatccctgcatagattgggacgcttctgctcaattaagaaataatatgactgatcgaatttttactaaaaaag

SEQ ID NO: 39158 - DNA, 905 bp, Heterodera glycines
  misc_feature (11)..(12): n is a, c, g, or t
gcaggtccacnncttaattgagcgaaaccaatcacaaattattattcggcgtttctctgcgctcacttgggacccaattgagcccgagccgtcgatcagaaatatcagatcagtcctctgcttgggacagctcgtctgcactgcaattgaacaatgtgcaggccaatcacatcatgccaagtttggcttttctacctgtgcagactctgcccgggggcaaatgcgcatttgaggacacgtcgacgtagccggcaaagcattggcaactgtacccctggggcgtatcgatacagtccgcgttctcatcgcatgtgttcagtgaacgttccgcgcattcgttacttgctaaaattacatattttcagagtcaaagcaaatggagttagacaggaaacagacattaattaatttgaatcattacgaatttgaaacgacaatttttgctcattttaaatgtttcccaaaatcaatttctatacaattaaattttattttttaaatttatttttcgttttatttttattttcttttccgtcatttaaattttctttttttcttttgaaggtaacaacaaatagtatattatgctatttttaaaattgaatatcttcaattattttaatatttcaaataatatttgttaattattaatcattttccttttccatttttttttgatttaatcaaattgttctaaatcaaattaaccaaaaacgagttgttgcaaacgaagggtccgcccgtactaattagcggatgcaaaacccatcataatccccaatttgctaatggtccaattatttctaattcgattacgttagaaaatcagaaccttttgcggtctcttaatacgcacggcattttcattgtgcattatttaatttgctttacatttacacattttt

SEQ ID NO: 39159 - DNA, 1056 bp, Heterodera glycines
tttcggcgattccttgccatccttcttatcgctgacttctactattgaccgtccaatgtgagcagctggagggagtcttttgggtgacggatgggcggagacgaaacggaccgggtcgaataggccccgctgattgggccccaggaaggttttttggttaactcctttcataattgacataactgaatgaattaaaattcatttatagccctaaatgttctctattagcttgccaaataaaatttcgttgtggtgagttttattcattcagttaggtcaattacgaaaggtgctatacccaaaaaaccggcatgggacccattttgagcggggcccattcggcccccacccgagacgaaatgaggtaatacggttgaatgaaacaagggttttactccaaaaaacttattgttagagtaataattttgggaatgaaaaaacaaaccttgataactttgttgatggtgtagagccactcaatgatgcagtgggcacactcatggccacacgtgacagcgatattatctttgccggtcgttttacaaattttgatcaatgtccaaaatttgttttcacgccaattctttttttgagccgtcgatagtttgcgattaaccattttgctaagataacttgctgaaagggaaacattgcgaaatgtcattgctcaaattacttcaaatctcttttatcgtgtagagcatggacaatttgctaactctttccccaaattgatcacaaaatttgacataaaaaacatgtaattttcccttttacattttaatgtccatttttatgggttcgggtccgctcgaccgcgttcatttactacatatttgatggggaatttttttctgaacatttatattcgattttttaaaaatttgaaaaattgcgctttttagcggttttcagaattttactttttttttctgatcagttcgggggggggtcgggaaaaatgccgaaaattcacaataccaaatcggccatgctcgatacgataaaaaagcttttaaaatggtttgggtggattgacggacatttattactgcg

SEQ ID NO: 39160 - DNA, 981 bp, Heterodera glycines
tacccaaaagttttttacaaccacttattgccaatctaatttcttgcagattaaagccatccattgcctgccggttctcggcacagcaaagcactaatacggtgtttgactcacttcaaaaaataattcattacccaaaagttttttacaaccacttattgccaatctaatttcttgcagatttaaagccatccattgcctgccggttctcggcacagcaaagcactaatagggtgtttgactcacttcaaaaaataattccttacacaaaagttttttacaaccacttattgccaatctaatttcttgcagatttaaagccatccattgcctgccggttctcggcacagcaaagcactaatagggtgtttgactcacttcaaaaaataattcattacccaaaagttttttacaaccacttattgccaatataatttcttgcagatttaaagctatccattgcctgccggttctcggcacagcaaagcactaatagggtgtttgactcacttcaaaaaataattccttacacaaaagttttttacaaccacatattgccaatctaatttcttgcagattaaaagccatccattgcctgccggttctcggcacagcaaagcactaatagggtgtttgactcacttcaaaaaataattccttacacaaaagttttttacaaccacttattgccaatctaatttcttgcagatttaaagccatccattgcctgccggttctcggcacagcaaagcactaatacggtgtttgactcacttcaaaaaataattcattacccaaaagttttttacaaccacttattgccaatctaatttcttgcagatttaaagccatccattgcctgccggttctcggcacagcaaagcactaatagggtgtttgacacacttcaaaaaataattccttacacaaaagtttttttggaagacttattgccaatctaatttcttgcagatttaaagc

SEQ ID NO: 39161 - DNA, 1001 bp, Heterodera glycines
  misc_feature (908)..(908): n is a, c, g, or t
gaaaatgaaacaaattcgcggctttgctctcgcgttggagaaagcaatgcgcagaataactggggagacttagggttagcgcatcaattatttttttcagaatgtgatcggggtacaaaaatacgggtccaaaaatgggtgtaactccgcttggagatgcgttagaaaagaaagaaaaatatgttcggacagcttttgaagagctgcattgaatgctgcagtcgccgctgctgtacgcccacccgttgctgagttagggtcgagagcggcatgaaaaaagacaaaaaggaggaaaatgaaacaaattcgcggctttgccctcgcgttggagaaagcaatgcgcagaataactggggagacttagggttagcgcatcaattatttttttcagaatgtgatcggggtacaaaaatacgggtccaaaaatgggtgtaaatccgcttggagatgcgttagaaaagaaagaaaaatatgttcggacagcttttgaagagctgcattgaatgctgcagtcgccgctgctgtacgcccacccgttgctgagttagggtcgagagcggcatgaaaaaagacaaaaaggaggaaaatgaaacaaattcgcggctttgccctcgcgttggagaaagcaatgcgcagaataactggggagacttagggttagcgcatcaattatttttttcagaatgtgatcggggtacaaacaatacgggtccaaaaatgggtgtaactccgcttggagatgcgttagaaaagaaagaaaaatatgttcggacagcatttgaagagctgcattgaatgctgcagtcgccgctgctgtacgcccacgcgttgctgagttagggtcgagagcggcatgaaaaaagacaaaaaggaggaaaatgaaacaaattcgcggctttgccctcgcngtggagaaaagcatgcgcagaataactggggagacttagggttagcgcatcaattatttttttcggaatgtgatcggggtacaaaaaatacgg

SEQ ID NO: 39162 - DNA, 1466 bp, Heterodera glycines
  misc_feature (450)..(450): n is a, c, g, or t
actgcagcgcaattcaatttatgtatcctgctagaacgaggacacttcaactatattggacgaattgcacagctcttcaaggttcctggatactgcattgactgtgaacggagagcagacgcgcgttaccatgcgattggttgcaaggcggcatgtcgtctttgttttcgattcgggggtggatacccgtgtcaacgagaacgggttttaatttgagcttatttttttcagttataaaatttttttagttgtctgatggtcagatcagttcacgaaaatgtaccgaatgtggtttcattttcccaaatgacaactgttatgatgcgcaactccaacaatatatcaataatgagaatggggtaggacaaattcgccttgtaatcttcgaaaaggagcaagaataccgtattgtcttcaaggggagagggggtaatatttttttgttatctnaattaaaaaaaaacatttgaagaactgcagcgcaattcaatttatgtatcctgctagaacgaggacacttcaactatattggacgaattgcacagctcttcaaggttcctggatactgcattgactgtgaacggagagcagacgcgcgttaccatgcgattggttgcaaggcggcatgtcgtctttgttttcgattcgggggtggatacccgtgtcaacgagaacgggttttaatttgagcttatttttttcagttataaaatttttttagttgtctgatggtcagatcagttcacgaaaatgtaccgaatgtggtttcattttcccaaatgacaactgttatgaatatcatttggcgaatgatgcccctgctccaattgatgggcgcggacatagacaacggcgttcactttgtcaatggcgacgtttttgtcccacatgcggtcgtgttgcctattttggaatccatcaatgcccctcgatacgtcgtgctattgggccagttgattgctttcgttgcaaaggtccacatatgttggatgaaccttgctacatccaaccgattggtgttgcaccacctttaccaatgcttggtcctgttcacaacaacgacgacaacaacaacaacaacaacaacaacaacaacaacaacaacaacaacaatgaggatgaaaatgatattgatttcataatcaacaatctgggaggagaaggtgatgaagatgaagatgatgttgaaaacggggatgatattaatgatgatgatgatgatgatgagcgagatgaactgctaccacttcgtctttgcttcttcgatgccgaaacatcccaggagcgcccactacagcttaacaaccaagtcgcccataaacatgtacctttgctaatagttgctgaattcatttgtgaaccttgcattcgagctggaatcaacatcaacgatgggcaaggtcagcgcgcacccggttgcgtttgcctatgtggaagagtgagaggtcaacagatgcgtcaatgga

SEQ ID NO: 39163 - DNA, 1296 bp, Heterodera glycines
  misc_feature (538)..(538): n is a, c, g, or t
ttaattacccattccgaatgccgatagcaatttaattgttactgccaaacgatactcaatgaaattctggcctgaaaatgcggtgtacacaaaaagaaaattgccatgttgatgaaagcagttccataaatgaattaagtgccaaaatattattgaatgtgccatcaaaagtcagttcaattaatccatttttcagagcttttccatctacaatctgtctggcacattgttggacgacgacgcaaaacggcaaaaggtattatgtatgtgaatcgagtaagaatgtattcatttgacgaaatcacgcggagaaaagtgccaatgaaagggcattttatgcggacatatattataatttaattaaattcacgatattgcgtctctgggtgtcattaaataaataggtaaatgttgtctaataactaaaagcaattcgtttaaattgtaattgaaataaaatatcaaaatacatttaataaattcgataaattcatatgactaaaatttaagtcaacatcacgtcttttgctgactttanatggccttaaatgatttacaaaaattttatactttctttgatatcttctatcatatatttttacttttttggattttttttttaaatttttttatgactatttatcgtttttatattgctttttcatgactttttggcgatttttgtgactttttaatcgactttttggtaatttttggtgacttaagttcacagtcctattaattaattattttttggttcgcggaatcgaaccattgcagaaaccaaataaagactggagatttagccagtagactaaatgtttctgctttctttttatttaaaagaatagatcaatttaattattatttttttactttttctttttctcttaattttcccaaaagattttctctcaattgagtaacgaccagccaccctttgaacaactttaaacccattaaaatataaaattttattaatttaattatttataaacacattaaaaattgttcattaaaagcagaacattcacaataaaaattaataattacaattttttttatttcttgtttaactacacctgaatcttttctttattatttttttcttctcattttataaaatttttttattttaacaggttttaaccaattattttttttttttaattttaatcaccttttaaaatcaaatcaattcatttatcacatctaggggcacaaacccacaaactcaacatccaacaattgtttagatggaaggcagaaaaatgaacggaatgatttctatttcta

SEQ ID NO: 39164 - DNA, 897 bp, Heterodera glycines
tctctttttctgctcaacactcacatgaattccaaccttcctttcggaatagtagcgacgaccctaatttttctggattttctttctgggcgagtttggctctgaaaattttgaaaaaacgtctatctctttttctgctcaacactcaaatgaattccaaccacattttcggaatagtagcgacgaccctaatttttctggattttctttctgggcgagtttggctctgaaaattttgaaaaaacgtctatctctttttctgctcaacactcacatgaattccaaccacattttcggaataatagcgacgaccctaatttttctggattttctttctgggcgagtttggctctgaaaattttgaaaaaacgtctatctctttttctgctcaacactcaaatgaactccaaccacattttcggaataatagcgacgaccctaatttttctggattttctttctgggcgagtttggctccgaaaattttgaaaaaacgtctatctctttttctgctcaacactcaaatgaattccaaccacattttcggaatagtagcgacgaccctaatttttctggattttctttctgggcgagtttggctctgaaaattttgaaaaaacgtctatctctttttctgctcaacactcacatgaattccaaccacattttcggaatagtagcgacgaccctaatttttctggattttctttctgggcgagtttggctctgaaaattttgaaaaaacgtctatctctttttctgctcaacactcaaatgaattccaaccacattttcggaatagtagcgacgaccctaatttttctggattttctttctgggcgagtttggctctgaaaattttgaaaaaacgtctatctctttttctgctctacactc

SEQ ID NO: 39165 - DNA, 663 bp, Heterodera glycines
  misc_feature (649)..(649): n is a, c, g, or t
cttagatcacatgcgattttcggcactctgataattttagcgttcataatgggatgtataaaggcgattgtagaaggaattggatgcgctaaaattggttgagaagctttttgagcgtaattacgatttttacttacaccattttttgctaggcttagatcacatgagattttcggcactctgataattttagcgctcataatgggatgtataaaggcgattgtagaaggaattggatgcgctaaaattggttgagaagctttttgagcgtaattacgatttttacttacaccattttttgctaggcttagatcacatgcgattttcggcactctgataattttagcgttcataatgggatgtataaaggcgattgtagaaggaattggatgcgctaaaattggttgagaagctttttgagcgtagttacgatttttacttacaccattttttgctaggcttagatcacatgcgattttcggcactctgatcattttagcgttcataatgggatgtataaaggcgattgtagaaggaattggatgcgctaaaattggttgagaagctttttgagcgtagttacgatttttacttacacctttttttgctaggcttagatcacatgcgattttcggcactctgataattntagcgttcataatg

SEQ ID NO: 39166 - DNA, 814 bp, Heterodera glycines
  misc_feature (588)..(589): n is a, c, g, or t
  misc_feature (596)..(597): n is a, c, g, or t
  misc_feature (606)..(606): n is a, c, g, or t
  misc_feature (610)..(611): n is a, c, g, or t
  misc_feature (670)..(670): n is a, c, g, or t
  misc_feature (730)..(730): n is a, c, g, or t
cccattttttagagtttattttggggggtttttaagaccttaaagcctacctattttggcagtttttagagcctaaaactctcgagctctaattacgaacattgatacttttgtcacttcgtcttagccttagcaccaaattatttaattttgttaggtttaagaaattagatgattttttttgaaaaatttgtaaaattgcagtttttacgaaacgactcattcaacacggattttcatgcaacgcacctgaataagcttttgccgaacacttgcacttgctgcgcttcaatttcataaattgtttgtccaattgaccaaaattttccgtccaaattgttgttttggttcattaatgagtcaataagacattggaacacgtgattagcattaaattggttaaataattgttggaatgtccctaattgtatcgttgcaccagcaacaattgtgtgcacattttttatgccaatacattccatggtcagtgccaaaaagtgttgtacaatattgacttaagcaaatgtgctcgattttaatatacaaaataaaatacaaatataatatatattagggttgtgtattcanntatcgannataaatttntgannattggtaaaatgaccggtttcaagagctcgaatttgaaaagcgagactcggttggatangctagatagatactatatcaacagtagtttccagacattctatcagctatggatcaaccncgtagaccgatagtactatatcatcgtggtttcggactatcagtgtgattaatccgctctccgtctatcccgacactgatgctc

SEQ ID NO: 39167 - DNA, 922 bp, Heterodera glycines
  misc_feature (906)..(906): n is a, c, g, or t
gcttgaaccggtaataatgagaatgtcattttttaaacaattctactagacaaatactggacctcctatcagttagacaaaatatgaacgtttgttgtccaattgagagcgctttcggaaatgataattgcttgaaccggtaataatgagaatgtcattttttaaacaattctacgagacaaatactggacctcctatcaattaggcaaaatatgaacgcttgttgtccaattgagagcgctttcgtaaatgataattgcttgaaccggtaataatgagaatgtcattttttaaacaattctacgagacaaatactggacctcttatcattaggcaaaatatgaacgcttgttgtccaattgagagcgctttcgtaaatgataattgcttgaaccggtaataatgagaatgtcattttttaaacaattctacgagacaaatactggacctcctatcaattaggcaaaatatgaacgcttgttgtccaattaaaagcgctttcggaaataattgcttgaaccggtaataatgagaatgtcattttttaaacaattctacgagacaaatactggacctcctatcaattaggcaaaatatgaacgcttgttgtccaattgagagcgctttcggaaataattgcttgaaccggtaataatgagaatgccattttttaaacaattctacgagacaaatactggacctcctatcaattaggcaaaatatgaacgcttgttgtccaattgagagcgctttcgtaaatgataattgcttgaaccggtaataatgagaatgccattttttaaacaattctacgagacaaatactggacctcctatcaattaggcaaaatatgaacgcttgttgtccaattgagagcgctttcgtaaatgataattgcttgaaccnggtaataatgagaatg

SEQ ID NO: 39168 - DNA, 877 bp, Heterodera glycines
ttcagaactcggttctgaaaagtcattctgtaaaagtctttcactacaaaaatccgcaattttttcctctataatataaattttattttaaatttttatcacatttttaaaaaaagatataaaaataaaagtgattttgtgattcgggtccaaaggggggtgcacatggtttttaagtggaaaatttttttttcacaaaattcttccaaaaatatgtctttagagctattttagggttctgatcacaaatctgaaatcagatttcagttattacatcgttaagccctcagaatccctgtgtgattggggattctgagtcatcttctgaggggggggcggcaggttcgaatccggccggtgtaaattattttatatgcctttttacgtcattttcaatgtttttaattaatttaaaatattttgttgagttaataaataaaaaattatatttaaattattttttttttgatgaggttcggacccggacggtgtacattatttttctatgcatttttgggttattttcactgtttttaattaatttgaagattcgttttaatttatttaaactagcgggtgcgtgaaccgtcggctatttagctgggaaaaagcgcttcgcgctttgggagcttcgctacctagactgtgaagcgattcaaattgatcgaattggttggtgatttttttttgaatttttaaaaaattattatgagtgaaaaaatattttcgacaaaaatcttccaaaaacatgtctttaggggttatttgggccgctgatcacgaatacgtgatcagattttacttttgacatcgttaagccctcagaatccctgtgtgattagggattctgagtcatcttctgagggggggggggggg

SEQ ID NO: 39169 - DNA, 1043 bp, Heterodera glycines
atgaatttttccaaaaaaaccgctgaaaaatattcatttttttcaaattttataaaaattattttcgggggaaaacgtcctgctctgcctttcatagtagcccgaattgtatgaattctattcatttgatagcattgagtgttctttattaattgcatgggaaatttctaaaaattgcgttgagtttcaaaaggaaattccgaaaaaggcttccgatgtaagacgaaggacattttcaaattaaaaaaaaatcaaacgaatgtcacaaagatttttaaagcatcatttgacaaaaatgatgacaccaaaaaagagcgaatggaaaagagaacacaaatgtaggaccaccgtaggggacggcactaccttggccaccgccagcgccgccgccgcactcattgctggggtggtgggaccgatctgtgcaatgaaatgcgattttggaaagaattcaaaaaaaattctaagaaaatttcaaataaaaaagaccatttcactatgatcgaataaaatgactgtcggatggacaaatcgcaaaaaaaaaaaaaaatcgttgaaattctctcggccatgacgcgtctcgattcatgctttgccaaacatccgaatttgggtggatgagagcatgaaaatgggtggccaaccccacacgatgccctaaattataccatttttcagcgcttccaccgcgaacaccaacgcgtagccgccctccgccagcagggaacggaccgcgtacgaatggtggccaatggtcagcgtttggcccacgaggggatgcgatttgggatctggacagaaaaggtggaacaaaataatatatttgaattgggcaaatttgtaattagtggtaaacccggcaaaaatctaaacccccccccccagcacgaagtctactcccagaaaaacaaatccgcaaattctctgggtcttgtacaatttatgcgtccaatcattgattatctcctcaatttccaagaacataacattttccttactggtcaatgccttggcttttggtcatacattaaagaggggggggg

SEQ ID NO: 39170 - DNA, 688 bp, Heterodera glycines
taaaaacgcaaaaatgactaaatatttatttttctcgacttcctccaaaaattaattatacacgaaaaaccttcatgataataaaatattttaacacataaatgcttttttgagcccctttctttatagcatacgcgcagaaaaaaaaacttaccacaagctttaacgggtgacttatcaacattttttacattatcttgtgcctacggcgaatggcaatcgtgtctctaattagcacattaaattctggctgttgtcccgcaagcggcactatgtaattagttttacacctggttatgtaatttctaatgggcgaaaatctgacttagctatcccattaagcttttgctggtattgtaaatcggttggaaccataagaatgatttttgtttgaaatatatatttttttaaatatttatttttgccatttttctttttttttgaaaaataattattccaaaaatcttgccccaaaaaagccaaaatgcgtcattttaaatgattaattattattttggtttttattattcaattataattaatatttattttattttttatttaatttttacacttaacaaaagttattggcttcgtttcacttgccgttggcacaatcatttaaaataacttgaattaattgccatagaaacaaaaagaaaagcggtacattcgcataaacttttca

SEQ ID NO: 39171 - DNA, 1006 bp, Heterodera glycines
ttctttgtttgcttttttttggtttttcccattgctcttcttcgtcataatgcttcgaccttaaatgatcccataatcctttagtcgacgatttcttacacgaaaaagaattatgacaaaggacataaagccgtttccgacgtttgtgattttttataaaaagaccatatttcagacattttatctaaattagaaaaattcataggtaatattaacctgaaaaatgcaaatgcaggaagaagaacatttttcgatttacatttttagataattttattgttaaaattggcgaaatgttctaatttcaaaattttttgtcatttcaaagacaaaattcaaatttcttataacttttttgccttttcccacaaaaatgccattcttaggggtgtatatttaaccccgaccccgagtcggggttgagggtcggggtcggggttgtcggggttggaagcgtcggggttcggggtcggggttttccccgaaaatggccaaaaatgtcggggttcggggtggggtcggggacgcaaccctatttttaacatctaaaatctctaattatgatgcccaaatgttttgctaatattttttggcatttttcctttttccatccaatttttcattgaaaattttccacaaattctcttttctttttatcaatttcatttgaaaaattgtcaaaaaatttttcaaaatttgtttccaattgttctaattggtcacaatttatcgtactttcttgtttcacttgcaaattttgatcagtttcattctctccatttcctcggctttttcgtcccatttttggccaaatatttcatcaaagcttttttcttcgtttttctttcccgcataaatattatcaaatgtatttttgaagattaatattaataatattattttaattttcatatttttgaataaaaaaccataaaatgaatacaaatccttttactaattgattttatttgcgctttattaagcaaatcctacttgtttttatata

SEQ ID NO: 39172 - DNA, 1485 bp, Heterodera glycines
aaatatgccaaaaaatgtaggcttaacttttttagttctcttggatcactcatattttttgctaattgagcagaagcgttccaaactttgcagggatactccccggtaaaggactaacttacactgaaatgagcgccgagctagctggctcaaaaaaattttcgaaaatctgagtctttcgtttttatttattttttgcaaaattaattcttaaatattttttcagaaagggttctgaaacgcaccaaattttatttacatgttagtttaggcactctgatgctttttctatcaaaaagggagatgaataaaatttttaaaaatttttaattcctttttaaacaggccaaaaagtttaggcttaacttttttttcagaaactgatcagaagcgcaccaaactttgcagggatactgaaaggaagagaaataacctattttaaatattatctagtcagttcatttaaataatttttatccaaaaaatttttttttgggttttcggggcagtccccctgaaccgatgcgcccagatttatggggagaccgaatccttccggaatagcttcactatagcctgtactttaattctgcgttggatttttgctcccaataattgtttgagtaccccaaacggacacttgaaaaaatcgatttatttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataaatgtttgagtaccccaaacggacacttgaaaaaatcgatttttttgtttcataaatatttttttcagaaagtgctctaaagcgcaccaaattttatttacaacttaattttagcactctgatgctttagtatcaaaaaggaagatggagaaaaaattttttaaaaaatttttccttatattttggttatatcgttttgcttttggtggggtgcttggaacagtggaatcatgcgcacccgtccgatctggcaagttaagcaacgattgctgactagccaaaaggttcggtgccgtgatgaaacgaaccagcactgcttaccccgcggcacccggcacggtcccccgaaggaatggatttaattaaattctctccttcggggatttttttccattaggtcgtccgttagcgttcgattgctctagtcaatttttcaaaatttttgttgaaatatttgtcgtgctatgaagggcgtgggagggggggggggggcgaaggcccaccgcgggggcgcgaagaggccgagtgagtcccatcggtg

SEQ ID NO: 39173 - DNA, 969 bp, Heterodera glycines
  misc_feature (22)..(22): n is a, c, g, or t
tggaaattcttccactaatacnaggaagtagattggactaatgggaaaaataataaagatgaaaataaaaaatttatttttattaacgggcaaattgtcaatggatttaaatttattggcactaatattaatttttaaagacatttatttggtgccatttatttaccgactttcggcaattgcgatttggccaaaatcacttcttcgctttcgtcgccattttgtcttcgtcattttccatgatccatcggcagagatcacccgccatttacaattaatttttgctgtttattcgattgtccgcttcattagtaatgctcgtcattggaattcgcaccatatgcccattaaatggtgcttattatgtcgctaatggggtggtgcttttctttcgtcaccgtttttgccaatgtttgttttgtgttaacatttcatctttttgagcgatcattgagcaaaaaaaaaaaaattgttaagtgaatggcgaaataaatggaaatgcgattgcaaaataagcccacatttagcgcttcgaatgatcggcttaatccgtcgtcggaaaataacaaaaataataccgccgtaaaccaaaacaaacacattaaataatgcgcaattctcgcaattcgtgttttttggcggattatttgtccaataaatttcgcaaaatgtataaaagggaaacgaatgaatggacggaccacgcgcccctttcactttcatttgaaatcactccgccgatcattcacaaaagctcaaaaataatcccccgtaaagcgaacacaaaatgagaatgacccaagacgcaaatttgagcactttttgtgcccttttcactttccttctgattgttgaaggaactttcggcatttttggcattggcagcagtgacaatgacacaacgacgacgacgacacagggagggggagggacatcgacgacgacggcaaaaccaaagggaggagggac

SEQ ID NO: 39174 - DNA, 1015 bp, Heterodera glycines
cagcagccatcaccgttcaaagccgagcacaagcgcaagcaagcacttgaacccagacggccgcgctccccacagcgaaatcgcatctttttccagccacaatatcgcaaaaacggcccaaccaccaccactcacccacgccaaccaaccaacgcaaagcacatacgactaggaactttatacaaattttaaaaaagtaatattttgtatatgcatttaatcaaatttctactttctttataaatgttagctaattagtcagcgtctatttattttctgtaaaaatttgcctctttatttaaaattaaattatatataatttcatgaaataagacactaaatgtatagagaatgaattaacgtggtcgattggaataaatggaaaaaaagcaaagtcaaagacaaaaccttaaagcactagccgattgaaataaatggacaaaaaagcaaagtcaaagacaaaaccttaaagcactagccgattgaaataaatggacaaaaaagcaaagtcaaagacaaaactttaaagcactagccgattgaaataaatggacaaaaaagcaaattcaaagacaaaactttaaagcactagccgattgaaataaatggaaaaaaagcaaagtcaaagacaaaaccttaaagcactaggcgattggaataaatggaaaaaaagcagtcaaagacaaaactttaaagcactagccgattgaaataaatggacaaaaaagcaaattcaaagacaaaactttaaagcactagccgattgaaataaatggacaaaaaagcaaattcaaagacaaaactttaaagcactagccgattgaaataaatggaaaaaaagcaaagtcaaagacaaaaccttaaagcactagtcgattggaataaatggaaaaaaagcaaagtcaagaacttatcctacctaatttcatggtgactgaccaggcatttgactcccttaagagagccttcccttctcatgtacttgttacctaagatgttgatggtacaaacagta

SEQ ID NO: 39175 - DNA, 1313 bp, Heterodera glycines
  misc_feature (116)..(116): n is a, c, g, or t
  misc_feature (1229)..(1229): n is a, c, g, or t
tgaggccttttaccatatccagcagagttttaatgagatagatcttttgaatgaggaaataacaatgataattacaacttactccgttccaatgggatcaggcatagaggcagttntaaattaacaaattttaacattttaagggtcaaaaatcaatacatcaacatttttcgatgtaaaagaaaatggaagaattgtggtcaaaaattcagacaaatactgtcttttttatagtgttgttttgagtcaactatatcaaacaataggcactgaaatttcgtactcaatgtttcgaagaattctcagtaacgctaaacgacaacgaatttatgtggatgatttgatccgaaatgctaaaattgaaccgaataagaaaaactatggaattgacgagttgagacaaattcaagagtatttgaaccaagaatttcccggaaaatttttaattgcggcttttacaaaggtaaatttttaagattattttttccccaaatatatttaggaatgggggataaaaccaatatacaagggagatggaccaaaaaaatacattgtttgcgtttttcatgagaatgatcactgggatggtaagcgggtttttcaattagattattacaaaaaaaaatttaggattaaaaagcgtaaaacaatttttcaacataaaacattattattgtatatattgtgaacagacattccgagaaaaaattagacacacggtcaactgtgtaattaaatgtcagcgttgtggcggatggggtattattttagggacgggtaataataatttataaaaatttttaggtttaaattttccatgtgaaaaagaagggcgtgagcccattgaatgtttaaaatgtaatcgacttttctttagcgatttctgttttcaaaatcatctaaaattagcttgcaaattatacagaaggtgtacattatgtgatagcgaatacaacactcgtaacaaacatatttgcggtaaaatatttcttttaaaaatgtttttttcacatgtttaggaataaaattctgtaacttttgcaaagtaaaacacgccaaatcagagagttgttacatcaagaaaattaatattcccaagaatttaccaagatatcgtattgttagctatgatatagaatgttcagtaagcatcgaaaaaagctaatttacaaatttttaaattgaatttagacggataattctttttccgagggaaaattcgagcatanagttgtctttttatctgctcgattcacgtgcagcgattgtgacaatgaaaataaaaattgtgatatttgcggtcaaaaaggaat

SEQ ID NO: 39176 - DNA, 1036 bp, Heterodera glycines
ttattcaaaaatttccaccatttttggggtcggatttccgtgtttcgaaaatttgtcatcctaacttacacctcgtgggcgtcctccataatacagatgagaagaagagataatatcgcacaatgatgtttaacaatttaaagccctccattcgtttctatacatgagatttgttcatcggtcaacagttggggtgcctttgctaatgtcccatctgatgagagtaattagtcaaaattgactcttacgaaaaagaagaaatatccctttacagaatacgcccgcttactttattggaataccaatgaaattgaaaactcaaaaaattgagcatttttctgtcggttgttgtcgttggaatgggagcgacgattatttaccttttgaacaaccgttgagtataaagctaaatgtccattttttcacgtgttcgtttttatcggcatattttttgcttgggtataaaaatggagcgtcgtctagaaatgatttttcattagcaattccaaattcgattcaataatcgtgccgcagaaaatattaaaaatctgattttttgattccgattacactgaaatgtacgatttgctaggttccccctccccaaaaaaattgttaaagatgataattgggcgcaaataagacaattagagcacgactaaaaaggcaccaaaaatcacgaaaaaggcacaggcactataataggcacaaaaaattgaaaaaaggcattaaaataggcatttaaattttttattaaggatttttgagatcaaaatacgcaaaactaaatcaaaaaaacttaattttggtcatttaaatgattattaatatttaataattttttcgaataaggaaaatttttaaacctaaaattttttatcaagaaaaaaaaaattttggcgatcaatttttgaggaaaaatccaattcttagggatatattttctcaagttttttgggtcatttcttaggggtgtattttcccgaatttattgcatttttaatggaatttttcgtaaaaaacgccagaaaaggca

SEQ ID NO: 39177 - DNA, 580 bp, Heterodera glycines
ccaggggcctattcaaattagcatagtatcaacgatgcgatgatacgatgatcatatgcgtgttcaaattaaggactttcgccatatgatgagctgtcgtttgcagctcatcatacgatgagatcgtacgatgatccaatcgcacgttctcatcatacgatcgtatggctgttcaaattaattttatggataagatgtgatgatatgatacgatgaatgcatacgatgtttaccacaaatcattttatgtcttaaaaatatttccattggcaattttaaaataattttaaattcgacaaaaatttaataaaaataattacttttaatattcgctgttattttctccatttttattcaacgccagagtcagcagtagttagtaacattctcagcagcagaaatattccaaattttttctatcgacagcgggccatgcaaataaactatctttttgccatttacacccaatttatttaaaatttttgtagataaaatgaaataagccgaaaaaaatttgcgaattctttatgaatgattcggagaagttttcaattatttaaaaactgttaataatatttga

SEQ ID NO: 39178 - DNA, 1072 bp, Heterodera glycines
tttttagtttttttaaatattaatttgtatgaaaatttggctgagatagattttacatttcatcacaaatggaattattctcgcgagatttggataagcccaattggatggtattgaggtgaagagggaggggctgaacgaatgaataactgggaatgagcgagaatatatatggattggaggaatcgatcggagggggggggggggagaattgccccttcccctttcatggccacaaaagctatgcccaaacagaaaaagcttattagcttttctccgcttccgtttgcaccccaaaatttgaacgcgcgccgcacgcatctcaaaaagaggaaaagcggcggtaagggcaaaagggagggagggaaaagcgggggggggggcggggggtgggaaggcaacatcaaaagacgggggccgcacactgagcaaatgcaatggcatggcatggaactgattgattatggagggggtcttttatctgtttttgtttctgtacatctctaaacagttgtaaagcaaataacaaacgaataagtgaaaaagtatcaattggagggggggggggggaatttgcattgaaaagttcatattaaaacaaatgcttgtgccgtaacattcatcattggatcaaaatgggtgaactacaataaatgatcactaaaaatcgaaagttacggcacaaaaaatatacagaaaacgattaaagcgtacaaaaaaatacaaatgggaagaaataattcgtacaattgtaattaattaattgggagagaaagcaatttttttgtgctttttttcttttaatcgaaaaggaaaaaaggaactctaattttatgattgtctgacattgtaataaaataccaagtgtttaaaacagttttcaggatgttgtcaggacattgggctccaaacatagactttttgtcctcccgcggatactcccacaaagtccaaaaaccctcccaaaacctgggggccgttggtgacaacatccccaaaatggatggcaacagtgtaaaagggaatttggcataaaaaggccatttatagttgagcatacgcaattcattgc

SEQ ID NO: 39179 - DNA, 691 bp, Heterodera glycines
ttcacaaatttagataaaaatattaatttaaattattttttttccttgacaatcgacctgaataatttcaagaggttatgatggggtttttaagtaaattttctgatttatattttcttgaaatttaaccttaactttttcaattttattaattcaaaaaatgtaaaatgttttttagcttataaagaagttctttttttaaatattatttgtttaataaagttatatgatcgcgaagatcgcgacgaatttatttaatggaatttaatagttacggtatttatttatttaaaattattcacattttaaatttattgagtttcattttttataattttattacaatgtttactttttaagatcggtattttggtactgttacttatttgcatttctttcattttgataaagataaatgtgaaattttaaagcaaaattgaacatttaaagttcgttaaatagtggtataattttcatttttctgttatttaataaagcttttatttgtattacaaaattatagagatttattaaatattttgaaatagtatcgcagtctccacttaaatagtctgctttttttttgttttaattgtgaactaatttaaatataaatttaattaaagggctattggtttctttacaataacttattttggtataacctatttatttggttattttatttttt

SEQ ID NO: 39180 - DNA, 804 bp, Heterodera glycines
cgcccccccccccgcccttcaaaattttgaaaaataaataaaataataggagactcagaattttgaaaattttttataaaaactgatgacaagctaatgtgataaaacaggttaattcttttcctttcagtatccctgcaaagtttggggcgcttctgataagtttctgaaaaaaaagataagcctaaactttttggcctgtttaaaaaggaattaaaaatttttaaaatttattcagtgtccgtttggggtactcaaacatttattggggagcaaaaatccaacgcagaattaaagtacagactatagggaagctattcccgaaggattcggtctccccataaatctgggcgcatcggttcagggggactgccccgaaaacccaaaaaaaattttttggataaaaattatttaaatgaactgagcatcagagtgcctaaactaacatgtaaataaaatttggtgcgtttcagaaccctttctgaaaaaatatttaagaattaattttgcaaaaaataaataaaaacgaaagactcagattttcgaaaatttttttgagccagctagctcggcgctcatttcagtgtaagttagtcctttaccggggagtatccctgcaaagtttggtacgcttctgctcaattagcaaaaaatatgagtgatcgaattttcactaaaaaagttaagcctacattttttggcatatttaaaaagcaactaaaaaatttttaaaatttaataattttcctgcaccgaaggtactcactcggcctcttcgcggcctcgtggtgggccttcgccccc

SEQ ID NO: 39181 - DNA, 1015 bp, Heterodera glycines
acaaattccacctgggtgagcacacatttcagataccctccctatcattatttcttagaaataactaataatctgttgcacagttatttcaaaataaattcgaatatattagcttattatgcatcttcagtgtgcattctaaaataaaatcattttttgttctaattttatgatttatttgtttctgttgactaaatagtcggttcttatagcaaatattaatttatatttgcgtagcttcaaatgagcattctgccttcaatttcgaagggaagtgaatttttttataataaattgatagagagcaaaaagcacgattgtataatattcaaaaaatttatctatgcatttgttgaatgttcctaaacccgatcaaattttaaaacctttatatgaaaacatttattgcaggaaatgacaaattccaacctgggtgagcacacatttcagataagcttcctatcattatttcttagaaacaactaataatctgttgaacagttatttcaaaataaattcgaatatattagcttattatgcatcttcagtgtgcattctaaaataaaatcattttttgttctaattttatgatttatttgttttctgttgactaaatagtcggttcttatagcaaatattaatttatatttgcgtagcttcaaatgagcattctgccttcaatttcgaagggaagtgaatttttttataataaattgatagagagcaaaaagcacaattgtataatatacaaaaaatttatctatgcatttgttgaacgtttctaaacccgatcgaattttttaaacctttatatgaaaacatttattacaggaaatgacaaattccaacctgggagagcacacatttcagataagcttcctatcattatttctttagaacaactaataatctgttgaacagttatttcaaaataaattcgaatatattagcttattatgcatcttcagtgtgcattctaaaaataaatcatttttttgtctaattttatgattta

SEQ ID NO: 39182 - DNA, 1245 bp, Heterodera glycines
  misc_feature (19)..(19): n is a, c, g, or t
aggtcttttttaattatantttttgattaataaggtagtaccccttcttacaattttgaaaatatttcttacaaattagctttgcataaatgataataattcaaaaataacagcacgtttctcattgcttgaacggataaaagcaagacaaataaataagatatccattttttgttgagaaaatgccaattctggctggatgaagttaataggattgtcatcttaaaaaataaatattaaaataaattaaatagaactatgaaattattttaaaataaaaatttttttatacggactgtcaaaaagtccagtgtcgaaaagtccttccgaataccctttgcagacgactcaatgacaactcgtacaaatggcaaaacaataaacattttgcaagataaagcctaagcgtaagcccaggcctaagcaagcataagcttcggcctagccaaagttcacgctttgttctgtttcctttcaaataatttgttgttgctgctccagaaaaaaatccagttcgcatttatatagagtctaaattatcattcagtagtaacgtttttatgcaaaagaaatcattgaaaaaggaaaccaatggatagataaataggtaaatggaaagagtgtaaatgacagtaaaagcgaaccattgggaagaaaagtgttgagttgtaactcaaaaaccatcaaatggaaaattttgactaaaagtaatatttaattataaacacaactttctgaaactattaaaattttttgaaatttattagaggctaatagagaacactgagtgctatcaattgatattaagttgaaaaatttgttgtttttagcaaagttatgggcaaaaaaaaaaaaaaaatttgtttgatgcttttttgagtaacgccataacaccgtacaaaagagagaaaatggccacactcaaacgacccccaccgtatttttaggtcgtccatttttgtaagaaaaaataggtaaatttttttgcaatatgaatgaaattaataactcaaaaaaattaaatttgtaggctttacttaccaaaatttgatggccaacacaatttgcctgataaattttttttaaacaaattcacacagttttttcataatcacaatccgttttcattattatcaagcatatattctcagattaatttttgaaaattgtcgcatgtgaaaacaaaagtaaacaattattataattatgggtcaaaatcacaaacattttggcgctaagttaata

SEQ ID NO: 39183 - DNA, 1076 bp, Heterodera glycines
tttttgaaaaattttgaaattttctcggaattagaattagtggtttctttttcatttttattcaattttaaaaaaaacttcagaagaaatatgtgcaccctaaatgttgtccacccaatggaatcagatttttagtttaacaagcgaaaattcactattttaaaaaataattttcaattttcacgcatatttttgcaaataatttgcattttttttacccattccttacttttttgtgacgaaaaagcttgattgattggacaaactaacaataattagtggtgaggaatgaccggaaaaaaacgaacaaaatttttgtaaatgattaattaattaattgattaattaattaattacccacttcattaaataattagagagcgtattgatcaaaaatttattaatgaaaggcagagggatgaactgtgaacggaggcggaaaagcggaaataaaagaataaaagaacaggtcacacaaattttggaataagtgaattgatcagaaaatgatcggaaccaaagagattaatgatcagaaagaatagtgctgacagagtgattgatcagaaacgaaaaaggaaaaaggtatataataaattagccaaaaaagcagtcggaaacgccggaagaaatgatcaaacatataagtaaatgatcggaaattggaaaattgaaaccgtttgttcaaaaatttgagtagttgatcagaaagaaaagatggtgaaaaaaataccatatgagtgacattagaaaattgtcgtaaagtgatcggaataattgttgacaggttattgattagaatcagaattcttacaaagtttattggcaattttggactgataaattatgaagggaaggaatcttttccatttttgttgttttttgtttattgctgacagagtgactgatcagaaaagaaaataaataaatttggccaaaaaatgaccgggaacgccggaagaaatgatcaaaaatagaacgaaatgttcggaaattggggtgattgatctcgatcacaaagacaaatgaaaccctttatgaaaaatttgagtaattgatcagaaagaaacactgat

SEQ ID NO: 39184 - DNA, 1319 bp, Heterodera glycines
  misc_feature (48)..(48): n is a, c, g, or t
  misc_feature (53)..(53): n is a, c, g, or t
  misc_feature (76)..(76): n is a, c, g, or t
tttgcagggatactgaaaggaagagaaataacctatttcattattatntagtnagttgatttaaataatttttatnaacaaatttttttttgggttttcggggcagtccccctgaaccgatgcgcccagatttatggggagaccgaatccttccggaatagcttcactatagcctgtactttaattctgcgttggatttttgctccccataattgtttgagtaccccaaacggacacttgaaaaaatcgatttatttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgagccgatgcgcccagatttatggggagaccgaatccttcgggagtagcttccctatagcctgtactttaattctgcgttggatttttgctccccataattgtttgagtaccccaaacggacacttgaaaaaatcgatttttttgttttcggggcagtccccccgaaccgatgcgccctgagtaccttcggtgcaggaaaattattaaattttaaaaattttttaattgctttttaaatatgccaaaaaatgtaggcttaacttttttagtgaaaattcgatcactcatattttttgctaattgagcagaagcgtaccaaactttgcagggatactccccggtaaaggactaacttacactgaaatgagcgccgagctagctggctcaaaaaaattttcgaaaatctgagtctttcgtttttatttattttttggaaaattaattcttaaatattttttcagaaagggttctgaaacgcaccaaattttatttacatgttagtttaggcactctgatgctttttctatcaaaaagggagatgaataaaatttttaaaaatttttaattcctttttaaacaggccaaaaagtttaggcttaacttttttttcagaaactgatcagaagcgcaccaaactttgcagggatactgaaaggaagagaaataacctataaagatattatctagtcagttcatttaaataatttttat

SEQ ID NO: 39185 - DNA, 1054 bp, Heterodera glycines
gcttgctgcctgcggtctgctggtgtgttgagtcccagagattgaaatgcttctttctatgagtctcagagattgaaatgctgctggtgggttgctttccagagattggaatggcggagatttgagtcccagtgtttggaatgccagagatttgagttccagtgtctggaatgccagagatttgagttccagtgattggaaagcctgagaattgagtcccagagattgaaatgctggtgggttgagtcccagtgtctggaatgccggagatttgagtcaccgagattgaaatgctggtgggttgagtcccagagattgaaatgctggtgggttgagtcccagagattggaatgccaatgaaagttggtgggttgagtcccagtattggaatgctggtggcctgattttcagtgattggaatgtcattgaaagttgttgggctgagtcccaatgtttagaatgccgcagatttgagtcccagtgtttggaatgccggagatttgagtcccagtgtttggaatgccagagatttgagttccagtgattggaaagcctgagaattgagtcccagagattgaaatgctggtgggttgagtcccagtgtctggaatgccggagatttgagtcaccgagattgaaatgctggtgggttgagtcccagagattgaaatgctggtgggttgagtcccagagattggaatgccaatgaaagttggtgggttgagtcccagtgtttggaatgccggagatttgagtcccagagattgaaatgttggtgggttgagtcccagcgattggaaagcctgagaattgagtctcatagcttgaaatgctggttggggtgagtcccagagattggaatgacattgaaatgctggtgggttgagtcccagtgtctggaatgccggagatttgagtcccagagattgaaatgctggggggttgagtcccagagattgaaatgctggtggcttgagtctcagagattgaattgctgctggtggcttgagtcccagagattgaaatgccattgagagttggtagcatgagtccc

SEQ ID NO: 39186 - DNA, 1139 bp, Heterodera glycines
aaacccataataattttttaaaaattcaaaaaaacatttccaattcgatcaatttgaatcgcttcaaagtctaggtagcgaagctcccaaagcgcgaagcgcttttccacagctaaatagccgacggtttacgcacccgctagtttatatataactaaagcaacatcgagtttcattgctaaaactaaaatctcgggaaccgctggcgggaggggctcgggagtgtggcattgcttaagcaactttttgaggcgcatccaggaaaactataggcattccgttccggaggccaactgagcgccagcggcgctgaaacggctttttgaggcaaaatgcatgcagttttggggccataacttttttctggaaacctggagcaaaaaacttctgctgggaggcgactaagttggaatgtttgggaaatttttttcttcttggccgaagccctaggatcaaacgcctggcctgcaaaaattcgcaaaaatttttttccatttttccatttttccggtttttcgggaataactcgctgggtgttgcgctgagcgtgttggcgccgctgaactttttgtacagctcgacgagctctatcttgtcaattttttaaatttctgaaattttcagaaattttcgagctaggccccctcatcacttttgaggtttttgaattttagtattttttgcagatttttttcggcaaaaccaagaccactttcaagcaaccgtttttcacgctctatcgattggtggcattttcagaaaaatttttcaaaatttttttggaaatagaaaattttggttgctaggcctcaatttcagttctggctcaataactcgtcaggagttgattttagcaaaaaatcttcttagacaatttttgtagggaattttaagccctatataatgtgctttatatcatctcattatcacgagtctaaaaaaagttataaaattaattgtgattttgaaattcaaaaccataggggggaccccatggttttgcatttcatgaaaaatttttttgcttctaaattagccaaaatgcatttttatggcctaatttatggtgctgaactcgaatatatactttatttttggtttcagactttttggtaagtgtttaaaattttttcaaaaat

SEQ ID NO: 39187 - DNA, 1225 bp, Heterodera glycines
  misc_feature (1110)..(1110): n is a, c, g, or t
tgatccggctcaaaagtcgctcataatccttgccgggtcaaaaccacgtggactcgtctaaatcgacatttatctgacagccgacttttctaacaacttcaaacgttccatcaactgccacttcgtctctgtaggcccggagggtgttaatcccaaattgtgaacagaaaataatcattcggcttcctttgagattttggttgtagatgactcgatcaaccaactgatcgggtattacaatatcatgggttggaacagcatccaacccagcgtcgccttcctcaaataaacaataaaaataatttttttctatattttatttttttgaccgccatttgttgctttcggcggtgataattatatgtccatctcatgcaagaagggcctggtgcagacgcaactcgaactttaagaggcaaattcgaacggacgtcactgacaatatttcggcttgaagttgggtattcgctccttgcttcttggcgaagcctttcagctgatactcgaatctgtccaactttgtcttatacccttagaagcaatttatttgtaccaattcagcaccaaatgtagccggatggttgtgttcttttgtaaccctgcccaatttatactgtactccatcagcttcttgatgccattcgatttggacgcacgcacgaccaggacaataaggagaacggcaagggcaccgccaatattcccacccatctttgactttagataaagccttaaaatcactgatcagatttttgacattagtttgttggacctcaaatgcatactcaaacccggcatttgttagcaggattttcccacgcgatgatttagccgcattaaaacgcaataaagccattatttgactaagaaaaaatttagtaaaaatggaactatggattgaggagaatgataatatggacgaagaatgaccacaggtcattcatattataactttactcgaaaatcttatctaggaaattgtttgtcgagaacagcacagcagcaggagatgtttgcgcagaaaaaattaacgcgataagaatattttatatttttacaaaaaataaccatacaattttagttgtttaatattatttatttatttatttnaattaaatttcttataaattttttatgtatatgaaaataatatttaaaattaattcatatgtgcatatacataaaaatataattttaaaaaaaataatttaaaaaattttatact

SEQ ID NO: 39188 - DNA, 988 bp, Heterodera glycines
aaaccccagatttttgaatccggttttcagaaaaaatgccctgtggtgaaaacaatatttcacattccactccataactttgtgagttcggcacggatcgagaccgggataagaccatggaaagagcagctcgagctctacaagaaggtatggaaagaaaaaatagttatttctgggactttttcagaaatcagaattaattctccaatgtggcccaaattttaggcccccagccacagccccttgcttctcccagttttaagtcttggatttgtcaaataaattcaagacttcaaattaataatcaaaaattctcttaaaatttttttgaacccaattcaaaaaaggaaaaaaatttgcagtcaaaaaattattcgaatttctccaattttgtttccataatttccgaaagttattcggtatcataatgccaaaacaaaacgaaatcgttttaaaatattcctttctggacttgacttggtttcttgatatcgaagctgttttctacgctatttctaaaacggttataccaaaccccagatttttgaatccggttttcagaaaaaatgccttgtggtgaaaacaatatttcacatttcactccataactttgtgagttcggcacggatcgagaccgggataagaccattggaaagagcagctcgagctctacaagaaggtatggaaagaaaaaatagttatttctgggactttttcagaaatcagaattaattctccaatgtggcccaaattttaggcccccagccacagccccttgcttctcccagttttaagtcttggatttgtcaaataaattcaagacttcaaattaataatcaaaaattctcttaaaatttttttgaacccaattcaaaaaaggaaaaaaatttgcagtcaaaaaattattcgaatttctccaattttgtttccataatttccgaaagttattcaatatcataatgccaaaacaaaacgaaatcgtttaaaa

SEQ ID NO: 39189 - DNA, 885 bp, Heterodera glycines
  misc_feature (27)..(27): n is a, c, g, or t
  misc_feature (57)..(57): n is a, c, g, or t
cattggtgacgaaacatgtcaaaatantttgtgccaatcccttataaaaaataatantttgctaaaaatacaattaaattttgttagtacaaaaatacaaaacggaaactccgttatttttggaatttttctttttaaacaccattaaacaattgttttaaaagggcaattaacaaatgtccggttacgtgccgaccgtggcgatgttcgccgtcgctctgctgctccactgcttcgcgctgtcccgcgtgttcatgatcgtccacttcaagctgaacacgcacaaggatatgtcacccttgctgatggcgctgatcctcaactggacattgttctgccttttggtcatcccctacgaggtgtacagcatcgccaactggcgacccacccaaggcatgtactgttctgcagcattcactctctattgtcgtccgttgttgggagaagtccgagaggcaagagtcccgtcccgatctcctaatcaggctccatctcgggactttttgatttcgggaatcagttcgagagtgaggaagacccactatttttgaaattcttctacaatatgccagtctcgagaacttttcggtctcgaaagccattactgagcagaaatggttatttgttatcagtgttgaagtactttggcattaatctggaggctttgccttttttctagagaagtcagcagtcctttgatcagctagcatttgattaaccaatcaatcctttttggattttgcccattgtttcgtccccccttagagttgtaccaccccggcttggtgctgtttgtcatcgctttgccatgccatctctttcttgccatgatccccgtctcggtgttctttctcactttcgaccgtatctgcatcatttactatg

SEQ ID NO: 39190 - DNA, 430 bp, Heterodera glycines
aaaatttattttttacttttttattgtctctcctccacccgaggcaacgatttttcatttattttctactttttccccattaaatttgtttatgcgtttatccgtccgcccgtcccccttttttatctgtcccccccccccccggggacgaagcgacacacacacaaaaaaaaaatcctattgccccctccgccccccgcgccgtccgcgtcagctttatctcactcaccgccgcccgtcccttccggcgctgtgtcccccgctcctcaaaaacatatgtttatgagaggcgcgccgagaggagacgagacgaaatgtgaagaataatgactccgctcgccccggccccgagggtttaatgtgaaaaagcggcggtgaaaacggacgacggacgacgaaacacttgagcccccaagggacggggggaggt

SEQ ID NO: 39191 - DNA, 1203 bp, Heterodera glycines
  misc_feature (1192)..(1192): n is a, c, g, or t
atgactgatgtggcaaaagattgttgcgatattcaactgttaatcaattttcggtcagacaaagcggcgaaaaatgtaattctcacaaattgagtatttattacgttcattttaggaattttttttttgaatttagtgaaaatccgtaattatgttaaatcatcaattgttttaaataattaaacttatcacttatgaatatttttaaagtttttaatttttaaataattttgttaaatttgtgaaatttttgatttatatgtatagcattttgtttaaatgatataatattattaaaaaataaaattaaattctaattaggcatttttaaacaattaaattttattctacaaaattgtttaataattcacatttaaaactgagaatattaaaaaaaatttatccctgtacatacaataaactgaaatctgaacaaaaggcagtcaataccgcacattctgatcagtaatgagtaataaatgcttcatctcttcccctccccaaaaaatattacgtgaatgagtgatcaattgctttccactggcattaaactcgcatttggccaacatatccaccaaatcccccgaggggctatgtgttggattaagctatggatggatgaatcacacaaatccgcacttcttcaactgacgattggatggatttggtttctgtctcggctcatctccgaacctcctctctcccatcaatccattcatctttctgtgccacagggggacgaagagatgaagccgcttcatccattcactcattcattgccttggcccccatcgggccaatgctttggcggcgaacaaatgtttagttgagtgggtcttcctcgctccctccctgctgctgttgcttgctcagggccaacatttgctggcatatccgaggagcgtatgatggcccatgaaatatctgcggaaatgcctcttccaaaacacacccatcccaaacttttataatggcaatgatcaaacaaatgatttgcttttgaatttttacgtttgatcaagttttttaaataaccctcattaaagcatttaatttttttgaataggttatttcggcttttaaatgattgggactacaattgaagaaatttttatcttctattttagttttaaatttttctgtttcaatcgttttttttgaattacaaaattataggtaaagttattctcanaaaacaatttt

SEQ ID NO: 39192 - DNA, 1116 bp, Heterodera glycines
  misc_feature (17)..(17): n is a, c, g, or t
  misc_feature (118)..(118): n is a, c, g, or t
  misc_feature (140)..(140): n is a, c, g, or t
  misc_feature (220)..(220): n is a, c, g, or t
aaaaaaaaatttaaaanttaatcatataaaaaaaattattaatttattttaaataaattttacattatatatttagtataggaatttattgttatttggtattttgtagtcactgaantcattttaatattcctttagcnaaccatttaatggcgaactaattaatcaattattgaacagcaggtgttttacgcgaaattttatctatttgttaagccanccgacgggaggattacgtcaaaagccgaaaaaggaggtcgtcgcttttgcgtttctgcgaaaattcgcgtgccaaaaatggacgcaaataaatgcccaacagcaaacatgccgataatacggggaacttattacggcaccagaagtaattcaattagataaacaatattttaaccccggggcggcggcactcatttcgcgtcaccaatggcacaaaaatagaaaaatatacttaaaaattataaaaaaaaatgttgggctatctttggcagtgtcggcacgaaaagatacaaaaaaacggaaagcgaatcatatgatgtcacgaaatatatgcttgaaaactacggtaacaaaaaaaaatgaaaaattagttcagcagattataagctggccgcgcgaaagtcgaaattttcagagacccaaatatatgtgccattttcatcaaatttgtgggccctcggttttttttaaatttcaaaaattttcaattttagttagggtctattcccgaccctggtcatctgtggcatatcaaaatcagatgagagtgccaattaaatgaatgagtttctgtttctatgattttttaaaaatctattgtctttttctctttcctgacgagcgtatttctcgccgacattttttaaagcggagtaggacaaaacgtcgtcagccgaaacgtcgtcgaacgaatttttcgaccataacttttttctttctcaaccaaattaaacattcttggtattattcgaaagcattcgaaaaatgctattagcctgcaaattttcaaaaatttttatttatacacaaaaaaatcagagcaaaaaaaagttcgaattactgggtttttgagttccttctggtcataacttgtttgaaagttgaccaaaatttttg

SEQ ID NO: 39193 - DNA, 1263 bp, Heterodera glycines
tttgtcgaggacctgtaaaaatttgatttttaattgcattgaagtttttatcaaaatttcatcactttttggcgtcgaatcgactctgcgaccatgctcttggcgccattccttccgtttttgtcttgcttctgcactagaagcccaaaatggcttttggtgacttgacattattaaatgaatattaaaatttctggaaaatgagtcaaatgttagtccctttcaaaaaatttttctagctttttaaatttcttgaaattttgcataggcccatattttgaccccctctatcgaattctcttttgttatttgaaagtttcttttttaactcgagatcggctcttcagtttttacaagggaaaatctcggcaaaattttttaattaatggggttttttggcgttttgtctgtgcgcacttttggtcaaattgatgatatatggcccagaattatttgtacaaaaatgatgtgctgaagataatcgattattgaatttttatgaacatttctggcaaaacgcaaaaataggtgaaaataagtttttcaaaaaaaaatagttaaaaatagagtgccacgggaccgggaatttttgccaaaaccgggaccgggacttgccgggacctgagaagccgggaccgggacctcgattttttttcgggaccgggaccgggaccgcaagaaaaaccgggaccaaccgggaaattttaaaaattcaaaaaaattttaaaaattaaaaaaaaattcaaattttaatttatatcaagtgaaaataatacaaaattatttggttttttatttaataaattaaattaatgaaaattttcaaacaaattttcttcaattatttcaaacaattaatcatttttggactaaatcatcgaatattaatagaaattcagatttgattttcacatcactttttttcggagcgctttttcaaaaaacttttgggaaagaaggggtccggcggtgccgataggcgccgcagggggaaattttaaaaatttgggtgcaatttgttaacagattttcaacaaaaaaggttggtttttgcgattattaagctcaattggtaggattttcatttaaaaaatgatagaatatgtatcaatttaaaaaaaaactatgaggaatcatattttctttataggaaacccacgagtatacaaaaaaaaaaaaattgaaaataatctaatttctgtagagggattgaaccaggggaaaggagaagggaaagtcaaggagactagccattaggccatt

SEQ ID NO: 39194 - DNA, 323 bp, Heterodera glycines
cagagaacactaacggaaatttgtggcggaaatgcccctttaaagtccgtccaaatgcgttggcagtgcttccagcgactgaagacgcccctccgccagcattgccagtgccattttgaggcctacaaaattggcgctgagatgggccaccaattggactccgaattcggccacactcggcacattcgccgttgggccgggggaggcgaaaaaactttggcgtctgaattgggcgtgtatccatttgtccaactgaaatgggcataattcaaataattctaaatttgtgttaattctcaaatcgccggactgccattgacgcg

SEQ ID NO: 39195 - DNA, 1025 bp, Heterodera glycines
  misc_feature (1009)..(1009): n is a, c, g, or t
attaattcttaaatattttttcagaaagggttctgaaccttaccaaattttatttacatgttagtttaggcactctgatgctttttctatcaaaaagggagatgaataaaatttttaaaaatttttaattcctttttaaacaggccaaaaagtttaggcttaacttttttttcagaaactgatcagaagcgcaccaaactttgcagggatactgaaaggaagagaaataacctattttaaatattatctagtcagttcatttaaataatttttatccaaaaaatttttttttgggttttcggggcagtccccctgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcaatttatttttgttttcgggcagtccccctgaaccgatgcgcccagatttatggggagaccgaatccttcgggaatagcttccctatagcctgtactttaattctgcgctggatttttgctccccataattgtttgagtaccccaaacggacacttgaaaaaatcgatttatttttgttttcggggcagtccccctgaaccgatgcgcccagatttatggggagaccgaatnccttcgggaatagctt

SEQ ID NO: 39196 - DNA, 212 bp, Heterodera glycines
tacggacaaaaataaaaaggcgccttttccaatgcctttctttttccatgttttgtttttatcatccattactgatgctgcctcatttctattattgtttttgcgctttaatgtttagataatattttaggggtctgggtcctttcggtgccgtcgtttcggcgtcagcccgagtttttggattgcaacttttccattgtcaacagaatcca

SEQ ID NO: 39197 - DNA, 627 bp, Heterodera glycines
ttttgcgccagaagcaaaatgcggcagctttaaacactttttgcgagtaaaaaataagtaaataaacaaaaataattattattgtaaaattaaaagtcggacgacgtcggagtgctttttcattttgggacggcgtcaaattgggtggggggagaacagtgtggtccaacccatcgcacgatagaaattgatgagaatttcgcgtgtttatggggctaaattaattgaaaaccgaaagttagaaaatacataattcaatttcttttccaaaaattcaatgtcttttaattggcaaaagatttttctaagctttacacaatttttagcctaaatttgcatttttaagttgtttatttctcaaaaatgtaattctttacaaatctgacattaatataaaaaagactgtgttctcttcgctttactgatttagcaaaattatgagaatctcaatcatttttgcaattttcttctgtattttttctgttgcgcttcgtgactcgtccattttggcaatgcaaaacattcatggaagtgagtgtaaattaaattactatttaaataattaatatttcttttcagccgaatgcaaacggcacattcactgccccgacaaactgttttgcctgg

SEQ ID NO: 39198 - DNA, 500 bp, Heterodera glycines
cgccacctcacagcaagtgccgcctccaccgcccggaacagtgaacgaccattttgctatcgttcaaaattctcagaatggcaaagcgcaacaatctgatcgtaagacggacattctggcacggcatttgggcatgactctgtcccaaatcttcggcaattttacgcttgggcattttccagcaaattcggggaaaaaagccacaatggggaatgaaaaacaacagagtcaagaagtgaaaacagattcaaaaatggacagtgagaacgggggaagaacggacggaggaaaagcggatggaggaaaagcggatggaggaaaagcggatggaggaagaacggatggaggaagaacggaccaagttgtgtcggagccgcacagattgacacgcgtttttgagaagaaaagaccgtgaaataaacccaaaccgagaagagataatatgaaaatgcaatatgtacgccaacagaagacattgttgtaattaaaatattaattac

SEQ ID NO: 39199 - DNA, 644 bp, Heterodera glycines
tggattgagtcccagtgattgaaatgttggtggattgagtcccgttgattgaaatgttggagaattgagtcccagtaattgaaatgcggaagaattgagtcccagtgattgaatgctggtggattgagtcccgttgattgaaatgttggtgggttgagtcccagcgattggaatgttggtggattgagtcccagtgattgaaatgtcggagaattgagtcccagtaattgaaatgcagaagaattgagtcccagtgattgaatgctggtggattgagtcccgttgattgaaatgctggtgggttgagtcccagtgattgaaatgttggtgggttgagtcccagtgattggaatgttggtggattgagtcccagtgattgaaatgctggtggatagagtcccgttgattggaatgttcctgcatagggcctcagtgtctcagagacgggctgaatgtgggcctctaattcttcggatgttgagagtttcccaagtttatgtttcttaaatgactaaaccttgaaacaattaaaatattgacaaaattattcgcatttcagaaaaaaatatcttgatcaaaaagttcaacataaattgacttctatagcaagtgattttctatcgccctgttctataatcattgtt

SEQ ID NO: 39200 - DNA, 320 bp, Heterodera glycines
tgcataaacgaaaatttattggcgaaattctctacaagcgccatgtggcatttgcggtcggcagcgcaccgtcacattctcccaccgcgcctatgaacacacacaaaccgatgctcagttcatcactccttgtccaatggcggcctttgctcaatggctgctcagcgaattcgatccgcgctatcccacaatgctcttcgcccatttcggtggtcgctttgacaacattatgctgtttcggcagttcttcctcaacgggttttgtccacagatgatccgacgtggtaacaaattatacgaaatgaaaattgcgaggggcg

SEQ ID NO: 39201 - DNA, 495 bp, Heterodera glycines
aaaaaccaccttatagttcatttaaaaatctgaaataattcatgcttgcttaacttttgatactgatcaaaaaagatttttacaccaacttcatcagatcactccttcatggtgatcaggaaagtcaaaaatggcttgaaattgggaaaattttagaaaaaaattcctaggggactgggaaaatttacccctgggagaagggagtgggaaacatgatttcaaaattttcaatgttttctagtctaatctactcaaaacggttcagaattcaataaaaataacattcacggtgcgaaaaaaggggtttgaaaagtttattttgaaaaaaagactttacaaaataatacccctgggagaagggagtgggaaacatgatttcaaaattttcaattttttctagtctaatctactcaaaacggttcagaattcaataaaaataacattcacggtgcgaaaaatggggtttgacaagtttattgactttacaaaataata

SEQ ID NO: 39202 - DNA, 708 bp, Heterodera glycines
gggggactgcccccgaaaacaaaaaaattcgattttttcaagtgtccgtttgggggtactcaaacaattatggggagcaaaaatccaacgcagattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagtgaagctattccggaaggattcggtctccccataaatctgggcgcatcggttcagggggactgccccgaaaacccaaaaaaaaattttttggataaaaattatt

SEQ ID NO: 39203 - DNA, 656 bp, Heterodera glycines
  misc_feature (522)..(522): n is a, c, g, or t
  misc_feature (598)..(599): n is a, c, g, or t
  misc_feature (610)..(610): n is a, c, g, or t
tttcttgtcaattcagaataaaaaaaaatatcaaaaacttataaattactattctataaacaatttatatttttatttgaaaattttatatttgaaaaaacagattcaactcatattttagatttttcaaaatataaaaagaaatcctaaatattgaagaaaatatgaaagtttcatataaagaaaaattcttgaaaacacacaattaatatgaacttatatatatttgcttcttattaaaaaaaaaactttgaaacataaccttaatttaacataaaaaataaattattccgaaaaaaagaatatttttgaagagattaatatttgtcagtttatcatgtatttatgctagaaattttggatgtatgacatacaattttacaaggttatcaaaaaaaattatcactctactaaaaataagctttgttttgcacgattttttaaatactttattaactgtttgataaaccctcaattatttattttactcgaaaatgtttgattgttttaatttcgaattanattataaatccccttttttataagagattcagcaatgtttagttaaagtgtgtcttaaatccttcattcaagattnncatttaataanttgaatttttgttttttatagagtttaaattaaataattttccatg

SEQ ID NO: 39204 - DNA, 524 bp, Heterodera glycines
acatattttttcctggattctccatagcctaatttttgcactttttcgcattttttcgtttttattaaatgttccaaaatttagcaatttttcgtaatattttcatttttttttacatattttaagaatttttgaaaatttagaaaactatcttgtaaaaaaataagttttgcaacccacaaaaaaaaactattttagccatcaacaattcacaccaaataatcaaaattcaaagaaatttgaatgaccatttatttactggctagcttaaggcattaagcatatttagaaaaaaaaaaattatggcccattaattaagcaatttcaataaatggcacagcgtttttcagggcacaaaagtgcgaatcatgagcttttgatctcaacatttaagtttttagagcttacatcctacctattattagcaatttatatgctctaaaaatcgtttggtcctactcaatatgttctttacattttgacaccattcacttttaaaatttaatttgtaattgccccctatt

SEQ ID NO: 39205 - DNA, 467 bp, Heterodera glycines
taaccataaatttttaaaaattttgaaattgattttccatttttgaaagacaaaacttttttaagctggtagcatccaacatttttggtatattcgaaagcttaacatgtttagaagctttttctaaactattgcttcgcgattagacaatcaccaaaaaagttatacatagaattgcaaaaaggtcgaaattttggtttttttctccgctttttgccaactgaaccttcaaacgaaatatcgaagtgggatttttgcgatttgttgaattttttatttaaacatttaaaattcaaatctttaatattccaaaaaataaaagaataattaaaataaaaaacatgttccttttaaataattcaaatttaaatataaaatatttattgttcactatttactactaaaaatgggaatttaatttttttttcccttaaatgtgagaagcatgaattacataaattttactt

SEQ ID NO: 39206 - DNA, 611 bp, Heterodera glycines
ttgaattcatatattttttttcaatttattttttttttacaaaaatttcacattattccatggtggctcaatcggatttgtattaatagttgaatttaaggaatacacctatttcctggcatatgacccattttttacatatattttttttgcaatttaattataatgatcaataattcctatatatttttttaaattaatctttttgttcaagtctgttttggtatgcgaaacggccatggctcgtatacaccggtatacttaaataatcatatattatcatatttaagttaaaaaaaacagtttaatgcatacataattaactaaattaaacaaattaagctattattttgctggccccaaaaaagggatgcagcaaatttttgtggacaatttgcccggtttccctgacaacatccgaatttcgcgcagcgcagattcattttatgtggcgttacctttccatcgaagtgaacagaagccacacatttttgacagacttggcccatggcctttggcaaggaaattcattggcgaagtgtgcttttcaaatgaatggcttagcagaaaaaaaaactcgaattgagagaattatcaattaaaaaaactga

SEQ ID NO: 39207 - DNA, 431 bp, Heterodera glycines
  misc_feature (393)..(393): n is a, c, g, or t
ttattcatgagaacggatccaaccaaggacatcctttgaattgaatcctagaagaatcccacccctattaatacatattaatactgcgccctgaaaatgcgtcatattaatttcgtatttcgaaaaaattttttcgaaactatatctatttctaaattggtcaattcaattttctgaaagttaaaaaagttaaacagttggaaaatttccaaaatcagatatcctgtaattaattaagcttaacattacaaactatactactaccgtatctcgttttaaaaaaatcctgattcaatgacgcattttcactgcccattttccggtcatagtttgtgtacatcttgccagtcggatgttgcgatgagaatcgcgcctttgcaagtgtttgtgacnccagcgggggcatatccatccgtttcgacattttcgca

SEQ ID NO: 39208 - DNA, 488 bp, Heterodera glycines
  misc_feature (12)..(12): n is a, c, g, or t
tgcaggtcatantttttaaaaaatacataagattaaaatacataagagtagagggagatgacacattgaactttgtcaacacgaacattgataataattatataaagaaagcaaagtctccgcaattaaatttgggaaaaatattggtataacttaactgaaaatataaaaaactattatttaaattaataataaaatgaaaaaatattttttaaaacattggaaaaatccaaaattctttaaaacattaaaaaaagcatttcatacattcatcaaatgttagacatgaaataacagttcaaatgaattaattaatatttaatttcaattaaaacgataataaaacaatatgattttttgtaaatattatttataaataaaataaaaaactattataaagcataattaatataacaacaaataatgtcagatatcaatatgaaaatagaaatacataaaaatttaatttcattttaatttaaatataa

SEQ ID NO: 39209 - DNA, 1369 bp, Heterodera glycines
tgattggtcctattttattacagtatgtttttagtctcattttggcattataaatcagtggagagtgcttcagtgatgaatacaatttaaaataaaatctgcagcattaagtatttcagtagaaaaactcaaaattaaataagaatctcgttcgtcaattcatttgaaaagtttaaaaaattaaataaaatttagtaaaatttagcaaaagtcgtaaaatgtgaatatactggagtatatacttctgggttgccacgggtcgagaaaatgccgggtttcggattcagtcaagggctatctaagggggggggggggggaattgtacccctcccgaaatgaatcttttaatgaattatatcccatttcacgccaagcttctataaagggacacgaaaaaatctggaaaaagcttaatgagatactgaacaaatacaaggctttatataattaaatttatctacgcatagaacattcgatcacaaaatttcacgaatgtgacaaaaaagatttcctaaaacgatcccattagttttttcttaatgatcaaaagaattttttaaccaggggaaaccccattaatttttttaatgaaaaaaaaaattaaaaaaaagacgggggaaaagggcaaacttttggcccaaattttggatggggttttcaaaattccagaaatttaccccaaaccgccccaactttttctcaaaaagtccaaattaacccccttttttaaaataaaatttaagggtttaaacggttttgaaatttttaaaatctcttttaaaaaaaaaaaaacctttccccccaaaaaaaatataattttaaatttttttaaaaattttttccccccccggggggaaaggggggaagggggaatttttataaaaaaaaaaatatttttttttttttttttttttttctcaaaagccttttttaaaacgcccccccggtttttttttataaaaaaaaacacaaaaaccgccgaaaaaaagggggattttttttttttgttggtgttggttttttttttttttaaaaaaaaattttaaaaaaaaagaaaaaaaaaaaataattatttaaaaaatattcttctgcggggaagaggggggcccccccgggggggggggtggtgtggggttttttttttttttttttttttttttttttttgggggtgggggaaaaaacaaaaaaaaaaaaaaaattttttttttttttttttaggagagaaaaaaaaatttttttttttttttttttctttaaccaccccccccggcgcgaaaaagaaataaaaaaaaccattttttttttttttttttttttttttgggtggggggggggggggggggggggggtttttttttttttttttt

SEQ ID NO: 39210 - DNA, 475 bp, Heterodera glycines
gataagcggcggagtgtccggtcgcccagtcccaaaactgcttcgggaataccgaatcgagcctaaagataatagaaaattaaaaaaaaacgattactagtcggtcaccccaattaaaaaaacgattactagtcggtcaccccaattaaaaaaaacgattactagtcggtcaccccaattaaaaaaaacgattactagtcggtcaccccaattaaaaaaaacgattactagtcggtcaccccaattaaaaaaaacgattactagtcagtcaccccctgattccgatgaaaaggaatggccaagtgcgcctccgctcgttccgcttcgcccaattcttggctcaattcccattgaagtcgcctgctgtcgaagtggaactcgcgttatgctattttgcttcctgggcggagtaggtgttctgtttttgacggcagttgcgtcagtcgaatttttgaagggaatggacgaagtgcca

SEQ ID NO: 39211 - DNA, 1177 bp, Heterodera glycines
  misc_feature (386)..(386): n is a, c, g, or t
  misc_feature (476)..(476): n is a, c, g, or t
tacgcatgttataagaggaacaaaagtcgagcaatgcgcatgtttaccgtggggaagagtactgtgcttgtacggtaggcatttgatacggtaaaactgttaagctgtgccatcttttagtacaaaggtcaagtgccgaacgagaaattcggcattgtttttggcacattcaaccgaagtcggccgatttgtctgagggaattgcaaaaatttgcatttgtaaaaaataataaaaataataattgtatttaaattttattttttgtacagatgccaggctgcggtaacaaatattatgaccatgtgaagcattgtgccatggtatgccaatatcatataatttgtttatttatttatttttacaattttaggtcaatttctatganaatgaaccggacaaaaatcctaaagaagatcctccccaatgacgtcgtaattaatgaatatttttgtgcccaattttttgtcccattttncgcactctcgcacttttttgacggatgcatcacccgggcaagcaaaaactgtacgggaaaatgtgaaaattgattacaatgaaacctttccaattggccaaatgctattggggaaaaaggcccccaaaacacttttgaggggaccgaaatccgaaaaacccagtttaaattcccaaaaaacccaattttttccccccccccccaagggggaaaatttttcaaaaccccaaaaaaaatttttttataaaaatttttataaaaaaaaaatttttcgggtttttatttttgttgtataagggggccccttaaaaaaaacaacttttttttgggaaaaattatatttccaaaaaaataaaggggttttaaaataaaaaaaaaatctctttctattttgggggggggagaacctccttttttttttttttttcccccccccccaaaattttgggggggggcccccacaatttttggggaaaaaaccttttttttttttttttctccacaaacaaaacaaacccgtctgggggggggggggggagggagggggggcccccccccccccctttctcccccgggtgtgtaaaaaaaaaacagccggggagcggaaaaaaaaaaaaaaaacacttttttttttttttttttaaaaaaaaaaaaagggggggggggggggggggggaaaaaaaaaaaaaaaaaaaaaaaaa

SEQ ID NO: 39212 - DNA, 289 bp, Heterodera glycines
tgctccgatttcgttgttcctcctccccatttgcattttgctgactgtagtctaccgtaatggtactgatattcctttacagtactcactccccacatggcaattgtcgctggcactccgtcctcacaatgtccaaatcggccgaactttccaccacaattctaaaaaacagacaaaaaattaaactaataaaatatggaccaaaattcaatccaattcagtcaaaattctcaaatctctaaaagttgtctgaaaaacaatcaaaatttgctcataaattaccccgact

SEQ ID NO: 39213 - DNA, 560 bp, Heterodera glycines
acgacggcaaaagcagaagcgaaggcgactcggggaacggcaatttgtcggaggagccgaagagaacggcaccgatcagcagcgaattgagcaaattgaagcagacggacagcgcgaggaacagccgacgctggcggggcagcacaaagaattggtaaagcgtggagatggccctgggggggaaacagcggataaaacggacaaaaggggaggggacatttgaacaccagcagcagcagcagagacaattcgtcactaatgcgttaaaaataaactatccgcttttggcttgcttattgaatgaacgcacccaccctcctcgattgacaaactttgaattttcttgatttttaaaattttaatcgaggctgagaatgaagtgggagaaggggaagtgctgtgcccagcagcgggatgaatggatgtgatgggactgaaatggcggcataatttgccactttaatcccatcacaatttgtctctgattcggcacaaaattgaatttgccagtacattgaggagcaaagtgaggacagttcggcaatgcgttcctgcttaat

SEQ ID NO: 39214 - DNA, 534 bp, Heterodera glycines
tccccccccccgccctcctcctccgccgccgcctttcccaaatattctccgactggcaaaatccaaccgcaaatatttttctaggccataaaattccgagcaaataataataatacaatgggaacaaatatttttggccaaattcgtaactttatgttcctctcatggccattttttgtgaatcattcgcccatttttaaattattacaatttcaaatggtcattcatttgctgattaattaattaattatgtaatggttcattttcccattcaattacatagctgaaatgcttaaattccaagtgacttcctccgcttcttcttgctccaaccgtttttctccctcgccccaaagactcagtcaaatctcttcttcctcctcctcttcctcttcttcttcctctttctcctcttcacatccctcggcaattggggaacacaacgtggaccgatccatcgacgaattggagggatttatcgtacaacaaatggccaccccagcaccgtaccccactgatggcaaatccttttac

SEQ ID NO: 39215 - DNA, 326 bp, Heterodera glycines
ctggtctcttttcggcgtcggctcgcccactagtcgatgctccttcgtctgttgcattttccaatgcttcttcgccttctgctgctggtgttggtggtggtgctggtgttggtggtggtgttgatggtgctgctggtgttggtggtgctggtgatgctgatggtgcatgtggtgttgctggtggtggtgctggtgctggtggtgctggtggtagtggtgctgctgctggtggtgctggtggtagcggtgctgctgctggtggtgttggtggcggtggggtcggtgctagtggtggcgttggtgttggtggcggtggtgtcgatgat

SEQ ID NO: 39216 - DNA, 624 bp, Heterodera glycines
  misc_feature (598)..(598): n is a, c, g, or t
  misc_feature (612)..(612): n is a, c, g, or t
atgacagttcattattgtattaattaatttaatattaattaatttattttaaactcttatctaaaattaaaagaaattattttcaattaattaatatttgattaatcttatcgctcaaataaacatatcaaatcttcaattaattaattattccacttaattactaaaaagcatttcaatgaattgtatataaattcttatttaaaataacgtaaagaagaattgaaaagattaaaattcaaaaaaattattaaaaatcattttgatgttacgaaattttccatcgaattgaggataagaagatgatagaaggaaatgaatgaatgcttttcctcaacaattttattcattaaaaattaatcattttgttagcatttgctaaaataaaaatggcattgcgctgcgctgcgccgcattcattgcgctggcgcttcttttttttatgtgcagcttttgcccgtgccactgattttgcccacttacacataaaatatgccatcccacacattcattcatgcacattcaacatgaacaaccccacacaacccacccatgaggtggcatccatgtaaaataataataatgaaattgtgaattnggcatttgtgaggngggggggggggg

SEQ ID NO: 39217 - DNA, 582 bp, Heterodera glycines
  misc_feature (495)..(495): n is a, c, g, or t
  misc_feature (525)..(526): n is a, c, g, or t
cattagcaactttatattcaattcaatattgaacaattttcattcttggccacctgtggaaaatggaacatatttctacgcagctttaattttttaatacatgcactgtgtaacaactttcgtgtatataaagtttgaaatcgtttattttgatgtatttattttagttataatgatttttttgttcatttttttaatttgaaattttaaaggaaagaatgtcaaattttcggaaaaatataataataaacttcttgtttaaaacatataataatttatactattttttatattaaagcaagagaattgtgaagtaattattatgtttttcaatgcatttgactaattatttacgaaaaatttaacaaagtcaaaaatataacatataatctgaagattaattgctaaataattataaattcctttttatataattcatatttttaaaatatgtcaatttggtaatacgatatgataatttaattgattcattanaaattagtttttcaatttataaagcattanngtaattgaaatttttcatcgaatgaaaaaaggatgaaactttaacttgtcgtagtt

SEQ ID NO: 39218 - DNA, 601 bp, Heterodera glycines
  misc_feature (514)..(514): n is a, c, g, or t
  misc_feature (517)..(517): n is a, c, g, or t
ttttaattgaaaaaatttttgatttaaaaaatgtcaatatttagctaaaaaatattaaaaaggaaatgctcctcattttcaacagcaaccagtgaataaaaaaaatttttgttcaatttttggctttaaattatgtcacttttcctcactattttagttaactagtttgagatttctcgtcaataaaagttgcggccctatttattacatcctattttttcaaaatcctattcgtcaaatcaaaccaacacaccaattttgggtatgacaaaatattaaaccaaaatgtttaaattaaaaattcggtgttaataattataaaagtttttgaaaatacctaattataaaaagaaaccatatctgttcattaaaatatgcaaaaaatagtcatttttggcgaaaaatggctaaaaattcctgtaaaaagactcttccctaatttcggatttcaaaaaactaaaagcacatatgaaaaccaaaatttttgaactcagcccctctacccgaaagccanggntgtctggctacgccactgatataaaaaaaggtgtcgactgccgtgccgaaatatgataaaaagcgatggcaacgtcacaaaaaa

SEQ ID NO: 39219 - DNA, 421 bp, Heterodera glycines
attagaccagggctcggatctgtcctgatttatcagatttgtcctgatttgaagggtccaaatctgataaaattaaaatgtcctgatttgtcagatttgtcctgattttgaggtagcgaccaaattttgtcctgatttgttgattctccgaaaaatctgtcaattttctttataaattctgattggcgtactgtttaagaaaaatatttttaaattttgcattatatttctttttttgctgttaattttggctaattatttttgtatttgttgtttttctcttttgtttttaatttaacagctgcactaatactaacaaatggcaccgcctaagcgcaaaaatgcttttaaaagtgaatatgcaatgaatttcagaggatcacaaaaagccaagcaggagatgaatttgcgcattgcatcc

SEQ ID NO: 39220 - DNA, 363 bp, Heterodera glycines
  misc_feature (343)..(343): n is a, c, g, or t
ttgtggttttttcctaataacttttttagaagctaaaatttttgtttgttttttgtaaggctaatagagcatgtgaagagctttcgaatgataccaagattgttagatttggtcaacaagaaaaaaagttataataaaaaaactgaggctggcgccaaaacggcagcgccaaaacgaccgattcccgctaaatagaacctttatgaatctcaataaagcgaattaaaaagtaatagaaagagaaaaaaaacaagactgcaaaaaaaattaatattcgcttcaaaacaaagataaaaaaaattgaatttctctagaatgccaaaataagtacattaggtagganccaagagcgtttgggccccc

SEQ ID NO: 39221 - DNA, 998 bp, Heterodera glycines
aaggaatggatttaattaaattctctccttcggggatttttttccattaggtcgtccgttagcgttcgattgctctagtcaatttttcaaaatttttgttgaaatatttgtcgtgctctgaagggcgtgggagggggggggggggggcgaaggcccaccacgaggccgcgaagaggccgagtgagtaccttcggtgcaggaaaattattaaattttaaaattttttaattgctttttaaatatgccaaaaaatgtaggcttaacttttttagtgaaaattcgatcactcatattttttggtaattgagcagaagggtcgcaagctttgcagggatactctttcggtaaagtactaatgttacattgatatgagcgctgagttagctgtctcaaaacgaatttttgcaaatcttgagtcttttatttttttatttattttttgtaaaatcaatttttaaatattttttcagagagggttgtgaatcgctgccagttgtactaacatctcagtataggctctgtgatgcattttctatcaaaacgtgagatgaataaaatgttcaaacattcgtcattcaattttaagcaggccaaaccgctctaggcttctttcctttttcgtggatctgatcagacgctcgtccaccttttcagggatactgaaagcaagcgccataaccttttttaaatattatctagtcagtccgtttatataattcttatccaaaacaaatacattttgtgttctagcggcacgtcgtcctgaactcgctgcatatcggatttattgggagactgactcaatcaggctttcatttttcatagcccttaatcaccacagaccatgaatgacgatctatatacactctttgtagatcgccaaaggacgcttccaaaaaggactttcgtcggacgaagcagcaaatttggaccgagcggaaaaattgctgacccggagggggaatgctaagaacttcaacagaatgggcgagaatgtg

SEQ ID NO: 39222 - DNA, 284 bp, Heterodera glycines
ctaagcatttttataagtttgaaaaaagatataagcgtttgaaattttattttttgaataactttttagaacaacatttaagctataaaaacaaacatagaaatcgatgcagaatttttttctctatcgatatacaaaatttgaagcggatttaacgtcagggaaaaaagttaaacgtcacgaagtgaattcagtttgtctctattaacagagacaaagaaatagtacgccaaaaagagagatgtttttttctctgcactctctatttattgacacatgtctcg

SEQ ID NO: 39223 - DNA, 545 bp, Heterodera glycines
cccccctccggcggtatttgtcatcatcactcttccaccagcctaccgcccactgacctaaacaaccgctgataatccatcccatcatcacacggccgaaaccctactaaattgcccgtgggatggtttttggaaggaatctttgggaagtgatcaatgaaaatgaccacctaatgggactaattattagggagggattctcaagttgatttatggggtctttcttaaattgcaattttcgagaaaagccaaatgattgctcaatctgtgccgaacattggccattattatgatgaagaggaagtgatggaagacgaggaggaatattcatacgaagagattgacgaagaggaggaggaagaagaagaggaagtggagaaggaagagaagcgaacagtcgccgcaagggcactgccagcggcgcaattggcggagggcggcggacagaaccgcactgcccagggcaatgatcaactttgccatttggcggatgagtgccgcaggcaatttctgaatatattttaaggggcaattcccattaaaat

SEQ ID NO: 39224 - DNA, 1255 bp, Heterodera glycines
  misc_feature (50)..(50): n is a, c, g, or t
catgaaatttgcaaagaaaaatgttaatgattcccgaggcggaatattgngctctacggagtgcgatgaatagtggtgattatctccaaaatgaaaaagcgagtttagacgcaaaaatttctcagaatttacaagaccccgacataagcgaggacctcaaggcgaagagacatgattggctctataaagaaaggcgtacggtaaaggggatacttgaaaatagaccacagaaggtagtgattgagaatcatgtaccaggtccaaatgttgcaccatatctgggcctcaataaccaatccaaaccacaggagaccgaagaaccacggaaaataattattcctaggaaaagacttaaagagcaaactcctgatcctgaatcagataatgatacacttgaggagttaactccggagccccaaacaacatccacactcaaaacacccgttccgatcaaaactattatacacccgacccttttaaacggtctttttaggtacgtgaaggaaaacaaagatttatttaaaattacggcggccggaaaggtacagtcgaacatgaatttgccgattgaaaacagtaattatagagatgttttgttgtatctcgcagggaagaaagatgaaacgccgcgcggtgcaaaatttctcaaagatcggttactgaaggatccaacagtaaaagacatggttgataaatcaaaggtcatgtggggacgtggaaggaaaaaggcaataaaatctataaaaacacccggcatagtgcgagagaagaaacccttcaaaccactaatatgggcaagactgtagagaaaattttatcgaaaatttattttaatttaaaatctccggcaagttttgctggaattcaaaaaattttaaatgaggccaaaaagattgacccgaaaattacgaccgatgacgttaataaattcctagaaaagcagaaaacatacacgattcacaaacccatcaggaaaagattcccgagactaaagacgataccaagtggcttccataccgattggcagtgcgatttgtgcatatttgaccagttgaaaaggcataacgacggttataaatatttattggtctgcatcgacgtgctgagtcgaatgatcttcagtgcaccggccaagtcaaagaagagtgaggacatgatcgaggcttttgatcgggtgttcgaaaagtctaaaattatcccgatgaaaatatataaaggcaagtgggcttgaattccaagcaggaaaaatgaaaaa

SEQ ID NO: 39225 - DNA, 1462 bp, Heterodera glycines
aaaaatttaatttacatattttggttttggtacattttttgggatttttttaaaatatatttatgtaaatattttgagtattttttgtacatatttttgacatccatattacaattttgcagattttcttatatagaattcgcagccctaataattatttcttgaatacatttatttgggtatttaacaatgggtgtttagcaaatgataatataatctccacaattacccttagtaatattacatatggattaattattttttgcctatttatatgtaataaaatttggtttgattgccaattcaaaaaatattacgtacaatccgaaagaagcggagaaagaaatggaaaaagcaatgtaataatttcaaatttgaatttccatgataattattttgcttttacgttttctaccccgaaaaatttgttttttttaaaagatatcaaaaaattttttataaatcccccccccccccccgcccttcaaaattttgaaaaataaataaaataataggagactcagaattttgaaaattttttataaaaactgatgacaagctaatgtgataaaacaggttaattcttttcctttcagtatccctgcaaagtttggggcgcttctgataagtttctgaaaaaaagataagcctaaactttttggcctgtttaaaaaggaattaaaaatttttaaaaatttattcatctccctttttgatagaaaaagcatcagagtgccaagactagcatgtaaataaaatttggtgcgtttcagcgcttttctgaaaaaaatatttatgaattaattatgcaaacttaaataaaaatttctaaaaatttgatcgtccataaataatttgtaattgatcaggggctcaccaaattttgttttggatacgtatcagaacactacaaatgcttactaattttcctagattttttaaacccggtgaaaattttttgcagacaccaccacttttgcacttaaaaaaatttcaaaaaactttaaaaattcatagaaaatttaaattcataggtactactgctaaatcaacgcagagacgcctttccttgacctttttaggcccctgcaaaatctggtgcgcttctgatcactactcgaaaaatgagtgattgaattttcactaaaaagttaagcctaaactttttggcctgtttaaaaaggaattaaaaatttttaaaaatttattcatctccctttttgatagaaaaagcatcagagtgcctaaactagcatgtaaataaaatttggtgcgtttcagagcattttctgaaaaaaatatttatgaattaattatgcaaaaataaataaaatttctaaaaatttgatcgtccataaataatttgtaattgatcaggggctcaccaattttgcagggaacgtatcggaacactacaaatgcttactaattttctagattttttaaacccggtgaaaatttt

SEQ ID NO: 39226 - DNA, 1342 bp, Heterodera glycines
  misc_feature (24)..(24): n is a, c, g, or t
ccccccccccccccccaacgaganacaaaaaattttcaagcaaaaaagggcaaaatttctgaaaattttacacattttcttatcatattgcatttaattttccaaaaattcttcccggcggcgcctatcggcaccgccggggccccaattggatcataattttttgaaaatttgagcccaaaatggaaaatttgtgatttttcggcgcaaaaccgataataattcctgttttttggcgccggcgctgaagaatttcaacataacactggtgcaaaaaatttttgttggcccgaagagcaaaaaaaaaaagctcttcgggtgccctccccgaaatttttttctggatatgggcctgggcagttcctatttatggcaatcaacggaatgagaataaaaaaatgagacccgaaaaatgggttttcccccattctgaaattttttttccaattccgaacccgttccaatcccttcgtccaccttgtccttgtccagattgttcagccattccgggttcgcctcgcgatagtccagtgcgtatgcgcccggtttctcctccgacaagtccatcaggtgcagaatgggctggtagtcgcgctggaaaaatgccaaaaattgggatttttttgaaaaaaatattccaaacccttaggcccatttgggcaaacgcttgggccaaccgctgctcctggcgcattgtgttgaacagttggaccatgtcaagccgctccacatcctcgcccatcgcaatcggaatgccgttgaggaacagagcggactcgcctgcggggacgatgaattttatttgtaaatgaatggactggatcaattcggaggcatcaatcgtagcaatggggcaataacattttggtctgttttaacagtatgtgttcaaaatggcccaatttgtggggcatttagtagaagagccaaccccgggattctgatcccgaactaaatatcgtcggcaaaatttcatgccaaatttgagtcatcacgtaaaatcttatcccggcctaatttcctatcctaaccgactttttcaaaactactaacccacttttttttggtggtgttttgaatatgtcgagcgagggggggggggggagaaatgggaatttatagtaaacttggttcaacaaaatgccaaattaaaagaaaatttgccaaccctcagacatgtccatttgctcggcccagcgcttctgattttgtgccacctcatcgcgaaatgattgccggacttttgtttggaccaatgaactaaaaaagggaaaattaaaagaggttggcattttgtaaaaagaggggagggggggggcgaaaaaaggtaattttaaagaaa

SEQ ID NO: 39227 - DNA, 530 bp, Heterodera glycines
tttaattttagttttaaattgatttaaagaatttattttaatgatttctttatccagctcgattccacaattttgtagccctccccgcaaagggaataaattttttgcctaatttatattttgtgttaaacctataaaaggggacattaaagcgtttagaaggtttgaaaatttttaatatatctagatctgttcggccataaacaatcttatgcgccatgaacagatcaaatagctttcgccttttctcaagtgttggcagttgcaggtattctaatcgattttggtatggaattggcggaaggctgcatttaaaaaatactcttttggtgaaatatttttgacacttttcgatttttttaatatttttttgaagagacggattccaaacctccggagcgtattccaataagggcctaatataagttttatataacgtaatccaaatcttagatgatttggatttaattattcggaaacaggaacgcatacgtaaatacgcattcccttgtatatgatttatatgatcg

SEQ ID NO: 39228 - DNA, 522 bp, Heterodera glycines
  misc_feature (509)..(509): n is a, c, g, or t
gagccgctgattgcttggtcaatatgaaagtgggtttaagggcgctttgaatgcccctctcaagctgctgtggcgagagaaaacttccctttggcacacggaaacggtattttcggccgtcgtgcaggtgaacaatcacatattgtcagtctgatatacccagcttgcccaacttaagccaaaaatcgcacccaatagccatgattttcgcccacctgtttgggtaaattatgcctgacagtccaaccatccacccggccccatcgaacaccaacttctttggcaagtgcactttgaatttgtttgttttatttccaacaaagccaggcgtattgctcggcaaaattactaagaaagagtttgtcatttgatcaacaagtataaattcttcaaaatgagatcgttcttatatcgtggtgtgccatctcggttcactttcccccatctttgatccagcggaaactctttgccatcgtcgtcgtcgtcgttgccggttcatccttctttangtgcttcatgatc

SEQ ID NO: 39229 - DNA, 1471 bp, Heterodera glycines
aaaaaatgggaaactgttctggaaaaccaaaaaatatcaaaagaatttgaagaaaacattaagggcatgtgaagaaatcgaaaagaaaaagcaaacattggaaacgaataaacaagaaatggaaaatgaaaatgaaaagagcaaaatggtagcaacaaataaagaatttatagcagtgatagaaaaaataaaaagcaaaaaaacaattacagcgaaagataaaaaagctctgcaaaatttgtgtatattcaacaaattgtacataaagcataatggaacaattgaaggaattgcaacgaatttggagcaaaagatcagcgaacaaaagaagaagcagcctaagctaatggaaaaaatagaaaaaaagttacatcttaaaacaaaggaagaaaaacagttggaacaagtgaaaaacatccagcaaaaattgaagggcattgtggacaaaattcatggaattgaaaaaagttcaggaacggatttgtgggatattgcgaaagaattttgtgctgaggaagaaagtggaaaagaaaaaaaggtggatgaacaaaataaagaaataattgagacaaatgcatcatcatcatcatcattatcggagccgaagcaaaaaaagagcaaaacgaaaaaagaggggacggcggacggaggaaaaaagagaacacatttattgggtaaaattgaccaaatactacatcatgaagaaacggatgaagaaaagctgttaaatgaaataaatcaaattgtaacagacaattttatgaacgaatttgagaaagcaaaaaaggcgtatcagaatgaagcggatattaaagaagccgaggaaaaattggagcagataaagaaaatccttaaaattttgaacaatgaattatttacactaaataaaaaagaaagccaaattagcacagaattagaaagcattgaaacagaaatggaaaaagtgggaaagaaaattgcagatttggacaacgaaatcacaacgaacacagaaaaagcaaaaagacaggcgaaaatcatttgggaagagctcaaaaaaatgaaagagcatttcgccaagaaattggaggcaaacaattcaaatgttggagaaggcgccaaagaaaccgcttgagatttcccacgattgatttgatgcattttgagattttattcttttttcttggggtattatttatcctttggctttatcctcgatttttttttctctctttttgatggggtcttttatttatttttcctatcttttgggacttaacattttgtatttttgatgagtggagctgctggaaaatgaaaaaaagaaaataattttatttaaaaaaaaattgggataaaaaatgagatgttttgggacaaaaaatctttggcaaattcttgttgcccagcagaactctttttgtatcttttttggcgataatggtattatgtcacttttgtacattcattcacatggatttaaacttttaat

SEQ ID NO: 39230 - DNA, 1405 bp, Heterodera glycines
  misc_feature (1337)..(1337): n is a, c, g, or t
aaaagtgtttgaaaataatcgaaatgtagccttatgtaaattaaatattttcgatttacatattttttatttttttttattcataagaaaaaaaaatataatgaacaaaaatacggtttaaaaaaaagatcaaagtcaaactaaagtaaactctgtgaatgtcaaatcacttatgaaaattaacgtatattttatttttcctgtcttataattaatgcaaagaatttttaatgatcagagtggtcagtagggatacaatttttaggctttaaaaacagctgtctggaaggttttaggttctaaaaatcccaaaaatagtaaataggcactaaaagcctcaactttatgggtgtaaaattacaaaatttattcaaaaataacggaattgtaccaaatcagtattgagataaataattttaaagcaaaaattcttaaaataaataaataaattttgaagatgaatttttgagaattttttcattgcataggattgtattttttatattgcctttttatcaataaattttcggcgaaacgtcaaaataggtttttccgagatttttaggtttttaggctctaaaaataaattcttaaaaatgggcactaataacacgaaaagtagccttaacaaccaccaaagaaacttgtttttcgtgcgtttcaggccactgggagctcaggaaaaataggcaaacccctaaaaatcgtatccctagtgatcagtgagtgatttgctaacggcacattttttagctatacaattatttctttttatttcactattcattgcttttccataatgtattagcttctcctttggtgtgaggggccctctttctgcggttggcaccacgtcaagagaaagggcattttgacgtggcttttccctcaaaaattttcttataaaaggccaaaatcgatataaccaaacacttattcttgaatgttaggtatttccattatttgtaaaactataattcattttcccataattttgttttaaaattcagcggatgaattcgtccgtcgtttcattttcgctgttactttttgggttattcacaattcgcactgcaaaatcgcaatgcgagaaacattgcactaaaagtatgaattttatgttttattaagggttgatttctatgattaatccgaaaaacccttgggggcattgctaatgggaggggtcttaagcagcagtgtccatggattttcaagaatcactttttcgtgggaagaaaatgggataaagaataaagaatatggagaacatctaaaaggggcagccgttgttcagttcgataggaaaattaatcgactgactctcggaattattnaggcaaccgatgggccaatgcaatgaggcggaagaagtgattctgcgcaactccgactgtgccttcat

SEQ ID NO: 39231 - DNA, 772 bp, Heterodera glycines
tttgacgtcagattcttgatcagcgcttaaaactaccatataaaagtgctttccattgtcggggccatgaaatttttatggaggggggggcggtagcaaaacctacaagtacccgttgtcgtcctgtggttctggcgccactggagttagtccgccgtcagcgcgtcgtccagctcacttcattgaaaacttttgttccatcattaatttgccagtcaacgcctccttttcccaattcacatttgttctgattatgcttacctaaccgggcagcagataatgaacattctgcgaggagaagcaacaggcttcagtcgccatttttcgattcttgaaaggatcattttttccttgtccgttcgttaacaatttcaaaaggcggcacagtgacaccaagagccaccgtaaagacaataataaaattgacagcagaagtggcagttgccgcaaaaaattccgggccacaaattcatgtaatcggattcatgaccatgtctcataacattaaaatatctcggaatttattttgcacaaatctgtgaacaaactgcaataaaatttcaattttaaccaagatacaacatattgaccaccattgtcacaaatttacacaaaccttaaattcaataattatttcaaattcagttctgtgtgttagagtgcgacgggaccgggaattttgggcaaacccgggaccgggaccttatccgtttgaaataccgatcaaattacgcttccagaattcagacccgtggcactatactagatatgt

SEQ ID NO: 39232 - DNA, 1468 bp, Heterodera glycines
caaaacaaatttttttatttagcaaaataatgaacatttgtgctttttttttggtttttcctatacccaaatttttgcattttagcaatggattttgatttatttgatagatttaaaattaaaaaaaaagaatttaaaaggggatttttaatagtcgtttaaatttaaacatgaaaacaaggcaacaaaaaaccagttttttgaaaacaacaacctattgacactttttcggttttttaattattttaatagtttttttaagtttttagaacagttcatattttgattttagcacataaatcgaagttttataaacttaaaattaaattacttaataatgacatccaaaaatgatgtcacttttcttcaaaaatctccttcaatgagcgatatgaagcccctccttcgacttcttcgtagaccaagcattgtcagcaccagcagaagcggacttgggaatttgggagtggtaaaatacaaaatattacaaaaaatatatatttaaaattattttaatttatttcattatgatattttacctcttcattagagtttcgaatgttgagtctgtcaacataactacaagtataatgtaaggattgttttcagcaatgtttgaaatcccgacaccgaactttttggttatttttagggttatttccgacctcgagactttttttaaagacgggcttctacaaattaaacattaaaatgtttttaaattccttaataattgaaaattaataatgtgaagctttcctttttttaattaaagatttatctatggatttgggattaattacccagtaattagattaagccattaattaatggttattaattacattaagccattaactcgtcatctatcgattgaaccaccggccaatttggctgatgccttgggaatgcacactccaaattgggctttttatcactacagttcgtccaattatcgatcagcgtggccatggcgaatgtttcgtgaccgtttcgatgtaagaagcaattggcaaaaatgcaaaaccaaattaaatgcatttttggcaaaaaatcgtcataattttctcgaaagtaatcaaaaaatcactatatttttctgttaacctaataaatttatgaaaataaattattttttattaaaattattttaatttgcttaaatttttaattttactttttactttattaatgaattaattaattaaattacaaattttatctagtgtgaacaaatcatgtacaataagcacttctctgtgcagcccatctacagaaatgtgccattgaatgtgccatcgcacagaacgtaaaaaatatttttttaaaatgaataaatttcttatttagcaatttttccaaccaccaaagagctgggtattggtcatttgactacgattatatgtaaattatatgtataatgaaaaagtgtttagttaattaattaatggaaccaccattaaattaa

SEQ ID NO: 39233 - DNA, 1198 bp, Heterodera glycines
  misc_feature (10)..(12): n is a, c, g, or t
  misc_feature (23)..(23): n is a, c, g, or t
cttgcatggnnnctgcaggtaantttttaattggctttttaaatatgccaaaaaatttaggcttaacttttttagtgaaaattcgatcactcatattttttgctaattgagcagaagcgtaccaaactttgcagggatactccccggtaaaggactaacttacactgaaatgagcgccgagttagctggctctaaaaaaattttcgaaaatctgagtctttcgtttttatttattttttgcaaaattaattcataaatattttttcagaaagggctctgaaacgcaccaaattttatttacaagttaaataaggctctctgatgctttttctatcaataagggaggtgaataaaattttaagaattttttaattgctttttaaatatgccaaaaaatttaggcttaacttttttagtgaaaattcaatcactcatattttttgctatttgagcagaagcgtaccaaactttgcagggatactccccggtaaaggactaacttacactgaaatgagcgccgagttagctggctttaaaaaaattttcgaaaatctgagtctttcgttttttatttattttttgcaaaaataaattcataaaaaatttttttccaaaaagcgctctgaaacgcccccaaatttttttttcaaagttaaaaaaggtttccttgaaggttttttctattcaaaaagggggggggaaaaaaaatttaaaaattttttattggttttttaaatagcccaaaaaatttaggtttaatttttttaagggaaaatttcatcccccctatttttttttttttattttgagaaaaaaggccccaaaattttttggggggaaccccccccggaaaagaaaaaatttatcctaaaaaaggggccccgggaggggtggggtctcaaaaaaaaattttcaaaaaaaaaagaggtttttttttttttttttttttttttttttggaaaaaaaaataaaaaaaaaaattttttttaaaaaagggggtgtgtccaaacccccccaaatttttttttataaaaaaaaaaaaaaagaggcctcctctttcggtttttttttctttttaaaaagggggggagggggaaaaaaaaaaaaaaaataatattttttttttttttttttttttttttatataataaaaaaaaaaaaaaaaaaaatattttttttttttttttttttttttatt

SEQ ID NO: 39234 - DNA, 1190 bp, Heterodera glycines
  misc_feature (137)..(137): n is a, c, g, or t
caaaaaaaatttttaaaaattctagggggcttagctcgaaaatttttgaaaattttccgcccatatggcacaacattcgatagagcttaaaaaactctacaattttgccctaaggcattttttgtctaaaaccgacncctgacgagttatgggctcgggactcaaatgtcccgctcaggccaaaaaatttttctatttccggaaaaaaatcgaaattttttcaaaaatatcaccaatcgatagagctcgaaaaactatgttttggaagtggtcttcgtttctctgggaaaaatcgttaaaaaatcctaaaattcaaaaacccgaaaaccgttttttaggcctaactcgaaaatttttgaaaattttcgaaatttttaaatttggaaaaatcgggctttcaaaactctacaataagtctgctggtaactccccgcccagatcaaaccctaatgagttattcaaccgggactgaactggacaaagttggtactgaaaaagttcacgaacctacagcctttcctattgcagatagaggcctggaattttttttgttttttagaaaacacttcaacttagccccctcacagcagacattttttgaatttggaaaaatcgggctttcaaaactctacaataagtctgctggtaactccccgcccagatcaaaccctaatgagttattcaaccgggactgaactggacaaagttggtactgaaaaagtccacgaacctacagcctttcctattgcagatagaggcttggaattttttttgttttttagaaaacacttcaacttagccccctcacagcagacattttttgatttgggttttagaaaaaaagttacgggcccccaaatgcacgaaaaaatgagaaatcacttcccgggactcagtcgtccgcgcagaatttttctctatagttttcccggattctcctcaaaaagttgtaagacccttccaccactttcagggcgctcccggccttcggccgggagattttgttttttgaaacgaaactccttgtcaatataacatatatagtaactagcgtgtcgcgcagtaattgctcggtgtagacagtatgctttgcacagtaattgctcggtgtagacagtatgctttgcacagtaattgctcggtgtagaaaggatacttgtgagagatgaaaagaatatgcattacatgag

SEQ ID NO: 39235 - DNA, 464 bp, Heterodera glycines
ctgtttctaaatattttaatttaatgtttttttgactattgcccatttaaatgggttttgtttcaaaaaatgcgtcaacttacaaaaaattataacctgataaacacaaaaaaccatgtcttttgaacaattttggtcataattttcttgaaacttaattctaaatttccggaattttgttattttaaatctgtaatttcaggaaaatcgaaaatttgaagattattattaatagggcagggaaattatatgcacatagaaaggtaaaatatacgcataaaacaagcagcaaaaattgcaaatatgcacatataatttaaaaaatattcaaatagattttaatccaattgagggcaaaatttttcaaaaattatttaaattttaaaaatcacgaaaaatataacaataaattttttgtgtgtttcagacctcccccagacacaattttttttttgctaattttt

SEQ ID NO: 39236 - DNA, 1007 bp, Heterodera glycines
taagctggtcggcgaaatgaggtgccacacacgggcccatcaacagagggcggatcaaagattgttgccagagcatgagctgaaactggcaaaaatttatccataaaaaatctctgattgcttaagttggactagtcagtgagctgatttgtgaggacactcggctgaggagaaaaattaaaaaaaaaaaaattatttttaaagaaaaaaaatttattctgagtggaaacattttaatttggttggcatcagcaacagaatgacaaagcaaatgatgaagctgaaacagcaggcggaagaacaacatagcaacatttcaactgtggtaagctaagaattttttttaaatattgaaaaatgtaaattttaaatttataaaaatgtggaaaatttaaaattttgttggatttttaaaaagctaaagagtgaggtgtgttctttgataaggcatctaaatatactcattatagttttggttttaacgaccaaagataaattaaatgatacccccaatttttgtacgtctcctaattttatcaattaaaatgtttcaaatttttaaaatttttttctccctaaatacattttttgtaataaaaaaaaatatgaagaatttgtagtttggtcgttatattattaatctgtactcaccacacaatccagaatatattttatatatatttaatttttttacaacatgaattttaaatttttaaaattttttttcaactaaaaatttttttcataattctttcaagattatttttaattgttagccattcttaaaccacaaaagatcatcccacttttttgcccacccaatgcgcactccgttaaatgccctcgggcacattcggaaaatatacggtacttgtgtgttgttatctgtgggtagattttcaaaaatttttatgtttttcgctatgatcttttttctttggcatccaaatccaagattgttggtatcagacgaaagctcttcatatgctctattagccttacaaaaa

SEQ ID NO: 39237 - DNA, 755 bp, Heterodera glycines
tctcactttgggcgtactatctctttatttttaacaatcctcctaagaacttttacttttctccgtctaactttttttctctacgttaaacctacaccaaaatttgcatatcgatagagaaaaaaataaagaatttttcaatcgctttttaaaagaaaataatcgcttttatttcaactaaaattttaatttaacggcgaatttaattagatggcaaaaataaaaattgtgtgtaagcttaacgcaattaaatcggcacaaaagcgggtgataaagcgggatgagagacgcgcgcgaacggccaaagcgacagaagcccgttgggccacgaaattgagtttttacattcatttttcataaaatatgcaattttcccaaatttaagccgctccccagcccaacaccgatgcagaaatggcacaaccatctgaagaagagccgtcgacatcagaagcaccggcgcgggacaacgacggacaaccatcatcaactccaacaccggtgacaccgctggaaatggacgtgccgtcggtggagatggtggacaccgatgtgcaaatccctttcacgcctgccgacgaagaccaacaaattcaccaatgccgtcacatccacggcacgctgtgacctcatgtcgacaccatcgacttcaaaggggcccgtggctttggtctcgatgggggaaaaaaattcaaccaaaattaaatttttttttattcctttcctttttattattttttagtccacctgtttga

SEQ ID NO: 39238 - DNA, 882 bp, Heterodera glycines
ctacattcccccgttgtctcaccttttttagcaattctcccattcccttaatgcactccccccccccccccccaacgtcagcagttccccccttccgccgggggtattatctgctcacatttgctgctgagaagttctctcgcttttcctatagctaagcccaccgattgtaagggataagcagtgagaacaacaactgctgctgcttttccccccgggggtcgtcggtcggttggctcccgtttcatccatccccggagggagggagggaagacggacggatcgagtcgggcggggggagagggggggggttgagactcattgattgaatgctgcagtattggaccccgttgaatgaaatgatagcgagatatgtctcaatgatccggtggagagctcatcgccatcgcctgtctttagcccattccttacagattttggatggtccatatattatcccatctaatacagatatctctatttttttaattatttcacctcgcgatcttcccgctccgtagatctgcccagaatgacttcatccattcttgtagttatgaaagccagaaaatattccccaccattgttcttgaattgaatattcccccgtaatccgtatatacttctattgccttatccatgatggatattttttgtgtcactcaaatatgctgtgtactgactgtatgccctaaaccatttctgtcattaccctcaatattttgtccctctgctccacactgatgccattctcccggtcatccgatttctacatatgtagtgccggattaagcacagtgtctactattaatgacaatttcacgtcacaatgtgcctgatttgaggtggaacaccacacagcgctgatttggcacaatctgt

SEQ ID NO: 39239 - DNA, 948 bp, Heterodera glycines
tggtgtaagtaaaaatcgtaattacgctcaaaaagcttctcaaacaattttagcgcttccaattccttctacaatcgcctttatacatcccattatgagcgctaaaattatcagagtgccgaaaatcgcatgtgatctaagcctagaaaaaatggtgtaagtaaaaatcgtaattacgctcaaaaagcttctcaaacaattttagcgcttccaattccttctacaatcgcctttatacatcccattatgagcgctaaaattatcagagttccgaaaatcgcatgtgatctaagcctagaaaaaaatggtcaagtaaaaatcgtaattacgctcaaaaagcttctcaaacaattttaacgcttccaattccttctacaatcgcctttatacatcccattatgagcgctaaaattatcagagtgccgaaaatcgcatgtgatctaagcctagaaaaaaatggtctaagtaaaaatcgtaattacgctcaaaaagcttctcaaacaattttagcgcttccaattccttctacaatcgcctttatacatcccattatgagcgctaaaattatcagagtgccgaaaatcgcatgtgatctaagcctagaaaaaatggtgtaagtaaaaatcgtaattacgctcaaaaagcttctcaaacaattttagcgcttccaattccttctacaatcgcctttatacatcccattatgagcgctaaaattatcagagtgccgaaaatcgcatgtgatctaagcctagaaaaaatggtgtaagtaaaaatcgtaattacgctcaaaaagcttctcaaacaattttagcgcttccaattccttctacaatcgcctttatacatcccattatgagcgctaaaattgtcagagtgccgaaaatcgcatgtgatctaagcctgagaagatggtcaagtaaaaatcgtaattacgctcaaaaagct

SEQ ID NO: 39240 - DNA, 981 bp, Heterodera glycines
tcccattcattctttttcccaacaattttcctatttatcaaatatataataatgcccaaggcacttttatactttgcagatccatttttaaattaaaataactgtttctcctggttattcatgtgtttcgaagggttatcggggtcgctgaacacgaattaggcatcgtttcgactaatttgaaccccgaaaaaaactcaaaattttccaacttttattctaaaatcagcggacactgacgaagtgattggacgccaaattgcattccttattattttatttaaaaaattgccaaatatttgttattttaagtaattatttaaaaaactgagtagctttttcacatttaataatttttaaattttcgaacatttcgaaatatagtgatgcgaatctccacggctctagtgtactttataagtccaatcggcttatgagtccaataaattaaccatacctgttttatacaataattttttcatgttcgaacaaaccctatttttgggtatcatttgaaagcacaaaagtctaaagaatataaactctcagcgtttagccagcttcggttaattgattgggctaataaaggcagtgcgcttatgttggccaaattgccgctcactttgattttcattttattttttgtccagctcaaaaatttagctttagcaggaattctttcataattttttctctcttggtcgttttttgttcattactttggcaccacaaaaaaatgagtcactttgggttgaccgaatccaatttgttaagtgttggcgaaacaaagctcttttgcaatttttttacttccaaaccaaataattgtctttattttggcatagaaaagattttgaatttgttcgaaattcgtgttttccccacacaaaaaaaaaattcatgaattttctggaaaaccatttaccaaaatatcgataggagagccgacagagaattaacaattccatgaaaacaaaattt

SEQ ID NO: 39241 - DNA, 275 bp, Heterodera glycines
cggcgcgccaacgattcgtcaactcgacgattcgtcaactcagccaaaatgcgacgattcgtcaactcagccaaatgtcaacgattcgtcaactcaacgattcgtcaactcgacgattcgtcaacccagccaaaatgcgacgattcgtcaactcagccaaatgtcaacgattcgtcaactcaacgattcgtcaactcgacgattcgtcaactcaatcaatattacttaaaaaatggaacttaaagcaattgacaagaatttctagggatgcttaa

SEQ ID NO: 39242 - DNA, 178 bp, Heterodera glycines
tagttattttacggcataacgttgatgcgtttcaacaatgtgccatttcatcgcctctttgtttttagttgcaaaacaaaattttgaattgaaaaataatcatcaacgccaaacatttgctaattttgctgtttgtgagaaagttggctgatttttattgctactttatgtaaaactg

SEQ ID NO: 39243 - DNA, 889 bp, Heterodera glycines
aaaaaagaaatataatatataacaataatttatgcatcaaaaatcctatttaataattccagagccctcctcgaaatgattcgatcaggggaattatttaggctttataacttggaaacagaaaaaaagaaatttaattatttaacaataatttatgcatcaaaaatcctaatttaataaattgcagagccctcctcgaaatgatttcgatcaggggaattatttaggctttagaacttggaaacagaaaaaaagaaatttaattatttaacaataatttatgcatcaaaaatcctaatttaataaattccagagccctcctcgaaatgatttcaatcagggaattatttaagctttagaacttggtaacagaaaaaaagaaatttaattattcaacaataatttatgcatcaaaaatcctaatttaataaattccagagccctcctcgaaatgatttcaatcaggggaattatttaggctttagaacttggaaacagaaaaaaagaaatttaattatttaacaataatttatgcatcaaaaatcctaatttaataaattgcagagccctcctcgaaatgatttcgatcaggggaattatttaggctttagaacttgtaaacagaaaaaaagaaatttaattatttaacaataatttatgcatcaaaaatcctaatttaataaattccagagccctcctcgaaatgatttcgatcaggggaattatttaggctttagaacttggaaacagaaaaaaagaaatttaattatttaacaataatttatgcatcaaaaatcctaatttaataaattccagagccctcctcgaaatgatttcgatcaggggaattatttaggctttagaacttggaaacagaaaaaaagaaatt

SEQ ID NO: 39244 - DNA, 1093 bp, Heterodera glycines
  misc_feature (1068)..(1068): n is a, c, g, or t
ttgcctatgatgccaaggagaacaaaaaacaatgatgctttgatcagacacattcatgcccttcaataccgcctaggaatgaagggatttgaagaatggaactaatttaatcaatttaatttgattaaatatcttgttgaaattaaaattttttaaaagcggcgcaaatgtcgattttgctgggcggcgcaagtgtctgcggcgcaaaaatcgcggcgcaaatgtcgcatcacggtaattaaagcgaattaggggaaaaaagaattaaaaagctaattaatgcaaatttacgggaaaaataaaaattgcaaatttaggggaaaacaaaaattaaaaaagtaattaatgcgatttggaaaaataaataaagcgaattagggaaaaagattaattaatgcaaatttgggtgggggaggggggaacggaggcattgttacacaaatatatatttattttaattatgtataagtaagtatgatctctttaaagtatgccattgcaatacaaagcaaagtttgtcaaaatgaaagctaccctatttaattttgatgatctttgaccatcaaattaaggatggcatcattttgccggattatcaccgctcatcgaccacactcattcagtttatgatgggcaaatgatgaagagtttaatcataagatggaacaaagcgtccattagaagctaatggccaggggaattaatggcgaaggattaagtggagaaaaaaaggctaattagcaaaagcatttgcatttttgaaaatctgtgttttaattgcatagatttttcatagcacaaaaaaattatttaaaaaatggaacaattaaattccaataaattcccgattatctaattcctgaattttatattgacaaatggactacgtgagtttatgatgcccagcagacaatctgtcaagggacaatacgtcactaatatttaagttttatcaatttaatcattgtccaattgtcactgacccccgggcccatccccgtccagcagcagtcaatcagtcccttttcgcttctcattaaccatttaatttgctcaaattgttaattntattatgacacatttattttattta

SEQ ID NO: 39245 - DNA, 1607 bp, Heterodera glycines
  misc_feature (20)..(20): n is a, c, g, or t
ccatcctccgttcaattttntaaaatttatttccaatttgtaaaacatattgattattggactattttctgctcggataacaaaggaaggaaacgtttttaaattttcgatcatttttgaagacattctttcaaagaaatataattaaaaaatgtatttaaataaatctataaataatttttaaaagagcataaagaattaagttaaaatttacaaaagatacaattaatacgaactttttgcaaaaggcacaaaatcatttagttaatcgttttctttctattctaatgaatcagataaaatacataaattaattaatatgattaagtacagagactgataaaaacattaaaaattatataaattacaaaaaattgtaaatttgtaaatatatacgaaaaatttaataattcataatgaaaatacgagaatataatttaagaatgtaaactggagaaaaaattaagtttcaaacaataaatgaatattaatacaaaaaatgatttttttaataaatttataaaatgaagatttgtataacatttaaagataaaaaattgtccaagttaacaaacttattttgaattttacccaagtaaatttattatgcttataatataatattttatactaaaataatttgcaaaattaattattaaaatttaagttttcatctaaaaaatcttaaaagattttagagttttaaaccaaatagaaacaataaaccaaaaagtctattacgctactctttatatacttaatatattattaggaaataagtatttaaaaatgtaaaaatcaaatctttttgaattttcaaaaagtttaaatataatgctgcacgccttcttcttcacgctcaaaccgaaaaaagaatcaaggtatcgaagagaaaaataaaaaaaagactaacatttttaagtacaaacttgacaaattaaacgcataatacatcagttgtaaataggaccagtgttaaaaataataattgttgactgcttaaaaaacaaaaataaaaaagcaaattaacaaatttacatttaatttatgtttgcaatacatgagttatgaaaatattaaacaacaaagctaaattatccagtaattagctaaaatgaccataaacgtacatttcaaattaagatataaaagcaaataataaaattattagtagtttttcacattgctagtctggcgcttcaaagaattatgttgttttattatttaaaatagaatttatataagaatataataattatatagcaatctgttatattcgagttttttgaacaaatattaagattttataattcgtttatattaattcaatttaacccattttcaattattgattttttcaaaataattttttatgaatgcatgaacagaattcgttatattaaaaattggcaattttggtccttttttttgaacaaaatctattttcgaattttctaaaattttccgcgggcaaccgccagaccccctccccctgttgaattacaaatgtacctccgaaaattaatggttttcgttttagaattaccgatgccggttaaagtgaaaaatacaggtaccgtgctactctaagttcacactttcatacg

SEQ ID NO: 39246 - DNA, 930 bp, Heterodera glycines
atcatttttgtttaattcgcaaaattacagctcattctgcgcgaaatataaactgaatcagtgtttgcggaatgaccgagctgataatcgccaataatcttcgattacaattttcttggtcacctttttggaattccaccatttcaactccttatcctctaaatataaactgaatcagtgtttgcggaggaccgagctgataagtcccaataatctccaatttacaattttcatgatcacttttgtgatattctcaatatttcaatttcttatatccaaatgtaatctgtataagtttacagtaggaaattgtaatttgggggttattggcgatttcaaatcgatccttccggaacactgatgctgtttatatttagagcgtaatgagctgaaaatgtcagaattcaaaaagtggggtcgcgaaaatagtaaatctgaggttattggcgcttatcaacctgatccgtctgcaacacttaaacagtttatatttaaagcctaattagcagaatgtgaaattctctcatttgttactttatgatcatttttgtctaattcgcaaaattacagctcattctgcgcgaaatataaactgaatcagtgtttgcggaatgaccgagctgataatcgccaataatcttcgattacaattttcttggtcacctttttggaattccaccatttcaactccttatcctctaaatataaactcaatcagtgtttgcggaggaccgagctgataagtcccaataatctccaatttacaattttcatgatcacttttgtgatattctcaatatttcaatttcttatatccaaatgtaatctgtataagtttacggtaggaaattgtaatttgggggttattggcgatttcaaatcgatccttccggaacactgatgctgtttatatttagagcgtaatgagct

SEQ ID NO: 39247 - DNA, 966 bp, Heterodera glycines
aaatattggaggttccgtggtacggacgcaaagttcctgatcggataagcttagttgcagaagaaacaattagccctgccgatgagaaattggttgggtggcgtttacacggctattacgaaattccaaaactcgtgaatatattgccgacgataacggaaaagatcgactttgtgaacccctacgaaaggccgtggaagcagtcggacctacgttggcacaggccatggatggcaccattgtctaagccacgttcgacatgggtcatcccaccaactccggcttacttggatgtgctcgactttttccaaatatatcaccaagaagcggttgaccaccgatgaggaagccgaaggggaatttgacgcatattataaatgcataaatttgccaaccgccaaatttgaggaacttgttgccgaaagtctggcaattcatttggaaagggaagaaatgcctaaaaaagagaatcaccagtagttaaacatcccgacttgtcgtagtcattagtgcgcgaagttttcgagcactgtcccatgggtttaggtgggatttgttttgaagcccaagggattaggggggtttcgcgcactagcccagggataggggtgtggggctttaccgcacaaacgccagggtttgggatggttttttgttttgaagatgccgccggtgttgggtttgggggtgtttactacaaaaacttctaaacatgtaaggctcaaaatttggtgaaaatcaatgaacaattcacacacaaaattttttcaaggcggtgtccacagccgaacccctttgttgacaaaatgttttttgaaaaatcgcggaaaaggacatacgaatttaaaatcaaattaataattgcacacaaattttatgaagaaaaaattgtatttaaattatcatgaaataaactttttaattcggatttatgaagaagccaaaaatcgagtatttgagttcagc

SEQ ID NO: 39248 - DNA, 956 bp, Heterodera glycines
  misc_feature (901)..(901): n is a, c, g, or t
ctttttaattctgccaaagtgccttttcgcgctctccgcgcttttcctcctccaattccatgcgcatccgttgttggacaattcgtctctgataaattaatcagacattttctctcccactcctcttctatccccattttgcacattcttttttcctctccctctctctatcatttctcctcactttatgcgctctttctcctctctctcccaatcacgctgtctctctctcattttcctttgtcgattctcctcaatttgtgccatcaattccatccgatgcctttcttttgccgtcgctttgttcgcctcaatccacgcctctcccaattcacttccaaaagacgctccaaaattggcctaaacaataaaagggaaggggaaactgaattttttttttggttgattgcaaccttcgcctttcccccttcaaatgcttcttgccacgcgttagaaccgcgcagtccgttcttcggctggggatttccacgaagccacggcggattgtcctccccgtcggcggcggtggcggcggcggcgagagattgctggtaaatgaaagggacgcgaggagcgagcggagcatcctgctgagaaattagcatttaaaagcaatgggcgagatggccactgaccttttgctgcttcggatggctttggccattgtcggcagccgaaagtgccaacaaagggcccattgggtcgaccggcggcgccgacgcggacggacagagagcggcggggacactgagcggttggaagaagcgttggcctgagcaaaggcacaaatggaaaagggaggataaaaaaggcaacgggacgacggacggaccatttatgagaacggaacggatgctgatgaaagtggttggctcctcctcaaaacaaaaaagggaattgngaaaaacggacggaacagccgaacacctcgaacatcactttggcgacggtctccg

SEQ ID NO: 39249 - DNA, 830 bp, Heterodera glycines
gctacttttcgatttattagtaactattttatagttttttatttttagcaactaaaaaactataaaaattttgaaaaaaaaactattttcaactatttttgcttgtgaataaaaatttgttatgaaaaatgcaataaaaacgaaaaatataccccctaagattttacacccctaaatttgaaattgttagcaactattttgggggttttttagaaactaaaaacaaaatacctatttttgcagttttagcaactataaatataagccctgctgatgacaacgcccaatttgccttacggtgcaagagaggggagcggccagttcagtacgggcaccaatttcagccccccaccaccgccgtatgacgccggcgccagtagtccatttgaacaaccacaccaacagcatcagtcaccatcgccctacggaatgatgtacagcggtggcaatgtgccgtcgccaccaccgccgtcctctccttaccaccaataccaacagcaggcgccgccgcaaatgtccccgccgttccaaccaccaattggggacccacaacagcaggttgggggcatgccaagccaagccaaccaagagaaaatcgatgcaaatgatgggattgggttggttgggatggcatggaaatggacatatggaggaatttcggattttttaaatgttttgggttccattagggttgtactaatggaattgcacacaggtacagatagatgatcatttaaactgaaagtttcggtaacaaatgccaaaagtttgccctccaccaaattttagaaaaaaaaattgtcaaaaaatggatgaggggcgacaaaatt

SEQ ID NO: 39250 - DNA, 1792 bp, Heterodera glycines
  misc_feature (63)..(63): n is a, c, g, or t
  misc_feature (75)..(75): n is a, c, g, or t
aattttaaaaattattaatttaaaaatacaaaaaccaatgggatataaaaaaatcaatctaanaataattaacanaatataattatgatgagaacctttgaattaattcagattaaataaatattagaaataaaaaaggaaaataatttaaatttaaaacaaaatgtataaaataaccaataaatttaaaattatttttaattcaataaaattcattaaaaagcaaaaattaaaatttatgtaaaaagcaaatagccaaaaataacacttactattaacttattttttaattcaataaaaattaaattaaaagcaaaaaaaataaataaaatttaaaagaaaattgcctcaaaaaataattaaaaattaattattttttaaaccatttaaattaattgttgttttttggatcccttctgtacctgcatcatttttggaatggatttgaagatcatgttcatgtccgggtacggagctggtggaggttcatggattattgccggatccaaataatgtgttgcggtttggtggtgactgtttccgttccccattttggagggaataaaaatataattaacaattatttaaaatttaattgaattaaatggaaaaataaataaataattgtttaaattatttaattgaaggaagtacaaaaaattttgcattatatgtataataaaattaaggtcaacatatgttattttcaataattaaattttattttatttattttttgtaataaaattaaattaaaaacctttttttacattttttatttaaaaaattcaaataatgaatctataaataataaaatttaaaaaataagaatttaattttacatataaaaaaaatataaaattaactttttaataaataaattttatttttaatttttaatttaaattatattttatatgaaaaatttatgaattaagaaataaatataaaaaaatgaaatcaaattaatttttattaactctcgaataaaataaaatatttttaatttttaaaatgaatgaaaaattgtttaatttacttttaatttagaggcataaaatagtaaaaatatacagtttcgaattttttaaaaattttcaacaccaaaaagggaagtaaattcaaaagcattttttaatccaactaaaatgatgctaaaaatggcaatttttccaattttggccctttgtaaaaaaattcgaaagccggcacaacatggacagattttgtaaatgaatgaaatgccgccaccaaaaaacgaacaggaaatgtgtgtggagtgtgtgttgtgccgtcctcctccgtcggcttcttccttttcattttggcggaggcaatttgaccggggggctaggaattgataactcaactccacgacgaatataggttttaaatttagaattttattatttttgaactcattttattttttgaaaatttgcacaattccttatcatatttcatcgaaatttgcacaaaaaaaaaaaattccggcaccgctggaccccataacacataacattctttattgataatgtgaccctaaactacatattctttttatcacccccggcactccaaattaaaaaaaaaacaacattggataaaaatgtttttagcccgaagaagaacaaccaaagttcttcgggggcatccccaatttttttttctggataggggctgatttatagcccatttataccaatttgaactgataaaaaataaaatgggtttattcccaaggaaatacaaatattttaattttttatttcctgaaataaaattcaaaaaa

SEQ ID NO: 39251 - DNA, 967 bp, Heterodera glycines
  misc_feature (876)..(876): n is a, c, g, or t
  misc_feature (920)..(920): n is a, c, g, or t
caaaatatgcgaaatgcgaaaagcgaaattttttctacaactttttaatagttaaaatcataaagcaaaaatcattttttaaaattttattcaaaatttaaaaatcaataaaacgcttttttgaggcgcgctttttccaaaaaactttttgggaagagggggcaggcggcgccggcaggcgccgccgggaaaatttttgaaaatttgattaaaatttgttgacagattttcactaaaaaatgatcaaattttgtgatttttatcatttttctaatgagaaataagagttttggcgcgccgctgagaacagtttttcatcaaattaccaaattttgcgattttgggccattttctaagaaaaaataggagttttgtgggcgcggcggtgccgataggcgccgccggggaaataattggaaattttgatcatttataaacagtttttcactgaaaattagccaatttataggtaaaattttgaaaaattttatgggaatttaatccaattcttaggggtgtaaaagtcgcttttcgcgccaaaaagcgaaatgcgaaacgccaaaaaatgcgaataatgcgaaaggcgaaatgcgaaaagcgaaacctcggcccatccctgatctatatctcaccggattcattgaagcaaacgacacactactattcaaatgtctaatattctcaaaaaaattcacgtgtctcgcataaaatttaataaacaaatccttcaattcctcaggaaaatcctgcttaggaatctcgggaacaaaaacttttccatagtggcaacaatccttgaaggaattacctcggccactcattttcttttcaacaaaatgcaaagcatcacaaaattcacatctaacattcataggntccaagtctgttttcatgagcatttgcatgagtccctgctgcantaacattaacaacacattgtctaatcactctatgtctaatctatctt

SEQ ID NO: 39252 - DNA, 1187 bp, Heterodera glycines
catttctaaaaaggatctaaaaataatttcttgcgtacttctttttacattatgttgttgaagaatttgaggctgcttctgatgcgattgaaaatttttcagcttttcttgaaaagttttttcccagaatttatacagctttcccgacaaattgtttagataattattctagacgatttttttatatctcagtgcttaactattgcctttttgtatgataactggtagatattgggagtgaaaaaaagtttgtttgtgactatttacaataaaaatttatgcagcatttctaaaaaggatgtaaaaataatttcttgcgtaatattttttacattatgttgttgaagaatttgagtctgcttctgatgcaattggaaaatttttcagcttttctcgaaaagttttttcccagaaaacggatgggtcaaataaaaaactaaacatctcacatgaccaatttaaattcacttacattttgggtttactttattatgctggcccataaaaaaatggagtttttccggtgccaaatttttgtgaattttctttcggcccgtcataagcagattgtttgggggcaaatgaaaacaaattttgtgttattcgaatgcgctagccgagctctacatattcaaatgtatcaacaaagggtctatctccactctctggcgagttatgtccagccaaagcagagtgggccataaacacgaattttttaatctttggtatttcctctattttgagcctgctctacatttatgtattgtgccaatatgcctattgcaactgaaatttattcaactttcccgacaaattgttgagataattattctagacgatttttttatatctcaaagcttaactattgcctttttgtatgataactggtagatattgggagtaaaaaaaagtttttttgtgactatttacaataaaaatttatgcagcatttctaaaaaggatctaaaaataatttcttgcgtaatattttttacattatgttgttgaagaatttgaggctgcttctgatgcgattgaaaatttttcagcttttcttgaaaagttttttcccagaatttatacagctttcccgacaaattgtttagataattattctagacgatttttttatatctcagtgcttaactattgccttaatgtatgataactggtagatattgggagtg

SEQ ID NO: 39253 - DNA, 672 bp, Heterodera glycines
aagtcaaaaatccaatattaatacaatttctaataatattattacaaaatgtttttcattttactgctccatccgtcggaaggccctaaaaagtttatggcattccctgcggcacgcaaaccctcgggccaatcattttaaaggatccagcgcattatatcctacatattgcggctaatattactttgatggctctgcccgtccactctctcttccccctcccctcaatttcgtctttttcatcgaatcttttgccaccactgcctttaattcgctttgtactcctccccccgtaaattccggtactgatttattgggatttattggccataaaatccgagtcgtcccaattcatcttcaattcatccagtgatttttttctgttattcgtcatttgttgatcaatcgctcgctttcttcgagctcaataagcgaccgatcagaatgcttttcattgctttaccaatcggcggaaaaataaatttttgtttaaattttaatgcctttttcaattcttctgtcattcctttttcggttgtgtctccggccaatgcgacaaatgtccctcaattttggtcccatcttcgctttttgcgagtgttgcgtttcccctctgtctcccctttttttgtttatccccccccctccaaatcccttttcttctccacagat

SEQ ID NO: 39254 - DNA, 1293 bp, Heterodera glycines
  misc_feature (1238)..(1238): n is a, c, g, or t
aaatattttttaaacagctccaaattgacgcagcatggtggccgaaatctacgcaataaccggcaacctcaggccaaatgaagaaattttgactgaatacactggcggacagaggagtcatgtttttgccagaaatgatgacatggagcagtttttccaagccttggacgaagtccgattcaaaaaaatcaaaaaataaaaatcctaaaatttccattttttcagaaaattaacccttgtgaaagctctaaggctgaacttttgaaaaagaatttgccatctccagcggcaaaacttcgtgatgacaaaaatcggactggcgttgaagtttgtttcaataataatttttctaaattcatttttttataaatatttttaattttttggttttttcagcttttgatactgccccaaaatgacagtaattcaccaaaaaattttgtaaaaaacagccaaaagacagagcaacaacaacaattagtcaacaaccgtgaacagttgccatttttaccaaagaatttgaagttggaatgcaacaacgttggaaaggtgacaaaaatttagattatgtcatgaaaaaaaaaacaaattttccgagaaaatttttattatttgggttttcttcactatgattcattatttttgttaaaaattttaagaaattaaatctgatttttataccaaaagaagcggttttgaagttgtttcggaaaatttaattttcctgaccaatcattgatgattgataattcaaaaatttaattattattttttaggttgacctgatgcttgtgttagacaccagtggctccatttaccattcattcccacagcaacgtcaaataggtgaatttaataagaatttttttatcgaaattaaataaaaaaaatttgaatcgcgacaaatcaaaaaattattcaaaattaattgaacgaggcaaagttccaaataacgattgaatttatcagaatgatattgatattaattttcctgaaattacccaatttttttttataaattacgccaaatggcggcgcactgcccgcaaactttaaaaaattttttaacacaaatttaattttaaaaattaaatatcgatctaatacaataagataatttgttttaatgggttcgaggatgaaagctttttattttgttttttagaactttcgaaaaaatttctagcactgcaaattctgcacgccatcgagcccgcactgcattcattgcaaattgnggtcatccaatttgcacatgagcctaccgtaatccactcgttacgcgagcctacc

SEQ ID NO: 39255 - DNA, 506 bp, Heterodera glycines
  misc_feature (482)..(483): n is a, c, g, or t
tttgggtttgcaatcaaacatcaggcaaaattggatgaaccaatttattgcaacagcacctgcggacgctttagcaatggcaatttttggattaacggttcgattgaaggagatgcccaatatgcttacgattgtggtgatactgtaggatttggcgtcaatttgaccaatcaacaattaattttcaccaaaaatggacttctttttggttagttttatttttttatttaattttacaattttttaaattattttctttggttttttcacagatatcactgatttgttcttcgattcttccttttctgccgattcactttttccattcatttctttgcgttcttttggtgacaaaattgaggcaaactttgggcccaatttcaaattcggtgtgaccaatttctgctgaaggaagaaaattaagaaaaatcttgtcatttttgcagatttaaaggtcctttttaacagtatttatcataatnngttgtagtgaaatgtgcaaaatt

SEQ ID NO: 39256 - DNA, 1469 bp, Heterodera glycines
agagttcattatttgtttattttttgcataattaattcataaatattttttccagaaaatgctctgaaacgcaccaaattttatttacatgttagtttaggcactctgatgctttttctatcaaaaagggagatgaataaaatttttaaaaatttttaattcctttttaaacaagccaaaaagtttaggcttaacttttttttcagaaactgatcagaagcgcaccaaactttgcagggatactgaaaggaagagaaataacctattttaaatattatctagtcagttcatttaaataatttttatccaaaaaatttttttttgggttttcggggcagtccccctgaaccgatgcgcccagatttatggggagaccgaatccttccggaatagctccctatagcctgtactttattctgccgtggatttttgctccccataattgtttgagaacccaaaacggacacttgaaaaaatcgattttttttgttttcggggaagcccccccaaaccaaggggccccaatttttggggaaaccaaacccttccgaaaaactttcccaaaaatttggaatttaaatttggggtgggaattttgcctccccaaaatgggttggggcccccccaaggggaccctttgaaaaaaaccttttttttttttttttgggggaacccccccccaaaacaaagggcccccaaattttgggggaaaaccaaaacctcctcaaaaaaaattccccccaaaagcgcggattttttattttggggggggggttttttctcccccccccccccaaatttgttgggggacccccccccaccaacccccccaaaaaaaaaaaaaattttttttttttttttttaaaaaaaatttttttttcaaaaaaaggggcggcccacgggcccccccccaatttttttttttaaacaaaaaatttttattcccccccccccgtggggttttttaaaaaaaaaaaaaaaaaaaaaaaaaggaaaaaaaaaaaaaaaaaaaaaaaaaaaaaaaatatttttcttttttttttttttttttttttttcttctttccctttttttttgggggggggggggggggggggggggggggggggaaaaaaaagaaaaaaaaaaaaaaaaacccccccccccccccccccccggggggtgtgtgggttgcttgccccccccctctctctttttttttttttttttttattttgtcccactctctccggggggggggggggggagggggggaaccccaccccccgggggggggggggggggggggcgccccccccccccccccccccccccccccccccctcctttttttggttgttgtgggggggggggggaaggggaaaaaatcccccccccccccccccccccccccccggggggggggggttataaaaaaaaaaaaaaccggccgccccttttttttttttggggggggggggggggggggg

SEQ ID NO: 39257 - DNA, 1129 bp, Heterodera glycines
cccggacaccacattgtgaacggatgcttgaaaccttaggcacttgttgatggcggagaggttgctcttttgtccgctgctgctgctgcttcattatgccgtttagctcttgtcccaaaatataaactaaaaagacatttgtactcattatatatatatatatatatatatattaaaaagcaacttatccttccccctcccccctcccgcacatttcgcatattgacatatataaagtttttagcttccgaatttttgaataatcattcaatggacatgttccggttcaacgttcataacgctgtcaaagacaccgacgacgccgccgccgactctgctgcacacgatcaatgtcaacaacgccaatagcgcgaggttgcgtctcctcgcacaatgccgttgtcgttgttggttgaagagcaagctcatgtgtcagcagcagctgaggctgctgccgaggcagcgagtgctgttgaccaaaagatgtcggcagcgccaaatgacactcccgccatcactgacacgaaaattgattttatgactgatgaacaaacagtggcggcagcgccgccgcctctattcagtgagattgaaccgacgcagcagcagcagcagaaacaacaacaggtttgctctaaattggtgtcggttatttaattttttatcaagaagattcaggggcgtacagcggaaatcatcgcaccgaaagtggagctgtccgccgaggacaatggtgatgatgatgatgatgatgatgatgatgatgatgatgagactggacaacaggtcaaacaggaggcggacaggaacggcatggatgcacatcattcaaattgtgcaaaagggccccttttgttcattgatgaacaggagaatgaggaggaggagagtgaggaagatgaggacatttcaacaacgcatcgaaggcaaggcatggactcatcatttgactacgaagacgacgacgatgatgatgacaatgacgatgatgatgatgatgacgatgaaatggaatcagtcagcggatgtgcggaatcggacaaatgtggtcactgtcaccacccgcatcagctaccacgaaatgctttggaggtgctcaaaatgccactcattgactacctgtgtgcgc

SEQ ID NO: 39258 - DNA, 815 bp, Heterodera glycines
ctataagttttttattgctcaaccaaataaaacattgttggtaacatgagaaatctcttaatatgctctattagcctgcaaaagtttaaaaatttcgtcaattttgaacacatttttgaccaaaaaggttggaaaatctggttttttgaattcttctggccataactttttgaaccttaatgaaatttttcaaaattttgcagactaatagaggacacttagggcttttgaatgataccaacaatgtttaatttggtcgacaaagaaaaaagttatagctgaaaaggtgctggcgcccaaacgtgtcggcgcccaactcgacgggatccgttgatcactgaattatttatctgttgttgaccattccgaacaccattgttgtctccaatatgaagagttgaaccatgtagccacgttttccaccaagtggtcccaattggaatgtaaaatttagttgagatgccatgcccaataaattgctcattgcccatttatcattgactgccaagccatcttcgaacttaaaaataattatttattattaatttgttttttcaaataaattctttgtaagtagattaaatttaaaattttgcggctctaatgcactttatgagtccaatcggcttttattgtccaatcatcagtttcttttgccataacttttttcttgcttggacaatatccacatttttggcatcaaactaaaacttaaagtctatagatttaaagaactaaaatctgtgctaaaaccaacagataaacaaaaaaatattcaagaatatactcacaaaaatctgctttcccagtttttt

SEQ ID NO: 39259 - DNA, 279 bp, Heterodera glycines
tataataacgctgcggacatctacattcttgaattgcttcctaattggtaattactctttctttttctccacattgaccatcatactcatactccccccaccctttctcctccttcattttttttttcctttccttctccaaccctctcctccctctcttgatagtttaaactgaaggcgggaaacgacaatctgatccccatcaagctagcttctgcaggtcctgctcgagcggccgcccggggatcgatccccgatctagtaacatagatgacaccg

SEQ ID NO: 39260 - DNA, 1090 bp, Heterodera glycines
  misc_feature (68)..(68): n is a, c, g, or t
  misc_feature (1011)..(1011): n is a, c, g, or t
  misc_feature (1022)..(1022): n is a, c, g, or t
tataatttaaattattagatttaaaagcaatttatctgcttatataaagcaataataaaaaattattntaaaaatagaaggagtaatctcacgactaagtttaattcatataaaggaattttgtaataaaaatttaaaatatttcatcaattatattttttaaatcaccagctgaattttctagattataaaccacaataatgtttaggataaagtattagcgctgttatttcctaaaattaattaaaaaatcaatcctttctaaattatatgaatatgaaagttattcatttttaattcattatctaaataattaaattgcgtacatgagtaaaaaattttcttctttaatttctttgctctagacaatacaatattttaaaacataaaatactacaaaagcaatttaaaattataaaaaaaataataaaattaattcttctaggttcacaatttttagaaccatttaaatgttgtttaaaaattattatttatatttatgtaaatcgtataaattaccaaaattgaacacgaaaaatatctatttgcaaaatagtcgattttcatataaatccaaactgctgtgaaaacagcgtttgtggaaatttattgtttttcaaattgagcgccagtcaattgagagacatgaaactacgctaatagcaaaactaattttattatattaacttttttaataaaaatgattgtaatttttctaaatgatgtcttaacttaaatttagtaatttcattataaacatatgcaatcaagtgtttgattcactttttatgaatcaatgccacgaatgatgcagtaactaaaaagaataaaaaatgaacttttttcaaaaattaataaaaataattatataattttattttaaaagaatgaagtgaagcgatatataatcaaaaaaatcattaatttgtaaaaactaaattttactgcgcataacttaacatgaaatcggacacgacaagaagaaaaattttaacgctttaattactgtanttgtgaaatanaaataagaaaataataataataacatgaaaaataattacatttgtatttgaattatgatctagaaaaa

SEQ ID NO: 39261 - DNA, 954 bp, Heterodera glycines
ccaaaatcacttttatttttatatctttttttaaaaatgttataaaaatgtaaaataaaatttatattatagaggaaaaaattgcggatttttgtagtattttacttttacagtatgacctttcagaaccgagttatgaatttttttctgaaaaatcgaaaatttccagaaattctggaataactttttttcttttgaacattataaaaccaaataaacctcataaaattctcccgattttttgctatttttaaagctttaattcacttaaattgagcagtccttcattgagttatgaattttcaaattttaacccaaatttccaaggaccaaaaaaattaaaaatatttttgaatttttaaaaaattccaaaaaatctgaaacttaaaataaacatcatatttgtgctcaggaccctaatttaccccagaaaaatatttttcaccctctttttcaacccaaaaaaaaattttgaaaatttctaggtggcctagctcgaaaatttttgaaaatttccgaaaatgaagtacaccattcgatagagcttcaaaagctctacaattttgctctaaggccatttttggctaaaagcaacccctgacgagttatgggcccgggactcaaatgtccggctcaggcccaaattttttctatttccgggaaaaaaccgaattttttcaaaaaaattaccaatcgatagagcatcaaaaacggttgcttgaaagtggtctccgtttgtctgggaaaattcgttaaaaaatcctaaaattcaaaaaccccaaaacctacttttaggcctaactcgaaaatttttgaaaattttcgaaatttttaaatttggaaaaatcgagcttttaaaactctacaatagtcccgctggcacccccttgatcaattcaaaccctgacgtgttattcacccgggactgaactggtcaaagttggtactgaattt

SEQ ID NO: 39262 - DNA, 908 bp, Heterodera glycines
accaatccaagagataaaattgaccaaaaaacaggcccttaagagctggagatgaactggacgggtgtcaagcggttcatcgactcgagaaattggcaaatcactaaaaatgataatttattaaaatcaattaattaggcattatgtatatctctgaattttatttttcattgcgaaaaacaaagattttttgaaataaatagaagtaattaaagaggaaaagcaataaataaattttaaaataatttaaatttttggaaagtgagtaaattttgacttattatctaaaacatcgaatatttacattttatgcatttttaaaatattttttgtcaattttcgctaaccaagaatcagatcgcccatcgtcatgctgattatatacacatgaattgtgtcgcgatttttgcgattaaaaatgcgcagtgcacagtaaatgatcaacacattcatggcgattgcgacaaacgaaccgcaaaccatggaaaattccacctaaaaataatgtatttaaaatattatttattaattaaataagaaaaatcaaatttaaaattaaatacccaattttgtatgttgacaaaaattcttgtcgtgttgcaaattgctgaattagacatggtctgatagatacaatttgtctaaatttaattaaaattaggggaaattatgaacaaatatattaaagggatacaaattcaaaataaattaattttcaattcaaaaaaaataaaaataatattttattgaagctatgtttgaataaaaaaagaaaaaaaattggtgttccgactatttatttgttcagatcaaaataaactgggttttaatatttaaaagataaacaaaatatagaaaattttgattactttatttaaaaatatatataaatgtttaaaaaaatttta

SEQ ID NO: 39263 - DNA, 1783 bp, Heterodera glycines
cgcccctacaaggaattcctcgttcacggacaataattgcaatgtccgatcccaatcacggcaaattttcaccggtttaccaacccctttcggggaaggacaagcacgctgattttgccagtgtagcgcgcgtgcagccccggacatctaagggcatcacagacctgttattgctcaatttcgtgcggctgaacaccgaaaatccctctaagaagttgtgcccacagaagcaatgagccaactatttagtaggctagagtctcgctcgttatcggaataaaccagacaaatcgctccacgaactaagaacggccatgcaccaccatccaccgaatcatgaaaaagctatcaatctgtcaatccttacggtgtccgggccgggtgagtttccccgtgttgagtcaaattaagccgcaggctccactcctggtggtgcccttccgtcaattcctttaagtttcagctttgcaaccatacttcccccggaaccggaagactttcgtttccgggaagctccccaccagggcgaataaatccgccggcggatcgctagttggcatcgtttacggtcagaactagggcggtatctgatcgccttcgaacctctgactttcgttcttgattaatgaagacattcttgccaaatgctttcgctgtagtccgtcttgctacggtccaagaatttcacctctcacgtagcaatacgaatggccccgtttgtctctgttaaccattatctcggtcagcaaaaccaataaaatcggaccgaaatcctcttctattattccatgcacgaacattcaagcgaaaacgcctgtttgaagcactctgatttgttcaaagtaaactcgccagcccaccgacgccgaccggtaaaggccaacgccgggggaaagaccggcagaaaagccaaccaaaccagtaacacacaaagtgtgcaccggacggctagcacagatccaactacgagctttttaaccgcagcaataattctatgcattttgagagctggaattaccgcggctgctggcaccagacttgccctctcatagatactcgttaaagggtttaaattgtacccattccgatgaccggcctcataagagatcggtctcgttatttctcgtcactacctcctcgcgttgagagtgggtaatttgcgcgcctgctgccatccttagacgtagtggccatttctcaggccccttctccggagtcgaacccttatcctccgttacccgtcatcaccatggtagtcagatacactaccatcgaaagttgataaggcagacacttgaaagacacgtcgccggtacaagaccgtgcgatcagcttagttgttctgagtcaacactggacgcccggagggcgcttggttttgtggcgaacaaatgcgctccgctctggggagattggagctttggtgcatgtattagctctagaattaccacagttatccaagtaagaagtcaaggtcaagtaaattatagctggtgtaatgagccgtacgcagtttccctgtctggcaggttaaacttacacatgcatggcttaatctttgaaatgaacacatcagttcaggcaggatcaaccagatagctgctagcgagcgttgccaagcgccgctattacagccgtcttgtaaagacggatagtttcagcagaaacaactccgttcagcgcaagcgtgcgcatgggcagcgaaggagaccgagcaagtggtaatgacacagcgctggccaggcatccgagcttcccggacttgggaagaaccatctcgccg

SEQ ID NO: 39264 - DNA, 1001 bp, Heterodera glycines
  misc_feature (907)..(907): n is a, c, g, or t
  misc_feature (976)..(976): n is a, c, g, or t
ttttctgaccaaaacttcattggaattgattgaacactaaatgctagagtagagccttgggattttgagaagttttcgggatcatggttctccagatggacccggaccgaattccagtatttaaaaaattactgtttttcttggctctcctgtctgattccgagtcctttttccaaaatacaccctgacaaagattcccgtagaggatccggtcctgctgttccggctctctaatcatcacactttttaaaggtcacatgtgtggacgtgtcgccggacgagaattggattgtcagcgcatgctatgaccgcacattcaaactgtggaacttttcagcggatgaatgaatgaatgaataacaactgaactgttttgaatttgttttgtttggcacaatgtttctcacaactatttttttaaatttcattatttttaatttaaaatcaaaaaaaaagaaagcaaaatggcaaatgtttttatgtgagagagagagagttaattaatttaatttagtagtctgcaattagacaaaacaacaacaattaaaaaaaaaatccatggaatttaatgttcgttaataccctcgttggtaaaagccggcacttcaaaaaaatggcggcaccctgctcaattttaattgtgccgcaaaatgatttagtatctgtcggccaatttaaaccaaattggcggaatccacgacttaattactcaaagaccatcattcaatgggcgttactcaaaaagccaccaaaacatacaaacgctacgattatggcttatatgctacgtatattccaattcaaaatgtcagaatcatttcaaacaataaaaaccattatattagcgccgatattagtttaagctcagcagatcaatatatttattttaagagcattgtcgcattanatgaagtgacttttatatttttatattattataatttcaattatatatctgttgtaaaggaaattccanaaatcgtttaccatgaaaatttgat

SEQ ID NO: 39265 - DNA, 1024 bp, Heterodera glycines
accagttcaattttgtcacccctcccccctcccattctcgtccccctttggcgctgatcggatcggtcagcagcatcagacccatcaggacgaacggcgaaagagggggccattccctttacggcacagcgagcggagtgagcagagaaaaaagggacgagagcggtgaagaggagcgggaaccaatcccgcctcagcttggcctaccccaaccccaagcgcgcggcgcaaataaaagattggcgacacatatacttctgaacaattctaatgctaaaaaacaggtactcacgcgaaaactgaataaaaattttgtatttggaaaattttgtccaaaaatttttatgttctaaaattaccggtttttaccggtaccggtaccggtaccggttgaaaaagttggtaccggtaccggtaccggtttttgcagtaccggtcagtaccggtaccggtttttttgcaattaccgattaccgctcaactctaattggaaggtgaaatgttaccatggctttcatggccaagtcagttctttttgacatttttcggcatttttctgctccatgtttttgacattttatatttttattaatctcttttttacaatgtttgtacatttaaatttccctaatcattttatctcggtttattcaatttaattttttttgaataatattcaattcagaaaaaaaacatttcgttttttattgaattacgaatttataacaataaaaaatggatagtgaccaaaaatttacaaaattaagctgtgaaacaactggatcttccatccaattcggcgcccgcccaatagtccagcgcaaaatgtgaatttgtttctatcccttaatctcagggtttatattttgttttgaaaattggcattttccggacttttggagttttttctgaagatccctgtttttaccgggtttataaaactaaaaatatataaaattcaagtaaaaattcttaattttttatttttttagttttcttttaaaaaatatttttttcttttttt

SEQ ID NO: 39266 - DNA, 840 bp, Heterodera glycines
atccaataaaattaggaaatgggcgggaagcgctcgtccggaggccgggagcggctgaaatgatcacataaaattatgaaaatggcgcgaagcgcccgtcctgaggccgcgaagcggccgaattaaaccttaaatataaaaagggcgcggagcgccctttgaggccgcgaggcggccgaattaaaccttaaatataaaaagggcgcggagcgccctttgagtccgcgaagcggccgaaggtcctccacaaaattatgaatgcgtcctcgcgatgactgtagactgaaaattccttatcacatccataaattcatttcaaaatcgcgcatgcactagcaacgaagtcctttgcgcgaagcgctcatgtcagcgcccgcccatatatacaaaaagtatactgtgtacaccgagcaattactgtgcaaagcatactgtctacaccgagcaactactgcgccacacgctagtttatatatactatagaataatgttgcagttcgtagaaaaaattataagtccccgtggtttgcccggaggctcctgaaagtgcggcattgcttaagcaactttttgaggcgcatctgggaaaaataaggatttttcggtccggcggccagttgagcgccagcgacgctgaaacggacaaataaaaaaaatcgtcgcggatttcgggctgtaacttttctcagggaaccgggagcggaaaaagtccgttgagagggcacacccctgacatgttggctacaaatttgccactgatcactttttgataagatcagatgccgagcctgaaaaaattgttgactgaagcgcgctctaaatgtcggatttgacttttcg

SEQ ID NO: 39267 - DNA, 1175 bp, Heterodera glycines
  misc_feature (124)..(124): n is a, c, g, or t
agcagaatgtgaattctctcatttgttactttatgatcattttgtctaattcgcaaatttacagctcattcttcgcgaaatataactgaaatcagtgtttgcggaggaccgagctgataagtcncaataatctccaattacaaattttcatgatcacttttgtgatattctcaatatttcaatttcttatatccaaatgtaatctgtataagtttacagtaggaaattgtaatttgggggttattggcgatttcaaatcgatccttccggaacactgatgctgtttatatttagagcgtaatgagctgaaaatgtcagaattcaaaaagtggggtcgcgaaaatagtaaatctgaggttattggcgcttatcaacctgatccgtctgcaacacttaaacagtttatatttaaagcctaattagcagaatgtgaaattctctcatttgttactttatgatcatttttgtctaattcgcaaaattacagctcattcttcgcgaaatataaactgaatcagtgtttgcggaatgaccgagctgataatcgtcacaatattcgattacaattttcttggtcacctttttggaattccaccatttcaactccttatcctctaaatataaactgaatcagtgtttgcggaggaccgagctgataagtcccaataatctccaatttacaattttcatgatcacttttgtgatattctcaatatttcaatttcttatatccaaatgtaatctgtataagtttacagtaggaaattgtaatttgggggttattggcgatttcaaaccgatccttccggaacactgatgctgtttatatttagagcgtaatgagctgaaaatgtcagaattcaaaaagtggggtcgcgaaaatagtaaatctgaggttattggcgcttatcaacctgatccgtctgcaacacttaaacagcttatatttaaagcctaattagcagaatgtgaaattctctcatttgttactttatgatcatttttgtctaattcgcaaaattacagctcattcttcgcgaaatataaactgaatcagtgtttgcggaggaccgagctgataagtcccaataatctccaatttacaattttcatgatcacttttgtgatattctcaatatttcatttcttatatcccaatgtaatctgtataagtt

SEQ ID NO: 39268 - DNA, 885 bp, Heterodera glycines
ttatcgaggtcaattttcaactttcaagtcttggcttttattactgatccgatttgcgtgtcttatttacctaccgctatactatggaataattaccgtatgaaatttttttttaaaaaatcaattatatgcatttgagtattttattgtaattaaaaatttggctcgcattttcctattcctaaatactatgaatagctctgctagctgcctgtcctcagatgcaccgaatgtggcgaaggggaggggaggggagggccaaattcctcaattaatgtgatggacggggcgatattttaggaaaattcctcatccatacacccccaaaatcatcgccaccacatacataaaaacgctcggcaaacatttggtggacgacaaaaagaggaatttcgtttcgagcggcggcgcttcgtcgccccccccccgccgggccccgcttcttcattgactatcatctcatctcaccccatctcatatatctgttgccacttctctcaaaagcataaggggcttgcttatccagagtctgtactcttgctctggttcagaggtgcacaatgttcccccccccctgctaattgagcataagcgtaccaaactttgcagggatactccccggtaaaggactaacttacactgaaatgagcgccgagctagctggctcaaaaaaattttcgaaaatctgagtctttcgtttttatttattttttgcaaaattaattcttaaatattttttcagaaagggttctgaaacgcaccaaattttatttacatgttagtttaggcactctgatgctttttctatcaaaaagggagatgaataaaatttttaaaaatttttaattcctttttaaacagggcaaaaagtttaggcttaacttt

SEQ ID NO: 39269 - DNA, 760 bp, Heterodera glycines
atgaagccgcacttgccgacgatgacctgtacaatcccataaatacagtcagaaaccacaacaacaaaagggcgccgacgatgatgacctgtacaagccgccgcaacaatacaatcaacagcagcagcggaagatgggccgaccgaaatcgtatgaagatgagcttgacgaagatgatttgtacaagccaaagcaatacaattagaccgagcctatattatatgtctatatgcttatgtaataataatatgtatgttttatgtgtgtgcgataacgagtgtaaatattcatttaataatgtgcaattctggaaaactcatcatttgactgcgatttgacaattgaaaaggattttcattaattgaaaggttttataaagtttgtaaagggcttaacacaaaaaagcggaaatattgaacatttttactgaaaattagtcaaatattttagggcgtggtgctagatcgaaccgaaaatagtctcagtgtgggcgaaccgaaaaattgtctcagtgtgaataaaaatatttaaatttaatatacgattcactaaattatataattatataataaaataataacgtgtgaataaataattcccaacacgtataattttacgagctacgcaaatataaaaattaatatacatatgtatggattttatatgttaaccgcttaaataaatatataattataattattttatctgttagttgtatttatttatcgaatcattatattgatataaattctaaaaatga

SEQ ID NO: 39270 - DNA, 1015 bp, Heterodera glycines
  misc_feature (46)..(46): n is a, c, g, or t
gtaattaggccatatcgaaatattttttatgtttaaaatttttgtnggatttattattaaattttttttatttttcaaaaattgcaaattctctatcaaaaatgagatgtgccaatcttttaggaaattaaatccttaattaacccttaatccatgccagacgaattacaattgccaaataaaaaagacaagtaacgaacaaataagaagtgacattggacgaaaactttccttaaattaagagttgtttccaaaaaaaaatatttccatgaaatgccgaaatttggataaaaaatggactgaaatgtataaatatatggaaaatatgtattcggtgcccttaaagaaatttttactggatataaaaattcgaaaataacttccgcaaaatttttcaaaactttgcacaacatttcaggagtcggaatcccgcaaccgaaaaaaacaaaattttttttctggtgtccaattttccggtgtccaatttaccggtccccattcgtatcgcatcccttccttattttcaccccatctttaatccatgagacacagaagtgaaatttgtcaacgttttttaaaatgtattattttgtgacgcacactattgtgcctctcatgctttagagagagcacatgtgttgaatttgtcaaaaaagttatttgttattgtattgttgtgagatgaccctgattatggtgttatcgtacctttgataagcccaccacagaaagtacaatacgtggaataatatcctttattccgatggtacatgtttaacaatggtgagctttcccgattcggagcggggagggagggggtcgggatccggatccaacggccaggtggagtgacgtgtgtatggacaaaggaaaagcatatacaagcacattgggggaggagacaaagggaaggaccgccccaggcaaattgtcatatggctataagcaaagaagagggagagaagaaaaagagtagagacaatgagaaaaagagtaaatgattagaaattagtca

SEQ ID NO: 39271 - DNA, 1301 bp, Heterodera glycines
  misc_feature (140)..(140): n is a, c, g, or t
  misc_feature (1273)..(1273): n is a, c, g, or t
catcctcattgcctagtctttctcttttttgtagtcctttctcagcttcagatacttgtctattttcaatatctttacgtttaatatgctcacccaaagcctcattaagcctattcactatcccgctaaaaccctttccngatttatcattatatccctcgagagttgatgtatatttggtctttgcctgtctggcgattccctttgcgacgtcggctgatttctttgcttttttcaagtcattcttttccacatgctccaatgttatgtttttggctttatctacttcttcttgaaaagacttaagttcatttcgggatgtttgaatttcggttcccatctcaaccattttgtcaaaccaaatttttatatcaggctcttctaaaatgtgaggatttgtttctcgtagtgtgtttagttgggtttggatggaattcgagatattgttgatctgattaaaatgtctttctacgtctctcccggcgcgttctgcggccctctttgcgacatcaatttttgagtctttggtatcttcagccttggcttctctccttccacgttgttttttgattttgtaatgatggctgaatgcctcgttaattttatttcccaggcccccggcggttttaaaattcatgtccggtaaataaacttgagtcgggacactgctgtcgttttcccatactttaataaactcttgaccgtttataccgagtgcggtgaatgagtaggggtaaataattgatgagagagctactgaccaatttgtgcccaattccagagtctcggggagtcgaactgtgaattttgatgtactgttccctggtcccggtgtgttcgagggtagtacaatgtaaaaatcatccatctattttcactaattcctggttataaaatatgccttttattaaatttccttccaaatcttcaatcctgtatgaatcgggtgtcgtcggattaacaacaacgattttaaacaattcttcggtaaagtttgggagatacccctttgcaaattttcctttttccttggtaattcgaacgatatcgccaattttaaatttgttctttttcgaaattttaaattccttcgccttatataatttttcccagagcgcacgggcattttcaaaattaattgaagacggtttggctcccaatgttctattcacactgttgttaatgtttgttattattttgtctattacatcgacccatcgtagagtgtctttctttgtaaaatatctgtacaagcgctcttgtattgtccgantttgccctttcaacgactccggcgtgca

SEQ ID NO: 39272 - DNA, 1410 bp, Heterodera glycines
aagggagaaaggggaggggaaaagaaagaggagagaaagggagaaagaggaggggaaagaaagagggaagaaagggagaaagaggaggggaaaagaaggaggagaaggaagggagaaaaaggaggggaaaagaaagaggagaaaggaagggagaaagaggaggggaaagaaggagaggaaggaagggagaaagaggaggggaaagaaagaggagaaggaagggagaaagaggaggggaaacagaggaggaagaagaggacatgtcaacgtcaaatcccaacgcactttgaaccgctcaaagaacccgtaacggttgaacagctcgaagccgatgtacttgagagagtgtccgttggtggcctcgttgaggtcgaaagagtcgaagttccaattgttcacttgctaaagtgggagggaaaatggccaaaaaggaagagaaactgacccgcaaaaatggcaaatattcgtggggaatgggagcctaaaataaaacaaaaattgggatttttaatgttcaaaaatgtctgtccgtttcgccccactgaccaaaacggactgcgtccgacggtaaattctgaacagagtgaattaattgcatcaattgaactgactgatttctgctgctgttgcccgtggggacaaacttttcgaaaaagatgcccgtccgtatggcattggccaccgatttgaattttggtttttccttccgcgattgcaccgtttggcgagtgaatgtcgccgtcagccattcgcgcacttcgtccggcaccgcctctggcgtgacctccgccaagtcgtcgtcctcgtcgcaaatccgcctagagacagacggtaaatcgccgagggcggggaattatcgacacaatttgagacagtcccaccgtgtctcgtccatgtacgccgtctccagcacaagcgccgcatattcgatgttccgtttaaggtcttccaatgacaactgaccgccattaagctggtggagaatgtaacgcaatctgagggggagaagcgattggatggtgaacgaaacaatcttcaaaagccatgccaatgaaagtgattgactattaccattaaacagtgctccaacattcattatcctcattatcccctttccccccgcccgcctcaaagtcacttcttgtcacactatcgcattcctttcacctgcacgcgtgcttccgcaacaccaactgatagaaaccgtactggtccccgatgatcatcatcgtacaaagtaattacagggtaatgcaattgaggaaaacaaactaatttggagggagagatgtcgccaattttacaaatcaaaaagtgcggaggaaaagggaatttcgtagtgaaaacggagaaattagcggcagattttcactttaaaaggttcatttcctcgaggatgatgcttcatct

SEQ ID NO: 39273 - DNA, 622 bp, Heterodera glycines
ctggggtggggggaaatagggttggattggctaaaatgggtgttagcccttggctgattacggttcgggactgggcataatggtcgcgggtgcccgtccctgcatttggaacacacggctggggagggacattggcgtgccggatgtccggtcttgaggcatttgaagcaacggttaagggagcgcaaacgttgtaagcgactttcgggggtgccaaatttgtcacaattactggaaaaatggtcgggggaatcgcagaagagacagggcaatttgggacggattttagacccggggggttgttggggctgagtacgggattgagtatggaaagtgagagtaggctgggggttgaaagaagaaccgaatccgggaggccgtggggatggcttaggacggggcccatggtcggttttgggcaaaagagtgtcgatttgttcctttctcttgagaatagaacggagcttatctcgcagccgatcagtggaccattgtcccgctgattcccgggccaaataaatttcatccaaaatgtaccgtgggagccgctgttcgacttccatttgtatgttgatcgtgttgtgaggttgctgctgctgtcccgtttgcacacaaatcgctt

SEQ ID NO: 39274 - DNA, 672 bp, Heterodera glycines
aaacgatttcgttttgttttggcagtatgataccgaataactttcggaaattatggaaccaaaattggagaaattcgaataattttttgactgcaaatttttttcctttattgaattgggttcaaaaaaattataagagaatttttgattattaatttgaagtcttgaatttatttgacaaatccaagacttaaaactgggagaagcaaggggctgtggctgggggcctaaaatttgggccacattggagaattaattctgatttctgaaaaagtcccagaaataactattttttctttccataccttcatgtagagctcgagctgctctttccagtaggacttatcccaggctcaatccgtgaacgaaatcgcgagattataggaatgaaatgagagatattgatatcaccgctaggaatttttactgataaccactttctaaagtccggcttatgggatctgctctgtatcacttacttctgttccccgttgctgatcgtatctgcgatctccgtcactgatggtcatatttgacgacgattcctccatcttctgaatttgttgtgcctaatttctttcagaagagaggcaaactatgctctatagcatcaaatcctattttgaacgcattatcgcccgacttaatgaatcgggtctgaatcacttactt

SEQ ID NO: 39275 - DNA, 812 bp, Heterodera glycines
cagaaaagatggtgatggacagctgttggcctttgcacaaagcgtgaccctccgggaatttggcctcacattggccgctttgtccggaggcaatgatcgctttccctcttatcccttccccgccctccctaactcttttcttagctttagctctaatgctttttgtctcttctcgcggcaatgatcaatcgcttactctgtcttctctgccacacattctccgccccttttcgcttctctgtcgtgtctgattttgtggcttaagtgccttgggctgcgaatgagtggaatagagaaacataccgagaacagccccgcccgctgacaaagcttaagggccgggcggggggggggctttctttgtgtctgcctctgctttcgtcagcttttcctttccctcccaatcggttttccgccattggcacactctcttcccactctttgttctcccttggtgtcaatctttcgccgtgctgcactgtctgtgctcgcattgtcccccggggcgcggctttttgtttgcttctctgtgttctgcgctgcctctttcagcgggctccgccccttccgctgatcgcccccaaatgcgttgggccccgggagggaacaaaaaggcttggcccggcctccgatccacttcatttttgcttgtcgacgacagcacacacagccgaaaagcgcttcttctcatcgccttcgccttcaaaacttagaagcaccaatcccaaccagaaaaaatgtgcgacgaagaagttgctgctctcgtggtggacaatgggtccggaatgtgcaaggcgagttttgggatttgg

SEQ ID NO: 39276 - DNA, 381 bp, Heterodera glycines
cgcgagaatgtaaaaagcgggtgcgtagcgcccgtctgaggccgcgaagcggcctaaaaatcgctgataattttttaaaaattccaaatcttttcacaacccgatagctaatctaggtagcgaagctcccaaagcgcgaagcgctttatccctgtgccagatccgacggttcacgcacccgctagttatatatatgttatattgacaaggagtttcgttgctaaaaccattttctcccggccgaaggccgggagcgccctgaaagtggtggaagggtcttacaactttttgaggagcatccgggaaaactatagaaaaaaatttagcgcggacgactgagtaaccagggacggatttctcattttttcgtgcatttggggg

SEQ ID NO: 39277 - DNA, 1738 bp, Heterodera glycines
  misc_feature (44)..(44): n is a, c, g, or t
aaggttcatcaaacttttacaaactgcgcctatttgcactgcgnatttctcaataaattggttttttcaagacctggttcgaactggaccctgatcttccggatccagcaccacccggacctgactttttcaaaatacccggactatcctattttgtagtttttaaatttcattaattttaaaggaaattcagtcacttagttttggtaactccctccctcccacttgggcaaaaatgtttgataatttataaataaagaaaactcatttatgaaatatctttttttgaaaggttattcggcaatttgccagtcgaccagttgccaccaccaagcaatttaattggttttaaagagatttacatcaggtagataaatacttttattttgtatataaaaaattcttatcccccatgctgcccctataaaaaatgtaagaaaaattaaaaacaaaataccttattatgtatatagcacatgtttcggaacctaaatgaattcgactcaatccaattttaaatttcaacaataatttttgctagattttttaaaaaggaggacacgtagagctctagctgcctgcttcttacaataccaagattgattatttgattaaatttagctaaattatgatttattattttgcaaacaaataatataataattaaatttaaaatattactatcattgatacttttgtaacttcttctctccacggacaccacaccggtggtccgggggtttggagatttagtaaataaataaactaaattaataacatttaaccggcacgttcagttactttgacaactctgtgctctcattgctccattgcttaacgccgcttttcaaaatgggcatcacattgaaacatatgggagatgggatggataaacagaggagttggggactgttcatccacaaaattcttcctctgatcggcatccccaacatccacaagttgttcgttactttcgggtatgttttggccaacaatgactctttgggcatctcagtgatcaggattaaatagatcagtagggtggggaattagattacaaaaaaagcccgaaatatttaagaaaatattgatgaaatatctattttctatctatttcggtatttttggtacgtgtttttagaaaaacccttaacagaaatgaatttaaagacgaaaaacgcacttatacgaatctacctaaaaaatttctaaagggcctatgtaaaatttcaagaaaatttgaattttttacaagaaaaaagttttttctttttctctcattttggcgtattatttcaattgtacttggagcccaaaattgaatcgccatattttaaatacctaaaatttgcatccttagcaacaattattcccaatttttagtggcgctaaacgactgcgtggactgctcacaagcacttcagcagcttttctgatcgaatgcccaaatctccgatcaatttactatgattggtattgcaatggccatgatcgtcccgttgacgccaacgcaaaagtgcgggaatggcttctgtggccgcgcgcggatggccgtccgaaagtgttgtaccgctccttttgctacgatataagcgacgaatacaatcaggcaagcggcggaaaagcaaatccataaaaatgataattaatcgaaaagtaagagaggttgaaagataacagagagagagagaaagaatgggagagcaaaagagggaggaacggggagggatataaaaag

SEQ ID NO: 39278 - DNA, 1103 bp, Heterodera glycines
  misc_feature (76)..(76): n is a, c, g, or t
tcacttcataatatcgcaatttttttattttgttatctttcgataccagacaaacagacaaccgctccgcaacagnctggtaaatgctccttcccagtagaattcaagcagttttccataatattttcttcgccgagattttgtccatcgattgactcgccattgcggcatttaagtgctgaattaaaacataaaagaatttcttattgaaatataactaataaattttaactgaaccttcaaaattttaactgaatcttcaaaccttttaaatatgtcgaaagggtgagcataataaaaaaaataatattaagcatttgaccaaaaggaaaataagttccagaattcagcaaataatagaagcaaaaatttttatattgtttgataaatttgctgtttatatatatgttatataggttttgagtttcgtttcaaaaactaattccggccggccgaaggccggccggggtctgaaagtggtggaagggtcttacaactttttgaggagaattcgggaaaactataggtttttttctccgagggacaactgagtcccagcggctcgaaaactgactttgccgccagtctcagtgttacgaaattttttgcttttgctttctgagcttagcggaccccaaaagcgaaatgccccaactatggcctacaactttgccagcaaaaaatttttgatcagatcaaaggcctgacctgtaggttaggcaacgtaagaatcactttttttggacacttcagtaccaggcgaatagctcgtaagggtttgaactgagcgagggggtgccagcagacttattgtagagctcaatgagcttgatttttccaaattttaaaatttcgaaaattttcaaaatttttcgagttaggcctaaaattcggtttttcggtttttgaattttatgattttttaacgatttttccagggaaaacgaagaccacttccaaaacatcgtttttcgagctctatcgattagtgatgtttttagaaaattttcgattttttccaggaaaatagaaaaattttttggcctaagcgggacatttgagtcccggggccataactcgtcgggggtgggtctagccaaaaa

SEQ ID NO: 39279 - DNA, 1834 bp, Heterodera glycines
  misc_feature (1644)..(1645): n is a, c, g, or t
  misc_feature (1654)..(1654): n is a, c, g, or t
  misc_feature (1689)..(1689): n is a, c, g, or t
  misc_feature (1737)..(1738): n is a, c, g, or t
  misc_feature (1747)..(1747): n is a, c, g, or t
  misc_feature (1749)..(1749): n is a, c, g, or t
agtggtttcgctgatgaccaattacgttggcactcccacccattccttttccaagtcatcgctttgttcggatgcccctgtgttgcgggcgcattgaaaggccaactgatcggctgctcgaagggcggcgacgcaactcttttggccgacatcgaagcatctcttggcactcattttgctggtaatgatggactaatggatcaaatccattgccaaattagccaattaacttattttatttagtttagttattttatgttttccgccttttagatgagtgtgcccatagcctcggcttcgtccgtgccatgttcgccattgccgcctccgcttcttcccatgccagcaacaacagtgaatggcaggcattgagtgccaagtttggtcagcaaatcagtgaaattgaatcgaatgtgccgagtttggcattggcatttccaaagtgccttttgacggccctaaaggtaaaaccaattagaatttgtcactaattaattatgttgtacgatttaaggagaccactcccaacgtaatgtgcctggcaggaacagtgtgatttccatgcccggattgaccggctcacacaaacactgaatgatgagttgatgagtgactgaatagaatgaaatgattgtggtgagttcgttttggattttgtacagcaattagctgttgtatttctgtatttagaataaaataaataataaattgcaattgcaattgaatttttctaaatgttgaatatgaattttcttttatgagagtctttgtactttattccaattttggcacatttttgtcctcgttttctgtcctaaaattcaaccctttcatgacaagcacatcctgacaacaaaagaagccgcccccccccccccgttcatgttctttcttcccaatcgcatcatttttattctccacccaattcattcgcaattcattcttctgttatggctccataaagtcgcctgggaaagtgctaaaaacgcgatgaaaattggaagacgaagacgaagttgatgatgatgatgtgatgatcaaattcagcgatcggagcaatgagcggacgaatgaatgaatgacccgcgcgacacgccgaagagagtcaataaaaagggcggcgatggcaaaacaaacgaaggcattctcaggagaagaagcagcggaaaggacaattcaccagcaaagactcatttcagacaatcggacaatatgtatcaggggtgggacaactctcgtctctcgcctctcgccatttttggtactctcgcctctcgtctctcgcctctcgttttttgggacgagaggcgagagttgaaaatacacccctaaagattgaacttttgagcagccagaaaaattttcaaatttacgcgaaaaaaaaatctcaaatctctttctttccttccttaatgttttctctatttttggatatctccaattcaaatatggtctactggctaaaccttctgcctttcattatttttctcttgggttcaattccccaacggtacagaatttttttaataatttctttaaattatttttcaattgaaattttaattaataaaaaatatttcaatttaaaaattattattttttctttttttaaacagcctaaaactgcaaatttaaccaaaactnntgatcattntttgacaagttctggtaatatattacactcaaatntagaaaatttttttcccggcggcgtctatcgggcaccgccggaacccnngcaccatgntnccaaaaaaattttttttgaaaaacagcgccacaaaaaaagcgacttaaaaacaaaaataaaaaaaacaaggtttgggcatttttt

SEQ ID NO: 39280 - DNA, 997 bp, Heterodera glycines
gggaatttttaaatttattctttatgccagaaaaaaggctatctcttttttgcgagaaattttgtaccatacaaatgttcccagcgtgggcagaggggcgcggagagcaatggccattctattctacagggcattttttaaatttattctctatgccagaaaaaggctatctcttttttgcgagaaattttgtaccatacaaatgttcccagcatgggcagaggggcgcggagagcaatggctattctattctacagggaatttttaaatttattctctatgccagaaaaatggctatctcttttttgcgagaaattttgtaccatacaaatgttcccagcatgggcagaggggcgcggagagcaatggccattctattctacagggaatttttaaatttattctctatgccagaaaaatggctatctcttttttgcgagaaattttgtaccatacaaatgttcccagcgtgggcagaggggcgcggagagcaatggccattctattctacagggaatttttaaatttattctctatgccagaaaaatggctatctcttttttgcgagaaattttgtaccatacaaatgttcccagcatgagcagaggggcgcggagagcaatggccattctattctacagggaatttttaaatttattctctatgccagaaaaatggctatctcttttttgcgagaaattttgtaccatacaaatgttcccagcatgggcagaggggcgcggagagcaatggccattctattctacagggaatttttaaatttattctctatgccagaaaaatggctatctcttttttgcgagaaattttgtaccatacaaatgttcccagcgtgggcagaggggcgcggagagcaatggccattctattctacagggaatttttaaatttattctctatgccagaaaaaggctatctcttttttgcgagaaatttgaagaatacaaatgttcccagcgtggcagaggggcgcgga

SEQ ID NO: 39281 - DNA, 791 bp, Heterodera glycines
ttccgcgtgttggccgtcaacgaagcgggtccgtccgcaccaccggccctgtcagcatcgcaaatctgcacggcgcgcttcctgaagccgcagatcatcaccgcgcagcgcaagtggaaagtgcgcgcaggcaacacactgacgctgggcatcaattttgttggcacgcctgacccgtccgtgtgctgggtgaaggcaggcgggaccggcactctgccacccgagctgattatggaagaacaccgcccaggcaacacgtcaatcttcttcccagccgcaaagcgctctgaatgcggcacctatgagctacggctgaagaacaacgtgggcgaaacggaaggccactttgaagtgctggtgcaagaccgtccggcaccgccgaagggatcgcttgcggtggacaacgtagcgcgcgactcgtgcacactgtcatggcaaccgccggaggacgacggtggctccgaagtcaccaactacgtggtcgaatgccgtggtgtgggcagccaagtttgggtgccggtcaacaacgttgttggcacaaacagcaccgtgccgaacctgcaggagggccacgaatatgaattccgagtgtgtgccgtgaatgcgtttggctgttccgacccgttgaacaccgactcggccgtggtggccatggacccatacggcccgccgggacgacccgaggtcacggaccacgacaacaatcaaatcagcatcaaatgggcaccgtcgacggacactggcggatcgccaatcgcttattatgatgtgcaacggaaggacgcaaaaac

SEQ ID NO: 39282 - DNA, 462 bp, Heterodera glycines
aaaaaagttattgtcataaaattttaaaaaaatgcagtcagaaatttttgtcctgaacttttttgaaactcaatggaatttttttaattttaaaggtaagtagagagagaattcttagagctatcgaatatattaattattttggctcaattgcattttaaagattttaaattttaaatgtttataattacatatgcatgatcattgaaaaaacataaaatagcatgttcaatgctttataattttttttatatttaaggaaaaatttttttaaatccatattcttatagagatcaattaaagctattaaatgataccttgaaatattaatttgttgaatttgaaccaagttatgaatttgtttgtgtcaccttttttgttttcgaactcattggcggatttacgaaacgcgcatgggtggcggtattaacaaagtacccatttggcggatttacgaaacgc

SEQ ID NO: 39283 - DNA, 1164 bp, Heterodera glycines
aggaatcaatttttgggaaaatttttcatttcgtagaggtgtatatttcgtttttattccaaattttgtaagttttttttacgaaaaccctataataggcattgtaaacgtcatcgtagacacccccaaaccaagcttaaacgtgtttttttgtgcttatttatacgtatcaaatgccgcagaaattttaaaaatctacctaaaaaacgaagccctaatgataaataatatcgaaaaattttaatattaataattattatttttttataaattaccgctatgagcttttcaatggctgcttcaaaggaaggagcatgatgaagatttttcatttcggtattccagaacattgtggccacttgattgcgtttcaaggagtacatgaaacgtcctggaaaaatgtttatacaatatattaccgtatgtcccatagggcatgggacgggacaaaatcccgccgccgaaattgttttaaaaaaaatttcctaacatagaaattttccatcaagaaaaaaaatttttttacatttgaaggacgaatgggaagcctggattatacaaagagtttcacattcaaaacgaaaattaaactagctctaagaattctttatttaactttagaaatttcattgagtttcaagcaaattatagacaaaaaattctaacttaaggagacttattagaattttataatcataacttttttttaccattttaaaaaattttgtaacttaatattcttatagaaaacatctagcattatttaatgataccatgaaatgtttaatttgattgaaataggggcaaattaacaatttttatatgttacacttttttagcgaatttttttgagattttaagcaattttcttaacaaaattacattaaaatactcaaaaaatttcccggcgtcgcctatcggcaccgccggacccccattttaccatatatttttttgaaaaatggagatcaaaatgggaaaaatagtaatttttggcgaaatacgtcgaaaaattttgtaaaatacacccactaattcgggatttcacaaaaaaacaaaaaatacagtcttaaaaatcgacggaaaaaagaaaaatacacccctaaatcctaatttttgacttaagcccccccccgaagccaagggtctagctacgcccctgat

SEQ ID NO: 39284 - DNA, 960 bp, Heterodera glycines
gaagcaggtaaagaagcaatgaatctgattggaggaatgcttcaaagtattcaattaaccaaactgatcaaaagcactcactcggctggcagtttgaccaccacagcgagcagcagcgacgacggaggcgaagtgaacgggtggggcgtcgcgtgctgttccgctgcgtcttcgtccttttccggcaccggcgttcttttccttgccgaagcggtcgtcgattttctcccaaatttcgtgactttgaattttcaggtgtgggaacatgtcgcaatgcttcgtgatgaattgcctttccgtgccggagaggaagttgccgtgctcgactgtccctccccccaactttggtacggcgtttgcggcccgcgcagcggatggtttccagcttcatatgtgcgggtaaatgtgccattcggcattgttcttgggttcttccttcccactcgccctcttttcggcactatcatccctccccccccctcttcccccattttggcattttaaattccaaggtttagcccaggaatagggacttgtgcaaactttgtgctggtggtcaattggaagcgttgcacaagttcgacccttccgaagactttccatcgcccgaaatgcgtttgctgagacgacgaattgtgcaggaactgatcagcactgagagggaatacgttcgactgctgaagaacctcgtccaggcaaaacatcagaccgaatgagcgcataagcccaaaattaatcccattattccttcgtcaagggatttgtggaacagtgccggcgccgtcgagagttattcccggaggaaagggtgcagcgcattttcggcaacttggagctgattctgatgctgcactcgcgactgttccgcgagttggagacggagttggacgagaaggagccggaaaaaagggccgttgccaatgtgttttgagaaatggaattattgctctagaggtcccc

SEQ ID NO: 39285 - DNA, 1621 bp, Heterodera glycines
  misc_feature (1128)..(1128): n is a, c, g, or t
tttttttgatccgcttgtgcccggtggaacgcggaatttggttgccggtttccgagagagtgccgcctctgccgaatttctggtgcgaattgggcgttggtggcggaatggaagaaagatggtcctgaagaaatgttttaggtgttattttccaataaattatgggcaaggcgtgtgcccgggcaagcaaaaaattatccgaggccagtttccagtgttttgagccttttttaaaaaattttactgttttgggatcgctgtgacttcccctctattttctcattggaaaatgaattctgctactcttctctctacctgattcatgaaagtgttttcacaaccgccgaaatttggttggttctgtaaaatgcaaaacattaatatttctcatttgtttaacctttcaattttcgtttcataatttaaaaagtggaaagcctggtagtgttattaccgtttttaacttaaaactcggcaaacatatcagaaaatgaattccggaatcgaaatttttgtctttgctcgaaaaaaaactattttggtttttgcgtcattttccatcaaatccctctctcccctcaatttcacatgaaatcatcaaaagtggattctgttgcgccctacctgaatctgtttgtgttccactgttggtggagcaaacggcggaacagaagtgtcggagacaatggacggtcctggagaatttggaattacaaaatttcgtaaatttgttttacccggaaaaagttgcagtttttgttcctgttccatttttgcaatctttgcttggaacacgcgcatttcttccaggtgtttcaactttacgttttctagttacagtttggtctaatgaaagaaagttaaatgatttttaaaagattttaaagtaaaacctacgttttgatgttccaatttggcaattgtctaatgaataagttaaatgatttttaaaagattttaaagtaaaacctacgttttgatgttccaatttggcaattgtctaatgaataagttaaatgatttttaaaagattttaaagtaaaacccacgttttgatgttccaatttggtaatttccgtctccaactctttgcaacgttctgcgagtttctaaagaaggaataacctntagtgagatattgctgaaccctgttttcatttaatggtcggattaaactatcattttattccctgtttcttacccgaattattttagtcctaatccaattaaactgttttttctttaaaaaataatcaatggacgaagaaactcgggtaacggcccagcgaaggtcaaagggaagtgcgccagtcatttcgtaaataagctcgggtggcaattgtaattttttaaacaattgcatggctttttggttagaaaaataaaaatcttttagtgaatgaggtggaagagggagtggagtttatgtgtcgtcgtaaataaatctctccctcccctttgactgatttgtgaaggattttcggcatggcatactttgcgtaagctgtaacgactacacagacatatgtattctccgtccttattaaaggtgctcgtcccaatttgaaagggaaacatcaaagacaaatttcaaaaagccgcccaagcttatgatgaaagg

SEQ ID NO: 39286 - DNA, 1078 bp, Heterodera glycines
  misc_feature (47)..(48): n is a, c, g, or t
  misc_feature (122)..(122): n is a, c, g, or t
tttttgctaggcttagatcacatgcgattttcggcactctgataatnntagcgctcataatgggatgtataaaggcgattgtagaaggaattggatgcgctaaaattgtttgagaagctttntgagcgtaattacgatttttacttacaccattttttgctaggcgtagatcacatgcgattttcggcactctgataattttagcgttcataatgggatgtataaaggcgattgtagaaggaattggatgcgctaaaattgtttgagaagctttttgagcgtaattacgatttttacttacaccattttttgctaggcttagatcacatgcgattttcggcactctgataattttagagttcataatgggatgtataaaggcgattgtagaaggaattggatgcgctaaaattggttgagaagctttttgagcgtaattacgatttttacttacaccattttttgctaggcgtagatcacatgcgattttcggcactctgataattttagcgctcataatgggatgtataaaggcgattgtagaaggaattggaagcgctaaaattggttgagaagctttttgagcgtaattacgatttttacttacaccattttttgctaggcgtagatcacatgcgattttcggcactctgataattttagcgctcataatgggatgtataaaggcgattgtagaaggaattggataagctaaaattgtttgagaagctttttgagcgtaattacgatttttacttacaccattttttgctaggcttagatcacatgcgattttcggcactctgataattttagcgctcataatgggatgtataaaggcgattgtagaagtaattggaagcgctaaaattgtttgaggagctttttgagcgtaattacgatttttacttacaccattttttgctaggcgtagatcacatgcgattttcggcactctgataattttagcgttcataatgggatgtataaaggcgattgtagaaggaattggatgcgctaaaattgttttgagaagctttttgagcgtaattacgatttttacttacaccattttttg

SEQ ID NO: 39287 - DNA, 961 bp, Heterodera glycines
  misc_feature (838)..(838): n is a, c, g, or t
  misc_feature (918)..(918): n is a, c, g, or t
agttgcatgtgatggcaaaagttgtgaaattcacttccattttacggccatgaattgccgggaagtgaggcgatcaaaattcataatgatagagaatgtgtggctttacctgttttgaagctaagtcgggcatctgacggctaatatgagaataaagtgcagttctctctttaaacgaactgattttatggccactttctataaaggcgatggcggtcgctgtatgaccgtaaacccagttttttgtatagaaaagggttgtcctaattgcaaatggatacagtatctgatttatttcacaacgccaacacgccgttgaaaataaaaacacaagttgcatgcgatggcaaaagttgtgaaattcaaacgcattttacggccatgaattgccgggaagtgaggcgatcaaaattcataatgatagagaatgtgtggctttaactgttttgaagctaagtcgggcatctgacggctaatatgagaataaagtgcagttctctctttaaacgaactgattttatggccactttctataaaggcgatggcggtcgctgtatgaccgtaaacccagttttttgtatagaaaagggttgtcctaattgcaaatggatacagtatctgatttatttcacaacgccaacacgccgttgaaaataaaaacacaagttgcatgtgatggcaaaagttgtgaaattcaaacgcattttacggccatgaattgccgggaagtgaggcgatcaaaattcataatgatagagaatgtgtggctttaactgttttgaagctaagtcgggcatctgacggctaatatgagaataaagtgcagttctctctttanacgaactgattttatggccactttctataaaggcgatggcggtcgctgtatgaccgtaaacccagttttttgtatagaanagggttgtcctaatttgcaatggatacagtatctgatttattt

SEQ ID NO: 39288 - DNA, 566 bp, Heterodera glycines
cattaaaatactcaaaaattttcccggctgcgcctatcggcaccgccggaccccccttttaccatatttttgaaaaatggaggccaaaatgacaaaaaatattaattttttggcgaaaaacggcgaaaaattttgtaaaatacaccccgtaattcgggatttcaaaaaaccaaaaatacacccctaaaaatcgaatttttgacttcaacctccccaaagccaagggtctggctacgcccttggtatatatatactagagatcgacctggatccaggtccaggtccaggccatttttcggcaatctggatttttcctggacctggattttcctggatttttgtccaggaaatcaaggtccaggtcaaatgtgaaaaaaaatccaggtccaggtccaggcaaaacaggaaaaaacctggattttcctggacaaaattttagaatttattttttcaagtgaccgatgttttttcaagttttcaaaaacagattaaataaatttaaaaacacattattattattaattagtaagtttagatgtttctaagcaaataattaattttttcaa

SEQ ID NO: 39289 - DNA, 1129 bp, Heterodera glycines
aaaaaaatcgattttttcaagtgtccgtttggggtactcaaacaattatggggagcaaaaatccaacgcagaattaaagtacagactatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaaggattcgtctccccataaatctgggcgcatcggttcggggggactgccccgaaaacaaaaataaatcgatttttttcagtggtccgttggggtactcaaaccattatggggagccaaaatcccacgccaaaattaaagtacaggttatagggaacttttccgggaagatttcgccttccccataaattggggcgatcgtttccggggggacttcccccaaaaacaaaaaaaccatttttttcaggggcccctttgggggaattccaaaaatttttggggaacaaaattccccccccaaaatttaaatacccacttttatggggagattttttcccaaaaggtttccgcctccccccaaaaaatttgggggccctctgggtttgggggggggcctccccccaaaaaccccaaaaaaaaaaattttttttgggaaaaaaaaattttttaaaaggccccgccccacaaaaaattattaaaaaagggtttttttttttttctttctcaaaccccccacaaaaagtgtgggggtctttttaaaaaattttaaaaaaaaaaaaaaacaaaacaaaattttttttttttttgtaaaaaaaaaaaaaaaaaaattttaataaaattttttttttttctcttttttttataaaaaaaaaaaacaaaaaagaaccaaaaaaaaaaaaaaaaaaaaaaaaaaagagggggggggcccccccccccccccccttaaaaaaaaaaaaaattaatttattttttttaaaaaaaaaaaaaaaaaaaaaaaaaaacacccccccccccttttttttttttttttttttttttcccccccccccccccccccacccaaaaaaaaaaaaaaaaaa

SEQ ID NO: 39290 - DNA, 912 bp, Heterodera glycines
atccgttccgcagagcctcttcaaattttttccatcattgcaagagctgcggaaattgtgaattaattctcagaaaaatggctatctctttttaggacaatattctatctcgtaaccccgatgctaatccgttccgcagagcctcttcaaaattttttccattaccgcaagagctgcggaaattgtgaattaattctcagaaaaatggctatctctttttaggacaattttctatctcgtaaccccgatgctaatccgttccgcagagcctcttcaaaattttttccattaccgcaagagctgcggaaattgtgaattaattctcagaaaaatggctatctctttttaggacaatattctatctcgtaaccccgatgctaatccgttccgcagagcctcttcaaaattttttccattaccgcaagagctgcggaaattgtgaattaattctcagaaaaatggccatctctttttaggacaattttctatctcgtaaccccgatgctaatccgttccgcagagcctcttcaaaattttttccattaccgcaagagctgcggaaattgtgaattaattctcagaaaaatggctatctctttttaggacaatattctatctcgtaaccccgatgctaatccgttccgcagagcctcttcaaaattttttccattaccgtaagagctgcggaaattgtgaattaattctcagaaaaatggccatctctttttaggacaattttctatctcgtaaccccgatgctaatccgttccgcagagcctcttcaaaattttttccattaccgcaagagctgcggaaattgtgaattaattctcagaagaatggctatctctttttaggacaatattctatctcgtaaccccgatgctaatccgttccgcagagcctcttcaa

SEQ ID NO: 39291 - DNA, 1024 bp, Heterodera glycines
cggcttatgattttgactattaaaaaagttgcagaaaaatttagctttcgcgttttttggaatttcgcttttcgcatattttctttcgcaaatttcttgtctcgcattttattttccgatttggtcgatccctggtgcggatactaacatttcaaaaaggcataacatataaattatcctttttttaaaatagtgggaaacgaactttttatcaaaatgtgcttttgctatgaaaacaaaaaatcattgtagacatttaaatgaatttcagaaaaattatgataaaaatttaaagaattcttctctaaattgtgactgtgaatggaaggatatggggaatttgatgaaggtaaaaactgaaaaaactgagaggagatgagaaaaagaggataaaaatttgaattaatcgactacaacacacacacacacattcaacgccacagaaaacaaacactactaatccgcaactgttaaggattaattaacaccaaaacggcactaaatgagccaattaatttatcaatttctggtcaaacaatttggtcattgttttgcggggacaaatgaatactaaggctgagcgtaccaaagttcaaacacacttaacatataattttttgcagtttaaaaaaatgcatatcgcataattttccaaaatttttacgcacaatacacgcaattattgaaattcaaactttaaattggaaaaaaatagtgctgaaattttgtaaaaaactgttctttgtttctatgaaaataaattaaaaatcattataaaaagtttcttggtttcaaaaaattatgtcaagaaattttaagacaattgggtctagtgcattttatgagtccaaccaagtttaatggcatttgatgagtctaaccaacaatcgaacccgtattttttggactgtaagctttttcatttctgaacaaactgtattttttggaacacgaaatcattaagtctgaggcagttaataaatacgagaaaacatgagaattctgtcgtttaaagaaattcatt

SEQ ID NO: 39292 - DNA, 693 bp, Heterodera glycines
gaaagaagctttcttttttacccgattttgacgagtgacaaacaaattttgcgccaaaagtcaacacaatttttgtgtgagtgtgaaataattagagggaattgaaggcgtgaaaatccctttctttgctgcgcacatatcgtgcggttcttcggttcagtggagtgtaaacttttgattagtgtgaggcgcgaggggcagcgacagggaaaggcgttgctaccgatggccccaaaaaacggaaaactatgagaatgacgacagtaagacagaagagaagactcttttatggtgtcaatttgggagggggcagagaaagaagtgtcgggaattattaaaaagcatggaaatagggggtatgtatgtctccaactcaagcataatctcggggaaagggattttggcattgatttgtaaaaatcggtaaattgggatcagggatctgcagtccgggtttctcttggtccaaacacctgattcgggggcatagattaaaaaagcatcgaaaagggggatgccgaaaaattaccgaattttatcccagaatgtccggtctgggaatagttcccaaagccccgatccgtgaatttttttagattccgttctccactaaatacatattcactggaactaatgcgttttcgaggagcacttcagcgtctcttcccggcggctccattgattcaccacggc

SEQ ID NO: 39293 - DNA, 1461 bp, Heterodera glycines
  misc_feature (400)..(400): n is a, c, g, or t
  misc_feature (403)..(403): n is a, c, g, or t
  misc_feature (465)..(465): n is a, c, g, or t
  misc_feature (516)..(516): n is a, c, g, or t
ctgccggttctcggcacagcaaagcactaatagggtgtttgactcacttcaaaaaataattccatacccaaaagttttttacaaccacatattgccaatctaatttcttgcagattgaaagccatccattgcctgccggttctcggcacagcaaagcactaatagggtgtttgactcacttcaaaaaataattcattacccaaaagttttttacaaccacttattgccaatctaatttcttgcagatttaaagctatcaattgcctgccggttctcggcacagcaaagcactaatacggtgtttgactcacttcaaaaaataattccatacccaaaagttttttacaaccacatatttgccatctaatttcttgcagattgaaagccatccattgcctgnccnggtctcgcacagcaaagcactaataggggtgttgactcacttcaaaaaataatcatttaccnaaagtttttttacaaccacttattgccatcctattttcttgcagatttaangctatccattgccttgcggttttccggaacgcaaaagactaaaaagggggtttgactcccttcaaaaaaaaattccttaccccaaaatttttttaaacccccttttggccaatcaatttttttggaaatttaaaagtttcctttgcccgccgggtttccggaacaaaaaaaaaaaaaaaagggggttttccccctttaaaaaaaattctttttcccccaaaatttttttcaccccctttttttccccatttttttttttaaaaaaaaaaaattcacttttccgccggggccccccaaaaaaaaaaaaaaaaaaaggggggtttttccccccctaaaaaaaaattttttctccccagatttttttcccccccttttttcgtcctattttttttttttttaaaaaaaataacaccctctccccccccccccccccccccccccccaaacacaaaaaacaaaaggggggggggggccccccccaaaaaaaaaaaaaaaaaaaaaaaccacatatttataacccccccccccctcctcccctttttttttttttttttttttaataaaaaaaaccccccccccccccccccccccccccccccccccccccccccaaaaaaaaaaaaaaggggggggggggggggggggggcggggggggagggggaggaaaaaaaaaaaataaataataatttttttttttttcttcccccccacccccaacaaaaaaaaagagaagggggggggtcccccccccccccccccccccttttcttcgagggaggcgcaccaaaaaaatttttttttttttttttttttcccccccccccccccccccccccccccccccgcgtatatttttttttttttttccgccccccccccccgcgccgggcggcgccccccttttaaaaaaaaaaaaaaatttttcccccccccccccccccccc

SEQ ID NO: 39294 - DNA, 976 bp, Heterodera glycines
cggagtttgaacgacacttctctagggtttgaggtgctcccgagtcagaagtttcgcttttcaaaaaaatcattgggatcgtacgttttcggcaaaagagtgcaccatagcaaaaatggcggagtttgaacgacacttctctagggtttgaggtgttttgagtcagaagtttcgcttttcaaaaaactcgttaggatcgtacgttttcggcaaaagagcgcaccatagcaaaaatggcgtagtttgaacgacacttctctagggtttgaggtgttttgagtcagaagtttcgcttttcaaaaaaatctttgggatcgtacgttttcggcaaaagagtgcaccatagcaaaaatggcggagtttgaacgacacttctctagggtttgaggtgttttgagtcagaagtttcgcttttcaaaaaaatcgttaggatcgtacgttttcggcaaaagagtgcaccatagcaaaaatggcggagtttgaacgacacttctctagggtttgaggtgttttgagtcagaagtttcgcttttcaaaaagctcgttaggatcgtacgttttcggcaaaagagcgcaccatagcaaaaatggcgtagtttgaacgacacttctctagggtttgaggtgttttgagtcagaagtttcgcttttcaaaaagctcgttaggatcgtacgttttcggcaaaagagcgcaccatagcaaaaatggcgtagtttgaacgacacttctctagggtttgaggtgttttgagtcagaagtttcgcttttcaaaaagctcgttaggatcgtacgttttcggcaaaagagcgcaccatagcaaaaaatggcgtagtttgaacgacacttctctagggtttgaggtgttttgagtcagaagtttcgcttttcaaaagctcgttaggatcgtacgttttcggcaaaagagcgcaccatagcaaaaatggcgtagtttgaacgacacttctctagggtttg

SEQ ID NO: 39295 - DNA, 1054 bp, Heterodera glycines
acctggattcaatggtagacctgaaccagggatttccttgacaaaaatccaagaaaacccaggtccaggaaaaatccaggctcgaatcaaggtcaagattgagctctctctcacccattatccctcttgaaagcggacgatttattctctaccccgattcattctagaaatattaataaaataaattacaatttaagtaaaattccacagtggcccaatagggctcttagtatattcggattaaacagcgattagttcacctgcaaaaagatccctttgctgttacagtagtccaccagatccgctcgctgcataaatgggtgcatttcgcattggacaaccgccggcagacggtgcccgtccttgacaaggtgttcaacatggtccgactcgaaattggctgtgccaatggaacgaattgtgccaatatctgaaattgactaatggaattattaaattttttactaaaatttaatttcaaaaatttttttttggaaagtttacccctcaaattgaaaaatccccacttgtcccccgcccgaaattccgaaacatctccttgtccctaccgaccgacctcatttgtccggtccccaagaaattgcatatataatacccaaatagtgttccaacacgccgtacaccactgcacggtcgtccctgtttcctgaacacatgttggacacttcgccaaaaaagtcccttgggtagtgcaccatgcacaggtcaatgtagcttaaaaaggtgtgttgaatgttgttatattgaaaaattgttgctaccctcgtaaaagctaatatgaacaataattgtttaattgaaggtatcaatttttaaggggaaatttgggaattttggaccgattgattttttaacgattttcattaaaaatggcaattttgagtcaaattttaaattttaatgaaatttggtcgagattttcgaaaatttcaataattttcctctttctcctttcgccaagcctcgcaccttgtccgagacaatcacattattattcaggcgataaattttcggtctcgagcatcactcgatt

SEQ ID NO: 39296 - DNA, 1044 bp, Heterodera glycines
  misc_feature (912)..(912): n is a, c, g, or t
  misc_feature (953)..(953): n is a, c, g, or t
  misc_feature (1033)..(1033): n is a, c, g, or t
aaactataaaaatttgctatggaaaaatttgcataaaacatgaaaattttgtaaaaagggttgaccattaaagccccaccctcgagtataaccccattttgaagggggttttattcgaggaaatacggtataattatgaaaagcccttaatccagacttggaaccattacaggtccaggtccaacaaggaatccaagccaggctcaagcattttcaagatagcaaactctctaatcatcaaaatattattcattaccaacgctttctgtaaaatcctcttttggtatgagtggaaaacgaatgttggacaatattgggtcaagaattttgcctcgattttcagctgaacattcgatgactttttgacggcactgttcgtcggaccaacggagtgccttaattttagaaaataaataattgtaatttaaaatatttaatttaccgcattccaaatttcgatttcactgcttctcagctcatctcttttgagaatttcacacaacaaatcttggtcaatttgtaaaaaggcttctgatttgaccaacgcactgatatttcgatcaatgtagtgcaaacaacgcagagaaaaagcccaaaaataaaaatattataaaaaattatataattattactttaactcgtcggggaccgtaccatagaattttaccgatgttttcggttgagaatttatccttagattatttatagggcccggatttatattgacaaaaaaaaacaccaaaatatagattatattatagacgaaaaacgaaaaatatagacaaaaagctaaaatatggacaacaaattacagttgtacgggaccggaaattttaagaaaaaccgggaccagtacttttcgggttgaaaaaccgggaatttttggctggcaaaacagggaaaaaccgagancttttcccggtcccggtcaaaaccgggacgtaggtactcangtgtacgttctttcagtatcaggtcccggtcgcgtacaaccctataaaaataaaataattgggacaaaaaatttatgaanaattgtcttga

SEQ ID NO: 39297 - DNA, 564 bp, Heterodera glycines
aaattgttacccctgccaaaagtcccgtccgaatctcgggccccttcgtgtccagtgcaatagccacgttgtacttcttggtgcatttggcagctgcttcacgcacatttttgatggtaccgccgtgatactgtaattttttgtaaaaattaatttttggcctgcagaaaattcaaattttttcgaaatttaatcgtttaagccaaaatgaatgccatattcataatcagcgaccctaaaatctctcaaacatgtttacgacttttgaaaatcggcaacagcaaattgaccatgctctacacgataaaagtgtagtttaagtgatctgagcaatcacagttcgggatgttgttcatttataagttttggattgaaaattttacaaaacggtggccgtcggaaattcaaattctcaaaattaaacagtagtgaaaacctcacttcgtggtccccgtgactgaagttcatccgggcgacgttcatcccattttcgatcatttggaccaacatgtccaccgaacgacaaacgggccctgaaaagggaaaacagttcagggccagcct

SEQ ID NO: 39298 - DNA, 879 bp, Heterodera glycines
  misc_feature (61)..(61): n is a, c, g, or t
  misc_feature (75)..(75): n is a, c, g, or t
  misc_feature (866)..(866): n is a, c, g, or t
tctgctgcttgtgtagagccgacatcatgcgcgcaacctacccagggaccgccaccgttgnccgaactgcgcggngacccctcttttgactgcgagccgcctgagggaggcggcggcgagggattgggcgacgcgtgacgggaactgtaagcgttcagggaggaggcggacggcgagcgggactgccctcgctgcagttgaccgccaaaaaaggacgagccggctgcaggttccatgagcggcgactgaacgtccactgaggcgtcacgtatcagacgcgcgctgcccgccgatgggcccgcgacaacagacggaatcacagcggtcccgccaagcgagccttccggtagcagcacaaccgctggcagtattgaagaaggcagtgccaccggctgctgaggtcgcactcgctgactgtttgtcatggcatacggctcggcggaagaactgacgacaccgccaccaccgccgctgctgctgttgctgcctgcgattgtggtggctgtagatgaacatggcgtggtgctgaagctgggcggtgccgcggttggcctcggctgagtttgccaagcggcgcttggccgcattatcaaaagacaattttaaatctgtcaaacgaaagaaaaacaggaaataataaaaacaaacacatgaagaaaaaaaaatttaaaaaaagttaatttttggagaaaatggtcacaaaaacacttgaggaatgggaattgtttttaaaaaatatcgtaattttgtgccgtttattgctgccggggggcgcagctgaaaactgtgcaatgcccaggggggtttctcattctcaccacacttcccccccccctccctctgcttaaccgttgcgcatgtgtttnaacgaccgaccga

SEQ ID NO: 39299 - DNA, 1035 bp, Heterodera glycines
  misc_feature (25)..(26): n is a, c, g, or t
  misc_feature (966)..(966): n is a, c, g, or t
  misc_feature (1017)..(1017): n is a, c, g, or t
agattttttgaaatttcctaaatcnngcaatcctgcgcaggatcctgcagattttaaatgcaggatttgcaggataatcctgccggatcctgtcctgtaaaaaattttgaattccaattctgcaacaggacccgcaaatttgaaatttccggtctctaattttaaatataattaatgttatgatttattctattattcttttgtataatttttaatattaataagaggatttttttctggttaatgtttgtcagcgccaaagtttttacatttatttgcttcctatttcaatgatcaattaatttgataattgacaaaaaaatgtaagagcatttttaaaattttctttaagtttgtttcttttaaattttgtgatgtaaactaatttatttccctaattttcggaaaatcaagctaggagctgcgattctccttggtcgcgtgcaagcaattatcctgataaattaaagtttagagtctaatttttatggctcactagaacgggccaaacaattggcttgctgtttatttatttattgtactttatttttgaaatttttatgtcaattttaaaatttttcaaataaaaaatgtatttaaattttcttaacttttatttgctttataataaattatttttatttaatttcagataatgttattttaatacgcagactatcagcaattttccaagactttagctgttggctattttatttcttataaaaaaagaatcgtccataattttttattttgattaagcaaaagattttttgaaaattaatcatacattaatgtttaataaattaaaaaatggctcttcatttaagtagttgttcttagttattcgagggccataattatatatgttattttaataaacactttaattattacctcatttatacttcaaaattttttgtgtatttgggtcagttttgattcatatctctttagtcgaatganattttcatatatcccatatttattaattatttggtttcaaaattatactanatgatatcaagtattact

SEQ ID NO: 39300 - DNA, 951 bp, Heterodera glycines
aaagtatatattgttcttcaagcaccataaattagggccataaaaatggcattttggctaatttaggagcaaaaaaatttttcatgaaatgcaaaaccatggggtcccccctatggttttgaatttcaaaatcacaattaattttataactttttttagactcgtgataatgagatgatataaagcacattatatagggcttaaaattccctacaaaaattgtctaagaagattttttgctaaaatcaactcctgccaagttatagacccaaaactgaaataagccctcatttccggaaaattttctatttccaaaaaaattttgaaaaatttttctgaaaatgccaccaatcgatagagcgtgaaaaacggttgcttgaaagtggtcttggttttcccgagaaaaatctgcaaaaaataataaaattcaaaaacggaaaattttcgagggggcctagctcgaaaatttctgaaaattttcaaaatccgaaaacatggatggatgcagctcgtcgagctgcacaaaaaagtaattatcagcatcccgctcagatcaaaacacagcgagttatttgcgaaattcaaaaaatgccaaatttggttttcaaaattcgccgaagtgtacaggccaggcctttgatgctagagcctcggccaagaagaaaaaaatttcccaaacattccaacttagtcgcctcccagcagaagttttttgctccgggttcccagaaaaaagttttggcacaaaaactgcatgcattttttcccaaaaagccatttcagcgccgctggcgctcagttggcctccggaccggaatgccattaatgtcctggatgcgcctcaaaaagttgcttaagcaatgtcaacatttcaggtccccccgattagccgttcccggagattttagttttagcaatgaaactcgatgttgctttagttatatctaaact

SEQ ID NO: 39301 - DNA, 197 bp, Heterodera glycines
ctttgcagggatactgaaaggaaaagaattaacctcgttttatcacattagcttgtcatcagtttttataaaaaattttcaaaattctgagtctcctattattttatttatttttcaaaattttgaagggcggggggggggggggggggggggtagaggcttaattaacgagggataatagaaaaattaaagaaaaa

SEQ ID NO: 39302 - DNA, 888 bp, Heterodera glycines
ccaaaattaacgaaaataaagttttttttgtttttaagggtaacaaaacgaaaaaacaaaacgaatgagcaggggaatgacggaagagcgaacggagcaacaaattaacatcaaaatactcgtgcttggacccccacgggttggcaattacccaattaactttcgagaattcgttttcaagagcggcaaaacatcaattgccaattatttggccgattcgcaagacgccgtctccaaggagtacagaccaacccaaggtgaaaaaagagcacaaatgaccagtcaaatggtaattgccattaatgggaaggggtgcgcatcgtcgaattcgaaagcaatcagttggaattggatggggaccgagtgaacgcggaggtgggaaaagcaaatggggggggggggaagctcaagactcgaattagccgagagtccaccaattgcaggtggaattgtgggactgcagcggagacaaaaagttcgaaggctgttggcaggcgatacgacaccgatgcaatggggtgggcgagggaaagacggcacagccgaggaagggatgccgaaaatgtgggagggagtgccgaattatgaaggggagtgatcagcaatgacttttaaatggtccaaggagatgagtgaaaccgaccaaaactgttggaatcaatcacagaaaggactaaagggcacaaatcattcgcggtgatcaacaaatgatcagaaccgttcagatcatttttgtctgcaatcccgaaatatcctccggagacgacctgctcatttggtgttgtgccaatgcattttttgtcctttggaatgaatgccttttcttaggtattccgaatttgctttacgttcccgaatcagttccaaaaatttgcttgtgcttctcca

SEQ ID NO: 39303 - DNA, 1058 bp, Heterodera glycines
attacatcaattcccctaattacccccaaccacttttgtttatcctcattagcgccgagcaacacaacgcgccaacttcttcaagccgtacacacaaaacagccaccgactttgttgtacacattttttcttctttcttaatctctccaatttatgtacaaattgcgaaagattagtccgtttgattgggggcaaaaatgcccttttcccacacaaatcccctcaaatcgtttcgcctccaaaagggtcatcgtcgggtacacacccaacaccactcactcactcacttatccatcttttcccattctttccggctcaattcgcgctcccctgaaatgattaaccctaattttttgatcgtttcgactgattaaaaaaggtaattttataattattttttaggtttttgaaatcatttttaatggtttatttaaataaaagcatttttttttgaaaatatgaacatttaaaatatttagattttatttctttatttgtttttttaaatcatattttgttgaaataattagaatttttattataaaataacttcaccaaaattggcactccacttttttgattaatttaaaatttgataaatggaattcccaaaatatcagaaccattttacatggcaaaaaaaaaattttacaaaatttcaacgccttggaattgttttttccttttttttaatccaattttcttttttggccgatttccaataaaatgtttacatctcataatgttttccattaaactctcgagacaataccttccattaagtcaaaatcttcgagatttaatgaatggacaactttggacttggtttttcctgccttttggggggttacagtattcgcattgtctctcgagtgtccattgttttcgtgccaaaacatccaaaaccgattttcgccttttcattttggcacggcacttctgcaccctctacattaactttcgaaggcaaatccataagtatgtttcgtgccaaaaatgtttttatatttctaaaaaaattttttaatgtaattttttaatcttttttcaatgaaaaa

SEQ ID NO: 39304 - DNA, 1092 bp, Heterodera glycines
  misc_feature (881)..(881): n is a, c, g, or t
  misc_feature (988)..(988): n is a, c, g, or t
ttgtacattttttttttgatttttccaatttttgcctcccttgcagatggaatttccggtgccggagcagttcaaacctaccttagatgtgaccggaaaaaagcttaaaactatggtacttgacattgcttagatagagagggagagagagagaggcatttaacaatttttgatttccacagtacttatttgtccattcattactcatttgtctgtgtccaattttgatgaagaatctgcttgctgtctgtgtcttgtagtgataatttttgcatttttttgaggtttttttctgaataaaagttaaaaaggaaatgcctatttctctggtttcatatttaaaaactttgttgattttttttacttgcatattttgtatgtataatcaactggtaataatggattacattgttaaattttagtccttttcgtgtacagaaatttgcgcccaacacattatcacttttaagaatataaaatctaaattgttttattgaataaaagcccgggcgcaaatgatgggtaaccccttttttacagatttttttttttgtacgatacccgaacaattcccctctcttttttcatggaaactgaaaacgctggtgagccatgcctttaaatttttgatttttttttttaataaatttcatttttcttcaaagaaacagaggaaacacagcaacaacgaccatttgcaattaagcgatggaatttggtgtctacatggagttgggacgtggagtgtgacacgtgcgccatttgtcgtgtccatttaatgggtcattattacctaattgctatattaattaagtaaaaggatggaccaactatatttggaccatatgtaattaaagctcaacattatgaaaaaagactgngcagcttccatgttggacctggatttcattgacaaaaatccaggaaaatcaaggttaccgaaaaacacccgagtctgattcaggagaaaccaattttttccccaaangtgacagactggaaaacatgaattcatcgctcaaaattttcccgtgcccgggatatttttaatttggataagaataaaaagtagaatttttaagtgattgtcca

SEQ ID NO: 39305 - DNA, 1247 bp, Heterodera glycines
  misc_feature (61)..(61): n is a, c, g, or t
  misc_feature (97)..(97): n is a, c, g, or t
  misc_feature (103)..(103): n is a, c, g, or t
  misc_feature (105)..(105): n is a, c, g, or t
  misc_feature (107)..(108): n is a, c, g, or t
  misc_feature (134)..(134): n is a, c, g, or t
  misc_feature (144)..(144): n is a, c, g, or t
  misc_feature (208)..(208): n is a, c, g, or t
  misc_feature (222)..(222): n is a, c, g, or t
agctagctggctcaaaaaaattttcgaaaatctgagccttcctgggttatttattttttgnaaaattaattgataaatattttttcagaaagggttntgaaangnannaaattttatttacaagttaataaggntctctgatgntttttctttcttttatggaggtgaataaaattttaaaaattttttaattggtttttaaatatgncaaaaaatttaggnttaactttttagtgaaagtttgatcactcatattttttgctaattgagcagaagcataccaaactttgcagggatactccccggtaaaggactaacttacactgaaatgagcgccgagctagcttgctctaaaaaatttttcgaaaatctgagtctttcgtttttatttattttttgcaaaattaattcttaaatattttttcagaaagggttctgaaacgcaccaaattttatttacatgttagtttaggcactctgatgctttttctatcaaaaagggagatgaataaaatttttaaaaatttttaattcctttttaaacaggccaaaaagtttaggcttaacttttttttcagaaactgatcagaagcgcaccaaactttgcagggatactgaaaggaagagaaataacctattttaaatattatctagtcagttcatttaaataatttttatccaaaaaatttttttttgggttttcggggcagtcccccctgaaccgatgcgcccagatttatggggagtccgaatccttccggaatagcttcactatagcctctactttaattttaccttggatttttgctccccataattgtttgagtaccccaaacggacacttgaaaaaatcgatttttttgttttcggggcagtccccccgaaccgatgcgcccagatttatggggagaccgaatccttcgggaatagcttccctatagtctgtactttaattctgcgttggatttttgctccccataattgtttgagtaccccaaacggacacttgaaaaaatcgatttttttatttcataaatattttttcagaaaatgctctgaaacgcaccaaattttatttatatgttagtttaggcactctgatgctttttctatcgaaaagggagatgaataaaatttttaaaaatttttaattcctttttaaacaggccaaaaagtttaggcttaacttttttttcagaaactgatcagaagcgccccaaactttgcagggatactgaaaggaaaag

SEQ ID NO: 39306 - DNA, 1112 bp, Heterodera glycines
agctcattatacatgtgcatactgtatgttattgctagatccgtgcgcaagtgatcggattccgcgcggcatttagcgggattccatcccgcaatcctccattattggatattgtcggattgagggattaatctcacgaaatcccgtcatcaaatatttttgagttccaatcggtagccgcagatttgaaattccggtctattgttttaaccaaaaaacaattttagtcagcgcaaagaactctgagcagcaacaacaacattcgacagtcgacagcagtaattgatgaaaaaccagagaactcattaattaatacggcagagaatgtttgatgattgtcggtaaaaaaaatcgtataaaagtgctaaaccccataacctttctgttttattcacctattaaattaacagtagaaaatttatttagaatttttatttgcatatacttatatttacgaactgttcatgttaataaataaattcataaatttattaaattattgtattgaggaataagttctgttatagttgagattttttcaacaaggtctttcgggtgtcatgaattttcaatttatgacaaacaaaagtccccggtatattggacactcgaaaattggacactagaaaattgggttcaatggaaaagtggacactattggatataaaaataaataagctaaaagataaataaataaaattttcgtttggcgtaaagatttttattttaatttacacatatgtttttatgaacgtaaaaatgaaaataaatagtgttgttattaatttaaaacaacagaagaaaactcagtcattttcataaaagaattaaaagttttcttttagatagggttcccatttttcgccactttttagtacatttaccattcatcgtaactattaaatgcctgatccactctaaatgcctcaataatttcattaattcgtttattctacacaaatttattttttatctcattcctgagtttattttttaaaagaaggatttgatctccgcttttaaggtgtccaattttcctttggtgtccaaaattcctgcagtgtccagttttccgcttgatgttcaatgttatcgtgtccaatttcccgtag

SEQ ID NO: 39307 - DNA, 1020 bp, Heterodera glycines
  misc_feature (63)..(63): n is a, c, g, or t
cggtactttcatattcctgtctctactgaataccactctacctggattgtttataccaatagnttttcaataataccactttaaaactgattcaccataaattttaagcaaatggctgaagaccgacaaataaaacttttaatggagaaaatggatgagaaattcgccgatatgaaagctgaactgaaagcggaaatttctgggaaattcgccgaaattgatgggaaattcgccgaaattcaggaccaaatccaggacttaaaagccgaaataaatcaaaaggtttactggaaggggaaaaattttagccattttgtattgcaaaaatggttctagtgctgaatacgcgtcccatggacttttacgcgtcccattaacttttaagcgtcccatgggtttttacgtatcccataattttttatgcgtcccatcaaattccaatttggacataggtgagaatttctgggcacaacttgggacgcgtattctgcactagaaccgaaaaaatatttattttgctagttttttaattccaataatttatcagatttttttggccgaaatttgtcctttaaatttgttaggcggccaaaatcagcattgaagtgcccgctcagggactcaccattcaacaggcgaccaaagcaggcctgttggacttggaaagcgggcaattaacgattatgtgtgacacggcgacaaacttgtcactggcgaaggctatcgaaattggcatgttggacccacactcgatgactgtgtgcgactcgagccatggtgaaaagcgagaactccacctcgataaggcgttgaatgaaggagtaaggaattcgattagtgtggggagaagcgaaattggttggcctctcaaaatcgcaaaatttttggcttcattcgccaagttttagcctcattttgcactaaacgtttgaaaacattatgagaggagaggtccattggtgcccacttgctcctcagtcaaattatggcggcagaaaattttgtcattttctcctaaaa

SEQ ID NO: 39308 - DNA, 1781 bp, Heterodera glycines
  misc_feature (947)..(947): n is a, c, g, or t
  misc_feature (952)..(952): n is a, c, g, or t
  misc_feature (987)..(987): n is a, c, g, or t
tttcccgaagttacgaatctaatttgccgacttcccttacctacattattctatcgactagaggctgttcaccttggagacctgctgcggatatcggtacgatcaggcaggagattcaaatagcttccctcgcattttcaagggccgtgtggagcgcacgagacaccacaggaaccgcggtgctttacgggcgcaacatccctatctcaggctgagccacttccaggcacgcacaccctaaaccagaaaagagaactctggctcggactccacacgacgtctgcgagttcatttgcgttaccgcgcaaaacagctcttgcgaaccgtcatttccctagcctggcgtgggaatgttaacccacttccctttcggcaaccggatggaccaactgcgcaagcacagaaaagtcgtcatccgtagtgtgttacggcgttagccggtgccttaggatcggctgacccacattcaactgctgttcacgtggaacccttctccacttcagtcttcaaggatctcacttgaatatttgctactaccaccaagatctgcactggtggaagctccggccgggcccacgcccaaagccttcaacgcaaccaccacgaccctcctacacgtcatggccagactacgcgacaagcacgtgtacaagccaatgacggtggagtataggtggcccgctccagcgccatccattttcagggctagttgattcggcaggtgagttgttacacactccttagcggattccgacttccatggccaccgtcctgctgtctatatcaaccaacaccttttatggggtctaatgagcgggcactttggcaccttaactccacgtttggttcatcccacatcgccagttctgcttaccaaaaatggcccacttggagctcaaacattcaacggcctggggttcagagtcaagcaaccctggcttcatacnccatntagagtttgagaataggttaaggacatttcgtccncaagtcctctaatcattcgctttaccgagtataactgctaacggagctccagctatcctgggggaaacttcggaggggaccagctactagatggttcgattagtctttcgcccctatacccaagtcagacgatcgatttgcacgtcagaatcgcttcggacttccaccagaagtttcctctggcttcatcctgctcaggaatagttcaccatctttcgggtctcagcgcatacgctctgtctccgccccatcgcatgcgatcgagacgggactatgttgcgccccaacaccgcagtgccagggatcacacatcagctccgtaagaagccttcactttcattgcgcctttgggttttgaacacccaatgacttgcgcatacgctaaactccttggtccgtgtttcaagacgggtcgaacagatgaccggcttttacaccgagaacgcacaactgagagcccgagctggaccgaactggttgctggtacgtgtcgcacgcgaccgccaccgacccccagctcgagtcaacacggacccgaaaccattgcacaattcacccagagtaaacagcactcccccgatccgggtaccagaccccgaaaggctggcctcaagaccgagctcacgcagctactccgagcatctcagcgcactccgcctgcaaatgccccattcgccactgaacagaaggacgagcaaaccccggtctggaggctagcaggccaacgtacagcaacaaacgggtgaatgcagaccagatacgccagctctgtccgtttccacctcatcggttca

SEQ ID NO: 39309 - DNA, 694 bp, Heterodera glycines
cgggcgcgaagcgcccgtcatgaggccgcgaagcggccgaatgttctcaaaaaattaaaagacgggcgcgaagcgcccgtcctgaggccgcgaagcggccgaatgtcccccaaaagtttaaaaaaacgggcacgaagcgcccgtcctgaggccgcgaagcggccgaatgtccccaaaaatttaaaaaaacgggcgcgacgcgcccgtcctgaggtcgcgaagcggccgaatgccccacaaaaaattaaaaaactggcgcaaagcgcccgtcctgaggccgcgaagcggccgaatgtcccccgcaaaattaaaaaacgggcgcaaagcgcccgtcatgaggccgcgaagcggccgaatatccccgtaaaatttaaaaacgggcgcgaagcgcccgtctggccccacaaaattaaaaaacgggcgcgaagcgcccgtcctgaggccgcgaagcggccgaatgtcccccaaaaatttaaaaaaacgggcgcgaagcgcccgtcctgaagccgcgaagcggccgaatatcccccgtaaaatttaaaaacgggcgcgaagcgcccgtcctgagggcgcgaagcggccaaatatcccccataaaatttaaaaacgggcgcgaagcgcccgtcctaacgccgcgaagcggccgaatatcccccataaaatttaaaaacgggtgcgaaactcccgtcctgag

SEQ ID NO: 39310 - DNA, 975 bp, Heterodera glycines
  misc_feature (53)..(53): n is a, c, g, or t
  misc_feature (118)..(118): n is a, c, g, or t
  misc_feature (223)..(223): n is a, c, g, or t
tttaatgatttagcgtggagtgccgacagaacgaagggttaagcgatggggcntaagcgtcatggaactcgtgcgcgaccctatcggacggcaggcaaatgaatgaatgacgaaccancggttcctttccattttctcaggttctcgaatcctttttggattccgagttctcgtcagagaacctccgcttctggtgttgcatccaggacctcaaattctctcncaattgtcaagttaaaacaaaaggccaacacattttggacgagtttcttgctcccggtgcgccctgtcaggtcctttcctccgttttttgcttccttcggtcaattttttacattaggttaacgtcgactctagaacgcttgaagaaacattaggatgcttgagggagtcggaccaagcattgcgaaaccagaggttcgctttctcagtttcggaggaacacgtgttcacactgatgagcaaagactcgtacccacgttttctccgatccggcatttacaaggctgttttggacgctgccaaggcaaagggtggcagaaaacggatcattgacctgatcagagagctgtcagggagtgccgtaaacactaagaaagtgcctgccaaataccacaaaacatcgcgggggagtgccgatgtggacaatacacaacaactgtcgttgaacgccaacaacttccccaaacagtgctcctctgactcattgcctgtgaaagtgggcagcttgggcggcacttcgccatcactgcaactgccttcgtccggcacttctagcgccagttctcctgctcttcagacaaaggaaagcaataaaagatagtaaaacacgtctttcttccatgtttgttttcgtacccacgaaaggaatgtctcgactctataaaaatttaaaaaaatgacaagaagcattgattcgattatggaacaaaacccagtggagaaaattaacaaagaaaatttgcaaatggtgac

SEQ ID NO: 39311 - DNA, 660 bp, Heterodera glycines
aatttttaaagcatttcatttttataagtaataatttgagcatagaattcctcaaaaactcaatatagtctaagaaatgttttaatttaaaaattattttgatatttcttaaaaaaacatttttagagacatacgttttttgaaattcttttatattcctatttcaagtccaattttcaataatttgacaaatgtatttctcaaatttagtttgaatacatattttgtatttaattaatattagaacatttttcacttttctttgcttttttcaattattttaataccaaatttaccttttattttttggtgcgcgagtctcggggtgcgcgagggggcggggcgtcgggaaagtaccgctcaaaatggtgccagaggcgaaattctttcgccgttcagcttagggatgggtggattgacagcctgtgaaatttgaagtcaatcggacaaggggtgagcgagttttggtgcgcgagtcccggggtgcgagagggggccgggcgtcgggaaagcaccgctcaaaatggtgccagaggcgaaattctttcgccgttcagcttagggatgggtggattgacagccctgtgaattttgaagtcaatcgggacaaggggtgagcgagttttggtgcgccagtctcggggtgcgcgagggggcggg

SEQ ID NO: 39312 - DNA, 1269 bp, Heterodera glycines
aaaattgtggccacattctaaaagaaatattcattcggcaatatgtgtaagaaatattgcgtaagaattgtataaatatttagaaaagattagtatgctagaaattgttcctagaaggaatctgagcgatttttttattgcatcatgtagagcacaagagcagcattcgattggagtatttaaatattttttatctcaatttgctgaagagttatgcccatctgaatttgcatagaaaaattgtggccacattctaaaggaaatgttgccacattctaaaagaaatattcattcgacaatatgtttaagaaatattgcgtaagaattgtataaatattttagaaaaagtttagaatgctagaaattgttcctagaaggaatctgagcgatttttttattacatcatgtagagcacaagagcagcattcgattggagttatttaaatattttttatctcaatttgctgaagagctatgcccatctgaatttgcatagaaaaattgtggccacattctaaaggaaatgttgccacattctaaaagaaatattcattcggcaatatgtttaagaaatattgcgtaagaattgtataaatattttagaaaaagtttagaatgctagaaattgttccaagaaggaatctgagcgatttttttattgcatcatgtagagcacaagagcagcattcgattggagtatttaaatattttttatctcaatttgctgaagagttatgcccatctgaatttgcatagaaaaattgtggccacattctaaaggaaatgttgccacattctaaaagaaatattcattcggcaatatgtttaagaaatattgcgtaagaattgtataaatattttagaaaaagtttagaatgctagaaattgttcctagaaggaatctgagcgatttttttattgcatcatgtagagcacaagagcagcattcgattggagtatttaaatattttttatcagggatttcaggagataattttcatcagacattcatttggcaggcaagagaagcactctttttgggtcaataatgcactcagttcttttcagtaatgtgttataaaccggtataaaatgatcaaatgttagattaagattgtccatgatcaatttgagcatttttggaatagaaataagcattttttgggattatgtacatcacaagagcagcagatgtttggagtcgcttattccaaaataagttttggggcgcaaggggttcggcgcatccgataggcgccgccgggaaaa

SEQ ID NO: 39313 - DNA, 904 bp, Heterodera glycines
  misc_feature (52)..(52): n is a, c, g, or t
atgcgatgggcggagacagagcgtatgcgctgagacccgaaaagatggtganctattcctgagcaggatgaagccagaggaaactctggtgaagtccgaagcgattctgacgtgcaaatcgatcgtctgacttgggtataggggcgaaagactaatcgaaccatctagtagctggttccctccgaagtttcccccaggatagctggagctcgttaagcagttatactcggtaaagcgaatgattagaggacttggggacgaaatgtccttaacctattctcaaactctaaatgggtatgaagccagggttgcttgactctgaacccaggcgttgaatgtttgagctccaagtgggccatttttggtaagcagaactggcgatgtgggatgaaccaaacgtggagttaaggtgccaaagtgcccgctcattagaccccataaaaggtgttggttgatatagacagcaggacggtggccatggaagtcggaatccgctaaggagtgtgtaacaactcacctgccgaatcaactagccctgaaaatggatggcgctggagcgggccacctatactccaccgtcattggcttgtacacgtgcttgtcgcgtagtctggccatgacgtgtaggagggtcgtggtggttgcgttgaaggctttgggcgtgggcccggccggagcttccaccagtgcagatcttggtggtagtagcaaatattcaagtgagatccttgaagactgaagtggagaagggttccacgtgaacagcagttgaatgtgggtcagccgatcctaaggcaccggctaacgccgtaacacactacggatgacgacttttctgtgcttgcgcagttggtccatccggttcagagagggaagtgggttaacattcccacgccaggctagg

SEQ ID NO: 39314 - DNA, 1075 bp, Heterodera glycines
  misc_feature (21)..(21): n is a, c, g, or t
tttcgtggaatcagacgtaanaaggaactataaatctctagaaatgacctaaaatggtctacaaaaaagccaatatgaaaattgtaaatatgtcttcaaaacctatcattttttgattttacatatttaataatgttctcctaaattttcaggttatttttctgcagcatttttttctcatattaccaagttccataatcttatagggagtccatgtaagggccaatctaaacattgaaaggcctttttgtgacaaacaaagccaatgcaacagagccaatgattagctatgaagaattatttctaacccgataattggtgtggtggggactaagcagatcctgaagaaactccaccattgaagacaacgaaactaagctgaccttttcgtggaatcagacgtaaaaggaactataaatctctagaaattacctaaaatggtctacaaaaaagccaatatgaaaattgtaaatatgtcttcaaaacctatcattttttgattttacatatttaataatgttctcctaaattttcaggttatttttctgcagcatttttttctcatattaccaagttccataatcttatagggagtccatgtaagggccaatctaaacattgaaaggcctttttgtgacaaacaaagccaatgcaacagagccaatgattagctatgaagaattatttctaacccgataattggtgtggtggggactaagcagatcctgaagaaactccaccaatgaagacaacgaaatgaagctgaccttttcgtggaatcagacgtaaaaggaactataaatctctagaaatgacctaaaatggtctacaaaaaagccaatatgaaaattgtaaatatgtcttcaaaacctatcattttttttttacatatttaataatgttctcctaaattttcaggttatttttctgcagcatttttttctcatattaccaagttccataatcttatagggagtccatgtaagggccaatctaaacattgaaaggcctttttgtgacaaacaaagccaatgcaacagagccaatgattagctatgaagaattatttctaacc

SEQ ID NO: 39315 - DNA, 967 bp, Heterodera glycines
aattagccctctcaaattttccttcgggcctcagaaaatggctatctcttttcggccaattttgtaccgatcaaagggaaaatggcttattcaggccccaatgtgcgcctgaatcgctaattagcttggcactttcgaatattacatataaattagccctctcaaattttccttcgggcctcagaaaatggctatctctttttcggccaattttgtaccgatcaaagggaaaatggcttaattcaggccccaatgtgcgcctgaatcgctaattagcttggcactttcgaatattacatataaattagccctctcaaattttccttcgggcctcagaaaatggctatctctttttcggtcaattttgtaccgatcaaagggaaaatgtcttaattcaggccccaatgtgcgcctgaatcgctaattagcttggcactttcgaatattacatataaattagccctctcaaattttccttcgggcctcagaaaatggctatctctttttcggccaattttgtaccgatcaaagggaaaatggcttaattcaggccccaatgtgcgcctgaatcgctaattagcttggcactttcgaatattacatataaattagccctctcaaattttccttcgggcctcagaaaatggctatctctttttcggccaattttgtaccgatcaaagggaaaatggcttaattcaggccccaatgtgcgcctgaatcgctaattagcttggcactttcgaatattacatataaattagccctctcaaattttccttcgggcctcagaaaatggctatctctttttcggtcaattttgtaccgatcaaagggaaaatgtcttaattcaggccccaatgtgcgcctgaatcgctaattagcttggcactttcgaagtattacatataaattagccctctcaaattttccttctggcgagggaaaatggctatctctttttcgg

SEQ ID NO: 39316 - DNA, 976 bp, Heterodera glycines
tttagctgccacacaactacaactttgagataccgaagacgatttggaaaatccggacaattgatgccaaaattggtaggttccttgtcaattaaataaaatgtcgaaaatcaattcataatttcgatcacactcttattctaaaatttgggcacattattctttttatctggaacctaggcatttttcataaaaactcaagtgggtcagaatacaggaaacagagaacccgacatttgtgcctatttccaaaatcggattcaaaattgcatttttaaagccctgatagcctaaaccgttttttaaaattaagaaaacccaatcttttagttggagcattattctgttgtttggataatttatgattttttcaaaaaatttactgactattgaattatcaggcacaatcactttctaccagatataaaatgctgttttaggcgatcagaaattgcggaaaacttaattttgaacccgattttgggcaaaggcgcaaatgtcggaacacgggcaaaagtgaaggggattctaagtcaaaaaccataaatggatttttgacaaaaaaatattcagttcttgcccaaaatcaaccacattttaaagccttgatattattctacgaccctctttttctctattagcctgtaaaatttcaaaagaaacaatagtttttgactaagtcataacactgaccctgacttttttatgcaatggaatattttaagaatttttttcttttcagtcgctttgcaatttcccgagggcctcacaatgttcgcctgcgtaatcgtcgacattctcgagaagcacaccggcgccgagttcatcattctcgcgcgacgtcacttatggaaggtgctacaaatattttggaagagaaaatgggggggggggtctaaaagttttcaaaaaaaaaaatccgggagtttggtttaaaaagtttttgcatacccaaaaaagttgttttccatttttt

SEQ ID NO: 39317 - DNA, 173 bp, Heterodera glycines
ccgatgagaagtgcagcaatccgccagaagagaaagtgggcctataaatacacaacgccaccataccattattttctgaggaaaccctttagcccaatgccaaaattaagtggtgccaatttaccgcgatattatgccaaaccaatgcatgggaatttaaacccatccatttt

SEQ ID NO: 39318 - DNA, 925 bp, Heterodera glycines
gaaccgttttgagtagattagactataaaaaattgaaaattttgaaatcatgtttcccactcccaccccccaggggtattattttgtaaagtctttttttccccaataaacttgtcaaaccccatttttcgcaccgtgaatgttatttttattgaattctgaaccgttttgagtagattagactataaaaaattgaaaattttgaaatcatgtttcccactcccttctcccaggggtattattttgtaaagtcttttttccccaataaacttgtcaaaccccatttttcgcaccgtgaatgttatttttattgaattctgaaccggtttgagtagattagactagaaaaaattgaaaattttgaaatcatgtttcccactcccttctcccaggggtattattttgtaaagtcttttttccaaaataaacttttcaaaccccatttttcgcaccgtgaatgttatttttattgaattctgaaccgttttgagtagattagactagaaaaaattgaaaattttgaaatcatgtttcccactcccttctcccaggggtattattttgtaaagtctttttttccccaataaacttttcataccccatttttcgcaccgtgaatgttatttttattgaattctgaaccgttttgagtatattagactagaaaaaattgaaaattttgaaatcatgtttcccactcccttctcccaggggtattattttgtaaagtctttttttcaaaataaacttttcaaaccccatttttcgcaccgtgaatgttatttttattgaattctgaaccgttttgagtagattagactagaaaaaattgaaaattttgaaatcatgtttcccactcccttctcccaggggtattattttgtaaagtctttttttccccaataaacttgtcaaaccccatttt

SEQ ID NO: 39319 - DNA, 1070 bp, Heterodera glycines
  misc_feature (1029)..(1029): n is a, c, g, or t
agaaaaaatgaaaatttattgggaattaaaaaagaaaatctgaaaatgagtgacacggaaattgcaaaaatattaaaattgatcaatcgagcatttcaaaatggaaaaaacaatttggagaagaaataaatgagcaattaaaacgtttaatccaagagggaaatcgaagagagcagagaaatgagacatcggattctgatttttgaatttctcttttttaaactaaaaataaattatttatggatcttttttgtggggattataagaaaatattctaggaatacataaaaagtgtaaaattacaaaattattcaaaaagtaaaaaaacagaaaattttaggctcgattcttaagggtgcatttttcttatttttattgcatttttgttaacaaattttggaaaaaaagctaaaataggcaaaaataggttctttcagaatttcttaggctttttaggcactaagaataaaagcctagaaaataggcactaataactcgaaaagtagcttaacaacaatataaaaaaacatgtttttgtgcgttttaggccacggggagctcaggaaaaaataggcatttgcctaaaaatattatctatgcacatttatttttgtagaaaagttcaacttagaattgtgcccgaggaatattaaaaaaattcttaaaacgacaaatttaataattttaagttcaattttcctccgtatcattcaccgattagctctatgacgcaaaatctgagcatgtgttttcaatttttttaaatgttcaggctttagaggaacccgtccttttaaaatattaagacaaatctctacgatacataaaagcaattcatctgatgctctctgtataagttgtttggaattttttgcattacaaatactctctaaaaaatttgtattctttgtaattaaattggaaacattcatttttgaacgtaaacagttatcttttcatcatatatatgtgttcttaaccgtaaaatttcaagactttctggatgcatgtcaactaggagataaccanaatttttttgaacatgcgttacggtatgactccataaaatg

SEQ ID NO: 39320 - DNA, 106 bp, Heterodera glycines
gccgcctgtcccggccggcacgtagatcaggccgcgccggtcgacccagacccggctgctgttgagcgtgccggcatcgcgtacgtccggggcatcgcgcagttcg

SEQ ID NO: 39321 - DNA, 1055 bp, Heterodera glycines
aaaacttaatcaattggtcattttttttacaaattctgttaacaaatcgcattaaaaattacaaaatttttcccggcggcgcctatcggcaccgccggccctccttgtcccccaaaagtcttggaaaaaacgtgccgcgtaaaaagcggtgttgaagcaaaaaaggtcattgatttacattaatttacatggccggagaccccttcacaaaattggaaaattggctgctgaccccttgttttgcaataatctgaattttgaggtctatatctgaattttagtgttctttatcctgaatttgaaaaaaaaacttggtcaacctgaatatacatatacttctgaacaattctaatgctaaaaaacaggtactcgcgcgaaaactgaataaaaattttgtatttggagaattttgtccaaaaatttttatgttctaaaattaccggtttttaccggtaccggtcagtaccggtaccggtttttttgcaattaccgattaccgctcaactctatatttaaggcacgaaaatcccgaaaaaggcaaaaaaaggcataataaaagtctaaaacctaaaaatatcatccctagtgatcaacgaccccgaaaacccctaaaatctttttaaaagcatttaaaaaagcatgtgaaatctgccccttaaattgcataagtaccccaaaaaattagcgcaagcgacaaattaaaatttaaaaaaaaactacaaaaccggttcttaccttcttacacattcactttgagcttttcgtttgccagactaaacgaaaatgttttttcaaaataaagtaaaaagaaggaaaggagtctgatcaattgggctgcgacttttaggttttaactaaattttttgctcaattgatttgaagaaaggagctcaaaaaacgcatttctgcattaaaaattttcgattctgttgtcactatcggtcactagaaatcactattttggcgacttcgtcactaaaatagttaaaaatcactattttgacttgttgtcactatttcgacatttttgggaaaaattccttagaagaaatgca

SEQ ID NO: 39322 - DNA, 1177 bp, Heterodera glycines
tttgcatgccctgcacggtctctgtgaataccaatactgctaattcgtgcccttcggcattcgtccaatgcgcgtcgcgtgccttcgacgttcaccagaaaacacttttcacggtccaactgagtgtttgaaatgccgaggatggtaattaattcttgactccctaattattcaattagccattgattgaccaaccgacggtccgccggacattccgtagccggccaagtggaagcacgcgtcgcacccattcagtgccaggcgcaattcatccacatttatgatggatccctgaaaggatgaggggggagtatgtacagtatacccatttgttaaaggaaggggatacgattgcaaagataccgtaatctttaggcaaagtttcgagtccaggcgaatgttgccaaagtgttggaagtggaggtcgaacagcacaacaaaatgtccctcacgctgcaacgacagagcgagtaattgacctgaaacagtcaaacaaagaggcgaatgagaaaagggcacaaaaagagatgaaaaataagaaagaggccaaagttggagcgatgaaaccaattaacgaactaatgatacactaatttataatttaatggactaagcggatccccgtaataatttcaataatttaactcacccaaatagccgccccctcccaacacacaaagccttttcccggaagttgccaagtcagaaggcattggaaatattcataatcataattaaatttaaagaattatgtattagtctgtaaaattttcgggaacagcggcgacacaaaaggaaaaggaactgccgaaagagcaaagcaaaatttgggaatgaatttgcattgagaagagagaaaaaggggggggcaatcggaagagatcgatggaaaaggcgaaagaacaggggaaatggagagaaaaaagagcgaagaaaaagaggaaaacggagagaaaagggggcagagaaaaagagagcggtagagggacattcattcactcatatttatttatccgccgatcagcggaaagcgaaggctgcgtgacgaagcgactaaaaggagggggggggggggggtaattagcaaattgaaaggcttaattgactttgaatgggacggaccaattggacatttttatcactaattgtttaatgcatcaaatttattgttttatga

SEQ ID NO: 39323 - DNA, 1152 bp, Heterodera glycines
attttatatgggtaaaattttttttagaaattttgcgtaaaaattgcgcccctaagtcgttctgaaaaaatgaattacacaaaaaaaaaatcgtggtgggatataagttaagttgacaatgagtcaaatttagaaaatctaagcgaaatttgccaaggatttttaaaatttcggtgggatgcccccccgcagtcctcaatgttcgggagcgaataatacgcatttatagtgtgatcaggaaattactgcatttgtacattatttgatctaaattcgacctgttcttgtcaatgccaccaaaaatggtgccagagatgagcaattaattattagacaaaaattttagcccccccccctagttaagccaagtttttgaaatttaagcgaaaatttagagtgatcaggaaaattagtgctagctctggtcagtgccataaaagaagtgccatgatgagtgcaattaatcattagacacatatttttttgtgccatttacacagacaacacgtggagggagcacatttgcattgaatgtgtggaccaacttggccattgccccatgcgcttcccggcctacacaattgcgaatggggaggaggacgaaggacaacagaagcaggcaaatggaagtggaaacaaaacacggaaaagcaatggacgaagacggaaaaatggacgaggaaatggtaaaaaaaacaaacaacaaaaacatcaatgacgtcaattaaattataagtgttagcactttcaaagggtagccgccctagacccttgggctttgggtgggtggagggggcttacccgcccgcggggcgacctattttaatgagttttcaggtcaagcggtgccgataagcgccgccagcacaaaatggatttttatacattttttagcaaatgttcatcgaaaatttggcaatattgcaattttatggaaattttggaccggtggcgaaaatttgaatataattttttgaagaattttttattgaaaagtcttaatatttttttactaaaaaacccactaagaaaataattttcaatttattagctccccgtagcgatcagaccaatgagaatgatcataatttcttccgaaactttcttaaaattctgaatcacaattcttccacaaaaaatgatctagattaa

SEQ ID NO: 39324 - DNA, 1068 bp, Heterodera glycines
ccaatttaatttcccttacattttgggttttttttattatgctggccctaaaaaaagggggtttttcggggggcccaatttttgggaattttcttttcggcccgtcataaagggattgttggggggcaaaagaaaccaaattttgtggtttttgaatgcgcttaccggcttttcatttttaaatgtttcaacaaaaggggtctaatctccactctctgggggagttatgtcccagccaaagcagagtgggccataaacgcgaatttttttatctttggtatttcctttattttgagcctgctcttcatttatgtaattgtgccaatatgcctattgcaactgaaatttatacagctttccccgacaaattgtttagataattattctagacgatttttttatatctcagtgcttaactattgcctttttgtatgataactggtagatattgggagtgaaaaaaagtttgtttgtgactatttacaataaaaatttatgcagcatttctaaaaaggatgtaaaaataatttcttgcgtaatattttttacattatgttgttgaagaatttgagtctgcttctgatgcaattggaaaatttttcagcttttctcgaaaagttttttcccagaaaacggatgggtcaaataaaaaactaaacatctcacatgaccaatttaaattcacttacattttgggtttactttattatgctggcccataaaaaaatggagtttttccggtgccaaatttttgtgaattttctttcggcccgtcataagcggattgtttgggggcaaatgaaaacaaattttgtgttattcgaatgcgctagccgagctctacattttcaaatgtatcaacaaagggtctatctccactctctggcgagttatgtccagccaaagcagagtgggccataaacacgaattttttaatctttggtatttcctctattttgagcctgctctacatttatgtattgtgccaatatgcctattgcaactgaaatttattcaactttcccgacaaattgttgagataattattctagacgatttttttatatc

SEQ ID NO: 39325 - DNA, 1150 bp, Heterodera glycines
ccctccaaatgtcgtagtcactgtgacgcgtgacggcgacttcggctgttgccgtttttgtcggtgccgtgttctcgtaatgcttccttccgttttgccgtgatgaatcgtctcaaactcgctgtacagttggggaggttgtccctctccattcccttttgttcctcccccttcctcgtcgtcctcttccgttccactcttccgccggatgcttctaactttggtcactctctcggatgactcatccatccgactgtttctcctccgtctcacttcctcctttgtcttaactctttcgtccttttcctcctccaactcctccctcgtcggaatttgtttgaaccattcatccgctgcccatctgtttatttgtgtgcttatgcttgtctgaacgcattgtcctcgtctgccaattgtccctccactgtattccaattccgtgatgttcatatgttccaaaatgatcgtgtcttttggcattgatttgtcgcattcgtcgtcttccaatttccgtcccatcttcatccgttgatgaatttgaaagtaagacgctcttcccggcatctcattttttcttttctcaaaatgcacagagctttcggccttccgtccgactccgtcttcagtttctcgtacggttgtccgtctgttcgcccaatcccttccaaaacacacttccgtcgccgcttccctttccgtccgctctccgcccacaaaatgcaattcgacttccgtctcctcctcccccacttttccccctactcgtgcgttccattcttccaccacatccgttgccttcttctccaattggtccatctcatcgttctctttgcattgtgtcctcctctcttcccatttctcttcttcttcaaactcttccattggcttccaaatcggtactctctctccatcaatttgtccaatttcgcttccattcacttctatccaactgacttgttgttttgctgggcagaaggacgacccttcgtttaattctgaagccaacttttgctgtgcgtcgctttcttttcgtaaagtgtcgtttttggctttgttctgccccagttgcgttctcgtgacttccacctcattttttccctcaatttgtgctttttccgcttcaatttcttctaatggcttccattccgcg

SEQ ID NO: 39326 - DNA, 1191 bp, Heterodera glycines
tgaattgaaattttaaattttaaaatgccaaccttaaaccaattgcttctgccggatagccatcgttttagcagtatgccaccgccactttgctgctcaaattgatcacactccgacattttagctaaatatttatttattcatttattcttttttttttgttttaaggcaataaatttagtatatatgcgaagataaaagaaaaaagcaaagattttttttatttaaattataataatagaatttaaacatttctatattttctaaataaatttttattcatttttcaaaatttattcatttataaaaatgatttttatccacgcatttatggattggcagaagatgaagaagaagcattcaatcatccgatttgataatgttgcttttgcgcacgtaacacaagaaacataaacattcattcattgctcgcgccatgcgcgtccggggaaattgggggaaaagcatgaaaaagtggtggtggtggtggaaccggtccattctctgcccatgcaattacatacaaaaagcccactcagattcagttatacgctttttgaatgctttttgatggctgcgaagaagcggcgggcggagcggttagagaaagaaaagtgaccaaaaaattctcaaagccggacatttgcgcgaaatttttatgtttgtttgatcagttttggaagttagagcgagagagagagaaagagagaaaaagaagtgatcaatttatttatgtgtgtgaaaaatagtgaaaaaaaaattaataagcgaaaattaggtcaataattttgaaaattatttatttatttcatcgcccgaaaatgtttgatcaaatttttttaaggaaaaacaaaattggcttacgaagtaaaaaaaaacaaaatgagtttgattgttaaaataatgaattcgataaaattaaaatcataaatttatatttaaaataatcgtataataaatatattttatacggatgaattattttattattttataaaaataaataggtataaattaaaattattatttttaaatatattttaataaaaataaaaaatatttttttattccatgaaaaaattggttatgcaataattgttcaccttcaccacagactgtacgtggtccaaccaattcatcttcatcttcgtcgtcgtcctcgctgtcgtcgctgtttcgggcgcacaaaag

SEQ ID NO: 39327 - DNA, 629 bp, Heterodera glycines
agcagcgggggggcaaaattctcggggaacagaaaagccatttggatgagtgcgacttacagtggcgcaaatgtttgaattcattcaggtggcattggagaggggggggggaagtgggggatattgccaaaggcacggggaatgactcatcgcatcgggacaatttaatggcccatttcaaatttaaaccaattttaaaagtccctttgaagattttgtccgattcgttggtctctctgaaaattcttgctcccccgtcaaattcttccgactcttctgctgctgatgctcttcaccagtacaaaccgaggccatttcgagcgacaaacgcatgggaaatgttttggaataatccgccgccgttccctccacaacaaatgaaattgaatgggacggcggaaaagggaggaccaaacgaagcggaagacggaacacagcggaggcagaagagcaccacgggatggatgaggggagaaaagtcgaaaaggaaggggacgaagcggacggaggaggcggaaaagcgggggaaagagaaggcggaaaagcggggtgaagaggaggcggaaaagcgatggaaatagaaggcagaaaagcggggtgaagaggaggcggaatagcggtcgaaagag

SEQ ID NO: 39328 - DNA, 403 bp, Heterodera glycines
aaacacacaaaatggacgcaaaattggcacaaaaacgacggagcccaaaaagtcgcacaaagaggaagaagtagtcgaactgggcgaacacgcggttccattccttttccacctgaacaaacgaaacaaaaaagaaacaattggccaaccgccgaaagcattttcaccgtcaaatgccttttccgcttctcaattttcttccgaaatatgcgctgagcaacgacgatttccttcagttgcgaattgacggccaccaaaacgcgcgggtcgacgaaagggctaaaaaatggaaggcaattattcagctaaaacttctttctcaggggatgccgtgccaaaaatggagtcctttgtttttaccccccccccccctctctttcctccctctctcctccatttgtcc

SEQ ID NO: 39329 - DNA, 385 bp, Heterodera glycines
aatgtcctgtaaatttttatttttttgggtttcgggggggggggggctttagccccacgtttgtcagctcccccccccctacctacgcccttgttggggatgggaatttaaggcatgaaaaatcgccaaaaagtcacgaaaaagttttaaaacgcaaaaagtataaaaaagtcaaaaagtcacaaaaaaaatacaagttagaagcttcaaacaaagtttagaacttaattgaaaaagtgttatacatgcgatttaagcaatttttgttaaatgttctcattttttaccctaaaatctttttttagcatgtttcagcaaaatctcgatggaacccctgttttaaggacgtttaaagtcagcaaaaaaaagtcatttgacttaaatt

SEQ ID NO: 39330 - DNA, 1513 bp, Heterodera glycines
ggggccaaaaaaatttcccaaaaaaattaaagaattttttaaaaaaattcccaaaaaattatgaaaacttaaaattgcccatcatatttggttctcagccacatcaaaaataccccagaaaaaatttttttcacccccatttttcgtccgaaaaaaatttccgaaaatttctagggggcctagctcgaaaatttttgaaaattttacatcatgtagtacaccattcgatagagcttaaaaagctctacaattttgctctaaggcactttttggctaaaaccaccccctgaccagttatgggcccgggactcaaatgtcccgctgaggccaaaaaatttttctatttccgggaaaaaatcgaaatttttccgaaaaaattaccaatcgatagagctcgaaaaactatgttttggaagtggtctccgtttttctgggaaaattcgttaaaaaatcctaaaattcaaaaacccgaaaaccgttttttaggcctagctcgaaaaattttgaaaattttcgaaattttaaaatctgtaaaaatcgagctcaccgagctctacaataagtctgctggccaccctgcgctcaggtcaaagcctaatgagttattcaacggggactgaactggaaaaagttggtactgaaaagttgccaatttctgcagcccttccaagtataggtagaggcctggaattttttttgaaaattagaaaacacttcaacttagtttcctaccagcaagcattttttgatcagagttttagaaaaaaagttatgggccatcggtgtagacagtatacttgtgagagatgaaaagaatatgcattacatgagcgcttcgcgcaaaggacttcgttgctagtgcatgcgcgttgataagtgatgagcaagtgcattcggccgcttcgcggcctcagacgggcgctttgcgcttctaaatattgtggactcattcggccgcttcgcggtctcagacgggcgctttgcgcttataaatattgtggactcattcggccgcttcgcggcctcaggacgtgcgttcgcgcccgttttttaatttttcggagaggatcggccgcttcacgaacacacgaagggtacaccggtgatcaaaaatataaagaattcttaaataaagtactgaaattatatgatacttttataccaaatagacctcttaaaacaatcgtatcctcaaaaaataagagatttattttcagagaaattacggttacataagcttgtaagacaatttcctgaaaaaagtgaaatcatttaaaaattacaaaattatttctaaggaaatgaaaaaacaattgtacaaattaagaaatgaacaagagtcaaaaattatttcccaggggcaaaattcaattaacaaatttattagagataaattctcaaaagttaatgacattcctacgattaattgatagtgctggaaatatgttttcccagaaatgagcaaaaatgcgaaatattaacagaaatatttcaaaaaatcttttttagaaaa

SEQ ID NO: 39331 - DNA, 922 bp, Heterodera glycines
atagctggtagattatggggagtgaaaaaaagtttgttggtgactatttacaataaaaatttatgcagcatttctaaaaaggatgtaaaaattatttcttgcgtaatattttttacattatgttgttgaagaatttgagtctgcttctgatgcaattggaaaatttttcagcttttctcgaaaagttttttcccagaaaacggatgggtcaaataaaaaactaaacatctcacatgaccaatttaaattcccttacattttgggtttactttattatgctggcccataaaaaaatggagtttttccggtgccaaatttttgtgaattttctttcggcccgtcataagcggattgtttgggggcaaatgaaaacaaattttgtgttattcgaatgcgctagccgagctctacattttcaaatgtatcaacaaagggtctatctccactctctggcgagttatgtccagccaaagcagagtgggccataaacacgaattttttaatctttggtatttcctctattttgagcctgctctacatttatgtattgtgccaatatgcctattgcaactgaaatttattcaactttcccgacaaattgttgagataattattctagacgatttttttatatctcaaagcttaactattgcctttttgtatgataactggtagatattgggagtaaaaaaaagtttttttgtgactatttacaataaaaatttatgcagcatttctaaaaaggatctaaaaataatttcttgcgtaatattttttacattatgttgttgaagaatttgaggctgcttctgatgcgattgaaaatttttcagcttttcttgaaaagttttttcccagaatttatacagctttcccgacaaattgtttagataattattctagacgatttttttatatctca

SEQ ID NO: 39332 - DNA, 1048 bp, Heterodera glycines
  misc_feature (37)..(37): n is a, c, g, or t
tagagcaaaaaggcaaatgcttacttgatcctgattntcagtacgaatacggaccgcgaaagcgtggcttatcgatccttttgaatgtgtaaagtttccagcaagaggtgtcagaaaagttaccacagggataactggcttgtggcggccaagcgtccatagcgacgtcgctttttgatccttcgatgtcggctcttcctatcattgcgaagcagaattcgccaagcgttggattgttcacccaccaatagggaacgtgagctgggtttagaccgtcgtgagacaggttagttttaccctactaaagacctgttgctatgatagtaatcctgcttagtacgagaggaaccgcaggttcagacatttggttcatgtgcttggtcgatagaccaatggtgcgaagctaccatctgagggattatgactgaacgcctctaagtcagaatcccgcctaggcaagatagcaatattcttgctccccggtgtcgggaggcactacttatgcgccgcttgcggtgcagcacaaatgccccagcatctggcccgatgtgcgtgcttaattgctcgcacattgccaaagccgtagcactcgtgtgccatggtggaacgtcggggcgcaaaatcacttgtatacgacttgactactggtcagggggttgttagcagtagagcagcttttacactgcgatctgttgagacttagcccttgatcggatgatttgtcttatttttccccctttactttttgtgccaacaacattttaggtacaagtacatgagaaaggaaggctctcttaagggagtcaagtgcctcgtcagtcaccatgaaattaggtacgataagttcttgactttgcttttttttccatttattccaatcgactattgctttaaggttttgtctttgactttgctttttttccatttattccaatcgactattgctttaaagttttgtctttgaatttgctttttttccatttattccagtcgactattgctttaaggttttgtctttgactttgcttttccatttattccaatcgac

SEQ ID NO: 39333 - DNA, 752 bp, Heterodera glycines
aaaatatatttaatctttaattatttaaataataaaattaaactttttttataatttaagggcccacctctgaccaatataaaacgggcacataaaggccgattttccgagtcaagccaaattgaagaaaatgatgaacaaattggacgttccaccaaacaattaaatatgactaatgaggacggagaacggcagccaattaggcgcagcaaattggctggcattggcattcttcacacggcacgcgcaaatcgattggaatgttgggcatcgatcaatcaatttaattaaataaaatattagattaatagaatgattcattaatatattttaaataaaaaatatataatatgaatataattaaactttgttatttattagattttcaaatgaaaatgaattcaatatttatttattttttaaatttttctataaaatatttttcgttttaataagatatttgtgttttttttttcatttatcatttttcaaaatatcttatacattttttcaacaaatttaaaatttaattattttatttattaactaagcaaattataatttttataatgttaattaaggcgattatatgaacccaaactgttgcaagattgtcagaacaacatgtccacataatgaaaagccaaccaagctctgagattcgctggtacagaaaggtacaacaaaaaacatattgacaaatttacatttgaaaattaaaattcttaaattgctttcataaattttatttt

SEQ ID NO: 39334 - DNA, 1042 bp, Heterodera glycines
tgtacaatttttaccaacaaaaaaaaaaaaaatcattttagctgaacgatgacattgcgcagctgttcccgaacacttttttggtcaacgaaagcgacaaacaacagacagtgatcgcggaggaacggttgaacagcttgaaggagtggttgagcaacgactgtcgcgtctccaggcaacaggtagggcgggtgcataacatcgcgtttttttcaaaaaaaaaagattgggtaacaggacgggacccgtattgtcatttgtccggaaaattttaattttagggccaggctccaattgacgaaacaaatttttaaatttgttaacaataaattaaaaaaaaatttttttttctgaattgtggttggggaccctgtgaaaatttttggtttttgctaataaattttcaaaaaaaaaaaaaattttatttcattttgttgtatttttttaacagttggccattgccatcggtgcgacggttgttgaacggattcgcaaacgcgtcaaggaggtcacccaattccgatgttcggccggcatttcacacaacaaagtgccaaatttttctaattttttcataattttttttttgtattaattttttttagattcttgccaagcttgtttgtgcaaggtttgttgtgtggtttctggtttcagtcataatataacataattaccaaattttccacctttttgtgtgaattttaacggaaaattaaggagtttttacatttattgtgacttttttcattttacccccccccccccccccatagcacgaaattaaacagttatggggcgtaaaaaatagaaactttccttcttttttttgacaaaaattgctgaattttttttaattttcttaaaattatttggttataaaattttttctttctttcaaggcataaaccgaactgtcagagtgtgattgtgccaaaacacattgccaaactgtacggacagacgccaatcaattcggtgtggaatttgggcggaaaatttggcaagcgactgaagcgccaattcaatgcggaggtgacgg

SEQ ID NO: 39335 - DNA, 877 bp, Heterodera glycines
  misc_feature (821)..(821): n is a, c, g, or t
tagggttgagcggtaccggtaccggtactggccggtaattaccggtttttttggtaccggtaccggtaccggtaccggttttttcaaaaatgaaattaccgttaccggtttgtctagtaccggtaccgccggtaaaaatttgcactggtaagaatgggggtctggtcgagaaaagagtaggaaattggtgaagaaggagaaatttttgagaaaaaattaaattttatttcatttagtcatgggattacacacatgcacatgtggtgtttcataatttttcgcctgggttcaattccccacttggatagaatattcctcacattttctttaccattattttaattaaaattttaattttaaaaaatattccaactttgttctttcatgttaagcatcctaaaaacccaaaacttaatcaattggtcattttttttacaaattctgttaacaaatcgcattaaaaattacaaaatttttcccggcggcgcctatcggcaccgccggccctccttgtcccccaaaagtcttggaaaaaacgtgccgcgtaaaaagcggtgttgaaagcaaaaaaggccattgatttacattaatttacatggccggagacccttcgcaaaattggaaaattggccgctgatcccttgttttgcaataatctgaattttgaggtctacatctgaattttagtgttctatgtcctgaatttgaaaaaaacttggtcaacctgaatatacatatacttctgaacaattctaatgctaaaaaacaggcactcgcgcgaaaactgaataaaaattttgtatttggaaaattttgtccanaaaatttttatgttctaaaattaccggtttttaccggtaccggtaccggtaccggg

SEQ ID NO: 39336 - DNA, 878 bp, Heterodera glycines
cccactcccttctcccaggggtattattttgtaaagtctttttttcaaaataaacttttcaaaccccatttttcgcaccgtgatgttatttttattgaattctgaaccggtttgagtagattagactagaaaaaattgaaaattttgaaatcatgtttcccactcccttctcccaggggtattattttgtaaagtctttttttccccaataaacttgtcaaaccccatttttcgcaccgtgaatgttatttttattgaattctgaaccgttttgagtagattagactagaaaaaattgaaaattttgaaatcatgtttcccactcccttctcccaggggtattattttgtaaagtctttttttcaaaataaacttttcaaaccccatttttcgcaccgtgaatgttatttttattgaattctgaaccggtttgagtagattagactagaaaaaattgaaaatttttaaatcatgtttcccactcccttctcccaggggtattattttgtaaagtctttttttccccaataaacttgtcaaaccccatttttcgcaccgtgaatgttatttttattgaattctgaaccgttttgagtagattagactataaaaaattgaaaattttgaaatcatgtttcccactcccttctcccaggggtattattttgtagtctttttttccccaataaacttttcaaaccccatttttcgcaccgcgaatgttatttttttttgaattctggaccggtttgaggagattaaactaaaaaaaattgaaaaattttgaaatcatgttttccccctccctttctcccacggggatttattttgtaaaaggcttttttttccccacaaaaaatttttacaaccaccttttt

SEQ ID NO: 39337 - DNA, 1160 bp, Heterodera glycines
gaaaggggggggggaacggtcgaatgacgagtcgaaaagtgccaaaagttaacgaagataagtcgaaaaggtgccaaagacatcgaaaaaataccaaaaatctatccgtgccgttcagacagccctcactacgatttcggcactttgccaagcgatgatcgatttgggtgtcgtggcactttgccgttacgccttcaacatgtaaatgcgaagttgtgccaatggacattagttttcttcatctcagaaattcaaacccgaaaatggcctgtctcatccccaaaataagcaaagaggccaattatccggtacgtctcccatttttgcattcattttccatttttcaatcagagtttatccccatttcgaggttctcatccattatctgatgccttttcgcgacgactttcgctatttcgattttccgcccatcaaaacgccgttgtcaagtccaaaaaatgtacacaaatgtctaaaaatagtgaccacactttcagaatatcagctggatctgatggacagttacatcgacgccctaatgctttacgacgagggcaggtaaaatggggacaaaggacaaccaaaaaagaaacgaaaattatttcgaaatttacttggaaaaggataaacgggcggactgcgaggtgtcttttgcttttgcatttcagccaagtggagcagctgaagaagcgccaagtgcacgacccgcggcttcagtacgaatgccaactgttgcggaaccgcgccatgcacccggacaaaaaagggatggaactgagtgcggaagaccgtcagagactgctcgaaaccctttcggcaccaaagcaacggatggacgaagcgcagtgagtgaccgaatggaaattgggcggagaagggcaccattcgacccgaccaaaataaattgatgaattaagggtcgtactggacgaaatccgtgaggagtttccgcgggagctgaacgaaaacacacggatggccgcatttcgtacaaccaaagctaagacggacacgctcggccaagtcgatgaccgtctccagcccattgtgccgggtgcgcccgttaaggacgaacagagaacggcaaagaaagaagacgcggactgaccggcgaaatttattcattttacactccatccatccattatttgtttgatccc

SEQ ID NO: 39338 - DNA, 544 bp, Heterodera glycines
  misc_feature (502)..(502): n is a, c, g, or t
aaaaatcactatctctttttttggaatattttacgtgtcaaagggtgtgcatttaagcgactcgctgtgcttgcccactgcatttcaaatagctggtaatttttatttctccggcataatccagaaaaaatcactatctctttttttggaatattttacgtgtcaaagggtgtgcatttaagcgactcgctgtgcttgcccactgcatttcaaatagctggtaatttttatttgtccggcctaatccagaaaaaatcactatctctttttttggaatattttacgtgtcaaagggtgtgcatttaagcgactcgctgtgcttgcccactgcatttcaaatagctggtaatttttatttgtccggcctaatccagaaaaaatcactatctctttttttggaatattttacgtgtcaaagggtgtgcatttaagcgactcgctgtgcttgcccactgcatttcaaatagctggtaatttttatttgtccggcctaatccagaanaaatcactatctctttttttggaatattttacgtgtcaaagg

SEQ ID NO: 39339 - DNA, 1528 bp, Heterodera glycines
cgcattcacttaaatttgacatccttcatatgaaaataataatatgatcaaattcttttacaccactcaaattctcgccatagcgacaagatttataaatgaataaatttaaatgtgataaacagatacatattatgaaatcaaaacttaattgaaatgatcgttttgcctaatagtcaaattttctaattggaaaccaagagcatgaaaagttaaacctttatctaatacctttacccaccaaagaatttaaaaacaaattaagtgatctcaaatatacagaagaaaatactcattaagagaaatattctttttaacacagtataattttttcttaaaataatggcaataaattgaaaataaaatttgacgcttttggtcttctttattaactgtcggagaaaatataaaaataattttgtcgtttaatatatttttatactattatcaactaaaataaaacatagaatataaggcgacaaaattccataagtaaataatttataaattgctataaaattatttataactagaaaattaacaaataaaatgaaaaaaacagaaataaaaatactataaaattatcaaccaaaatattattgtatccataagaattttattaaatgttcatccagaatttaaaatgcacaatttaaaaggtttacaaactaaacaaaactaattgggaatattcgttaaaacaaaatacataaaaaattcataaattaaaaattaatgaaaatgaaagtaaagctgaaaaataatcatgtagtcttaactaaaataaataaaagaatcaatgaaaaacaaaatttttaatataatttaaacagtgccctacgggcactgaaagtgacgattttaattatttaaaaaaaaattgaaatagcttcgctattaaacactgtctctagagggtgctacgtgccaaaaaacttttataagatggcaattggattttttaatggccgtgaattcagttgagttttcttaaaactcaaacttttaatatccacttaaaatctctcactcttcctcttccacttactctttcttttatctttctcttcctcttctctttaagacatgcaaaaagcattcaaaaatgagacatccaaaaaagtccgtttttgggccagttttttgaatgtagttcgtgacttcgcattatttttcccttatagcccttaaaattctgcgccgattgacccaactctcgccccgtaattcgcgctaaaaagtcttaaattagctcagaagcttggatcatgggtataaacttcttataaggggaatcttttctaaattgcctctggccatttatattaaaagcagaggaacttgaaaaaaatacaattttatcaaaaggaatcactaagaaaaagaagatttgaagatgtttctaattttgtgagagaaattaaaatgctaaattaatctcaaaatgtgctttattaattttaaaataaattttacaataaattagtattgatttaaaaaatttaaataaatttaatcaaattaccag

SEQ ID NO: 39340 - DNA, 1043 bp, Heterodera glycines
ttttatcatttttaaagaaaatccatacaattgagcatagtaatcccaaaaatcagtcatttttgttgaaaatctgttaacaaatcacactcaaattttcaaaattttccccggcggcgcctctcggcaccgccggacccccttcttccccaaaagttttttggaataaacgcgccgcaaaaaattgatgtgaaaagtaaatctgaattcaaataatattcgatcatagtccaaaatgattaattctttgaaataagtgaagaaaatttgtttgaaaattttcattaatttaatttagctttaacttttggatttattaaataaaaaacaaaataaaatttaattttgtgccattttctcttgaaataaattaaaatttgaattttttaaaatttttttgaatttttaaaatttcctggttggtcccggttcccggtcccgaacaaaaatcgaggtcccggtcccggcttctctcaggtcccggcaagtcccggtcccggttgtttcagccgagtttttgatacaaaaaaatggggggggggcggatggaagccgtaaatccgtaaatggaaagccgggagttatggggaagcgcaaatccgaaggctcattaaaaaagggacaaaaagtactagaataaaggggacgacagaatgttaattttaaaattttcatttttttaaaaaaaagcaaaaaaaaaaaaattttttttattgattttcttactgtagcagggagttgacctgtgttcgatttgaatttgtggatgaaatggtagaaggacagaatggcatcacgattgaacagacttttattggtagtttatattcaaatatttctcattgagaattacattcataaatgcagaatttatttgtctattaattttactcagtttgtagcctgtggccagtccaaattgggtcgtgccggaggatggcaattccttcagctggcaatgaatgacgaccaacggtgcacgaatgtaattttggcagcatttaaaatatttgcactaattttttcctctgttcccccatttt

SEQ ID NO: 39341 - DNA, 271 bp, Heterodera glycines
cccgacctggatttcaacgctacttctgctgcgagctgacatgaacgtcgtacgcactctccccctgatcgtcctggccaccgccctgaccgcctgcgccggcaagcccgcacgcagcgatgcaccggcggccagcaccgtggttccggccaatgccgctgccgaagcccccgctgcagttgccgatggcggaacgatcgaccctgccgtggccgttccggcggcgcaggcgccggttgccgcgcccccatcgccggccacgccggcagcg

SEQ ID NO: 39342 - DNA, 826 bp, Heterodera glycines
aatggtaaaagatttctttttaattgttttgctccttataataaatggcttcttaatgcactttaaccgtccccatcaggttgattttttcttttttttggcccatatcttttaaaaaaatgaacacaaaagtcaattggggagcctaaaatgcaagaccccaacagtttcatgttaattggaacatttggaaatcctgtctaatttaagagtgtgttttgcgcatggcaagtgataattaattaattacataattaattgcctgtttttccatatatttttttttgtctttccgttggccaacagcaggtgaaacacccgtcgcattcttctaatttccgttgtcccccggggcgttctcccccccccccctcccccatttgacagctgtcccccccccccttttcccgccctttcagacgattttcccatggccaaaagattcgttcgtcagtgttaattaattttccattaattacgccattatccttttttttctccggcaaaatgttcagtaacattttgcagcgcaaaaacttcaggtgaaaagactgaaattggtcggatttgtgcaaaacatccatgtttcgaatcccgaacccgaattcggacaaatttcttgactttttaatttttttatttcttgcggctagtatcttctacaataatttgtcagtttggtcggatgtgcatcaaacggaaaaaataattaaaattttttgggggaggttgtctgacgggccatgaaactcacatcgccaaaatttcttaagtccatctgcgctcaattggtcgaaaacatagagtgcgccgtcatgttctaact

SEQ ID NO: 39343 - DNA, 1205 bp, Heterodera glycines
aaataaaggtcccgagtatggaagtatagctcagttcatgcggtaaactcaggtttcagacgaaggatttttataataacagttttttaattcatattttcatgaaaatgaatttgcttttgttttatattaccatcaaaattagtgttatgcatatttgtagctgcattataattcttttaaaattttctaaattttatttttatttttattcttcaacgtaccacggtaatcggtgcctcgtttgccacgcggttccacgaaatgattcccctcccatttttttaaaatatccatgatgaatttgtttttaaccacacgtgccttcatgtctttataataatcataaaaatcaatcatgggcgtctgtttggctgctcttgttcctttggaattgcacatacggtcataactttctcgaagcatcctgaaaaattatgtgttataaaatcttgatttaaatttgaagctacggattccaagtagctcgagaaatgccgaataattaattaatcgttatttctactaagccaagaaagcggctgggaatcgaacccacgacaacagcaatccgtgctatgctgcattgcattttaggcttttgagtgtattttaaatattccgttttccagttattactgggctctagtataaactctagatccttacatttaccctaaatttatcgttttttatatcaatttattgatattaaatctttactctaatgatcctttgtgagcctcgttttgcattttctgattatttttcacgacagttaattcctgttttatgcttcggttcctgtccaagtgattatgcacttcctcatccgaccctccgcctctgctgctgaaagtgctccttgatgacctattacggctcatgcggggtggcttcaaccggctgccgcccaatgattgggaccgttgtaaatacacattttgttcgggttgttgacgctgatgcccacttggctgtacatcgagccctcttagctggtcctcgtatccgttgttgttgctaccagttaagaggtcgagcggaatcccgtcccggaatctttgtacaccattttgaaccggtggatgacttgatgcagatgaatgcgatctcgttgttgatcgttgcaatgattgacgacttggtgccactgatcctgcatctgagcgtaccgctgactgccttagtcctattttccttga

SEQ ID NO: 39344 - DNA, 1190 bp, Heterodera glycines
tttcagggttaaacttcatttcatattggtcaattgggtgtttttactatattttaatagcattacagtatgatctctgttagtttggaaaatttcataaatttattaggtttttaaaaaaggccgagacccgatttttttaacggtgtgcacagcggaaaagagcaaacaaaaaaaataataaattcaaaatactcgtaaaaaaataatttttttttttttactattttagaaaaaagccgaaaagtttggtcacctttagagaaaaaccgtaaattttctgcatcatttatttggaattcaaaaaaaaaaattttttttttcaataaaaaaaaatttttcaaggggtgtctaaagaataggcaggcgacactaaacaattttttgtgttggaattttttttaagttataaatttgaaatttaccttcaacacggggtcgatatttccaaatatgagcagggcatgctttctttggctgaccactgcttcaactcggattgtgattattttcccttgaatggaaaaagcgaaatgaaaaaccctatttttccgtcgtcactgtaaatttttgtccggaacgtaacgcgtacaaaaaattttttgttccgtgactgatcgttagggacgtgaattttgagaatataagcaagcaccaacagattgccttattacgccttcaaataaatttggtgctccgagcactatatatcaggggtgtgacttgtctcagaaaagacgagagcgagagtttggcgagaggcgagagttttttaatttttttctgtagccttattttttaatttaaaaaacttcaaaatcgtatattaaattaggggtacgggcctgggtatttgggcaaataccgggtcagggtattgccgggtacagaaagccgggtcagagtcctagtttttaaaccgagttcaagtcatgaaaaatccaaacaaaaatctttaaaaaattttcatgaaaattaaaaaatattttcatgaaatatatttattttagaaacaaactttattatttgtccatttttcccacctttttttgcggtgcgttttttaaaacttcggggcaggggcggtcgggcggtgccggtaggcgccgccgagaaaattttgaaaattgtcttcggatttgttaacagattttattcaaaaaatgaccaaaacttgttttttaattttt

SEQ ID NO: 39345 - DNA, 1075 bp, Heterodera glycines
gattggaagtggccaaattggccctttcgaaattgcactctttttgggcatcgaaccacggcaaaatgtgcggaagaacgaactgcttgtagctgaacggaaacccaaattttgagaagacaaatcggcggacaaaaggagggaaaataaatgatcaaaaaaagaggaaaataattaatcagagcgataagaaaaggcaaaaacgaactgattaaaaaggtaatttattgtgattgaaagaaggaagtagtaaaaaatgataaatggtctgtgatttgtgagaatggagagcaacaaaagctgaaactgaccaaaaaggggaggaaagggactcggagtgccattcggggggacagccgggcaattctgaaaagggcatttgaaaagagaaagcaagcaacaagtaacagctaatgaattaccaaattcaatcactgaaatgtttaaagccgcgcttttgaatgaccgaatcggagtgaaaatggacgagaagagagtcagcggaactggtgatggcggcgggaaaatctgaacgcaaaggcaattaaacacaatgattgattgtgccttttcaaattcaactcttttcattaattttaattaaaaatcaaaattcggattctttcgactgtttcccccaatcccttagaattgttgttttttctctcttcccaccttggccgcaccaccgggccacttccttcgaatttgtctcgttccctaaagggcaaagtgtcagatgctgcagctcgctaatcactccctcccccaccctccctttctctgatcactttttccactcgctttccctgatcactcgtctcttccctcactctctgatcactttccttcccctatttcccctctgctcacttctgatcacttccactgaccttctctgtcccggatgctcacataatcgtcgcattcggtaaaaagcgcctcctccaactcgctctccaccacagtgaggtgaattctgtgcaatttactggtcgcctgttccaagaatgttcattttattgccttattccaccgccccctcaatttcaatgccattttttaaatttatatc

SEQ ID NO: 39346 - DNA, 1398 bp, Heterodera glycines
  misc_feature (1291)..(1291): n is a, c, g, or t
  misc_feature (1325)..(1325): n is a, c, g, or t
ggaggcttcaaaaggaaattgaataaaacaaaataaatttttattttccatgttaattactaattttttttcgctgtataaccgcattgaagtagttatgttgatgcccaaagtgccaagctcggacagctcatctaaagtctcttttttgtcacctgaatgcgaaacattggcacataacgtgccaatggaaacctgtttgttgggtgttcagttagtagtatataatggaaaaactttcagaccaattttaaggcatctaattcgatcatcaagatcatctcgaaaagtgcttcgcgaacatcctcgttcgctgtggtaatttcgttcaaaatgcacctaaaatttttgaaaacggaaatgtgtttgcttcgccagatactatctttaaaaaatgtaaaactatacatgatcattcattctacttttgcttaatgaatgcaaaaatatatttaaatatttgattgattttgcagttcatttaaatattttacttttagcacctgcgtggattgttagtccgttcgtaatctggcatgatgccaccgacgttcaattgtatgacggagtgtcgcagttcaattattgcgttttcaagcgcattgatgctttttccatgaattttttctaaaaaattaatcgattttcatttatatgtaaattatttttaatacgatttattgagtctagcagggcgatgttttttgccattgacacagcactaataattcctaaaataggtttttttaaggaagtgaattaggtatcaatttactcaagcgaaaatcagaatattgttccggggatagaagctcgaattttgatgcgtttttgtcgataaagtcaaaaacttgttgggcttgtacataaacggtggcttcttcttggcttggcaacacgcagccaagatttaccctctcattaagccactgaattcgaataacaattataaaattaattaatgaccagggctttcaaaaacatgcacaaaaagtggccaaaatatgcgcataaatatgcacggcagtgaagctcactgttgactcactcgcgcatccattaagatttggatttaatttttggcatgatcaaattttttctaagggatttcaaatcggaagtatttgacgaaaaatgaatatacaaattatggaaataaaagtcccgacttcatacgcaaatactaaaaacaaagtgtttttcctactaatcagactacgtgaatccaggaaaaaatatacatttgcatattctgacagccctgttaaagacaattccctatattatttanagaatttttcattaattttcagaatattttttanataaaaaattaatttttataaacaaacaattaatgaattgtgtggtgataagttgtacgtgcaaaaattgatg

SEQ ID NO: 39347 - DNA, 808 bp, Heterodera glycines
  misc_feature (793)..(793): n is a, c, g, or t
  misc_feature (802)..(802): n is a, c, g, or t
ataatctccggcaacttaatttgcatcattcatttgcttctctttcattgcatcatttataggtttggctcggtcgttcaatctgatcaattggacattgtgtggaatgatgaaatggtgcgttggaatggcccaattcccggcaaaggcaccccccccccccacaggacgacttttcctcgcccggaatgcccaatggcttcggttttgccccgtcaccggcaaatttcattgagccgggcaaaaggccaatgagctcaatgagtccgatggtcatattcgaccaggaaaatggaaaggtaaaagcaaaaacaagcaactgctaaatggattaattaattaagtaattaattaatttgtcagttaaaatttgttatcggcgcttcgggcggctcaaaaatcatttcggccatggcgaagcccgtgatccgcgtgctgtgcttcaacgagacaataaaagaagcgatcgacgcgccgacgcttcacaaccaattcacaccagacataacgcaatttgaggagacagtgccaaaggcagagaaaaaggggaaacgaaaaaattaaaaacaaaaaataaaatagggaattatttaaatataaaaatatttttaaataattaaaaaaggattaaaataatataaaaagaatagaaatattttatctggataagcaaaatatacaaaaaaaattttgattgaattttcctttttttgaatttaattgtaaaaataatcggaaaacaaaacaaataaatggataaagtatagtatgtaaattattgcttttcagccgnttgctcaanagactt

SEQ ID NO: 39348 - DNA, 536 bp, Heterodera glycines
tacagtcaggtgcaaaagtattgcctcaaattttttttttttaaaactggttttcccaaaaatgaatggtgaaaaaaagtcttatttacgcaaaaagaaacactaattacagcgctaataaatagccaaaaactgccccgataactctctttgtcgacgagaaaattggtcatgatccaattgacccccccccccccttctgatggtgcaaaagtaatgcctcaaaatgtttaatcgaccaaaattcaattttatgttgagataaaattctgaaaaaattcttgctaagcttacttttgatactgatcaaaaagtcttttggaccaacttgatcagatcactccttcatggtgatctgaaaagtcaaaaatggcttgaaattgggaaaattttcgaaaaaattcctagggggttgggaaattttttttgaaaattttgagtaggcctatcagaaagtggacaaaattctctaccgaattgcctttcgcatgactggtctacgacctatactcgcagggcaccatagagtgtcaaaa

SEQ ID NO: 39349 - DNA, 899 bp, Heterodera glycines
  misc_feature (8)..(8): n is a, c, g, or t
ataaaatntcgagattatatgaaaaatatttttttttacttatattttccaatatatataggttttcccgggtctaactacattttttgttgaaaaagttattaacaattgagctcaaagaaataaataaatgatgtcgtcctgaacttttaaaaaaatacaaagcattctttttaggaagacttaatcagtgaaaaatttttttataaaatatttattctcccaagtctaaaaatttcctgtttcatgggtcaattctcgctctcggactctaagtttactatttttgttcatcttgaatgtcggctattatatgtattaaagcacacgaaattgaaaaagctgattttcctattcatttggtaagttcgaaaaaatgttacgttagattttaaagttataaaaacttcttaaaaaatgtacaatgtgtgaaattttttaaattttcgacaaatttctattaaggtatttttatgtcattctgtcaactacggaatgaacaggaaaaacggctttttaatttggttaattttaatttcattggcattttctgcgccagttttgacaaataaaaaaataagtgccgacgtactcgcattacccaaacattcgagatcggtcgagattctattgattttcaaaaatatccgctttttttatcgggtttttgtttttttctagactatattttaagacaataaatttaaaagaaataattttaataaggaaaaaatttcttaaattgtaaaaaaaaatatttgtaatttgcagataaggtttggcttccaaaatcagaatctttattagatttttttttattgaagcattgatgatttttagttggttttccttgttcttaagacggctttgaatcaaaaatgcacacactcgacaatttg

SEQ ID NO: 39350 - DNA, 1009 bp, Heterodera glycines
caatgacattttcggtttcttaagccataacttttttcttacttggtcaatccatacatccttggtatagtgaaggtgctgatgtccagcccagaatatgaggaagggacgagggaaattggggattggatttgggggaaaaaaggaataagccaaaatccgggccctggataaatgacctccccaaatttgtaatcccatgggcgcctattagatctaatacgcgtgcggggatgggcgagaaggagtaaaataataatataaatattggccaattacattaataataattccgccgcgttctgctctcggctctcgctcgccgattaactgcccgctcaactaactgactccttatcgagagaatgctcccgattaaatagttggacttatggaacggaataaagatggggaaaagcggggataaatggtgtgagaaagagattgaacggatgtgataaattgcgccttacaattattttcggtgacattatatcccgacgaattttcggcggtgacattttgtgtgcactgattttctacataaaattgatgaaattttgggggtttttcctaaataaacatgtggaaatttataatttcgaccttaagtgtcaatttttaacgaaaaattagaagttttatgggctcatagtgtgtcgatagacgcttctgggtgaaaaattggaatttttgtaatttttaacattgtttcaccgaaaattgaccattttaggtcaacttttgaaaattttaccctagaacatctaaaaataagtcgaacagagattttttgatttagaatttccctttaccaatagcatcttttattaattttttcataggatgtcgataggcgctgctgggtgctcaaaaaactaaaaattttttaattttcttggaatttgaaatttttttattattttaagggacattatatcccgacgaattttcggcggtgacccagggaggcactgattttctacataaaattgatgaaattttgggg

SEQ ID NO: 39351 - DNA, 1117 bp, Heterodera glycines
gggggggggggggggctgtgttttaggaatacggtatctggtgagatcagcaattgatcagttttaacgattaaaagggccacagttttttgagcattcattctttgatcacttttacgttattgtggtgccactgactttttcgatcagataaatgcgtcgacgactgatcagtatagctattttatttaatccaacaatttaatggccgccgctcctttctgatcagcctttgatcacttttaggctatttaatcgttgttttttactgatcagcagccccctatcctgctgctcattttcccgttcactttatgtaattttactgcttttcttttttggagccaaagcctttttccgatcattttattcctttctcccctccgtccgattgggcaagaaaaatttgctcgaggcaagcttttcctcattttattcaccaaatgtttgtgccattttaaatgtttttcggggccaaaacggccggtacacaaacggcgggacccaaatgatggtccaaaatatttctgagccttggcacaagccctagacccggattcagaaggcacaagaagggcttttctctcccggccttaaatttttttgtccaatgtaatttttaaagaatttcaccggcgagggaaaaaaattcgccgaaatttggcatttttgggatataatttatgaaaaaatacgcaaaaatttgggcccggcgataccgatttcccccctccccttactccatgggctgatattcctttttttataaattctcgagaccgatcccgaaccataaaactcgaaaatcaagccgtctcggttttagcgaaaaccaaagttgatttcttcagttaatcctggttttatccggcattattgtcccccatgtaagataatgcaaagcattgcctgcggcaaaacttaaaaagtggccatttttccttagatatgcttttcatcggtgccgccctccgtacgggcggcacaacacaacttgcagtccaaaagcgtaccccatctatgtccatgatgcttcaagttatgtttgccaattgtggacccagtcctcagcttcttcctcgatcagagtccccagaagcatgcccgaggcaaacat

SEQ ID NO: 39352 - DNA, 1281 bp, Heterodera glycines
  misc_feature (1274)..(1274): n is a, c, g, or t
attatttttgcttcataatacaaaattttattaacaaattaaagaaaaatacatcaaacgatataaaatttgtttatttttatttttttaataaaggttaagttttaaaattttgtttcttaaaaatctgttgctttttaatttaatcattataaatttattatatttaatataattttttaaaattattaatactactttggtttaaaatgtttgttttatttctgtatttaataaaagacaaattttttaatgttttttattactgttaacagctaaaatttaatataattgattttgttttttaatgtatttcttttagttttgattattttgatgcataatttatccgctgcagcttatataatttcaataatttttaaaaatatttctttcaatatataatgcctaggttttatcaataaataatatcgaataaaattttaacaaataaacttccattattctgttcaagaatgtctttatttactcaaaagttcataaaataaaaagaaaattcaaaaataaacaaacaggaaaataaatatcataatcaggcaattggtaatatcgtaattatctaacaattattgttttcggtatttttaacaagaaaaagaatgattttaatatacaaatagtataacatctcatgaaataaaaaatatataactttaagagaacatattcatacttttgtatattaaattatcaagcaaaacgaatttaattaaaaaaaaagaaaacataaaaatagtaaaataaaagtttatattcttttttatatatttaacacaattatcaatttcacaattgaattataaattttacaaaacaaaaaatttttttataatataaataaaaacaatttaaaaatgattgcggtaactcttttacatcttaaagcgaatattcgaactctgcatgaatattttttatgagaagaaggaaaaataataaatatgacaattgtccaagtattatcaagcgaaatatgatattatgtaaatgaaaattaagtttaaaagatcaaaaaacaattttatgttgcttgcaataatcaattattaaagaaaatcttataatattatcaataaaattgaatgattaataaaacaattgctttaaaaaatgaaattaatgaattatttaaatagataaaaataatattaatatttatcataatttccataaaagtaatttagattaacaagaaaagtgagggcatagataaacagagaaaaactcgaatgttttatcataataaatctgangtaaaaa

SEQ ID NO: 39353 - DNA, 1044 bp, Heterodera glycines
ttttattttttgcaataattttggcttttttctgccatttcgattttaattgcattttgttgttcacatttttcattcttttccatataattttcatagaatttttgccttttgaagttttttggggacggtggctttagggttttccacaaatgtttaaataagtcttcatctattgcatcaattagtacaattataaataagaagaaaataattatcaaattattttgcagcattattttatttaaaatatctcgaaaagaaattatcttacttttcagctgataatattatatatattattatggaatctatgaaaaatattttttcatgacttagaaatgatttaattaattgcaatttgtcgtgttttaattgtgaaataattgattagaaaataatttcatttatatgtttgtaacgtctattatatctttttaaattttaattgcttttttgttgttgcacattcgtttgagtaaaattattgaaaattgctaaaagtattttaaaatattttttgactaagcggcgcaagtgtccatctaaaatcatgctcgactaaatccatattttttccgggactatcgtagacctgaaacatgcaaaaaataagatttttagtttgatttgattttaataggtttttgcaatttttagagaatttttttaataagatttacgaatttttgggccctgcgatgctgataggcagcgccaggcgaattttaaaattaaaaaaaataaattaaaaaagaaaccgtcaacctgaatcgaactcacgacagaaagtaatgtcaaggttgattcactaaccactacaccacactacacatcaatgagaaataataaaattaactttaattcataaaaaatttgtcaaaatggttaaaaaaatcaaaattgtataaattttttgccttttatccatgaatatgtcattcttaggggtgtattttcacccccgcgcccccgcgggggtgaaggtcgcgggggcgggggatggcgggggtcagagtcgcggggacggggggaggccaaaaa

SEQ ID NO: 39354 - DNA, 986 bp, Heterodera glycines
aaaaaaagagatagtgattttttctggattaggccggagaaataaaaattaccagctatttgaaatgcagtgggcaagcacagcgagtcgcttaaatgcacaccctttgacacgtaaaatattccaaaaaaaagagatagtgattttttctggattaggccggagaaataaaaattaccagctatttgaaatgcagtgggcaagcacagcgagtcgcttaaatgcacaccctttgacacgtaaaatattccaaaaaaagagatagtgattttttctggattagccggagaaataaaaattaccagctatttgaaatgcagtgggcaagcacagcgagtcgcttaaatgcacaccctttgacacgtaaaatattccaaaaaaagagatagtgattttttctggattaggccggagaaataaaaattaccagctatttgaaatgcagtgggcaagcacagcgagtcgcttaaatgcacaccctttgacacgtaaaatattccaaaaaaagagatagtgattttttctggattaggccggagaaataaaaattaccagctatttgaaatgcagtgggcaagcacagcgagtcgcttaaatgcacaccctttgacacgtaaaatattccaaaaaaagagatagtgattttttctggattaggccggacaaataaaaattaccagctatttgaaatgcagtgggcaagcacagcgagtcgcttaaatgcacaccctttgacacgtaaaatattccaaaaaagagatagtgattttttctggattaggccggagaaataaatattaccagctatttgaaatgcagtgggcaagcacagcgagtcgcttaaatgcacaccctttgacacgtaaaatattccaaaaaaagagatagtgattttttctggattaggccggagaaataaaaataccagctatttgaaatgggcgccggacttttcgacagcggacctttcgacagaaggacttttc

SEQ ID NO: 39355 - DNA, 1316 bp, Heterodera glycines
  misc_feature (29)..(29): n is a, c, g, or t
aacgaaagtttaaaatttgtgacaatttnttgatccacataagatggccacccgcatttgcagaattgacaattacatttgccattttaataaaatgtgcattttcagggcacacgtgtggctttggacatgaccacgctgaccataatgcgccaacttccgcgcgaggtggacccgttggtgtacaaaatgagccacgaagaccctggcaatgtgagctatgccgaaattggaggtctctccgagcaaatcagagaactgagagaggtaagacaatttgagagcgaaaatcgaattgaaatttgtgggaggaatctgttggaccacaccttaaggttgttgaactgccgctgatcaatccggagttgttcaaacgcgtcggcataacaccgcccaagggctgtcttttgtacggaccgccgggcaccggaaaaacacttttggccaggcacagcgaatttaattagcgaattggcaaaatccgtttcctcagggcggtcgcttcgcagctcaactgtaactttctcaaggtcgtctcgtcggcgattgtggacaaatacattggagagtcggcacgaatgatccgcgaaatgttcaattacgcccgtgacaaccagccgtgcatcgtttttatggacgaaattgacgccatcggttaaatttgttatatattaaatttttttgatttgtcttattaaaaggcggacgtcgtttttcggaggggacttcggccgaccgcgaaatccaacgcactttgatggagttgctgaatcagatggacgggttcgactcgcttggcaaagtcaaaatcatcatggccaccaatcgacccgacacggtcccacgattttcttttccatgaaacttgcaactcttcacataatatgttcagcttgacccggcactgctccgtccgggccgattagacagaaaaatcgaaattggactgcccaatggacagagtcgtcttgaggttttttctgtgtcctaacggtactgagcttttcccttacccaggtgctgaagatccatgccaccaaagtgctgaaaaaagaagaaatcgattacgaagcggtggtcaaattgtccgagggattctcaggggcagacctgcgcaatgtgtgcacggaagctggactgaatgcgatccgaaaggagagggacggcgtggtacaggaggacttcatgaaggcagtccgtaaagttgcggacgccaaaaagttggagaccaggcatgcattcttaccgtttttgttcgggttatgagaattttgttttagtcttgactacaaacccgtgtgaaagggctgtaagca

SEQ ID NO: 39356 - DNA, 813 bp, Heterodera glycines
ttagggctatcgtatgataccaagattgtacaattttgttgagtctgagaaaagttatgagtgaatttactcaaaaaattagcaaatccaaaaaccataaataagaaataatttaaatagaaaaatataattgtaacatttaaacgatttaaaaaatgtaatcaagcgcagataatacagtttattttaataataattttaatgtaaaataagaataataattaattaaatgagcattaaaataaatgataaaaataagcaaatgatggggtgagtcattatgtaaaagcataaaatgaaaatgttcaacaaaagtctacccataacatttgtcaatgtcaaccaaattaaacattggaatcattcgatagccctaaaaaatttttataagcatgacaaattttctaaaattttgatattttcaaaaaaattatggccaaaaatctctgaaaacctggtttcttgagtatttttggccataactttgttcaaaattgaccaaatttttgtaactttgctattgtaaatacaaggttagtctgttccctaacacttaaatgtgattttttgatgaaattaaatttatacaattaattgtataagattatataaaaataaatgtagaaaattttagagtatttaaaagttattaaattcctttaaaaaggaacaccttaagaaatgctcaaattatagaagatgaatttaaacattcaacacgcaaaatcggtaaaataaaaaataattctaatataaaaaacaaattataatcatgaaaatcgattattttaataaaaataaattaattagtca

SEQ ID NO: 39357 - DNA, 1494 bp, Heterodera glycines
gtttttgccaaacattttcatttggaattatattctgagcaaatttttggggttcccgactttttcaaattagcatttatatattaatttgtttcaattcgcagaaaaaatggcgggggggcggggataattatcattaaaatttcaatttttcttctattgggacccaaaactacatggtattttttaaaacaattcaacaggaaattaaacaaattgactgtttttgggtgtaaaaacttctgctaaatcgacaatgcttttttattattgaaaatgccttaacgcagttatacctttaaaatttggtgcggttaatttatttatttttccaaaaattcgttggtcattttttagagtctttataaccatcctgtggagtcgaattgttaattaattgataatattagtgaattaatttaataggtgtttatgatttttctattaagacccatagaattggaattttagggaaaattttattaatcattttttaccaatggacaatttaaattgtgattttattttttaaaaaaattaaaaaatcattttgagacgtaaaaattgaaattattaccgctattatttttaatatatttttaattgccaaaattgaattagctaatgaaaattgctgcaaaagtcatttggcgaaatatttggaaaaaaatgggaagaaaaaaaggagaaataattgaaaaattttataaaataaaagagaaaattaagcaaaaagggagaaaatattcaataaaagaatggaataaaattaattcgaaaatagcgaaaaaattggggacaaataaaacatatttcaaaaagggatcaaagaattaggacttaatcaaaagcaaaataattgctacaaatcaaaatatgatgaagaaaaaattaaattgtgcaaaaattcatagaaatgaaaaatgaacataaacaaaaaaagaaaatattcaagaaaagaatgaaaccaaaattatgccaaaatttgtaagaaaattggagttggcaatgacacaattaggagatggaaaaaacaattggagatgaataaaatcattcagcttttagaagtgcatgaaaacttttttattgataaatctagacaaaatttgttcataaattttatttaaattatataaatcatttacgcttgttgtaataaaatgccataatcatgcgaattattaaatactcaaattctaatcatctattttccgagagatttctaagagaggtttttgggaaaataactccatgtgtgacataaaatatggacacaatgatatggacaaatatggaaacatagacataagtagcggagtggcacgaaaaatggaaaataggctctaaaaagtcaaaaaaataaggatgtaaaataagaaaattctattaaaaaagcaacaaaagtaagccaatctatgttaatatacataatttttaatattaaaaattattgtcaagaaaataaataaataaattttggagattttttag

SEQ ID NO: 39358 - DNA, 746 bp, Heterodera glycines
attaaaaataattttttttggggtggagccccggattctccagtattaccgtatattgataatatccattttccttttatgacgatttttgaaattaaaaatggttttatgacataaaaaatgcaagaagtattaaaatgtgtttacgatcggcgggtacggagcatttactcaatgaatggacagaaaagaaaaataattaagaaaaagtaaaggaatccaacaaaaaattatggcagaaaaaccttaaaattttttgaaaaatcgttggcacttaaattcggtcattccctaattgtctcccctcccccccccctgagggcaaaagcagtgctgcttcctttttatcaattatcatttgtgccttcatcaattcattaattaattactctgttcaattgaggattgattgattatcttcgacaataatttttgttgagttactgaccaaaattgccccattctctcctcaccaattcattgattgaatgcctttcattcattaattaatgtaatacattttttttattattttataattgttgatacaaattccgaattattaaaaactttttaacatggctcttcaagacgcttatgccaatgcaatggatgctttttgtggcaccacggggccattttgggtgagaaagggattttattttttaaatttatttgaaaaaggcaatgcctgttcgaactggccggtttagacacccttttgcccaagtgcgtagccggggggg

SEQ ID NO: 39359 - DNA, 827 bp, Heterodera glycines
ttactctcaatcaggggtcagaaatgggtttatttttttcctagatatttctctaaaaatagaatgggaaataattttgactaccgaatagcaaaaattttaagtctcgagttttggagctcgggctgtggttcgaattcgattaaaattaacataaagttcgtgatcagcaaacccccacatttaacgactcaaaataagtgacctttttcaatttgttcgctctgcctttgtcgtgtctttgccctttcccttccgttgccctttctgctgccactccaccgcacttcgtcccttccgctttcccttcgtatgatggcgatggtctgacttcgtcgtgctgtcggcggtcatcgtatcggcggccttcaccatttgcagtgacaaccaaagattgcatcgtcaactccaaattctgcatgtgttccaatcgccggttgccttcaatggaagttgggggccgaagaagcgattggaaatggagagaaggttcactgtgacgcatttggcaagcaattgttgagtcgaagaattataaggaagttttcaatttgtaaagtcgtttttgcttaaaatatgatttgaataaaaatctgctaagattgcactcaaactttaaaaatttctggcgatgcctttcggcgtcgccagaccccctcctgttcggacaggacaactgggcgacgccaactgcgatagtcaactggaaattatttctaaggtaatctaaggcgctgattgtgagcgggaatctgacattactcagtttcgaaccccgaacccggattagagatttttagaaatcctagtttcatttttttttttac

SEQ ID NO: 39360 - DNA, 1131 bp, Heterodera glycines
cgttaattattaaaattccaattcagaccctttctgaccaacagaatcatcccgccttagtcaataatatggcacagtccaatgatcatattatcgacgtccaaatccgttccatcagcggtcgctttaaaacctttcagattcggtattttgtttttcatttttctgttttttaagctattggtggtttagggttcgaagtcagcaggaattggacaatcttcgcgatcagttgggtcgtccgatcggtgttttggactctctcgtcttaccacaggtaaatcagaaataacaaataaacgaaggggaaatgaacacaatctgacatatttggtctgctagagcaatacccgggtgcttggggaaggtttccccagccaaaaaacattttgaattaaaaacgatttcaaattttattgaaattgtaatataaaaaagtttttttttcgtttgagatatgggtaaatgtgttgctttcccgggagagcaatactgggtttaaaaattgtttatttcagccaatgcatgaactttttgtggacgcatttttgactgaaatacgcaaaaacccgagagttacggacgtcgatttggatgaattggaaccgtgcttcagctgttcacaaacaattgcgcaagtaaaattggtgaaacggtgcgtcgattcggttgggcaaagtgaggaaaactgccgaagttgcgcctgcaaaccgaactggcaagtgaaaatatggagagaaatttaaaagattgtcgacatttaatttaaaatcctttaaggtgcgcgcgatgtatgggacgtatttttgcctccaaacaaaatcagcaaatgccggaaatttggatggctgggagagcgtaaggagaaaaagaatgcatatttgttaaattatgtgaacattaactactttaattactcacaaagtttaaaaaaatgccaaattagggaaggtcaaatgttcaaagtttgaaaaaacttttctttttaataatttggctttcgtttgacattccccaagggctctcttttcttaggccagtgccacgactttgtcgtcgcccactgttcgtgtgttttggatgtgtgccaaaaggaacagaaaaacaaaggcgacgaatgactgcgattat

SEQ ID NO: 39361 - DNA, 906 bp, Heterodera glycines
aacattttttaaaaagattttaaaaattaattttctccctttttcaacctgcaaaatgttgggctcatttgcaaaaatgctgttcaacagattgtaaatgtcgggcagaatgtccaggatgaacggcggcgagttcttcaagttcagccggggctgctggcacagcctaatcaccgtctccatggcacgatagcatttgtccacggtgcgtcggtccttcaacagcagcggggccataattattattttttgaattattttggcaaggaattttgaatttgccaattgccactaaaccaatcgagactctcgagaaacggacgaaaagtgtgccaaaagaaaaacaatttgataagcaaaaatcaaagaaagcactgagatggtaaagccgtcacaagaaaaacaaattcgataaaaacaatttaaaaaagtaaattaataatataatccatttacaaaattcaatggcccctccctttttgcctgatttgtcaactccgtccctttttcgcaaagtttggctttttcccataattactgattgctttgtagcatttaatttaatacagatcaatcaatcaatccatcactaattgttgtctctcgtcagtttccaactcattgttaattgccctgtgaataacctgcgcattcagctgacagttcggcccgctcattagcggcggtgcgttggcactgcccgcggcgccaccgccggcggcgccgttttggccaagtgaagcgagcagtgtttgggtggacgaattgacaaaggaagtggcggagccgaccatccgattgagcagcgaattcatcggaggaaatgcgaattttgtggacagagagagatcggcagcagaaggaaaagaaggcgcaacaattggaggcaatgaaagaaaaattaag

SEQ ID NO: 39362 - DNA, 1144 bp, Heterodera glycines
atgaacagaatggcaaagtcggtgatggccaagttgaatttgaacatggcgaacgggttcatgtgcaggggtcggaccaggcaatggtgcttggcctgggacgagggacttctgtcggtaaaaaatgttttttttaaacagatttagccattttaaatttgggtgtaatttgtcgttaatgagccgtgtcactgactttgagtaacggacgaggcgaacgacggccaccgaattgagcaaagtgccaatgcaaacgctcaacgaaaggtacacaatctccacaaagtcgaccaactcgcgctcactttccacgtcctccttttcaatttggtgccgaataattgtgccgttcatttttttatttgaatttaaaaactcgctctaaatggtgggaaaatatttattataaaaattttaataaatctaattagcagagagatagaggaaaatggcaatttgacaaggatcaatcatttccataaatgtttttaactatttttatacatttttaatattttttaaagaaaattttaaaccttcaaattgtttgacttattttttcgctttggattttcggagcatttaacgcaaatgaatttgctgatatggagaggcccttgcgcaaataatgtctaatggatttggtaaacattggcacggctttggaagggatgagcactaacggaagaagacgcccccggggggacggataatggcggatgatgaaaacggaagggagggggaaaggaaggggggagaggaaggggggaagagatgcattgggacgacggataaggagatgatgcacttgttcagactgattattcataccattaacagggaacgattaaaatgatttggtgttatcaccaattaagactcaaataaaaaaacaaaaagtgaaaagtgagagagagaatttgaaaaaaacaattgttttaattgaaagtcgaaaagcataagaatttcttttcaaatctaaaacgtaaaagaaaaataaataaataataatttatatttgttattaattagcgagttttcttcccgccatgcctaaattagctcctaaatgagcgctaagtgcctgataatccgcttgaatcataagcaattggaaatagtactgaaaaattaaatgtcgtca

SEQ ID NO: 39363 - DNA, 850 bp, Heterodera glycines
taccaacagttgccttctcttgtctggccctatcacctcccttacgatatttgaaacgcaaacaaaaaaaattcttgactaaaaaatggctatctcttttttctcattttttaaacgcaaaattggtaccaacagttgccttctcttgtctggccctatcaaacaatcttacgatatttgaaacgcaaacaaaaaaaattcttgaccaaaaaatggctatctcttttttcgcatttttttaccgcaaacttggtaccaacagttgccttctcttgtctggccctatcaaacaatcttacgatatttgaaacgcaaacaaaaaaaattcttgaccaaaaaatggctatctcttttttctcatttttttaccgcaaacttggtaccaacagttgccttctcttgtctggccctatcaaacaatatatctgaaacgcaaacaaaaaaaattcttgaccaaaaaatggctatctcttttttctcatttttttaacgcaaaattggtaccaacagttgccttctcttgtctggccctatcaaacaatcttacgatatttgaaacgcaaacaaaaaaaattcttgaccaaaaaatggctatctcttttttctcatttttttaccgcaaacttggtaccaacagttgccttctcttgtctggccctatcaaacaatcttacgatatttgaaacgcaaacaaaaaaaattcttgaccaaaaaatggctatctcttttttctcatttttttaccgcaaacttggtaccaacagttgccttctcttgtctggccctatcaaacaatatatctgaaacgcaaacaaaaaaaattcttgaccaagaatggctatctcttttt

SEQ ID NO: 39364 - DNA, 971 bp, Heterodera glycines
attaaaaatgatttaattcataaaaaaaataatttttttatttaaattttaatgaatatggagaagcattgccaaaatgcgatcaataaatgcaattgatcttcattagatctttttaaaaataataataatattagtcaataagattattaaagccatgaatttcatcataatttcatatggcattttttaattacggcccattgaatatttttcgacaaatccttcatttctgactgtaacttttttttgttactaaccaaatccaacaatcttggtatcattcgaaagcttaacatgtttggtagctgattctaagctattgcttcgtgattagacaattaccaaaaaagttaacatgaacatttaaaaaactagaaaattttgaagtttttttttaatattttttttttcaggcttgaaatcttttctttttttataatacgagtagagcgtttgaagtgctttcgaatgataccaagattgttagatttcgcttacaaagaaaaaaaaaattatgatccatatacttggtctggcgccgaaacggcggcgccgaaacgaccatctctcactagccatgattttccattttttaaactaattattatggattctttttttatgcacaaaatcgcgaaacaggcatctaaaaaggcagaaaaaaaatcgcaaatatgcatcaaataagtacaaaaatccttaaataggcacaaaaataggcaaaaaaaatttttatataacacttttaggtagcaaaatatgtaaaaatttaataaaaacacttaattttggttatatttccattgtaaatgaaaatattaaatattttaaaaatttttgagtaaggacaaattctaaagcaaaaatttttttatcaaaaaaaaaaaaaaaaaaaattaaatttttggccaccaatttttgaaaaattttttcttctcttaaagggatttttcaaaaatccggaaaaa

SEQ ID NO: 39365 - DNA, 1247 bp, Heterodera glycines
ttttgagcgtattacgatttacttacaccatttttttctaggcttagatcacatgcgatttcggcactctgataatttagcgttcataatgggatgtataaaggcgatgtagaaaggaatggaagcgctaaaattgttgaaaaagctttttgagcgtaattacgattttacttacaccatttttttctaggcttagatcacatgcgattttcggcactctgataattttagcgttcataatgggatgtataaaggcgattgtagaaggaattggaagcgctaaaattgtttgaggagctttttgagcgtaattacgattttacttacaccattttttctaggcttagatcacatgcgattttcggcactctgataattttagcgctcataatgggatgtataaaggcgattgtagaaggaattggaagcgctaaaattgtttgaaaagctttttgagcgtaattacgattttacttacaccatttttttctaggcttagatcacatgcgattttcggcactctgataattttagcgttcataatgggatgtataaaggcgattgtagaaggaattggaagcgctaaaattgtttgagaagctttttgagcgtaattacgatttttacttacaccattttttgctaggcttagatcacatgcgattttcggcactctgataattttagcgctcataatgggatgtataaaggcgattgtagaaggaattggaagcgctaaaattgtttgaaaagctttttgagcgtaattacgattttacttacaccatttttttctaggcttagatcacatgcgattttcggcactctgataattttagcgttcataatgggatgtataaaggcgattgtagaaggaattggaagcgctaaaattgtttgaaaagctttttgagcgtaattacgattttacttacaccatttttttctaggcttagatcacatgcgattttcggcactctgataattttagcgctcataatgggatgtataaaggcgattgtagaaggaattggaagcgctaaaattgtttgaaaagctttttgagcgtaattacgattttacttacaccatttttttctaggcttagatcacatgcgattttcggcactctgataattttagcgctcataatgggatgtataaaggcgattgtagaaagattgggaagcgctaaaatggttgaaaagctttttgagcgtaattacgattttacttacaccattttt

SEQ ID NO: 39366 - DNA, 713 bp, Heterodera glycines
atagacaaaagaaaatgacgaaatagtacaaaaaatgggagagaacggcagacggacagggagttgaaggatgggaaatcaatcagtggataatccgtcagtaatggacggacaatcaccagcaaaatttattttacgactctttttatcatatgattttgtttcatagactttgtctatgactgtatcatatgattttgtctatcatttcgcagaaatgccttaaaaagcaaaaaaaaattttgaaaattcttaaaaactcgacttcgagtgtccggcaaaggatctcgccgcttttgaaatgggttggaaagatagaattaggggcgcgcttgcccttttccataatgtgaagagatcaaagtgcttcgaccaggtcttttgctagtatggtgatggatgtattaatagaacaggatttaggttcgattttattggtctatgctgaccgagataatggataacagagacgaacggggccattcgtattgctacgtgagaggtgaaattcttggaccgtatcaagacggactactgcgaaagcatttggcaagaatgtcttcattaatcaagaacgaaagtcagaggttcgaaggcgatcagataccgccctaattctgaccgtaaacgatgccaactagcgatcccgcggcggatttattcgcccctggtggggagcttcccggaaaacgaaagtcttccggttccggggg

SEQ ID NO: 39367 - DNA, 1250 bp, Heterodera glycines
  misc_feature (7)..(7): n is a, c, g, or t
taaaatntctgtcccatatattactaacattatgttcggttcggcttgtgttctaccactgatccctgacatcaacttttcacccaaacaattcctgacccgctgtagcagtcatataaagcctctgcccactctcgatcacacagttaatggatgggtgttgtttacttatcccctcccaaaatccattttccaatcaccaccaccgccagcgcccattcattgcccttttatcccgcgccgtcagcgggaaatcccttcccgatcacaaggtcatgtcatgttcgtgtcctgtcgtgtctcgtgctggcggtgaaggttgtgggactgctgttggtgctcccatttgaccacccacacccgttaggcgataatggaaaccgtattttaagggggtgggtatgggatcagggatatgtcggcatgccgattttatcgcgtcgcaaaacacccctggtacgaactgtgtgccttccgccacccaacccccgcggtgaccattcgtataaatgatcaattgcccggaacgcgtaggccgagcaaccgcgccgtgcaaacagcagggctgctcgagagcgaaagactttcctatcacgtgaaccgaccccaaaagaaactcgaggctttaggccctaaaaagttcgagaatttttcaagattcaacaaaagtcgcaaatttttacaaatgtagtatttttcgtttaataatattcattatttattttgtgacttttaatggttattttttatttgatttttaaaattttttatctcctttttaaataaaattgtttttttttcaaattatatgttttttgtagtttgttttatatgcatacaaaaaatctttttttaaccgaattccccccaaaattccttttttttccctctttcccgtccctttctgccaaatggctcgcacatcagtccatttcagtcccgtcgattcatcacattttggcaaaagtgatttgggccaatttctccgcttttcccattggccaaccatctggccgataaattcactccatctctctgcttgctgtccatcttcacaccaaaacaattatttattatgtgtcggtgctgtggtgctgtgctcctcatttccatcgcccaacctcaaatttgacccattcgccgcactcgcggggccttggaaatcctcgggattctcgacacaagatcccctcactactctcgagataagatagttgaattttggtggggacaagccaccagtctctccc

SEQ ID NO: 39368 - DNA, 854 bp, Heterodera glycines
aacaccctattagtgctttgctgtgccgagaaccgtccccacagaggatggctttcaatctgcaagaaattagattggccttatgtggttgtaaaaaacttttgggtatggaattattttttgaagtgagtcaaacaccctattagtgttttgctgtgccgagaaccggcaggcaatggatggctttcaatctgcaagaaattagattagcaatatgtggttgtaaaaaacttttgggtatggaattattttttgaagtgagtcaaacaccctattagtgctttgctgtgccgagaaccggcaggcaatggatagctttaaatctgcaagaaattagattggcaataagtggttgtaaaaaacttttgggtaatgaattattttttgaagtgagtcaaacaccctattagtgctttgctgtgccgagaaccggcaggcaatggatggctttcaatctgcaagaaattagattggcaatatgtggttgtaaaaacttttgggtaatgaattattttttgaagtgagtcaaacaccgtattagtgctttgctgtgccgagaaccggcaggcaatggatagctttaaatgtgcaagaaattagattggcaataagtggttgtaaaaaacttttgggtaatgaattattttttgaagtgagtcaaacaccctattagtgctttgctgtgccgagaaccggcaggaaatggatggctttcaatctgcaagaaattagattggtaatatgtggttgtaaaaaacttttgggtatggaattattttttgaagtgagtcaaacaccgtattagtgctttgctgtgccgagaaccggcaggcaatggatagctttaaatctgc

SEQ ID NO: 39369 - DNA, 698 bp, Heterodera glycines
ctgttgcagtgttttctgttctttttggatgccatccgacgcattctcaaaaaagaaaataaatatttatttatttttattattttgcattttgtatttttattttttccatttgcctccaattccttttccaattcggcaatttttcgtgtcgcttctgccaatgcgtcggtcgtttctctttgctgcctaattataatatttaattgttttatcattttaaatcaaattttaactttttacgaaaataaaactttcaaaaattttaattttaaattttgtgcctttggaattgataaaaacacgtgaatatccggtgtgcggacgtttcgcctactggacacctcgcctactgacacttcgcctactgacatttcgcctactaagccaaaatcggacgtttcgcctactaagctaaattcggacgttttgtctactaagccaaatacggacgtttcgcctactcacctaaaatctgacattttgcctactggacatttcgcctattgaatatctcgcctactaacctaaaatacctagctctttcgacagcaaatttcaccaaatatatattctaatttgacatatatttcgctatatttataatgctaatgaaatttagcaaaaaaaaagcaaataaatttttcaaagaacacagaaagtgtgcatctctatcattagcttcttcatcactcttt

SEQ ID NO: 39370 - DNA, 887 bp, Heterodera glycines
  misc_feature (11)..(11): n is a, c, g, or t
  misc_feature (21)..(21): n is a, c, g, or t
  misc_feature (33)..(33): n is a, c, g, or t
tttctattttntggacttatntggtcgaaaccncgggctctaaaaaagttgaaatgataaaattaacacatagcaccaaaaattaattttaaaaaattggttttcactcactgtatttttaacaaccgaaaaccctttaaacagtttatttttaaaacccttaaaaaaagtatttctgtgcattttccatttcagttttttccattggtttagtcgatttgatttttcaatagaattttttgttactatcattttgtaaattagtcgcttttgaaataagttatggccctcaaaagttggctcaaatggaattggtcaaacgacaggacttctccgcaatgggcgggaaacttgattttttgcataattgacttatttaaaaaacttacagttgaacgttcgcttcgcgcgctggacgaacgcattgacagaagtaaacaaatttgatttgattgaatagcaacaaaaacgttaatggtcaaaagattattagcatttattcataattccattttgatttttccaattccctaatttaccgtcttaaatttgttgagaaccggaaatagttctaatgcgttttactggcctgcaccagggacggtcccaggattttggtttggggggtccctcccccggaagacgacctttttgcttttcacatctctttttgcctcggtttttccaaaaaaaacttgtggaacagggggtccggtggtaccaataggcaccgccgggaaaatttttgcattttttaatgtgctttgttaccaaatttaccaaattttgtcaaaaaaagtgacaaattttgcgtttttgagccatttttagcagggttttctcaaaaaattgtacattttttttgaaatttagcgaaatttttggaa

SEQ ID NO: 39371 - DNA, 437 bp, Heterodera glycines
tttcttgagacagatcgctttgcatcagcttaccttcaggcctaaactgtacaagaaccaagtcccccgaaaatcaacagaaacattttttcttgacctaagaacacatttttttccaacaaaggcgaacaacctacaatataaccaaatgttgtttttctcaataaaaatgcatctgaacggggctgtcaacagctttatttaagagttttacatccattgaagcaataagtcaaagcgcttcaatacataatgacacgaaaaataaaatagaaggaagaagctaaatagcaagaaatatgttatctggtgtatttaagagtattatatatttataaggtcttccaatgtttgcaaggttcgtttccatcggaattcaagcagtgaagcgatgcgacaatttgaacgtcccgtcgccccagtaagagagctgaaaa

SEQ ID NO: 39372 - DNA, 1030 bp, Heterodera glycines
ttaaaatcatttataataaatgtttaaatcatataaaattaaacatcatcagtctgatgattctttgtgcgctgactgccattttgtacgttttggcctcttttgcgtccaatgttaatttggcggcgaattgagcagaaacaaagaacgccgatggataattaattatgaatgaagagacaacaaaggaacagaattttccaattcgatttgatctgctgaccgatgacttattcaatgcattgtaaaatagaaaaataattattgaaaaattataaattcattgcagttttacattttttggatttgaaaaatcggcagagaattattaatcgcttatgtggattctccttcaccctttaccctcccattcattgcttcttcttagcttttccttttcttcaatcattctgactgtcagtgctttgaagtgacaattgtttgcttggctttttctcttcattgtctttgcctgggtttcccttgaaaatgaaaaataaaaaatatttaaaatttattttttttaagttaaaaccaatttgtgctactcctttgtaaatattatattatttagtgataatgcagcagcattggcaccgaccatttttgcgcgttttgttttgccttttgtgccattttttgatagttgcccacggaatgcaaatttatgtgaaaacattggccgacagaataattcccctgaaagtgcacagttcagagacggttttaagtgtgaagcgaatgattgaggcggaggagagcattccgacggatcagcaacgtttgttcatagagctggaggaccaccgacggttggcggattacgaaattcggagtggctttacgcttggcgtggtggtgggaaggacggaaatggcggcggaaagcgatcggatcagagtcaacgtgaaaacgaaggacaacaaactgatcacttacgaaatgcacagatcggacaccgttaaaaacattatggagaaagtccacgagcagcagggtattccgatcgcagaacaacggttgtcttccg

SEQ ID NO: 39373 - DNA, 397 bp, Heterodera glycines
cccgtgtcgctgttcttcagcgaaagtccgataagacactagtaggaatacgccggcttcacaaatccgttgcgtgcgatgggtggcactccgcgctctgctgacaaatgagggagaatttatgaaaaccgcaaaagcgaaaagcctcccctttcttcgagggggggggggggggggaagtgcaccccaaaatgcccaccgttttccgtccgctcgtcgtcttcgtcatttgaccgatatgaatcatcgttcctcacaacgaccacctaagggggaagggagggctattgggacagccaatgacaaaacaaagaattggttgaccaatgaccaaacatgggtaatgaatgccaaaaagggtcaatggtcgtcattcctttggtgccattgcctgtct

SEQ ID NO: 39374 - DNA, 910 bp, Heterodera glycines
acaaaaacgcaaacagttcgagtcttattgttaattaaacagttttataaacctttacaattgtaaaaaacaaaatattttcggacagaaaaacagacggaggcgggtgaattgaattatttgcaagtctttcaaggacgatgactttcgcttccattcggcgcccgaaaaccggtttttaggccccatttttgttcgagaaaatatcggccgaacatcgacacatttgtccgatgtcatagcgctatgttttcatactcatttatacagtttaatacttttttattcgtaataaaatatatgttcccacttcaacaattcgtctccgaattgggccgtgatccgtgggagatgttgcagttgtttttgccgcggtttgctctgctcattgtccgccgcaacaccaccagtgtgctcattccgttgttgttgctgttgtactccttcgccctctccgacactttgttgccactttttccgtgccgccgcccattccgtgccgatgccctcccgctcgatgaccacaacgtccatgcgttgcacaatttcggcacggatggcctccgcaaggttggcggcggatgcagtggcgtcactggtggtgccaagcaggtcgtacacgacgccatcggcggtgccggtgggatccatgggcctattaaaaaattcggaaggccttttgacaaattttaacagtagaaatcaaaaaaaaatcttttgaaaaactaaaaatgtttaaaattactaaaatgcattacaaatttctgtaaaacctttaaaaaattaggggaaaaatggcaaaaaaaagcgttttttgataaaatgtaattcaaattttatttttttattagaaatcggggatcggacgggtcgaaaaatctgtctaatcaaaaaccggaccatttctgat

SEQ ID NO: 39375 - DNA, 796 bp, Heterodera glycines
  misc_feature (770)..(770): n is a, c, g, or t
atttccattcccagacaaccgtccgttgcccagcaaaatccgttttaaatgccttcagattgagtaattaaaaaccagagagctatgacaataaaagcatttatttcattttcagttacatcgatcactccgtcatcgcttttcttcgttcaaatcaccaaattttcgacaaaagaggcaccaatttacatttgtggcttccttattcaaacaccacgaatggccaaccaatttgggatgtttttgcccgtgaaatttggccaattttttcggcaaacattcaccacttacgctttccccatggtgatcatttggaccatttgcttcgtcgcacttcgccgacaattctcaccgatctcgaccaattgaattcaatctattccggtgctttgttgcccgctgcgtttggtgatggttttgatgggccaatttcaacaatttctgctggccaagcattgtccaaatggttgcactctccgagaaaagatggccaacccaagcgattgcgttgcgataattacaacgcacaatggaacactgattggatcaacaatttcaaggaggtgtggccataattcgacaaatgattgatttttgttttcaaattgtttagcattttctccgtgccaatgccatttcttcggtcagttaccaaattcatttttctgttcatgtgccatcaatggaaatggtgccatttgaattggtgaacgaatgcacaaaggaaaagctgacattggccaaagcaaatgaaaatgaattggacaaanagtggataatgaaacgctgcaaaatt

SEQ ID NO: 39376 - DNA, 1195 bp, Heterodera glycines
aaaaagagaaattgcgcaagagactaaggccggaaattaacggaaaaaaccgaaaatggcattggcatttgtactaattgtaagtgagcagcaacagaagaagaaaaggttgttttgccaaaaacaattcacacaaatgaatgaatgttttgaggatgaatttgtgctggaaaacaatttttgtattttttttaaaagcgatttttgggaataaacaaaaagaatttgctaattatgtcaattctttaagaatggtgttcaatgaatacattcgccgattgtcctttaaatttcgattaacattatttaactaattaattatttgacaaagtgatgaatcattggcaaaaggttcaaaagcataattaataaacattatgtacaagccagagtggccaagtttttttttcttcaaaaaaaggacaaattctttgtgcctttgtccaaattaagttttttaaaatcaatggaagcctaaacagctttaaataagcgattgaaagtgattgtatccgatcatttgatcgtcaatgaatttttgaaaaaatcattaaatttttaaacaacataattaatgttcctaataatcaaaagacagtagtgatcttttcataattttaatgctgtttaggctatcagtgctttaaataaaatcaactttgactccgattttggacagaggcgcaaaagtcggggctccggtcgtcacccccgccccctatttaaggtatggtaaatccattaattgcttacttttttaagttgtgcaataaacgcaagagcaactttcttcgtgcataaaaacttaagttttttcaatggcaacagatcgctgttgtacggaagtggcgatgatggacataaccaattggcaaaagctttcagcgcagcgaaagttgctgtttcggtggccatatttttgtgtaagtaaacgacacaacgaagtggtggacaatcggtgagaatggacgggatgacacgaatgacgcagtggaaaatgccaagccattggtagtgcgcgagaatagtggcaaaatattgagcgaaacaaattccaacatgcgatcacttccctttgggatgctcacataaagtggacataattgaaaactgtggtcctccatttgttcaaaaattccataacttgttggctgacgtatctgaaaaaattcaaggaaaattaccgtaactctta

SEQ ID NO: 39377 - DNA, 1224 bp, Heterodera glycines
  misc_feature (69)..(69): n is a, c, g, or t
  misc_feature (128)..(128): n is a, c, g, or t
  misc_feature (157)..(157): n is a, c, g, or t
  misc_feature (1048)..(1048): n is a, c, g, or t
  misc_feature (1069)..(1069): n is a, c, g, or t
  misc_feature (1081)..(1081): n is a, c, g, or t
  misc_feature (1105)..(1105): n is a, c, g, or t
  misc_feature (1119)..(1119): n is a, c, g, or t
  misc_feature (1194)..(1194): n is a, c, g, or t
ccttttcatgactataaaatcttttgtttccgctttgactctcattaaaaaaataagctttccacgaanttattattctgttcttttgtttgacatcattcggaactcgtccaaaattgtgctaatgncaaaaaaatgaaccgacggtaataaattngaaaagtcacacaaattcatcattatttagctaacaataaactgttttccataatttcagttggatttgcaacgacgtttggatggacattttcccctgttttgaccatgcccaacttggcctcaaattggcacttctttcgtcacgtttcaatgcgttggtggacaaacatttcgatggcaaaagcgaattgacaatttggagaccaatcgcaattcgtcgcaaggacaaaggacctgaaccgaaactgtctgtacaaatggatagaaaatttgacaaatttgtggaatttccattgcccgaccgtccgttgcccagcaaaatccgttttaaatggcttcggattgagtaattcggaatcagagatttatggcaataaaagctttccttccatttttaggtacatcgatcactccgtcatcgcttttcttcgcttaaatcaccaaattttcgacaaaagaggcaccaatttacatttgtggattcaattatcatacaccatggatgtttttgttcgtgaaatttggccaattttttcggcaaacattcgccacttgggcgtttgcaatggcaggccaaatgttgtcaaaatggttgcacagtccgagaaaagatggcatgccgaagcaattgcatttctttttgaaggagccaccaaatatggaatgggccaacactctcaaaaaggtgtggccatattttcgttagccaactgattttgattgcatttaattaatgtccgtccgttttcccattgtttagcattttctccgtgccaatgccatttcttcggtcagctaccaaattcaatttactgttcagcaaccgtcaacgcaaattgtgccatttgaattagcgaacgaacagaccaaggaaaagctgacactgatncaagcaagcgcaaatgtttgngaggatcgctgngtaatgaaacggtgccaatattgngagacggcggcggntcatgggcagcccaaatttggacggattagcactgtcgagtttcattattacgtcgaagctggcattgggtgagncacaaaaaagcatttgattttgtttaaaaa

SEQ ID NO: 39378 - DNA, 1171 bp, Heterodera glycines
aaaaatggctatctctgaaagtcactattaaatccttccggggaattggccacaacttttgtcttctgttgtagcgctgaataaaacactaatagtgtgtttgaaaacgcacgaaaaatagttcttgacaaaaaatggctatctctgaaagtcactattaaatccctaccgggaattggacaccaacttttgtcttctattgtagcggtgaataaagcactaatagtgtgtttgaaaacgcacgaaaaatagttcttgacaaaaaatggctatctctgaaagtcactattaaatcactaccgggaattggacaccaacttttgtcttctgttgtagcgctgaataaagcactaatagtgtgtttgaaaacgcacgaaaaatagttattgacaaaaaatggctatctctgaaagtcactattaaatccctaccgggaattggacaccaacttttgtcttctattgtagcggtgaataaagcactaatagtgtgtttgaaaacgcacgaaaaatagttattgacaaaaaatggctatctctgaaagtcactattaaatccctaccgggaattggacaccaacttttgtcttctattgtagcggtgaataaagcactaatagtgtgtttgaaaacgcacgaaaaatagttcttgtcaaaaaggatgtatctctcaaagtcgagatgggagggcggacgggaatatcgcaaggagagcttttttctattgtaactgtgaattaagcgaaatatatagttatgtattggctcgagaaacagttcgacacttaaactgtcgatttgttaaagtcactattagatacataccgagatctcgactccgactttagttttgtgttgtagcgcagactcaagcttcaatagagtatgtgtatacgctcgattagatagttcaagagattttaataggcaatctgcgcaagacttatatcaaatccggatcgggagatggctcatccatcatccgtaatttcaaggagcggtgaataaagcattgttagtgcgccggatattccacggaaaataggtagccacaaaaaagagagatctcagagagacttgtattacatccctgccgggagggggacaacgagtgaagtaataaggagtaaaagtgaatgaagcaatgatagtgtgatggaccacgcacgaaa

SEQ ID NO: 39379 - DNA, 610 bp, Heterodera glycines
  misc_feature (544)..(544): n is a, c, g, or t
tgatgatgatgatgatgatgatgatgatgatgatgatgatgatgatgatgatgatgatgatgatgatgatgatgatgatgatgatgatgttgatactgaaataaaaagacgagaggagaaattttaactgagatgtattaaaaaataagcttgaagagattgggtataatgatgatgatgatgatgataataataaaaagacgagaggagaaattttagctgataaaatacgaaaccatagtgaaaacgaagaaaaaattgaaggaaagacgcatggagaaattctaaaagaaaagctttatgcggataatgatgatgatgtacaattagttgcgacaaagggtgaaatatttaaagaaagaattgaaagtatcaaaacaaccgataaaactgaaaataaaacccatggcgatttattacaaaatataattgcatcaaggcacgttgagcgaataagatttaaatatataaaagaacgacgaaaattttctgtgtattttaacgaacaaattattgcttatatcgaactgtcagcccagcttgngtatatactaggattcgatgatcccatcaaaatacatagcggggacatggcaaaatattactgtga

SEQ ID NO: 39380 - DNA, 780 bp, Heterodera glycines
aaaatgccaaataatccgagtaaaattgccaatggcagccaaatagtcaatgaaaatgccaaataatccgagtaaaattgccaatggtaaatagtcgatgaaaatgccaaataatccgagtaaaattgccaatggtcaaatagtcaatgaaaatgccaaataatccgagtaaaattgccaatggcagccaaatagtcagaaaatgccaaataatccgagtaaaattgccaatggtaaatagttgatgaaaatgccaaataatccgagtaaaattgccaatggcagccaaatagtcaatgaaaatgccaaataatccgagtaaaattgccaatggccaaatagtcaatgataatgccaaataatgcgagtaaaattgccaatggtcaaatagtcaatgaaaatgccaaataatccgagtaaaattgccaatggcagccaaatagtcagaaaatgccaaataatccgagtaaaattgccaatggccaaatagtcaatgaaaatgccaaataatccgagtaaaattgccaatggcagccaaatagtcaatgaaaatgccaaataatccgagtaaaattgccaatggtaaatagtcgatgaaaatgccaaataatccgagtaaaattgccaatggtcaaatagtcaatgaaaatgccaaataatccgagtaaaattgccaatggcagccaaatagtcagaaaatgccaaataatccgagtaaaattgcccatggcagccaaatagtcagaaaatgccaaataatccgagtaaaattgccaatgg

SEQ ID NO: 39381 - DNA, 1400 bp, Heterodera glycines
  misc_feature (1326)..(1326): n is a, c, g, or t
tttaattaattacatttatttgtttattacgcttttccggtcatgtgaaaataaaatgaaggaaaaataaataacggaagtaaaaaatcaatttttgtaattagtgtttaatgcgtcttaatctttgtgtgctgctgacgtttcgctcgtcagatgtgcaaaaagtccaattctgttaagcaaaatgaaatgatttgaattcatattttcattttaattatataattttattttattatttaattcttcattgctctccccgaaagaatttggcccaattttgaacattattcgtattttcgccatttttctttaccattttgtgccatccgattgtcgttgaagcgttcaatccctctgcgtatgtttatgtcgccgttatgattgtgctgtacacgaccaatttgatcaacgcctaattatgattttttaatcggaaatgggcgccttttattgactattttttggcattttctttggccaaaaatatgccaatttgtcttgtgacccattccaacaaacggatttaaattgaaatttcgattaaatcactttaaaaagagagcaactcacttgagtcaactaaatgagcaccatttgcaacagcagcagaaaagaggaaaaaaacaactccaataagaaaaatgcaaagaaaaagcagctgattcccaaatattcgttgttgagtcgtcatttatttttgttttttaatttcacaatttgtcggacgggaaaagggataatttaattgctttcgtaagtaatcaacaactaattatgatggtcgatcggtcggtgggaggtgagaatgggtgcgcgaaagatgtgatttattaggctgactaatgagtgaacaaagtaattagatgagagatttcaaaaaaaatatgctgtcctaaataaaataatacgtcaacggataaagtgattggtattttaaatattcttaggtttaatcaattcgaaaacagacatcaaatatgtaataaaattacaatattaaggtctgtcaagggaatttttcttaaaatgacagtagtaaatttaaaaaattaaaataaattctaaattaatgcttatatatcggtagctgattcagtttttccaaaaaatttataaaatcgaaatccaacatagtaaattgcttacactttatcagtcaatctttctgaaacaacaaatccaccatcaattcttgtacaataaatttagcattttatggaagtctgaagcgcgagagattgtgaagttgcatcggtgggagcgatcaaaattttttgattagtaatgcaaaagattcagaaaatttttcaatgctgtgtttcnaattttgaaaaatgaagagtccgacaatgcctaggcgccgcccggaataattttttggaattttcaaacattta

SEQ ID NO: 39382 - DNA, 1324 bp, Heterodera glycines
  misc_feature (1205)..(1205): n is a, c, g, or t
attaactattcaacctaaaaaaatttaaaaaaattaacccaaaaataaatcgaaattttcaatcaaatttcagaaaattcgaaaaattttccttcctcaataataattttattttattttttttaaattttcccccaaaaattatcaattttaaattccaaatttaaatgttaaaatgacttaaaaaggcaattttttcaaagctaattgggcgttgcaaatgcgctcggattatcatccattattattttattcattccgtcttttccccaacttttttttgtcaaaaatgtctttttttgtccattttatggccaaatgcctccgctgtcaaaaattgggcaaaaattattttttgttcattttcttcttcgcttaattagttttgttcattacttttgggtattaaaacaaatgaaatttctcatttttctccttttttggaaacaaaatttttttccgactcaatgcatttttttggccaaattctctcgggaatttttggacaaagaatttcattttttaaataattttaatttattttaggaattaaaaggggaatttattatatttttatataaatattcattaaaaataaaaaatgtcctcaattttaataaaataattcatttggctttgtttaaatgacaaatttctttaatcatttttatttaattttttggaaattctttttaattttcaatgaaatattttcaatcttttttcaatataatttttaatttaatttagcgttttcaattagctttaattttcgaaatatttttctttttatattattattagggctaggatttttatgtgctaaaaatcctgaaatatgtaataaaatatgtgctaaaaaatgctgaaatatgtgctaaaaacccccaaaaatgccaaaatatgtgctaaaatatgtgttaaaaattgaaaaaataagtgtgtttttgcataaaaattcccaaaaatctcattctttatcatttttagcccatacaacgcaaatcaaatacatttcgaagtgtttggggtaaaattgtctttttttgataaatcatttctataaattgaaagttccagcagagaacttcgaaatccaatgacgaattaatgaattcgagatttcattagtttctacaatcgaagaaaaaattttttaatttgaaaattatgttaataattaggaaaaaagtcgatttttaggngtgtatttttcaattttcttgtatttttattgcaatttttctcaaaaatgccaaaatatgtgcaaaatatgtgcccaacccccaaatatgtgctaacatattttatgtgccaaacgcca

SEQ ID NO: 39383 - DNA, 1210 bp, Heterodera glycines
cacggtcccccgaaggaatggatttaattaaattctctccttcggggatttttttccattaggtcgtccgttagcgttcgattgctctagtcaatttttcaaaatttttgttgaaatatttgtcgtgctctgaagggcgtgggaggggggggggcggttttgctccgggagtccctctgtccagcggttgtgaggatgaggcctaactgctctaccactctgctccattccccaccgcgcagaaatctatcatacaagaaaactgaatgctatacatctgatgaccgaatgacgtatcgtttgctaggtgagttgttactgacgcatagcaaaacctgcacaaagagcggatttgcaagaggaatttgcgcagttattaatggccaaccaccataaaagcaggcgaacccgggcgacccgggggcgaaagtgaagtccgaattcactgtggtagtggagggagtgaagaaaaagcggagacggcgcggggcggcaatttgttgcagtttttgctgctgtccggcgaattgaatgttctgctgctgctgctgctgttgttgttgctggttgggataaacgaagttgttggcctcaacggacggagatttgccattaaaattgacaattctctcggcggggggcggaaagggcccccgtggggagcgaaagggcacggacattggcacgggcacttgttggggcggggcaaagactggcggaaacggttggagttggggctgactgttctgctcactgttcagggactgctgctgataagcaaacggctgctgttccctactaagctcttcaccattttctttgttttattttaatttcccaatttagccatttaaaattgaaaaaacgaaatcatgtcaaaataattatttattacttgtcgtacggcacaaccacctgtgccggtttcctcatcgtcagttgcttcggttgttgttgttggctgttgctgggccaattagctattagaatgatgttttgttttgtcagttttgggaattattattgggacaaattgacttttaagttaagtgtccgatatgatcagccaattgacccaatcggtcattaattcattaattacctatgcgagaatcgctttcttctgtcgatgagtgttcgatctgttgcttcagtcttcgagttgagcttttcgagtcagcgtttgttgatgtcttctgctgacaaagga

SEQ ID NO: 39384 - DNA, 859 bp, Heterodera glycines
gtcgattggaataaatggaaaaaaagcaaagtcaaagacaaaaccttaaagcactagccgattgaaataaatggaaaaaaaagcaaattcaaagacaaaaccttaaagcactagccgattgaaataaatggacaaaaaagcaaagacaaaactttaaagcaatagtcgattggaataaatggaaaagcaaagtcaaagacaaaaccttaaagcactagccgattgaaataaatggacaaaaaagtaaattcaaagacaaaactttaaagcactagccgattgaaataaatggaaaaaaaaagcaaattcaaagacaaaaccttaaagcactagccgattgaaataaatggacaaaaaagcaaagtcaaagacaaaaccttaaagcactagccgattgaaataaatggacaaaaaagcaaagacaaaactttaaagcaatagtcgattggaataaatggaaaaaagcaaagtcaaagacaaaaccttaaagcactagtcgattggaataaatggaaaaaaagcaaattcaaagacaaaaccttaaagcaatagccgattgaaataaatggacaaaaaagcaaagacaaaactttaaagcactagccgattgaaataaatggaaaaaaaaagcaaattcaaagacaaaaccttaaagcactagccgattgaaataaatggacaaaaaagcaaattcaaagacaaaaccttaaagcaatagtcgattggaataaatggaaaagcaaagtcaaagacaaaaccttaaagcaatagtcgactggaataaatggaaaaaaagcaaattcaaagacaaaactttaaagcaatagtcgattggaataaatggaaaaaaagcaaagtc

SEQ ID NO: 39385 - DNA, 1115 bp, Heterodera glycines
aggaacaatttctattactagatcaaaccgaaagagtccccttttaggttttcaataaaattcaaaagcggcctatttttaaaaagcgccaaattcttttcataagaacatccagtacaaatgcacctcgttcccgttgtaaacttttgataaatactgaatttctttaaatcggtgacgcaaaatgttggacgtgccaattatgtcttcattttggattccaattgcattaatattattggcatctttcgcctccaattcctgcctatacaggatcactttcaccttcaattcctgcctataaattgccactttcgcaaacaaaatcattttaatgacaatttgctttatctcgccaaccgcttcggatgtaatcggatggccatagctatctgctaatgggtctggttatttgaggttatgcgaaataaatgtcccttagcttcaagtacgtccttggattgtagtaacagtacttatttcgaacatacatattcttttttaaatcaaaaatctccattaggttattcaagaccgaaattttccgagaccaagcgaaaaccggagatacaacgatattagtctgtaaaattccttaaggtacaaaaaagttatggctagaagaattcataaactggttgcccgaacattttctgccataacttttttgaaccataacaaaatttttcaagatatagaaaattgttaggactatcgaatgatttcaagaattaaattttgcttgcttttgagcaaatttatgggtaattttttgttgaaacttttcattttggtggtttttttttataacgacttagcaccagttgattacctaccgtatcttggacaccacaactggtgacaaatcatagttgactccctaccgtatcttggacaccacaaccaacgacaaagcatcagttgactccctaccgtatcttgggcaccacaagaaccaaggacaaatttgcgcctgactcaatttgacccaccgcttttttctttgaagtcctccaatttatcttttgcctcactgatgatctgattaaccaaattactgccactataaaatacatcggtttgaattgtagcaattttttgatataattgctcca

SEQ ID NO: 39386 - DNA, 845 bp, Heterodera glycines
ttttttttgtttggggggcattccccccgaaccgatgcccccagttttagggggagaccgaatctttcgggaatagtttccctataccctgtcttttaattctgcgttggatttttgctccccataattgtttgagttccccaaacggacactggaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgtttcataaatatttttttcagaaagtgctctaaagcgcaccaaattttatttacaacttaattttagcactctgatgctttagtatcaaaaaggaagatggagaaaaaattttttaaaaaatttttccttatattttggttatatcgttttgcttttggtggggtgcttggaacagtggaatcatgcgcacccgtccgatctggcaagttaagcaacgattgctgactagccaaaaggttcggtgccgtgatgaaacgaaccagcactgcttaccccgcggcacccggcacggtcccccgaaggaatggatttaattaaattctctccttcggggatttttttccattaggtcgtccgttagcgttcgattgctctagtcaatttttcaaaatttttgttgaaatatttgtcgtgctctgaagggcgtgggaggggggggggggcgaaggcccaccacgaggccgcgaagaggccgagtgagtaccttcggtgcaggaaaattattaa

SEQ ID NO: 39387 - DNA, 664 bp, Heterodera glycines
attcatgtgagtttgagcagaaaaaggagatagacttttttttcaaaattttcagagccaaactcgcccagaaagaaatcccagaaaaattagggtcgtcgcttcttatcccgaaaatgtggttggaattcatgtgagtgttgagcagaaaaagagatagacgttttttcaaaattttcagagccaaactcgcccagaaagaaaatccagaaaaattagggtcgtcgctactattccgaaaatgtggttggagttcatgtgagtgttgagcagaaaaagagatagacgttttttcaaaattttcagagccaaactcgcccagaaagaaaatccagaaaaattagggtcgtcgctactattccgaaaatgtggttggaattcatgtgagtgttgagcagaaaaagagatagacgttttttcaaaattttcagagccaaactcgccaagaaagaaaatccagaaaaattagggtcgtcgctactattccgaaaatgtggttggaattcatttgagtgttgagcagaaaaagagatagacgttttttcaaaattttcagagccaaactcgcccagaaagaaaatccagaaaaattagggtcgtcgctactattccgaaaatgtggttggaattcatgtgagtattgagcagaaaaagagatagacgt

SEQ ID NO: 39388 - DNA, 1103 bp, Heterodera glycines
ttttttggcagaaaactttttgtttttaagaaagatcagcgatcgcaaaaacctttacaacggaatccgctatttgcggcccgacttttgcggccccagcatttgtgcttatgtccaaaaatctgattcaaactaaaatttttaagccgccctgctcttcatgggcttcttaaacaaaaattctgtgccaaaaaagggggggtgccatcagcaatattaccgcgccctttcctcattttcctccatttctgtcgttcatcaaatccattcatttatagccattgcgcaactcaccagtaatgagcagcagccatcgcgagaccggcagaagtccaagaagtgtgctgatgcgccagtacgaaatgctgctgcaaaactcgaacgacaacagcggattccgtgcctggttcgacaacaacggcgctagtttaaaagagtacaattttgaaaattttttcaacttttttttggtcaaaatttttttttgtttaaaaagtcctgaaaccaaatacccgggggttttaaaggtcgctgattacaaatatgacaattatttgggcctattaagcaaatttggcgctagttataaagtgatagattttgtattttatcaaaaaccataggggggagacttttgttttgttaatttttttttggataaaaatcgtgaatatacattttattccccatatttgtgatgttttgacttattattcatcaatatgtgtgaatgatttaataataatttgttgcatctaagtagaatggaaagcgtttgattctaacatgcattctccagcgcctcacaatccctattcgcatacagatactgtgggcttaacgatgacaaaagtaaaatctgatcacgtattccggatcagcgtcacaaagatacccttagagacattttttcgagtgattctgtggtaaaaaattttttcaaatcaataatcctgtgctcccccttaagtcccaaatccaaaaattacttttatttttataacttttttcaaaaaagcaataaatgataaaataatattcttactatagagaaaaaaattgtggcatttatgaatatttttatatttttaagcgcctttttg

SEQ ID NO: 39389 - DNA, 894 bp, Heterodera glycines
gcctttatagggaagtggccataaaatcagttcgtttaaagagcgaactgcactttattttcatattagccgtcaggccccgacttagcttcaaaactggtaaagccacacattctctatcattatgaattttgatcgcctcacttcccggcaattcatggccgtaaaatgcgttgaatttcacaacttttgccatcacatgcaacttgtgtttttattttcaacgccgtgttggcgttgtgaaataaatcagatactgtatccatttgcaatttggacaacccttttctatacaaaaaactgggtttacggtcatacagcgaccgccatcgcctttatagaaagtggccataaaatcagttcgtttaaagagagaactgcactttattctcatattagccgtcagaccccgacttagcttcaaaacagttaaagccacacattctctatcattatgaattttgatcgcctcacttcccggcaattcatggccgtaaaatgcgtttgaatttcacaacttttgccatcgcatgcaacttgtgtttttattttcaacggcgtgttggcgttgtgaaataaatcagatactgtatccatttgcaattaggacaacccttttctatacaaaaaactgggtttacggtcatacagcgaccgccatcgcctttatagaaagtggccataaaatcaggttcgtttaaagagagaactgcactttattctcatattaaccgtcagaatgcccgacttaagcttcaaaacagggaaaagccacacattccctatcattatgaattttgaacgcctcccctttcccggcaaattcatgggccgaaaaatgggtttgaatttcacaactttttgccaatccctgcaaacttgtgtttttatttt

SEQ ID NO: 39390 - DNA, 1684 bp, Heterodera glycines
aaaaaaaaatttttttggtctaaattttttcaatttttttttggtttaagaagacatgaaacaaagtacaccgggtttttcaaagtcgctgatcacgaatatgacaattatttgggcctatgtttgggcctgagttgtttatatgctcattttaattctaccaaattttcttaataaatttaataattttgaaagtccaattctgggtttatgtttatgtataaaaatccatccctaataattattaacttttaattttcaatttaggtgcttgcttcggagcgtctacgagaagtactcgtcgatgaggcatccaatcaatcggcttgccgaaattatttccattgacaccatgaaaatcgtaaagatttttttacattatcaattgaaaaatgctactttgaattatccacatgggttcagggggcttcggtatgaaatttatgagtggttggatatccaacaagggaacatttcgaactgtaaccacccagatcacttagaaaaatcgataaaaataacaaatttttaaaaattcataaaaacttctaaaataatgatagagcaattaaattaatttaaaatgataagcaaacaattctctatgaaatagcatcataaaataaatttttttaatcggtaaaaaaaaaagaaaaacaaattgacttgggttacttttttctgctcggttcgagttcgtttttatgtaattttattttctatttaaaattgtgtcttttattatcttcccattaaaatctttgacattttttatctcggtacacatgcttatttggcaaatattttaagtccttttcttaagaatccttggtgctctacccacccataaaatttcatacagtaaagccgtgatgtcccactacccagtgcttatgagggaaattagtccagggggccctcttacgcgtccgtaattaggcccctcagggcttggaagggaagggatgttgatggatgcctgggggatcctcccaggcggggatcgattggccgttccactgaaatggctcccgactgatccgactgcccctttgactggctctccattgccttttaagcgcccctcgggatgggaggagtttatcggagtaataaatgtgcgtgggaaaataaaatgccatttccggtccaggccttacaataccgaaacccaacgggcacctgaggatcctcctttataagctattccttacttttgcatgcttcttaaggctatgattggaggaatgtgcgcaaacttcacattttcgggcgatgaacacttgattaagagggaaattgaaaaaatttctgaatttgtgaaagatatcacgggcaatgcaactcaatggataagagcggaactcgtaagtagcaattaaaattattatgcaattatagctgggattaaaaatgacaaaatagcttaattttttttacgatttcatatattgaattgatgcgtcaattacaggaaaactcctggccactggaaataattcggcatgtcaagatcgggataaagaatccagtcatcgacccatattcgtacaattataccgcaaatctgatcgatgacattgttttcgcacgtgggcctttcgggtaagtgaaacaatgacaaataatcattgatttctatgaataatcgctctgaacacttttatataaacttgatcaaacc

SEQ ID NO: 39391 - DNA, 1317 bp, Heterodera glycines
agggggggaaaaactcacgatgatccgggaaatgcattaactcggagtgtgtgatgtgaatgggcatcactttgtgcattaccatgccaaagtcgctgcctcgcgcgactctggccaagccagcctcgagcttctcaagacgaaccgtcaggtgcagcttcagcttgtcattggtttctgtaatttgtgagagtcacattggacacgaggaataatccagaaaaaaataatatgaattctaatttattgggggcattcattcactcacaattcatgcttttttgtttactacccccccccccccgccggtcattagcagtgaccgccattcatcccccttcatcagtcagcctcattgttcttccaccgactccccccccccccccagtaaataagagaaaagagagctaattcttgagcatattgggccgctatctcgtcccaaaaaataactgttttttcctaaaattaatttaatatttatcactcattcattttccacaactcaactcactcaccaccaccatttcacttttatgctgctgttcactccaaaattcattcattcactcacccattttcaccaatcgataagacaattgttttatttacacaatcactgcgcagaaaaaatccaacgaaacaaaataaatttaatctgtcacaacaaatgttttttcgtctgttaaataaaagtgtccgttttctgttgttcgtgacaatcttctgttttgtcgtcattattttcgtactttacacattcaacagtttgtcatgcgaaagtgtggcacaaattgaattggttttaaatgaacggttgcacagtgttaaacacggaaggagaacagcgggtaaaatgaagagaaaaacatattttagaccgaaattctctaattttaatggcactaaagaagcattgtcaattatcacgaaagcaaaataatcagcctttgaaaaactgatcgcttaaaaatcggattttatattttaaaacaaaaacttttaaccaagtgaataattttgtgttaatttttactcaaaaattcttggctttttttccataggtccgagcaaaaacattacgctgtttttggctattaaaaaggaggaagatttgctctccgaataccgattagcgcacagaacactccgatgttattgcgcaatgaaaaactattcgctaattgatggtggatttttccacaattgggacaatgggaaaactctgtccacaaaaagatgtgtggaatattttttggcacatggtaatggataattttgttcgatagtttatgttccgacggcactgcgtcctgt

SEQ ID NO: 39392 - DNA, 904 bp, Heterodera glycines
ttcaaaattttttccattccctaagagctgcggaaatgggaattaaatctccgaaaaaaggcttctctttttaggacaattttctatctcgtaaccccgatgctaatccgttccggagagcctcttcaaaattttttccattaccgtaagagctgcggaaattgtgaattaattctcagaaaaatggctatctctttttaggacaattttctatctcgtaaccccgatgctaatccgttccggagagcctcttcaaaattttttccattaccctaagagctgcggaaattgtgaattaattctcagaaaaatggctatctctttttaggacaattttctatctcgtaaccccgatgctaatccgttccggagagcctcttcaaaattttttccattaccctaagagctgcggaaattgtgaattaattctcagaaaaatggctatctctttttaggacaattttctatctcgtaaccccgatgctaatccgttccggagagcctcttcaaaattttttccattaccctaagagctgcggaaattgtgaattaattctcagaaaaatggctctctttttaggacaattttctatctcgtaaccccgatgctaatccgttccggagagcctcttcaaaattttttccattaccctaagagctgcggaaattgtgaattaattctcagaaaaatggctatctctttttaggacaattttctatctcgtaaccccgatgctaatccgttccggagagcctcttcaaaattttttccttaccctaagagctgcggaaattgtgaattaattctcagaaaaatggctatctctttttaggacaattttctatctcgtaaccccgatgctaatccgttccggagagcctcttcaaaattttttccattacc

SEQ ID NO: 39393 - DNA, 912 bp, Heterodera glycines
tttagtgcaattttaaaaaattcataactcgtgattgggagggtggattttcacgtgtcaaatatttaaaaataatttgaatatttcttttaaattatttaaatttattttttttaaattaaagaatttcattatttttttttgaatttgtaaaaaaattaatttaatttcaaattaaataaatattcaattaataatttccaacgttgtttttaattaataaaagagtattttattataaaaaatttttaaattaaaatgcattcgatttttataaaaacttttcattatttatttaattttaaaacatgttgtacctcttctgatcactgttgtacctcttctaatcattgttgtaccttttttaatcactgttgtacctcttctatttactgttgtacctcttttaatcactcttctaatcgctgttgtacctcttctatttactgttgtacctcttttaatcactcttctaatcgctgttgtacctcttttaatcactcttctaatcgctgttgtacctcttttaatcactcttctaatcgctgttgtacctcttttaatcactcttctaatcgctgttgtacctcttctaatcactgttgaacctcttctaatcactgttgtacctcttccacacatcttccaacaattttgtacctcgtctgagctcaacaacatttaaatacgggcgcgaagcgcccgtttggcctcaacaaaatttaacaacgggcgcgaagcgcccgtccaagctcaacaaattttagaaacgggcgcgaagcgcccgttcgaggccgcgaaacggcctaagaatcaccaaatttaaaaaacgggcgcgaagcgcccgttagaggccgcgaagcggcttaaagccccagataatttgttaaaaattccattctccacaaagcg

SEQ ID NO: 39394 - DNA, 1335 bp, Heterodera glycines
  misc_feature (1205)..(1205): n is a, c, g, or t
  misc_feature (1302)..(1302): n is a, c, g, or t
ttgggacatatttttcgttttttattgcattttttttaaaaattattaaaataaaaatcctaaatacatgtaaaaatagataaaattgacaaaaagtggcgtaattgttttgtgatgaatgtgctaaataatgattcctagtgacgaaaagtggcattaaaatggatttccgggataaattctgtttttcatgcatttctcagtgaaacaatgccacagaaaaatagttaaaaaactaaaatccccgctacattaattagttaaattatttttcagatttgtttaaatttaattggttcatacacatgcacctgcaatgaaaactttcatggagatggatttaattgttcgagtaaaaatttatataataatttcattcttatttcattttataaaaataaatttgataatttttttcataaaaatattttttggtaattttttcattattctataaaaaagattctgttttagttgccgacatttgtttagcccgtattaaactcaaatgtgccgcaaatgctcactgtgattcaacaaatgaagaagtaatttaaattaaaattttttttaattacttaataaataaatatccattgaattcattcattagctgccagaatgcgtttgcaatgatggattttacggagatggaaggcgaaagtgtgagcaaaacggtacttataaaaattcaaaattttaataattattataaaaaaatctgaatgcattaaacatattttttttaatcgattgctattaattttattgaaaagatattggtaaaatttcgaaaatttttaacaattttttgtataaatttaatggagatagcaaaattctaactataaattccatatgtaacaaaaccctcatacctattgttttttggggcataaattagttaaacattgaactccaaatctaaatcaaaatttttgtttggattaggcgttcggaattaaaaaaaaaaattatataaatataattttcgtgaacagtgggattttcaaaatactaattctaaataaaaataaatatatatagtagtaaattgcgtttttaaagcatagttagttataaatgcaaattttattaacttttcggaaaaaatgaaaaaaatgtacccaatttttacattcaaaaaataataaacataaaatatttagtaaaatttagacaattttaaaggaatttccaccganattacaatgaaaacaatacgaatatcaacaactacaacaacatcaacagatgcaccacctccccaaacaacacatacagtaacagcttctacagttnggtcctcactacagtatccttgaccgtattcac

SEQ ID NO: 39395 - DNA, 1026 bp, Heterodera glycines
agtttgatgttattcgaatgagctagacgcgctctacattttcaaatgtatcaacaaagggtctaccgccactccctggcgagatatggcctgtcaaagcagaacggggccaataaatttgaatttttgttaatcttcggcagttgcctttatttcgagcctactctacttgtgcatcttttcccaatatggcactgcttccgaattattgaactgtttcacgactgattgttgagataatttttttttccgattcctttatctccaagcatgagccttataagtgattgttcatatccttctcttgaaaaaaattgtcactaaaaaaaacacgttttctgaatattaacaacaaaaatttttagacactttctaaagaagaaagaaaaaaatttttcatttgcctaatatttatttatactgttgaactgttggaaatgcagctgatgccgtcggaaaagctccgattttttggggaagtttttttctttcagtttcaccactgatggttgaggcaatttttttcgccaatttcttttgtctacaaacattatttattgcgtttcatcctgtagtgtgtaaaaaattttcagtaaaaaaaacttgttatctgaatatttacaagcaaaatttaagaccatttccaaagaggaaggaacaaaaatttttgcctaaattttatattatattgttgaattgtttgaaatgcatctgttgtctgccgttttgaaatttttcaacttttcgcgaaaagatttcccagaaaatgcatgggacaaataaaaattaaacttctattatgatcaatttaaatttcctatcagtttcgggtttgctttaaacacgctggcctatgaaaaaatggagttttatggatgtcaaattttgggacttttcttcgacgtggtcatcagcgggttgtttcgtgacaaaaacaaaccagtttgatgttattcgaatgagctagacgcgctctacattttcaaatgtatcaacaaagggttctaccgccactccctggcgaga

SEQ ID NO: 39396 - DNA, 1756 bp, Heterodera glycines
  misc_feature (1712)..(1712): n is a, c, g, or t
aaaattttaaattttatatccaattttcaaaagtaacctgaatttgccgctcgatttccttcctgtttttttgggtcctctgctgtttggttgcttgtgagtgttttgtcctcctcgtttgcttccagctccagtcgttcgtgccggtctcggcctaaacggtttgcgaggtacggtcgtcggcagagcagcaacctccgcaacaaccttaatgataagtaattgctgaaagcactggttaattgactcacttccgcaacggttgattctcgcgtgagttgagacgaagaaatgccgttggaagatgaggacggagttggaacagtggtggaagtgactccggaagaggacgggcaggcgaagttctgactgacttgccgcagggaaagcgaagcaggctgaccaaccgggcgacgatgaccactgctggtggggctggttgtcgtgttattcttaacggactaagcagtttaaaaccaaataagagccaaaagaccccgagattgctcgtcgtatggccaacttccaccgcaacagcggacaaattggcactaatggtggttggcgtactaatcctagtggtagcagaacaagcgcttgggccattgttaaacgactccaaattgttgagaaaattctgcacaccaatgggaccgctgcaattgctgacagtcgtcgacatttggtgttgtacgggggaagggcctggcgggggattttgaacaccagcggaggacagcggactgtgaagtgcagcggcagccgcagtcaccggactcatctggcggactatttcgcttaatgcggacccggacgcaatgttttgcagcgtggagatgtcctgtggaggaatgccgagaaagttcattcgagacagttgagcgagaagttgttgggcactgagttgtcgggaatactgcgtttgtatctcattgatcatcagatcaagctgattgttggcaagcgcagcaaccaacgcctaaagcgttaaattgaactaaaaacaaacaacgcaaacgtgttttatctacttggtgttgttgttggaatggctgcgactgttgcgcggcaacattttggtgcgttgtggcaagttgtgcctaaaacaaacagtgaaaataaactgagacggctaaaaaaggaaaacggctaaataattgaaaatttgaaaggggaacgacgagagaatgaaatgtacattcatttgttcgtggttactaacctgtacagcagctattagttgctgctgctgttgttggacgatcatttgttgctgctgctgctcaatttgctgagtttggctgtccttctgttgttgctccattcggtgctgcagtctcaactcgttcaaaagcgtgtccatttctttgtttagctgacaatgagtgtgtacagatttgacatttgtaattagacaactccgcgcacctgttgaacttgtgcttggtattcttggaatttgtctgccacacttttccgacattcttcaactcgttttgcacaatttaccaatttgttcatccccgtcctttctctcgcatcaacaactgctgaatgacagctgccaattgattcgtcttccgccaaattacatttgacaggcgtttgatcgagaatagagcgaaactgtacattattcggggggacgacattcgtcgaattggcatttcggagaagtgtcttttgaattgttagcacgaagaggcgactanaagattatttcattaataaagtggaaataaaatttaacaaaatg

SEQ ID NO: 39397 - DNA, 760 bp, Heterodera glycines
  misc_feature (438)..(438): n is a, c, g, or t
gaagaggcgagagtcccccctccggggagccctggcctaaaaagaaaattaattagcaaatttaagcgccgaaaagcagtctattaatgggaatcaattcgaatacaccagcagaagaggggttttttatagccattttaaatggaattgggccaaaattaggcagacgaaacgaaactcccccccccccccccgttctctttcaccttttacctgctgaatttaacaaaggcatctgtgtgcaagaaagaagcggaatgtgagataaagtgggataacggacttggtagaacccctaaaggatttgaaagggccgtgggttcgagtcccactggcggcgggcgagttaccctttatgttctacaaaccagcaaaaggttgtctgtcgcatttatggtgccggccaaattgagcccggttactatagacccccccccncctttcaggtgattgtgttcatcattcctctgatttccttgtccgcctcctatttgctgatcgttgtccgcgtccttcgctattcgcttcgtcctccgcccaactccaacctttgctccttcaacggcttaaaatgcgcggcccaatgggcggccgacgatggccaacagacggactgcgaagggacgggcgaaggcggcggacgatggcacagggccagcaaccggcggggccgaagaagtgccaaaacgaggcaagaaagagtcaaatggcaatgatgcccgagggggaggggagggaaactatgccaatcacactgatt

SEQ ID NO: 39398 - DNA, 1269 bp, Heterodera glycines
gacccgagttcagaaaaattttgaagcctcagatttatttcccctggtatcaaaaggaggctggaaagcaaatgagatcaatttcgactcagttttcctcaccatgcttctccaacacttcggcaatgcccgtgtcgcctgctccggccggcaaattgtcgtcgggcacagaaagcccggcttttttcacggtatgacgatggatttggtagagacggctggacaccgaagtgccgccaatttgacccgcgttaaactcaatctgatttttttatttaaaataattaaaatattatatttaaaaaaatgtcttaaaagtccaaggaattggggtttttaccgtctctcgtagttttggatgactaatcattagttattaaaggctataaaaacacttatgattattagtagaatatggactcttgcactaaaaaagccatattgggtaggctttagatcttaaaagtcgctgaaatgggcccaaattaaaagaaaggcttagaaaagtccgtccattaaattattttttctttttataaaaacttttcagttcttttctttctttcattattcttagtttacctgtttaagttcatattgcggctcctcctttgatgtttcgacattattttttgcctcatggcacatataatccttaaattaattaatttttaatttttttcacatttttatgccataccgaacgtgccaacataatggattttgtttgtttgatgccttcttcgtgcgttttcttcaaaatttgcaaatgcattcggatttgttcgttcgtttttgccagttctacataggtttctaccaaaaattcgtagtcatttgatatgcgaaaatataacaaattaaaatccttaacaaaaaattttttgttaaattcattattaaaaaatattttttaataaattattgtttaatatcacatattttttaaaatttaacttttcttttaaattatttcaaaaatatttatttataaattgttgtctaaacaaaattcaaaatcaaataccatctgcacatttttcgcttgttcaaaaagttggcgcgggaaaggcgacgggaaaagagaaaatgcgacaatttcagccgtgtcacctctgaaaatttaattaatgagaataaaaaaaatatttaatttgtttcttaaattgttatctattttaattaatttttgaaatgagtttcaatttggaacacttaaagcacttcgaaagccttctctcaatgctctcaatttttcaatttcattaa

SEQ ID NO: 39399 - DNA, 1696 bp, Heterodera glycines
cctagtggctagtctccttgactttcccttcttctttcttctgtttcaatccctctacacaaattaaattattttgaatttttttttgtatactcgtgggtttcctattaagaaaatatgattcctcatagtttttttttaaattgatacatattttattattttttaaatgaaaatcctaccaattgagcttaataatcgcaaaaaccaacctttttttgttgaaaatctgttaacaaattgcacccaaatttcaaaatttcccccagcggcgcctatcggctccgacggaccgctttcttccccaaaagttttttggaaaaaacgccacgaaaaaatttatgtgaaacgtaaatctgaatttctataatattcgatcatttagtccaaaaatgattaattgtttgaaatgactgaagacaatttgatttgaaaattttcattaatttaatttagctttaacttttggattttattaaataaaaaaataaaatttaatttttgtactattttcagttgaaataaattaaaatttgaacttttttgaattttttatttttttttgaatttttaaaatttcccggttggtcccggttcccggtcccgaagaaaaatcgaggtcctggtcccggcatgttccggtcccggttttcccaaaattcccggtccaggcgcactctaattttttgagtttctcgctcgtttggaaatttaatttaattatatttgttattctttagatttttaataagttttaaataattaatgcagtattttaatttattatatttttttaataactttaaaattttttttttctaatttatttttttcactgcttcaatttttagctttttagattgtagcacattttcaatattttattgcttataactaataaaattttgttttgtctgtaaaattataaaatatttaattcatttttttgtcggcatggtcaagtagtcattttgatttttatcttttattgaaaaaacaaagcactagttgagtgtaaaacataatttaataagtgattaattagccactcaaatttatgctatcgtgacagtcacaggagggagctggcactctttaaaagattaaaattttttttttgcttttttcttattatttaattttgccttgtcaaattatttttttcgaattattatttttatttcccgtatatattttttctatttaattttaaaggcttatatttatttgttttaaattatttaaaaaattatatattttttcttaatgacaaacccaaatacactatttaacattaatgatgaactcatattaattttttattgtaatcattagcatttatacatgtaattaataatattttataattttttatattcacgagtttgaggaaatttaatttctattatatcatttttatatttttccactcgatttaaatataatattaaaattagattattctcttattttcaatcgaaaattagatcgagcgaagatagtattgaggctattataattaatttaacgatattatctgcaaaacaataatcatttttgttattttttttatttttcatatttttgattattaagtattatcaaaaattttcaaacttagcccaaaaatttttgtttttgtaatgtgtttataagggttttatattttcgtatttgttaaatttagagaaggcca

SEQ ID NO: 39400 - DNA, 853 bp, Heterodera glycines
atcatttcgctggtcttttgaaaactgaaaaagtcacttacgaattaaattggccatttgcaaatcaaattaggtaacattttcatcaaaaaatcgattaaacaacgaaaacatacgccggagtttccttgacagttttcagtccttgtgccatttcgctggtaatttcgtttaacggcgaaattccaagctttcgtttcagttgtgccacgtgtttctgacgcgcggttaacagctgacgaagtgtggcgatttcattctccgtctgaagataaatctttagaattcaaagggatttgctaaattttgtcaaacctttttcagttcctcgatcacgagttctctttccgcatcggacagttcggcggagttcgaatttgaagtcggatcttcagatgctaaatttgctatatgaactaatgcttaagtgtataaaaacaattctttaattgaattccaccttcaattcctggagttgccattgtttaatgttcggttggatttgatgaaatagcgaaatcaaaaatatcaacacaaggcaaaattggaaagggctttacagtttgcttgacagaaaaataataaaaaaaggcctggattagctttttaactatttttgaacaaaaaatgctaataaaccttcgataaaactttaaaagcttaatttggcgtttcgtagtatatgaacttttttctcggacatgattatttttagtgcggcacactgacaattttttgttttcttaagtcattggaaatgtgttttcgagtgttttcgtggtcactgatcatgaatccgacatacatttcgaccaattccgaatcccagatccgaattcgattttgggatact

SEQ ID NO: 39401 - DNA, 1549 bp, Heterodera glycines
  misc_feature (1516)..(1516): n is a, c, g, or t
taattatataagtaataatattaataatttcactttttccgctttgaggaggaagagcaattttcgaatttgaccagtcgactcccgtctcaccaagaaagcattcacatgaaacattggcagacccaacgtccgtttgcattacgtttgcccttaggctacattcatcgctccaaaccgattgagcacagccccaataaaggaacacatttcccggctgatcccctgtaaaatggaaaaaatttccaaaataaaaactgtattttaaatgtatctacaacgaaatgttgaaaaaagattattcgggctcggtattttgggtctcgggttttcagtctctgtctcgagtctcgggaaatttttggtctcgaacagttgggtacctcagaaaagtgcttatgatcccgagagcgagataaaaatgaaaaaaataataaaaataattaattaaccaattattgccaaaagtgattgatttatggaatatcacagcaaaggaaaaatgcaataaatttaattttaataataattaaattttgtcattgtacatgctgagcaggtggccgcaaaacacagctccttatcaggtaagcattctccatttttcacaatagtgtattcctggtttggcaaactttctgcttttccttgtttgcagaacaatcctttttttgaaaacacatcaaaatttaattaattatagcaattaaaaattaccgaaacaaaactgcaaaagcccgaataaaaagaagaaaaaaacgaacactgtatttgctttcatttggttttcaatttcaattgaatgccaagattggcagtctaaaaaggttttgtaaagcaaccagaaaattgaaaagtttttttcattaaaagggatttaacggacgattcatttttaaattctcattaatcaccctttactaaaatttggattggtgtggtgtgattagaaccaaaaatttgataaaaattattatttttctttgttattttagttctaattcataaaagcgaccaaatgagattaactaatgaatgctagtcaacatcagtgaaatatttttctggacataaaatgatcaatggtgactgtttgttcactttgtgtgttcattaacataaattcatctgatttttccaatgggtgaaataaaaaggcaaaaaaatatatatattatatatatttatttttaatacaagtataattgaattgaattgaatgaataaatgaatgaataagtggcaaacaaaaattttcgagtcttgaattccggagaacaaaaacactgaaattggattttattttatttaaaagtaaaaatctctctttactcattaaactctttttttactcattgctagggttggttttttgcgcatatgctacttagactaaaaaaaaaaatttggtttggttaagatttttggtccatatattgaaaaaaatgaaaaaaaaagaagcgaaaaaagacccctaaggatcggtctggaaatttttaaaaaattataaggccanaaaaaacacaaaaatttgcgtgttttcgttatt

SEQ ID NO: 39402 - DNA, 957 bp, Heterodera glycines
tgccaacgaatcgctcgtcggactgtcggcgaggcaaaggtccaaaacattgttgacacgaacctttgtcctaaaaaactaactaaagatttccatttaaacaccaagagtaattaatgtatggaaaacctatttttccgtaaaagtcactcaaaatttttaacaaaaattactctgattggaattagattttaacaaaaaccgtctatggtttaagcatatttcgacgttttaatttaatttgaccattttgagtgtcaaaacatttctatctgttaacgcaaaagtcgacaaatttgttcgcgttcgggtgatcattcctttatggtgaccgggacaccccaaaaacagaaaagcggcaaaatttctgcggaaaatattttttttgtttttgatcatttccatctgaagagaaaatgaagctgaaataataaaaaggagagagaccaaatcgaaggaaaaagaattgaaaggcgtaagaaaaaggaaaacaaaagaggggaccaaaagcgttgtcttttttaggcctaaccaacaaaacgcgttacctttttggtctgtcgcctttttacctttctgagtcggagaacacaaattttcggagtcgaaaatcgcgaaaaaacagtccaatgcgatggcaaaattcgaccagtgtggccatttgcttcagaattggcttcatccgcccttccgtccagcgaattgtctcgcaatttcttcggtcgggcccaacattttccccctcctccaccaattggtgtaaatttccatgatggtccggtaaaaggacgtagaagaagcccgacctggccgaactcgtggccagatgaagctgagagagcggaagcagcgaatcccttaaaaaggggggggggggggaattggaggggacaaaggcggggacagacggacctccgctgttcgaattcgtcgtcattgtaatgggccgatgccatc

SEQ ID NO: 39403 - DNA, 822 bp, Heterodera glycines
  misc_feature (11)..(14): n is a, c, g, or t
gggagagagannnngggggagagggagagtgagtgagtgagagagagagagagagagacaaaaatgatgaaattgggcagttattttttaagaaaacggacaggagaccggaacgccaagaattgaattttcaaaaaatagggcccgttggcgtgtgatggatgcgatggcttttcatcagaggtcctccccaaaaatcccccggggcattctttttggcccaaaaaattgcttttccttttgaacaaaacaaacaatacaaaaatatctgcccgatttaaaaagtcttttaagaataatgtcaacagttattttttctagcattttggtggaaatagtgtgcaaaatgaggagtgtgtgtgtgtgtgcaagggaagtcagagagacaaaaaagcggcaaaaaaacaaaggaacaaacaaacaaaatgccgcaaggcctaattaggtaatttgttttcagaagagtgcccagcagctgcattctccttctttagagagatttgtttaccatcgcatttttaatttgctgaaattgccccaaggcaacaaattgttgtttgaattatttggcctcaaaacactgaaaatgaaaaaaaaaacaaaataattttgaaaaataatttatttatacggcagtattcttcacctttacctaatattatcgtacacgcaaatacaacgcatacaaataacacagatacatacagatcacacaaatgacgagcgtgtctgtttcggattctccaaaaaattttttttttaatttcataaaaattttggcctctgtgaggggttgaggggcggaccggctcagttctaaga

SEQ ID NO: 39404 - DNA, 716 bp, Heterodera glycines
ccaactcgccgcggccatctcgccgcgagcaactcgccacggggccaactcgccgcggccatctcgccgcgagcaactcgccacggggccaactcgccgcggccattcgccgcgagcaactcgtcacggggccaactcgccgcggccatctcgccgcgagcaactcgccacggggccaactcgccgcgccatgttttttggcaatctcgccgccagaattttttcgtttaataatacattaaaaacaaactttatttattatgtattcaataagttatatttcatcaaagtttctctccaatttaatatgcttcaaattgaaagtcaacaaaggaagcaaaaattgccgaacgaatgattcctctatattttcgcaatttaatgtggatatcaatatgaaattatagtgatgctaacgaagagacgaatgtcgatgacgaataatacacacgtatttgaacaacaattttgtcaaaatggtcaaagaagaagcgaagaacagtgccaatgtgaaagtaaaaaaaaatcgtaacgggataaaaaaaaggcgtgcatgggactgtcttcccagctccgtgtcaatccattggtcaactttttaacaccggtgctggggatcaattgcaccggctaattggtaaaaggacgattcgtttttggccaattcgtttttattacgccgcattcttttttggggtaaaaattcgaaaatcgat

SEQ ID NO: 39405 - DNA, 607 bp, Heterodera glycines
  misc_feature (563)..(563): n is a, c, g, or t
tttcttaagatcccatgggtgctctatccgcgctctctaatagtattcggaaatcttcacggacacctggggtccttcctttgttagcgaaaaatgttgatttgcctttctctagtcataccggtatgtttataactttagagattacagaaaataattcatactaaggtacttatgcagtttagggccacataaaaaaattttggttttaatgataaaacgtgccagggggtatccgcggccacttatcacgaatatgacatccatttcgaccattttgaacccttaatccggactcgaataaagtcgaaaaacaacattttttttcaaatttagcatttgtttgggttgaattttaagttattttatgttagatgtgaactttatagaatatggtctgttgcattttattatagatttaactcaatttttggcaataaatgcgaattttgaaaatttttgttttagactttttgttcgagtgccggggttcagaaacagggttgttcccgggttaccctgaaacctcggcctttttctcgacaacgaaaccctgacccgantgattttgggtcgggtttcgggtcgaaataagcactggtaagaa

SEQ ID NO: 39406 - DNA, 1531 bp, Heterodera glycines
catcccacgaagcttcattgaatagatttttagaccgctggtgcacaaacgttttggtgggtaactccgacgatgtagtgcttcgagtaccagatgaaagtcgtattttcctcgtttatgagcgatacaaatggtgtgtgcttttcttgatccatgatggataagaaagtcgagaaattggtctacggggtcagaagcttcgttatcaaaagaatgaaaaaataaacgacggttgttgaatacaggagctccttccggctgaggagtattatccccaggagcatttacaaaaggtggtgacatccattgacgcatctgttgacctctcactcttccacataggcaaacgcaaccgggtgcgcgctgaccttgcccatcgttgatgttgattccagctcgaatgcaaggttcacaaatgaattcagcaactattagcaaaggtacatgtttatgggcgacttggttgttgagctgtagtgggcgctcctgggatgtttcggcatcgaagaagcaaagacgaagtggtagcagttcatctcgctcatcatcatcatcatcattaatatcatccccgttttcaacatcatcttcatcttcatcaccttctcctcccagattgttgattatgaaatcaatatcattttcatcctcattgttgttgttgttgttgttgttgttgttgttgttgttgttgttgttgttgttgttgttgttgttgttgttgttgttgttgttgttgttgttgttgttgttgttgttgttgttgttgttgttgttgttgttgttgttgttgttgttgttgttgttgttgttgttgttgttgttgttgttgttgttgttgttgttgttgttgttgttgttgttgttgttgttgtctgctgacgcgttttgttgattattaaaagtattcatttttattttgcaaaaaaaaaaaatttttgtgattaaaatgaagttttgcgtcatatttgcgtgcttttatatagcgaaaaggtacagtgctgcgcgctacgtgaaagacaaagttacggtgctcctacgcacatataaaagcgcttgaatgtgcacaagatctcacttgcgtgcaatgcatttgcttatcgcattctcgcgcattttggactgttcccctgacgaagtgggcgcgcgaatttgctgtagtgttgcggatcgagaaaaattgttgaaggaatttgcacatcgtaagctcatcactacatactccgaccgtaatggcttcacccacacactcttctttgctgggctcactgaagagggcgccaactcagtgcttgcttatggtaacctgatgcaccctacaatgtttgcgttgccgcccattattactcacgacatcgtattatgctaaagtacccgaaattcccatgtgtaattgagaagtgttttggtcaaagggatgatggacccttgcacaaatattacccgcttgaactggtaaaagtcgtcgatgactgttttccgcctgtgtacgcgagtttactgtctcaaaagcgtgacggctcaacgtcat

SEQ ID NO: 39407 - DNA, 1156 bp, Heterodera glycines
tagtcaaaaaaaagggaacagcaacaactcgccggatggttgactcgccgataaataacagggctcgagtcgaaaagttttcaaaatcagaacaacgggcccaaaaaatcggactttgtggtcgagaaacagaatattctccaaaaattgcttgtctaataatttaatcaaaaaataattttttaaataaaataaaattagaaaaaaattttgagttggaaaaaataggaaagaaacaaatcaatgaatgacaactcgtctggtatatcctcgtattcccttattagggttctttctcttttctctctctctgctcgatttattcctcacgtatttccttgttaggggtttcctcacatttcctttctttctctttccctctctctgcatatttctttcgctctctctgttcgattcatttttattttccccacttcctttctctcactttatctctctcttattctttcactatcttcccattcctctctctctcctctatctctctcctctatctgtctgtctctctttctcttattattatcccctttcactcgctttctctaaaattatttctctcgctcattctttctgtgtgtttcttttccatgctctacctttttctctcaatagctctcgttctgctctcgctcttttcgcttcctctttgctctttcttttttttcttttctctgttcctcacacatcacttttccattttctctctctctctctggtttcgtaataatttaacaaacacgttgtgtgtgtgtgtgtgtggaagactgtgactttgattgtttttgcctattttccctgttgttggcttcaataagacgactgactatccacatatacctaacttacaaaattggaatttatacggtttatttagggtatatttctgtttcatcatcgcaatctaaaaattcaaaaaacaaaaaaaatcgacaaaattataaaacaacaaaaagttgacaaaacaacaaaacctacctaaaaatacgtcctactttgtttcttcacgtttctgtctgataaaagggtttggttttatttttgttttaataaaataatgcaaatgatacatttgtttcttcctggttttcgttttacgaaaacttgataataaacttactaccaaacaatccacatt

SEQ ID NO: 39408 - DNA, 854 bp, Heterodera glycines
  misc_feature (44)..(44): n is a, c, g, or t
tttcttgtgattcacctataatcttcagtaataagttctcagtnttattctttaattctataggtaaatcccgaaaacattgcaccaattgacttttctccggattttaagcccgaatgttgaattttcttgtgattcatctataattttcagttaataagttctcagttttattctttaattctataggtaaatcccgaaaacattgcaccaattgacttttctccggattttaagcccgaatgttgaattttcttgtgattcacctataattttcagttaataagttctcagttttattctttaattctataggtaaatcccgaaaacattgcaccaattgacttttctccggattttaagcccgaatgttgaattttcttgtgattcacctataattttcagttaataagttctcagttttattctttaattctataggtaaatcccgaaaacattgcaccaattgacttttctccggattttaagcccgaatgttgaattttcttgtgattcacctataattttcagttaataagttctcagttttattctttaattctataggtaaatcccgaaaacattgcaccaattgacttttctccggattttaagcccgaatgttgaattttcttgtgatacacctataattttcagttaataagttctcagttttattctttaattctataggtaaatcccgaaaacattgcaccaattgacttttctctggattttaagcccgaatgttgaattttcttgtgatacacctataattttcagttaataagttctcagttttattctttaattctataggtaaatcccgaaaacctattgcaccctaattgact

SEQ ID NO: 39409 - DNA, 1136 bp, Heterodera glycines
cgtgcagccccggacatctaagggcatcacagacctgttattgctcaatttcgtgcggctgaacaccgaaaatccctctatgaagttgtgcccacagaagcaatgagccaactatttagtaggctagagtctcgctcgttatcggaataaaccagacaaatcgctccacgaactaagaacggccatgcaccaccatccaccgaatcatgaaaaagctatcaatctgtcaatccttacggtgtccgggccgggtgagtttccccgtgttgagtcaaattaagccgcaggctccactcctggtggtgcccttccgtcaattcctttaagtttcagctttgcaaccatacttccccccggaaccggaagacggtcgtttccgggaagctccccaccagggcgaataaatccgccggcggatcgctagttggcatcgtttacggtcagaactagggcggtatctgatcgccttcgaacctctgactttcgttcttgattaatgaagacattcttgccaaatgctttcgctgtagtccgtcttgctacggtccaagaatttcacctctcacgtagcaatacgaatggccccgtttgtctctgttaaccattatctcggtcagcaaaaccaataaaatcggaccgaaatcctcttctattattccatgcacgaacattcaagcgaaacgcctgtttgaagcactctgatttgttcaaagtaaactcgccagcccaccgacgccgaccggtaaaggccaacgccggggaaagaccggcagaaaagccaaccaaaccagtaacacacaaagtgtgcaccggacggctagcacagatccaactacgagctttttaaccgcagcaataattctatgcattttgagagctggaattaccgcggctgctggcaccagacttgccctctcatagatactcgttaaagggtttaaattgtacccattccgatgaccggcctcataagagatcggtctcgttatttctcgtcactacctcctcgcgttgagagtgggtaatttgcgcgcctgctgccatccttagacgtagtggccatttctcaagccccttctccggagtcgaactcttatcctcggtacccgtcatcaccatggtagtcagatacacta

SEQ ID NO: 39410 - DNA, 976 bp, Heterodera glycines
gggtattattttgtaaaaagtcttttttttcccaataaacttttcataccccattttcgcaccgtgaatgttatttttattgaattctgaaccgttttgagtagattagagtacaaataattgaaattttgaaatcatgtttcccactcccttctcccaggggtattattttgaaaaagtcttttttcccccaataaacttttcataccccatttttcgcaccgtgaatgttatttttattgaattctgaaccgttttgagtagattagagtacaaataattgaaaatttcgaaatcatgtttcccactcccttctcccaggggtattattttgtaaaaagtcttttttcccaataaacttttcataccccatttttcgcaccgttcgtgttatttttattgaattatgaaccgttttgagtagattagagtacaaataattgaaaattttgaaatcatgcttcccactcccttctcccaggggtattattttgaaaaagtatttttttccccaataaacttttcataccccatttttcgcaccgtgaatgttatttttattgaattctgaaccgttttgagtagattagacaacaaaaaattgaaaattttgaaatcatgtttcccactcccttctcccaggggtattattttgtaaagtctttttttccccaataaacttttcataccccattttcgcaccgtgcgtgttatttttattgaattctgaaccggtttgagtagattagactacaaaaaattgaaattttgaaatcatgtttcccactcccttctcccaggggtattattttgaaaaagtcttttttcccccaataaacttttcataccccatttttcgcaccgtgaatgttatttttattgaattctgaaccgttttgagtagattagagtacaaataattgaaaatttcgaaatcatgttcccactcccttctccaggggtattattttgaaaa

SEQ ID NO: 39411 - DNA, 1079 bp, Heterodera glycines
ataaaaataccgggataaagcacattagatagagcttaaaattctctacaaaaatgctctaagacaatttttcgctaaaatcaacccctgacgagttataggcccgggactgaaatgtcccgctcaagccaaaaaaaatttctatttccggaaaattttgaaattttttcaaaaatgccaccaatcgatagagctcaaaaaacggttgcttgaaagtggtctccgttttcctgggaaaaatcggcaaaaaataataaaattcaaaaacgaaaaattttcgagggggcctagctcgaaaaattttgaaaattttcaaaatctgaaaacgccatcggatgcagctttaaaaactgcacaaatgctcaagcggcgccaacccgctccgcttaacccccagcgagttattcccgaaaaacggaaaatgccgaaattgggtgccaaattttgccattttctgcagcattggcatttacagatagccccgccaaataagcgccaagttttcccaaacattccaacttaaaatcctacctccaagcattttccgctcccgcttcttcccgcaaagttacaggccaccaaagacggacaaaaaaaatttcacgccgtttcagcgccgctggcgctcaactggccaccggagcggaaaacctatagttttcctgaatgcgcctcaaaaagttgtaagacccttccaccactttcagacccctcccgacagccgttcgactcaaattagtttttaagacgaaacccgacttttctctatatatgtataaactagcgtgtgggaattgacgggggcggcgtaggccgttgggttttggatgaagagaaaatggacatgctcatttgttattttaaacagacaaacattaattgcattagtgtgaagttttaaagcgctatcgcgctatgggacgcggcttcgccgcgtcgctagaaagtgatgtaatttagcaattcatcgcagcctcaggacgggcgctcgcgcccgtgtttttaattttttgaggggaattcggccgcttcgcggcctcgggacgggagcttcgcgcccgttttttaattttgtgggg

SEQ ID NO: 39412 - DNA, 931 bp, Heterodera glycines
agagcaatccaagccagtttgccatgccaactgttttcacattaacatattgagtgcaagggggtgatagcctggagcatagtattgaaactggtcggcccttatggggcctccaggttattcgccacttagcgattatcatgattatgtacaaagccttggatctctaattgcataaatcaaacgagctatagtccatgtgggcggtactgaaatatggctattaagtgctgccacctggactaaagggagggaggagggatgatgtgcgacttagggcacttccggtttcattgcattgaaaagtgcaatgtgtcagcttattaagcgagcgaaaccaagtgcatgtcggatgacgcaaagaccctaacaaaaatttttagtttgctattctgaaatgctgtttcgcggtaaagggtgtgggtcgtcaatagaaggaactttctccatagtcaaaaccaattgtcgtgtcgattgcctcggggagaagaccgcattcaaattagaaggaactttaattttgggcttggcccaatttccctcccttttttcccagtaatcccccaggaaatttgccatctcaatgctatcacagcaatctcggacggatttgttgatgttctccattcgttccccatcacctcgacgccaattccatcatcacaatgccgttggccatcactgactccccacttcgctactagccgtcacacctgacccaattcgttgctcgaccattggcccttgctctaatcccgcccattctgcccacccgacgcgcacataaaaagaaattaagccccgccacattatcgctttcttccggccattcgcagccaaattttcgacaaattccgatgaaatctcaccattttcttgttcactaatttcgttttggcaaattttcacaaaatttgcttgtttttaaacg

SEQ ID NO: 39413 - DNA, 814 bp, Heterodera glycines
  misc_feature (9)..(9): n is a, c, g, or t
aatgaattntggcccaaaaattgggcccaaatcaatggcatgccaaatttagtcaaatatttttgccaatttttgggctatggtttaatgaaagatgcagacccaagcgaaaatgatatcaaaattgagctgccagcagaatggaaaatattctgcaaaaaatacatggaaaagattagcaggaaaatcagtggttattccgaacaactcaaatccaattgtaactgatcagtgatcactagtgatgcaaattatatggaaattattccatttttcctggactgatggaaggcatgaaacgaacgaaaaacattttttaagcttggtttgaagcttctagcatgggtttctgtaaacatatttttccatatttcgcgatttatttcctaaaatttggtaaatttagaaaaagttgtatgaaataagtactatttctgccatagcttatgttaaatttgatagttttattttaaatttgattgttttattaagttttctaggctaatagagaaaaagcttgcttattgaatggtaccaagaatgtaaaatttaattgcctttaagcaaagttatataccatgttttgtcgaaaaattcgctaaaatggcggatttcacgaacgacccagcacggttataaactcttttgtggtttgtctatactattatgggttctatcctccattgtccatgttttttcgcttttctaaaatttattttttatctaccattaatttattttaatttcaaaaatatataaattaaaaaaaaataaaacagcgcatatccgggacactccaaaaaatgtcttcctg

SEQ ID NO: 39414 - DNA, 1287 bp, Heterodera glycines
gcagtagtacctatgaatttaaattttctatgaatttttaaagttttttgaaatttttttaagtgcaaaagtggtggtgtctgcaaaaatttttcaccgggtttaaaaaatctaggaaaattagtaagcatttgtagtgttccgatacgtattcctgcataatttggtgagcccctgatcaattacaaattatttatggacgatcaaatttttagaaatttttatttatttttgcataattaattcataaatatttttttcagaaaatgctctgaaacgcaccaaattttatttacatgctagtttaggcactctgatgttttttctatcaaaaagggagatgaataaatttttaaaaatttttaattcctttttaaacaggccaaaaagtttaggcttatcttttttttcagaaacttatcagaagcgccccaaactttgcagggatactgaaaggaaaagaattaacctgttttatcacattagcttgtcatcagtttttataaaaaattttcaaaattctgagtctcctattattttatttttttttcaaaattttgaagggcggaggggggggcgaaggcccaccacgaggccgcgaagcggccgagtgagtacctcggtgcatgaaaattattaaggaagagagttcattatttgtttattttttgcataattaattcataaatattttttccagaaaatgctctgaaacgcaccaaattttatttacatgttagtttaggcactctgatgctttttctatcaaaaagggagatgaataaaatttttaaaaatttttaattcctttttaaacaggccaaaaagtttaggcttaacttttttttcagaaactgatcagaagcgcaccaaactttgcagggatactgaaaggaagagaaataacctattttaaatattatctagtcagttcatttaaataatttttatccaaaaaattttttttggggttttcggggcagtccccctgaaccgatgcgcccagatttatggggagaccgaatccttcgggaatagcttcccgatagtctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagctaccctatagcctgtactttaattctgcgttggattttcgcaaaagcataattgtttgagtacccccaaacggacactgaaaaa

SEQ ID NO: 39415 - DNA, 971 bp, Heterodera glycines
gatgacggaccagggcaaagagttcaccgccgccccagtgcaacgctttttagccgaccaagaggtgcaacaccattgcatgcacacctcaccccagtggcatgccggaattgcggagcgtgccatcagaagcatcaaggtttaaccgaaacggcaatttttttctttttcgttgtccatcatgtgcaacaaacatttaaggaaaggctgtaccgctactttacccatcgcggcgcaaagtgttggacaggcgtcatacagcagattgtgaccgcactgaacgggtcaccgaaccgtgcgctgttcggcctcaggcccaacgacattaattttggcaacgcggagcgcgtacgacgcaaccagctggagcgattagatgccggccaacagcagcgacaaagcccacgcgcccgactccctttccgtgtgggggaccgtgtgcgtattgaaaaacacaagcacgtgttcaaaaagggatacctgcctcgcttcactgacgaattgttcacggtggcagaggtacgcacatcacgactgtcgatcacctacaagctacgggatgacgacggtgaactgctcaccggctggttctatgcgcaggatttgtgccttgtgctcaagcctccacatccgctacggtcaaaaaaggatgaaccccattgctgacaaagcgggagctgctgattctgctaccgtagggcctgtgtacgacattgaacgtgtgctgagaaggcggacggggcgccgacggcgcggagcactgcttcgtcaaatggaagggctattcagcatgcgcataacagctggattccggtcacatcaaatcattataaataaagcggatcagaaccacgtcaaatggtaccggatttaccaaatacaaatgaccacctccttccctcctcctccttctaacattgtgttaccttccaacacgcaggtgggaggggcaaccgaacaaactccctttc

SEQ ID NO: 39416 - DNA, 732 bp, Heterodera glycines
aaatttgaagaatttgttaacagattttgtccaaaattgatcaatttttaacgccttttgggtgtgtttttgaacaatattttaaaaaatagaaagagaggttccggcggtactgataggttggagtttttgtgcaatttatttacagattttgcaccaataatgccataagtcagggctcccatcgtccatgctccgtttccaaggacgggtatgccgatttgcaaggacataatgaaaaaaattcatgaaacccaaggacatttaaaatttttggctctactgcagtttacgcgtccaatcgacttttacgcgtccaatcgacttttacgcgtccaatcacagtttgcgcgtccaatcaaaagtttacgcgtccaatcaaaaatttatgtgtccaatcaattattagaaattatttaattatttaaaatattggcattaaatgcttaaatgtcaaaatgaagactttttgattaatacaacgaaaagatgattagacagggtattgaatacgtatttcttcgagaatttgctgaaaaattttttcgttattgttagatctccgaaacatatactgatacaaataagattgtaaaagctcggggttagtgccgtggagatgacgaagaccatttttcactgcacgccaagttgcctcaatgccctgtgtgtgaaacaaattagtctctctattattaaattttataacaattgattgaatgcgtatatacc

SEQ ID NO: 39417 - DNA, 814 bp, Heterodera glycines
ggtgttcagctgcaattttctttttcctcttcttcagttgctgcccctttttctcctccattttactctctttctcttccgtctctcctccttccaatgttcttgcttctgctgatgttgttgtttctgatggtgttcagctgcaattttctttttcctcttcttcagtttctgctcctttttctcctccattttcctctctttctcttccgtctctcctccttccaatgttcttgcttctgctgatgttgttgtttctgatggtgttcagctgcaattttctttttcctcttcttcagtggctgctcctttttctcctccattttactctctttctcttccgtctctcctccttccaatgttcttgcttctgctgatgttgttgtttctgatggtgttcagctgcaattttctttttcctcttcttcagttgctgttcctttttctcctccattttactctctttctcttccgtctctcctccttccaatgttcttgcttctgttgatgttgttgtttctgatggtgttcagctgcaattttctttttcctcttcttcagttgctgctcctttttctcctccattttactctctttctcttccgtctctcctccttccaatgttcttgcttctgctgatgttgttgtttctgatggtgttcagctgcaattttctttttcctcttcttcagttgctgctcctttttctcctccatttactctctttctcttccgtctctcctccttccaatgttcttgcttctgttgatgttgttgtttgatggggttcacctgtaatattctttttcctctt

SEQ ID NO: 39418 - DNA, 1529 bp, Heterodera glycines
tccagcaagaggtgtcagaaaagttaccacagggataactggcttgtggcggccaagcgtccatagcgacgtcgctttttgatccttcgatgtcggctcttcctatcattgcgaagcagaattcgccaagcgttggattgttcacccaccaatagggaacgtgagctgggtttagaccgtcgtgagacaggttagttttaccctactaaagacctgttgctatgatagtaatcctgcttagtacgagaggaaccgcaggttcagacatttggttcatgtgcttggtcgatagaccaatggtgcgaagctaccatctgagggattatgactgaacgcctctaagtcagaatcccgcctaggcaagatagcaatattcttgctccccggtgtcgggaggcactacttatgcgccgcttgcggtgcagcacaaatgccccagcatctggcccgatgtgcgtgcttaattgctcgcacattgccaaagccgtagcactcgtgtgccatggtggaacgtcggggcgcaaaatcacttgtatacgacttgactactggtcagggggttgttagcagtagagcagcttttacactgcgatctgttgagacttagcccttgatcggatgatttgtcttctttttccccctttactttttgtgccaacaacattttaggtacaagtacatgagaagggaaggctctcttaagggagtcaaatgcctcgtcagtcaccatgaaattaggtagaataagtttttgactttgcttttttttccatttatttcatcggctagtgctttaaggttttgtctttgactttgcttttttttccatttatttcaatcggctagtgctttaaggttttgtctttgactttgcttttttgtccatttatttcaatcggctagtgctttaaggttttgtgttttgactttgcttttttttccatttatttcaatcggctagtgctttaaggttttgtctttgactttgcttcggctagtgctttaaggttttgtctttgactttgcttttttttccatttatttcaatcggctagtgctttaaggttttgtctttgactttgcttcggctagtgctttaaggttttgtctttgactttgctttttttccatttatttcaatcggctagtgctttaaggttttgtctttgactttgcttttttgtccatttatttcaatcggctagtgctttaaggttttgtctttgactttgcttttttttccatttatttcaatcggctagtgctttaaggttttgtgttttgactttgcttttttttccatttattccaatcgaccacgttaattcattctctatacatttagtgtcttatttcatgaaattatattaatttaattttaaataaagaggcaaatttttacagaaaataaatagacgctgactaattagctaacatttataaagaaagtagaaatttgattaaatgcatatacaaaatattacttttttaaatttgtataaagttcctagtcgtatgtgctttgcgtt

SEQ ID NO: 39419 - DNA, 1085 bp, Heterodera glycines
aagagagttagccttttttgtgagattatctatttgtagtaatggagccatctttcagccgaccatttgtagagctcatccgcatatagtgaggcggtttacggggaaaaccctctctcttggaggtctgagaaaaaagagttagccatgtttttgagactatctattgttagtaatggagccattttccaaccgaccatttgtagggctcaaccgcatatagtaatgcgttttcggggaaaaccctctcgttggaggctgtagaaaaaagagttagccatttttctgagactatctattcttagtaatggagccattttccaaccgaccatttgtagggctcaaagccattttccaaccgaccatttgtagggctcaaagccattttccaaccgaccatttgtagggctcaaccgcatatagtaatgagttttcggggaaaacccttcgttggaggctgtagaaaaaagagttagccatttttctgagactatctattcttagtaatggagccattttccaaccgaccatttgtagggctcaaagccattttccaaccgaccatttgtagggttcaaccgcatatagtaatgcgttttcggggaaaacccttcgttggaggctgtagaaaaaagagttagccatttttctgagactatctattcttagtaatggagccattttccaaccgaccatttgtagggctcaaagccattttccaaccgaccatttgtagggttcaaccgcatatagtaatgcgttttcggggaaaagcttctcgttggagactgtagaaaaaatagttagccatttttctgagaatatctattcttagtaatggagccattttccaaccgaccatttgtagggctcaaccgcatatagtaatgcgttttcggggaaaaccctctcgttggaggctgtagaaaaaagagttagccatttttctgagaatatctattcttagtaatggagccattttccaaccgaccatttgtagggctcaaagtcattttccaatcgaccatttgtagggatcaaccgcatataggaatgcgttttcagagaaaagcttctcgttggag

SEQ ID NO: 39420 - DNA, 1214 bp, Heterodera glycines
ttttttgggagatgggttttttaaggaaatcggcttttggggagacttttaactatactttgcgtcatttatttacggttatggatttcggattggtttccacgaagtgggcgcgggaaacgaaagaagccaaaatccaagaacaaagaaagaaaggccagaaaacaaattaaagaaattttgacggattcatagggggaaaaaaaagctccaagccggaggggaaaacgcactgaaaaagcggaacttaatgaagcgccagtgagtggaagtcaaaaaactttcacttgcaccaaaaggcaaaaagaaaaaggaaaagcggatgaaattggtggggggagggggaggagagaagcaaatagagggaattcaataaagggaagaggaggtcaaatgaaagtggaaaattgggggaggggagtgaaacgaatgggcggggcggggaacggaaagaaattcaatttaatggggggaagtctcgagccaaaagacgagagcattgaacccgttgatcaaacacaatgaatgctttttgtttattagcgatattggcttggattagggcgaggatgaaaaagggtgtttaaatggtgaggggggggggggtaattaaatgaaatgaaatgacaccgcgccgccgtcggcggaggggcgagggacagcaaaggcagacagacactctctgacgacgccgttcccctaacgcccctctcgccctccttcccccctctctctttcccttttccctcccctcgtgcctccactattttcctcttcgcatctcccccaattccatcccattcttgcgctttttattttgacgtcgtgacagatggaaaacaaaattcaaaaagacttcgcagtcagtgctaaaagatggaatttgatttacacgaagggacagcgaatggtcggccgatggtcagcagcagcaacagtcacttcatcatcactcttcacaatgcttatgcattgattggaaattagggtaacgatcattagcagcagcagaagaagaagcagaagaagctgaggacattttaagggaatgacgagccaagagaaacaaaaacaattaattaaattttgatgtatttatgaaattgcagagcttgatgaacgacttggttatgatggagtcattatgggcaaacggagagaaaaatggaacagagggagaaagggaggagagagaggggaaagtggaaacgagt

SEQ ID NO: 39421 - DNA, 1281 bp, Heterodera glycines
tcaacacaacgcttcctccttgcaactgggtgtcaaccaacagcaccacggattcctccttgcaactggtgtcaaccaacagcaccacggacaacactaatggtgatgaaacggaggaccaaatcgatgagactgaggaggcgacggagcaaagctccacgacatctctggaacatcatgtaaaacttggtttaagcactttgtagttgagaaatagactagtgtaagcattgggtttttatgggaaaatatacaaaagtccataataagccaatgcttacactagtctatttctcagctactgtaagcaatcctaacagtgataaatatagcccggctaaaatgtattttatcacacacctagctgtcttctgcgtcagctactcagccgaaaactgagtcccagtgaaaatggacatttcagtaccagagtaaaaaaatttagttttacttctaaacacctataaaagtgtttttgtgcgattttgagtcgataccatattcggcaattttaccaattatttagacccatacactcaacaaaggcactgaaattaattgcggctccaatgcttcatcatttgttatccgaattctcaaaaagcggagcctattcccggcgccttccaacagctcaactgatcacgaccaattgacagtgaaaattggagacaaacaggtgaaacagcagaaagagagcacagggcattcatccactaagatttgatcaggtcacccataacattggtctgatcactagtaaatcccggtcagatgactgacaaatgattttgatcagatcactggttcttgtactgaaaattttgtcagattagtgatatttcttgctcaggtcactactgataattgtaatttgttcgtttgtccatatttaaattagagccaattaaatttgaaaaataggcttttgggaggagaatattcagatctaacttaaatttttgcactaattctaatcctaaatccaaaatcggatagacttggattcgtggtcagcgaactcatctgtccatgtcacatcataaaataaatttttgtcatttttacttttaattgtgattggtttggtttggtcccgttcggagttaagaaagaaagagagcacgtggcgttcctcacggcccaaatttatttaaattctgataaacttggcggatagatcgttgataaaataccgtatttgctctttttatatacccatggtatattatttttcaccttctcagaagggggtatataattggagactggcagactaat

SEQ ID NO: 39422 - DNA, 987 bp, Heterodera glycines
tggtatcttacgatagcccttaaattgagttatcagcttgccaaatttctaaaaattttataaattttttcaaaagttatgacaatttttccagttttttggctagaacttttgaaaaacttaataaaattttttgaaattagcaatctaataaagcaattaaagagctatcgtatgataccaagatttgtgcaattttgttgtgtcttagaaaagttatgagttgatttagccaaaaatttagcaaatttgcactttttgtgaagtgacctagcaccgatgctggcagtaattctgaagtttaagttttttatgaatttttacttatgcctattattttaggggggtccggcggcgccacctgaaaaaatttgtaatttttaatgcgaaacaaattcatattttttttctttttggcgtaccttaaaaaagtactatactaaaaaattccggtaatggagaaaaagctggagtggaacgggattcccgccttttccccgttaaaatcccgtcaaatttccctgttgccagaccggtgtaattactttttatgtgttttatacattttttcacaagcaattcaaaaaacaaattttcaaaagtttatttatttttttctaaggcattcttgcatttgctttaaaaataagctttctcatcatgagttttttttatgctattaaattttcagttatctttatttgaatctttttttgtttaccaattcaaaaatgtcgcacaatccgaaagaagcaaataaagaaatggaaaaagcgatgtaattttctaaaattgaatgtacatggctaatcattttattgtttcagcttcatttcagccgactgttggcttgaggtgttcgatttgcttccgccttctcagcttggactgggaattgctttgattagtcgccgttttgactatttcgtcgacgaacacttcaaaacgcgcaaatggaaattgggcgaaatgaaaattcgacgcaaa

SEQ ID NO: 39423 - DNA, 1428 bp, Heterodera glycines
  misc_feature (1306)..(1306): n is a, c, g, or t
aacagtgattagaagagatacaacagtgattagaagtagtacaacagtgattagaagaggttcaacagtgattagaagtagtacaacagtgattagaagaggtacaacagtgattagaagagatacaacaatgattagaagaggtacagcagtgattagaagaggttcaacagtgattagaagtagtacaacagtgattagaagaggttcaacagtgattagaagtagtacaacagtgattagaagaggtacaacagtgattagaagagatacaacagtgattagaagtagtacaaatttgattagaaggggtacaacagtgatgagaagaggtacaacagtgattagaagaggtacagcagttattagagaggcacaacagtaaatagaagaggtacaacagtaattagaagaggtacaacagtgattagaagtagtacaaatttgattagaaggggtacaacagtgattaattagtaaattcattaaattaaaatgaaaatattttttaacaaatttaattaaaaaaaatacatgaaattctatcaattaaaaaaataattaatttaaacttataaaatgtattcatcaaaaaaaaaattaatttaaatataattttttatttattaactcaacaaaatattttaaattaattaaaatcattgaaaataacgtaaaaatgcacagaaaaattatgttacaccgtccggactcgaactttgccccccccccaaaaatgatgcctcagaatccccaatcacacagggattctgaggtcttaacgatgtcaaaagtaaaatctgatcacatattcatgatcagcgtcataaaatagccctaataacatgtttctggaagatttttggtgaaaaaatttttccactcaaaaatcctggtcacccccctttggtcccgaaccccaaaatcacttttattttggtatcattttttaaaaatgtgataaaaatatgaaataaaatttatttggtagagcaaaaaattgcggattttttcagtatttaaaatttcaaaagcacctttacggaaccgagttctgaatttttttctgaaaattcggatttttccagaaattcttgaataactttttttcatttgaagatataaatttcatttaaatcccataaaattctcctgatttttctctatttttaaggctttattcctgtaaaattgatcaacccttcgatttgttatgaattttcaaatattaggccaaaatcccgagggccaaaaaattgccaaaaaataaagaatttttaaaaaattccaaaaattttgaaacganaaataaacatcatattcgtgctcagcacatcaaaataccccagaaaaatatttttgacccccattttcacccaaaaaaaattttcgaaatttctagggggcctagctcgaaaatttttgaaa

SEQ ID NO: 39424 - DNA, 953 bp, Heterodera glycines
agggtttgaggtgttttgagtcagaagtttcgctttcaaacagctcgttgggatcgtccgttttcggcaaaagagtgcaccatagcaaaaatggcgtagtttgaacgacacttctctagggtttgaggtgttttgagtcagaagtttcgcttttcaaaaagctcgttaggatcgtacgttttcggcaaaagagcgcaccatagcaaaaatggcgtagtttgaacgacacttctctagggtttgaggtgttttgagtcagaagtttcgcttttcaaaaagctcgttaggatcgtacgttttcggcaaaagagcgcaccatagcaaaaatggcgtagtttgaacgacacttctctagggtttgaggtgttttgagtcagaagtttcgcttttcaaaaagctcgttaggatcgtacgttttcggcaaaagagcgcaccatagcaaaaatggcgtagtttgaacgacacttctctagggtttgaggtgttttgagtcagaagtttcgcttttcaaaaagctcgttgggatcgtcctttttcggcaaaatagcgcaccatagcaaaaagggcggagtttgaacgacacttctctagggtttgaggtgttttgagtcagaagtttcgcttttcaaaaagctcgttgggatcgtcctttttcggcaaaatagtgcaccacagcaaaaagggcggaggttgaacgacacttctctagggtttgaggtgttttgagtcaaaagtttcgcttttcaaaaagctcgttgggatcgtcctttttcggcaaaagagcgcaccatagcaaaaatggcgtagtttgaacgacacttctctagggtttgaggtgttttgagtcagaagtttcgcttttcaaaaagctcgttgggatcgtacgttttcggcaaaagagcgcaccatagcaaaaatgggcggaggttgaacgacacttctctagggtttga

SEQ ID NO: 39425 - DNA, 1056 bp, Heterodera glycines
cggccgaattaaaccttaaatataaaaagggtgcggagcgccctttgaggccgcgaagcggccgaattaaaccttagaatacaaaagggcgcggagcaccctttgaggccgcgaagcggccgaatcctccaccaaattatgaaagcgtcctcgcgatgcctgtagaccaaatagaagcgcaaagcacccgtctgaggccgcgaagcggccaaatgagtccacaatatttagaagcgcaaagcgcccgtctgaggccgcgaagcggccgaatgagtccacaatatttagaagcgcaaatcgcccgtctgaggccgcgaagcggccgaatgcacttgctcatcacttaacaaacgcgcatgcactagcaacgaagtcctttgcgcgaagcgctcatgtaatgcatattcttttcatctctcacaagtatactgtttacaccgagcaactactgcgccacacgctagtttatattaccatagagaaaagttggctttcgtcttaaaaactaatttgagtcgaacggctgtcgggaggggtctgaaagtggtggaagggtcttacaactttttgaggcgcattcaggaaaactataggttttccgctccggtggccagttgagcgccagcggcgctgaaacggcccgaaaatttttttgtccgtctttggtggcctgtaactttgcgggaagaagcgggagcggaaaatgcttgctggtaggattttaagttggaatggttgggaaaacttggcgcttatttggcggggctatctgtaaatgccaatgctgcagaaatggcaaaatttggcacccaatttcggcattttccgtttttcgggaaatactcgctgggggttaagcggagcgggttggcgccgcttaagcatttgtgtagtttttaagctgcatccgatggcgttttcagattttgaaaattttcaaaatttttccagctaggccccctccaaaaatttttcgttttttgatttttttatttttttgccaatttttccccaggaaaacgggaaacccctttcaaggaacccgttttttgagct

SEQ ID NO: 39426 - DNA, 878 bp, Heterodera glycines
tgtcggcaaccatttttgtcagaaaacaagcacttcctgaacaagtaaattgatgtagaacatgatatcattggtaaaattttacagggtattcgggaattaaggcagtttttttcgtaatttattacattaaaccgatgcaatttgactctaaaaagagggtgccaaaacgatgtgctggcaaaatatacctggttggccagtccatgcaatggaccagcaaggccggccatcgaagcggcaaatgacaggtacgggtcggacagcgcggagccgaccaaatggcacgtgtgcgcggacacattgccaccctcgtggtccgaatggatgaccaaatagagacgcatcagttccacgaattcgcgttcggtgtagccaagcatatggcaaaagttagcggaccaatcctttaaagggtggcatcaaatttaaccatggaaccaaaaattaaacaaaaaaaaaccttgttcgggtcgagcacacccacggaagaaccatcacggtagagatttctaaaaaaaaatatgagataatttagcaaagactttcatgctgtccaaaaatccgtaatttttggaccaaacaattttttcatttttaggaactgactaaaagcattataaaccaagaaaaactcaatgccagtactgatagttattcaataatacggattcctgagttccaagcgcggtataaaatgtccaaaatgaagagattttgtctttcaataaatatgggggactcctccgttcaaggaccatccaggatggatcccatccatttacctgtaaatcattgccgcaatggtgggtagtttagcgagcaggttcatcgagtcttcgtacgcatactcccagtaggtgctcttcggcacacct

SEQ ID NO: 39427 - DNA, 886 bp, Heterodera glycines
cagaaaatggaacggataaaatgggcaacaatcataagttgaataaatgtcagtatttaaatttggagaaataaacgccaattaggcgaatccgatgtaattggcttggttcggctgtttttttagtctattgttgtggcctttggagtgcgctctccccgtttattagctctgccgcaaaatgagccgcaattgtttgattggttggttaattgattgtgaatgggcgggggggggtcaaaatggtgtggcgcccgacgccgcatcattaccctcccccacagccttccattgcattccaaccagccaaagacgacggctgtgttgcagcgcctgccctgggcagggaggggaggagaggacccctccaactccaatctctcaatggcgccaatattttgtcggtcggcgggggggggggagaatgacggggaagggacggagggacacaaagtgttaggaaaaccaccaaaaatggcgagaagggaatggtggcggggagaaggaatataattgtcgaagtgcgagcgatggatgggccgggacaaacgcagcagccaaactccaattccaacctcagccgccgccgcattccgagcgagcggaggaggcacaacaaagggcgcccgccgcggccccacccccccgctatgacgtagtaacccagcgctaatctagggaagctatagccatacatttttatggcatttttgcgtgggcaagacggattttatatatgaaaattatgaatttttccacatttgatttgggcacatgggttaaacgggaaatgaagaaaaataaattagtgaattttttctataaaacaaatttttttgggggcattttgaccataattaaaatgaaaaattattgcttcacccat

SEQ ID NO: 39428 - DNA, 1405 bp, Heterodera glycines
  misc_feature (1305)..(1305): n is a, c, g, or t
  misc_feature (1331)..(1331): n is a, c, g, or t
caaataaaaaacgggggaaaggggggccgcagattttaattattcaaattttgttgtacataattttagaaaaataaaaataacccattccattttcagtttttccagatagggatgttactatattaggtcccaaaattagtcatgaacgaaatttaattcgtgtgcttagccaattgggaaggaaaataacatttcggcggcgcaacgcacaatttttctcccattaacaaaaccggcacatgtcgaatgcttttcaatttctgcacccgaaaagaacaatgttggaacactcaaaaaactggggaggccaaggaaagtgacttccgattcgattcagagcaataagcgtttaaaaaagactgattgacgacttacgaatctttctgatttttgccaagattttgtctaattttgatttattcttttgcttctttcgaaaacctcacctcatttgaaaacgcctcatttttctccatgtttaaaattgttttattgtatcatatttatttctgcttttatttattgtaaaccattgaagaataattgtgacggaatacatcattacaattttttgttgttgttgtttgctgtattaggatatattccttacaattcgttaattaatgcattttttaaattttgcgttttaatttgtcaaatattcgattatttgttgtgcattttattcctgtgggctgaaatgaggcgagtgtttctaaattttgtccgtttttcaattgttttgctttaagttggctgcccaatgagaatcttatggatgtgttcgcttttttgtccgatgttcgcctcctccgttcggtttccttcgtttgccaccgcttttggcgtttgtctgagttggcacttttcaaatttcacccaatggtggccaaaagtgttcgcatcggttgggacccaaaggttttttggaaattaaattgaaaaagacaattgtttatccttttttgtggaaacgactaacaaaatgggttcctatttttcagaatgcttcgcactatttctttgttcaaagtgtaaaatgtgccgtggctctttcgaatttggcactttccgttggcccatcggacaattcgtcgtccaattggcccccctctctgccgcccccaaatattgtcggaatccgacgcattcgaatggaaggtcatcagtttaattccgttggattatttaaaatttgtaaacattttttggtggcattttttgttaaggaaaattgactcgcgaagtgctcgaatttttgtctcggtgcgcagccaaaatttccgaaagtgaattggattntgagaatttggaaagctttttggcgngattaagccgacagaaaattcatttggacgaatttttgcagtttttggaaggtgaaaatttgttggcaatttga

SEQ ID NO: 39429 - DNA, 896 bp, Heterodera glycines
tttttcctccccataattgttggagtcccccaacccgggacaacttgaaaaaatcgatttttttttttgcggggcagtccccccccggaaccgatgcgcccagatttatggggagaccgaatccttcgggaatagcttccctatagcctgtactttaattctgcgttggatttttgctccccataattgtttgagtaccccaagcggacactagaaaaaatcgatttttttgttttcggggtagtccccccgaaccgatgcgcccagatttatggggagaccaaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccaaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattgtgcgttggatttttgctccccataattgtttgagtaccccaacggacacttgaaaaaatcgatttttttgttttcgggg

SEQ ID NO: 39430 - DNA, 1168 bp, Heterodera glycines
  misc_feature (37)..(37): n is a, c, g, or t
  misc_feature (39)..(39): n is a, c, g, or t
  misc_feature (47)..(47): n is a, c, g, or t
  misc_feature (147)..(147): n is a, c, g, or t
aaaatcgattttttgtttcggggcagtcccccccgancngatgcgcncagatttatggggagaccgaatctttcgggaatagcttccctatagcctgtactttaattctgcgttggatttttgctccccataattgtttgagtaccncaaacggacacttgaaaaaatcgatttttttgttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgatttattttgttttcggggcagtccccccgaaccgatgcgcccagatttatggggagaccgaatccttcgggaatagcttccctatagcctgtactttaattctgcgttggatttttgctccccataaatgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtcccccccgaaccgatgcgccgagatttatggggagaccgaatccttcgggagtagcttccctatagcctgtactttaattctgcggtggatttttgctccccataaatgtttgagtaccccaaacggacacttgaaaaaatcgatttttttgttt

SEQ ID NO: 39431 - DNA, 995 bp, Heterodera glycines
  misc_feature (913)..(913): n is a, c, g, or t
ttaattcacaatttctgcagctcttacggtaatggaaaatattttgaagaggctctcaggaacggattagcatcggggttacgagatagaaaattgtcctaaaaagagataaccatttagcatcggggttacgagatagaaaattgtcctaaaaagagatagccatttttctgagaattaattcacaatttccgcagctcttacggtaatggaaaaaattttgaagaggctctcaggaacggattagcatcggggttacgagatagaaaattgtcctaaaaagagataaccatttttctgagaattaattcacaatttctgcagctcttagggtaatggaaaaaattttgaagaggctctccggaacggattagcatcggggttacgagatagaaaattgtcctaaaaagagataaccatttttctgagaattaattcacaatttccgcagctcttagggtaatggaaaaaattttgaagaggctctccggaacggattagcatcggggttacgagatagaaaattgtcttaaaaagagataaccatttttctgagaattaattcacaatttccgcagctcttacggtaatggaaaaaattttgaagaggctctcaggaacggattagcatcggggttacgagatagaaaattgtcctaaaaagagatagccatttttctgagaattaattcacaatttcgcagctcttagggtaatggaaaaaattttgaagaggctctccggaacagattagcatcggggttacgagatagaaaattgtcttaaaaagagataaccatttttctgagaattaattcacaatttccgcagctcttagggtaatggaaaaaattttgaagaggctctccggaacggattagcatcggggttacgagatagaaaattgtcttanaaagagatagccatttttctgagaattaattcacaatttccgcagctcttacggtaatggaaaaaattttgaagaggctctc

SEQ ID NO: 39432 - DNA, 906 bp, Heterodera glycines
ttgctatggctccgcatcacccgcttcaaccgggtgctcagtgtaaatatcgactggtcattcaaattctgcctttccagccttatggaaagatattatggaacttttggttccatctcagttgtcaacgccgcgactgcatcgttattatatcagtcgatagaattttcgaatcgcttttaaatcgtctcttttgcgtcccttaatcttcactctgagcgagttactgcggtctaaacacgtttttggtagagttgcggccagaataaaaatacagtttgctatggcttcgcaacacccgcttcaacgggtgctcagtgtaaatatcgactggccattcaaattctgcctttccagccttatggaaagatattatggaacttttggttccatctcagttgtcaacgccgcgactgcatcgttattatatcaatcgatagaattttcgaatcgcttttaaatcgtctcttttgcgtcccttaatcttcactctgagcgagttactgcggtctaaacacgttttttggtagaattgcggccagaattaaaaatacagtttgctatggcttcgcaacacccgcttcaacgggtgctcagtgtaaatatcgactggccattcaaattctgcctttccagccttatggaaagatattatggaacttttggttccatctcagttgtcaacgccgcgactgcatcgttattatatcagtcgatagaattttcgaatcgcttttaaatcgtctcttttgcgtcccttaatcttcactctgagccgagttactgcggtctaaacacgttttttggtagaattgcggccagaatttaaaaatacagtttgctatggcttcgcatcacccgcttcaacgggtgctcagtgtaaatatcgactggccattcaattct

SEQ ID NO: 39433 - DNA, 943 bp, Heterodera glycines
agaaaaaattgaaaattttgaaatcatgtttcccactcccttctcccaggggtattattttgtaaagtctttttttccccaataaacttgtcaaaccccatttttcgcaccgtgaatgttatttttattgaattctgagccgttttgagtagattagactagaaaaaattgaaaattttgaaatcatgtttcccactcccttctcccaggggtattatattgtaaagtctttttttccccaataaacttttcataccccatttttcgcaccgtgaatgttatttttattgaattctgaaccgttttgagtagattagactagaaaaaattgaaaattttgaaatcatgtttcccactcccttctcccaggggtattattttgtaaagtctttttttccccaataaacttttcaaaccccatttttcgcaccgtgaatgttatttttattgaattctgaaccgttttgagtagattagactagaaaaaattgaaaattttgaaatcatgtttcccactcccttctcccaggggtattattttgtaaagtctttttttcaaaataaacttttcaaaccccatttttcgcaccgtgaatgttatttttattgaattctgaaccggtttgagtagattagactagaaaaaattgaaaattttgaaatcatgtttcccactcccttctcccaggggtattattttgtaaagtctttttttccccaataaacttgtcaaaccccatttttcgcaccgtgaatgttatttttattgaattctgaaccgttttgagtagattagactaaaaaaatatgagtgatcaaactttcactaaaaagttaagcctaaactttttcccaaagttaaaaagcaattaaaattttattcaccctccattattgatagaaaaaagcatcagaagtgccctaaactaacatgtaaataaaa

SEQ ID NO: 39434 - DNA, 970 bp, Heterodera glycines
tgatgggaaaatttttttgaaaatttacgaaagagagacttttcctctctatcaattttttggagagcaaaaagcaatttggcagctgaattttgctgccggtgtttcaaaattaccatcaataaacacacacataaatatgtatttaggtgacagctaacagaagaaaagaagcggaggaggaactaaaaaaaggggaaaatgatgcaattgcaaatggccaaccgaccgacggaagagagacccaaccaacacccactgaatgaatgaatcccccgcgggtgttccgctgattgtttacgtattttgaaattgaaaaatgagggaaggaaacatggccatggtaaataaataaaggggaggaaaatgccagaaagagagagagagagagagagaaaagagagaaagagagggagagaaatagaaggaacgaagaagccgggaaaaagaggagatagagaaggagtgaaacaagtagagaaagtgaaaggaaaacaatgagagaaaaggagagaaagggggagagagagagtgagaaaagggagaggaggggagagatgggtaaagagaagagagttgaaaacacggagactgagaggagaaggaaagagaacagctggcagcaaaagggaacggttggaaaatgattttggtttcaatttttttttctccgtattcccacacaatgtacacttttaattagtctctttctctttctggtcagacagtgagagtttggaaattgatctgatcggtgatcaaactcaacactagattaagggataagctttttaaaattgataaaaaattattactttttaaaaaattgataattattccatttattaattattatattttaattttattaataatctgacaaaacattctcggccaaaagtttacgtgggaaaatgagcgaatgagaaaagttaaaattattacagcaaataatatttttatataatca

SEQ ID NO: 39435 - DNA, 1432 bp, Heterodera glycines
atttaaaaatacagtttgctatggcttcgcatcacccgcttcaacgggtgctcagtgtaaatatcgactggccattcaaattctgcctttccagccttatggaaagatattatggaacttttggttccatctcagttgtcaacgccgcgactgcatcgttattatatcagtcgatagaattttcgaatcgcttttaaatcgtctcttttgcgtcccttaatcttcactctgagccgagttactgcggtctaaacacgtttttggtagaattgcggccagaatttaaaaatacagtttgctatggcttcgcatcacccgcttcaacgggtgctcagtgtaaatatcgactggccattcaaattctgcctttccagccttatggaaagatattatggaacttttggttccatctcagttgtcaacgccgcgactgcatcgttattatatcagtcgatagaattttcgaatcgcttttaaatcgtctcttttgcgtcccttaatcttcactctgagccgagttactgcggtctaaacacgtttttggtagagttgcggccagaatttaaaaatacagtttgctatggcttcgcatcacccgcttcaacgggtgctcagtgtaaatatcgactggccattcaaattctgcctttccagccttatggaaagatattatggaacttttggttccatctcagttgtcaacgccgcgactgcatcgttattatatcagtcgatagaattttcgaatcgcttttaaatcgtctcttttgcgtcccttaatcttcaccaacgccgcgactgcatcgttattatatcagtcgatagaattttcgaatcgcttttcaatcgtctcttttgcgtcccttaatcttcaccaccgtcgcaactgcatcgttattatatcagtcgatagaattttcgaatcgctcattgattcgtctctcttgcgtcccttaatcttcactctgagccgagttactccggtctaaccacgtttttggtagaattctgaccagaatttaaaaatacactttcttatgccttcgcatctcccgcttcaacgggtgctcactgtaactatctactggccattcaaattctgcctttccatccttatggaaagatattatggtacttttggttcaatttcatttctcaactccgagactgcatcgttattatatcagtctatagacttttcgaatcgcttttaaatcctctctttcgcatcccttcatcttctctacgattccgcgtttctgcggtgaagaaagaggggggggggaggaggggaaagggcgaaaaggaggtggaggggaggtgcttcgttaagcattggcactcgccgtactcaattatttcaactatttgcagcattaattttcttttgggatggcggaaaagctttggaatccgtcgcctttgcgctgtt

SEQ ID NO: 39436 - DNA, 1071 bp, Heterodera glycines
  misc_feature (1036)..(1036): n is a, c, g, or t
ggacaaaaaaaaatcaaacaaattatgcgattataaaagtcaattttgtatgcctgttaccgcgggataaaaccgatttcgcaattctagacaacaatatatacttgattcgatcagacctttgcatttataaatatagaattgttgaccgtcaagttgaactaaagtttgtggtcaatagtagtagcgcgaaattcaactttttattatttaaagaataccgcgacgacgccaataataataatatacttcaagcaggctctcaaacgcctcagttaaaattattgttaggggttgcttatacatttgacgtactactgatcataatttgtgcatttgccgtaaaacagatccgccgagcgagcagcagaagtaacacatcttccgaaaatcttggcatgttcgacctagtggaattggcagcgcttacaaataattccaaagaactggtgtacacgcccacaacagtagtcaaagagaggagtatttaaggcaactattctggccatcagcgctcatttcgtacactaaaccactatatgcaacgagcaatcaaatattttattgactattacgccataaacgacattactcaactgtatgctctgttaaaatcggaaatcgactcacacccgtccaattatttcccaaatcctctgctatcagtctcctgtgtccatattgtgaacaccgagttcgaaaaccaaccggtgatagtggaaggaacgcttgatttgatagacgagctgctcttttcgacatgctaccccaagacgaggcagggagtcggctggtaagtgagggattaatgtcaattatttaatattttttgttcaggagcgaacctctgtatgtggaactgacagatctaatggtttgtccgggcgatttgccaatatgtctgtcacacttcggacaacggaaggaacgacgacccagcttgatggtcgacgaactggattggcacgacagcgacgacgacgccgcagacgaagcctggtgaaagtgttatgtgaattcaataaatgtagaccgngaatatctcgctgtgacgatcagaagaaggaagaa

SEQ ID NO: 39437 - DNA, 869 bp, Heterodera glycines
gtccttttaaaaaaaaatggtgtgccaaaaaatgttgtgttcagttggcggtcgacaacggtgctcgcattcgggacgaacgcgtcaaattgcgcattgctcaaatgatgtttacggtgagtagaaaattcagaatacgaaaatccaagattctccagggccttggtacattatacccctggggagttttgggataccatgagaaactcttgaccacaaaatttagatcagattattagccgagttccgtcttgggcccccgcactttctctttttgaactttatgaacttggcgattggtccttaaacggagagagagagagaaaagtgacggagaaaaaagggcaatttgttttggcgcaaaattggcattttgaaaattcaaattaaataattgcttctgatgctcaggtgattgtcgtgttcgtactctgctggacgcctctgtacgcgttgtactgctactttttcatggcggaggaccgtgactcgatgttcttccaatttgcctcgtccgttctgcgcccaatttttcaggtcctccccaattaaaacctctcacttccgtttgttttcactcaaaaggctattttaattggtctaaatgatctaatgagccatttaatccctcagcagcactcaaatcaattagaattctccgagaaactttcaagatgctctcaaatctgattagattaagtatttgtgtacacgatcagtcgatcggttcattgccttgttgtgatcactaaagatccatcttcatcatgtttattttattgttagtcacgatgctctaactgtctgcattaaaaaactctaatcactctttttcaagaatttaaaaatttcgccggattttcaatttt

SEQ ID NO: 39438 - DNA, 1142 bp, Heterodera glycines
  misc_feature (1082)..(1082): n is a, c, g, or t
ttttgggcctgtttaaaaaaggaaatttaaaaatttttaaaaattttattcatctcccctttttggatagaaaaagcatcagagtgcttaaactaacatgtaaataaaatttggtgcgtttcagagcattttctgaaaaaatatttatgaaataaaaaaatcgatttttttcaagtgtccgtttgggggtactcaaacaattatggggagcaaaaaatccaacgcagaattaaagtacagactatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaactccaacgcagaattaaagtacagactatagggaagctattcccgaaggattcggtctccccataaatctgggcgcatcggttcagggggactgccccgaaaacccaaaaaaaaattttttggataaaaattatttaaatgaactgactagataatatttaaaataggttatttctcttcctttcagtatccctgcaaagtttggtgcgcttctgatcagtttctgaaaaaaaagttaagcctaaactttttggcctgtttaaaaaggaattaaaaatttttaaaaatttattcatctccctttttgatagaaaaagcatcagagtgcctaaactagcatgtaaataaaatttggtgcgtttcagagcatttctgaaaaaaatatttatgaattaattatgcaaaaataaataaaaatttctaaaaatttgatcgtccataaataatttgtaattgatcaggggctcaccaaattttgcagggatacgtatcggaacactacaaatgcttactaattttcctagattttttaaacccnggtgaaaattttttgcagacaccaccacttttgcacttaaaaaaatttcaaaaaacttta

SEQ ID NO: 39439 - DNA, 815 bp, Heterodera glycines
aaacatactgtatcactgacgctttttattttaggtatccaagacgggtggaataccgtatttgttttttttaaacatactgtatcactgacgctttttattttaggtaaaccagacggttggaataccgtatttggtttttttaaacatactgtatcactgacgctttttattttaggtataccagacggttggaataccgtatttggttttttttaaacatactgtatcactgacgctttttattttaggtataccagacggttggaataccgtatttggtttttttaaacatactgtatcactgacgctttttattttaggtataccagacggttggaataccgtatttgttttttttaaacatactgtatcactgacgctttttattttaggtataccagacggttggaataccgtatttggtttttttaaacatactgtatcactgacgctttttattttaggtataccagacggttggaataccgtatttggttttttttaaacatactgtatcactgacgctttttattttaggtataccagacggttggaataccgtatttggtttttttaaacatactgcatcactgacgctttttattttaggtataccagacggttggaataccgtatttggtttttttaaacatactgtatcactgacgctttttattttaggtataccagacggttggaataccgtatttggtttttttaaacatactgtatcactgacgctttttattttaggtataccagacggttggaataccgtatttggttttttttaaacatactgtatcactgac

SEQ ID NO: 39440 - DNA, 1070 bp, Heterodera glycines
  misc_feature (1039)..(1039): n is a, c, g, or t
  misc_feature (1048)..(1048): n is a, c, g, or t
  misc_feature (1059)..(1059): n is a, c, g, or t
tacgacgtggaaagaaagcgccgaattcgtaaaattgggaaacaaatccctaaaagaaaaacgagaaatttgtgatcaccgaattttgaaaagagggaaacaaatccctttcttcatctcgccgaattcgctggatttgttgaaattgtaaaacgtggaaaacgaatcttgaaagcggaggaaaagctgacaactaagtcaaaagctttgaattgaaaacgggaaaacaaattctcatttgctaatggtgccggttatgcgaagtccgccattaacgcgacaaagagcgttaaacctcggcatacaattgcgaaacgagggcataggagttgcgcaagaacagcagcgagttcagcaacagcactccgacgtcggaaatgctcctttgcgcgaaaacgaaaatcgccaaagccacgtttcatcggtttcatctgttttaggaccagacacaatccaccggcgacttttgcaaatcccaaatccacggaacgatatggacgcgcaacaaaatcgaaacaatttggacgaagatgctcttttggatgaccatggtgactcaatttttggtaacggaaatccccatgaacaaaatttgggtggagaaaatgttcgaaatgcagttagtgttatgagaagcattgaccaggggagagtgcgcgttgatattgtggatgattttgggtttcacccggacatgacttcgaccccaaacgtggtcgcaaattatcagcgtggtgaaccgagttttatgctcaatcaaccaccggcagtccaccaacgcaatttgatgctggaggaacagcattttcgttttgtcgcacagcctaacgccggggaacgcgctgaaccaagagaccaactttattttcgacaagcgcaacaaccaacgaatgtcgggccgcaacaaaatgccgaatatcatcaccagtacattcatcagcgaaattttccgcagtttgaaacgcgtgaaccccatcaacaaaaccaacgcaattttgttgaaaataacccaacaatgcgtttttacggaaatgctgcntccaaattntgtcacgaccncataaatgttc

SEQ ID NO: 39441 - DNA, 899 bp, Heterodera glycines
ggtaaggaaaaaatttggaagaggctctccggaacggattagcatcggggttacgagatagaaaattgtcctaaaaagagatagccatttttctgagaattaattcacaatttccgcaactcttgcggtaatggaaaaaattttgaagaggctctgcggaacggattagcatcggggttacgagatagaaaattgtcctaaaaagagatagccatttttctgagaattaattcacaatttccgcagctcttgcggtaatggaaaaattttgaagagtctctgtggaacggattagcatcggggttacgagatagaaaattgtcctaaaaagagatagccatttttctgagaattaattcacaatttccgcaactcttgcggtaatggaaaaaattttgaagaggctctgcggaacggattagcatcggggttacgagatagaaaattgtcctaaaaagagatagccatttttctgagaattaattcacaatttccgcagctcttagggtaatggaaaaaattttgaagaggctctgcggaacggattagcatcggggttacgagatagaaaattgtcctaaaaagagatagccatttttctgagaattaattcacaatttccgcaactcttgcggtaatggaaaaaattttgaagaggctctgcggaacggattagcatcggggttacgagatagaaaattgtcctaaaaagagatagccatttttctgagaattaattcacaatttccgcaactcttgcggtaatggaaaaaattttgaagaggctctgcggaacggattagcatcggggttacgggatagaaaattgtcctaaaaagagatagccatttttctgagaattattcacaatttccgcagctcttgcggtaatggaaaaa

SEQ ID NO: 39442 - DNA, 1237 bp, Heterodera glycines
ccatggatggcacctttatctaagcctcgctcggcatgggtcgtcccaccaactccagcttattttgatgtgctcgacttttccaaatatatcaccaagacacggttggccaccgatgaggaagccgaatgggaatttgacgcatattacaaaggcataaatttgccaacagccaaatttgaggtgttcaagagagtgtcagagtttatatacttaaaatggttctcttttaaataaaggaacgtgttgccgaaagtctggcacttcatttggaaagagaagaaatgtctaaaagagagaatcaccccgaaaaggaaagggaagaaaaccgcgccaaatttctccgctcgctcatcgatgatgcccatttaattttggcacatggaaacccaaaaatcatcgaccatcgcgtgagtaacagcagcatgcctttttatcagttcttaatttttatagatttcacattctgaccgttgcgagtccttttggataagggccggttttctccctctgtacgagagtttgcccgtttgggaaatggaaaaagtgccgtccattcgaaaagtgaagttcaccggcgatgacaggtccaaataattaactttatttccatcaaatattattttttaataatgtccaacaaaacagacgccgtcttggcgaactttcctttacaatgcgcgacaaacatggcgatgcaagtgcggacgaaaagcccaatgaaaagggtaactttatccgaattgcggggcgtatttctcccttaccattttttcagctattcgattgggatgacccgggcagactcgaggcaccagcgtttcccccgttttttgacgttgcggatgcattgataatgtcgcccatggtttataatattctcacctactcagagccattgtgacaatgctcagccttcgaataagggtcgggtaagtccaattcattcgcactattcatttttgtgtaataaagcccccatttccaccaataagccctggcttgtaaactttatgtgtatttattttcactccgttagtatttttaggtgaaacgcataagtgcggtcggttggctatcaagggcattactgacgcggatctttcgctctggccactcattggcgttgcgacacggaacatgagcgaaaggaagtgatcagagaaagtttgaccgcaacggcggtcgtatctctctaaagagtgctcgcatgcacaagcgccattgtcttggttag

SEQ ID NO: 39443 - DNA, 1547 bp, Heterodera glycines
  misc_feature (1516)..(1516): n is a, c, g, or t
gatattttcgagatttggactcccatctaagtgaggcctatgtataaaattcaaaatcgaatggcacggagaggagagaaaaaattttcaaaagaaccaaacctttggttcttgatcaacagagcgaagtcaggtgccgatcggttcacgccaaatctttttccaaaactcggaggtactttgattataagagtaataacgccattagcatttatcgacccctcgccacccattaaatttgacaaaagtaggcattttgtcacacttcaaagtcaatccccgtgcaggtggcgctgtgttttatgctgagttttgttggttgagcagagggcagctgctgtccttttgctgctgacgatttcacccccccccccccgtcaccccaaaaaattccaattttatcgctacgggttaaagacaaagagaagaagaagattgctgaaaaataaaggacaacccgccgccggcggtgacgaaaattttaattgcgcggccaataaaataaaattcaaaaggaaaagtgaaagagagagagaaaagaaaattaagacatggaagagaagagatggtaaaaagagcaaaagacggaaaaaataatgaaggagagagagcgcgagagaaaaaaaaggaaaatagcgagaaaaagtggaggaggaaaaggaaataaaaaagtgaaaaaaagaagagagagagagaggagagagagagggaggaataatatgagagagaggaaaagagttgaagtgaaattggcggggatagaaaagacaaaacagaatagaataaagagcaaaaagaaagaaaaaaagtgtagaaatggacgcggaacagcaaaaaatagcatagcgaggaacaaaaggaggagagcaaaaagagagaaaagaggcaaagaagagcaaaattggaaaaagagagcgaatgaatgcgcatgacaaatgacgcacaatcgtagcaaaaatgcattaattaggaaaggaagaaagtgttgtgcaaaatgacacaaatttcgaggagcaaagccaaggccatccgccgccgacgccgtggggcgacgccgacggcgacggacgcaacggcgcgtgccgatcattcggactgatcgatcagtgcccctccccccatttgtctctgtccttgtccccaatgtgcgcggctgttttgcttctttgcccaatttgttgttggatgctgcgccggtgcagcactttttttaagttccaccccatcaacaaatggaaatgcttttaattaatgacttacatggaggaacaatgaaatgaaaaagtggtggtggggatattagagacaaaatgaaaaagttagaggtgatccgatcggccaaaaaggtgcttgtttaaaaagtcaagcaaaattaatctgataatgcataatttgatcagatttttcatttgcgagtatttttcacatctttaatctggtccaatccttggctgtgattagacttcattcataacattttttaatgtcgttcaaacaaatctcactcgctgcattnagcagtctgaagtgatcagacagacaatgat

SEQ ID NO: 39444 - DNA, 1514 bp, Heterodera glycines
  misc_feature (1458)..(1458): n is a, c, g, or t
agcagcacgggattattgcgtttcagcttcatgtccttgcgatgggcaatgaacattcgcacctgagcggaattgttggagccatcaaaatgttggtttgatattcgtccaattaaatgcacaattaaatattaattaattgatcatttaccggtgtcccatctttgctggtataggaaacctgaaatttgaaattattgcaaggaacggacgacaattaaaaataattttgtacaaattaaagccttaattgggattttttataagtagtctcaattagagcttgcttccgacctgttccaccgtgaattccttgctgtccatcatctcgggcactttgccctggcgaaacacttccaactgaacgtgttcgcccttttcatatttggcaaagtccgcgtagaaaatggtgaacggagacacaaacgactcaattttgaagaaaaatttggagaaccgtttgtacgcaaaaacgtcgtcatttctgctgattgatgagtccataattactgaggcaaatggcaactcaatttgataaagcattttgccactgttcaggtcgtgcacatagagagcgtcctgttggatatttttaagaaattaataagacccatgaaagcgttgattggctatttaatcaatcaatccggctttagatcagaaaaatcggatcgggagatcacttgaacaatggacactcatttcaattaattaactaattaattaatgatggttcactggtaattagcaccttcacatccttcatgtagcagaccaacagcttgtctccggccacggggtagacaaatcgcaacaattgctttgggtcctcggggatgaccacctgcggcgtctgtttcgtgccgcccttgagactgactctgatcaatttgtactgcggcgcgtctatgtttgtgtagaccaacaccgatttgttgtcagagtcaatcatctgtccatttacaagtttatgtattatttattacactcgtaaaaaagttttgccctttttaatggcgggggaatttctctgcttacgcatttttattctttgtacttaatcagatggccgggaatcccggaaacagaaagtcccaggaaaagagattttagtccctaaaggcctttttgtctgtccattatcaaatcgttgtccattcttctgttcacgctttttcaaaatgacgagccttaatatttgtgcaatattattatggatgtacaaaataatttgccaatttttgctgcttgaacaaaatttgtctttcactttacaaattgtaccgtatgcctttattacttgtgatgtacacatgtactactgtatgctacagatttctcctcacttgataatccgcgtcagcttggtaaacaatggcgttagtttcagtgggccggtgaagttgtaatttgttcactcagatcggtgtaagcaattttgggtgttcttatcgtcgngcactttaatcacaaacaaaaagcgaccatcctctgacacttgggcatagctaaag

SEQ ID NO: 39445 - DNA, 1195 bp, Heterodera glycines
ggattcatattttaattaccaaatattctaataattcacctactctcttttgcaaattcgattaattgctgttcgacaaccttccaattttgccgagaaaacagttctgtgtaagaaaatcgaggatcaagtagcattgcgactcgcaactttttatttcttatagtttagtttattcaaataatgaatttttattttttaataaattaaataaaataaaaaattagtgaatataattttattattttaattaactcgacgagaacatgacattttcttaaaaatttcaaattactttttgattgataaatttcaaaattatattaattttttaatgtttatttatatatcttttaattgtaattaaatccaatttttatatttatttttatttgcaaataataaatttatcactagatcatttgaatttgcattattgatatgtttttctgcaaatttcattattttcttattatcaaaattatttattaagttgtttttgaatatttaaaaaaaatttaaatacgaatttgattattaatttcattaaaattaaaatagaatagtgccattaaaggaaattaaaaaatttttaattctttaattatttaaaatgttatatattttttattttgtatttataaatatttaaaattgctgcacaaattgacggttattgtccttcgatcgaactggagttttcctttatttgttttatagaatatacttatttattaaactattatattctcgtctaccagttaattaatttattattttttaaatatataaattccagaaaataaaaaatttacttttcttgaatttttatttaatcattttttaattagtatatttatttttaagccattaaaccgcaaaacatggaaaaaaagaatctagcgaacttttatatgatgatttgataagattgaattatggtttcaatttttgagttttgcgtaatgtataattaattttttctttcatcattatattcttttgaccatttattaatggatttttcaaattatcacaaacaaattaaaattatttttaattcaaataaatttttgttttctttacacttttttcttctatgttgctttaataattattcctctgtttcagatcatattttaatgctttttaatatattcgatttaattttgctttactaattaaaaaaaattaa

SEQ ID NO: 39446 - DNA, 1651 bp, Heterodera glycines
tttttgctccccataattgtttgagtaccccaaacggatacttgaaaaaatcgatttttttgttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgatttatttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgtttcataaatatttttttcagaaagtgctctaaagcgcaccaaattttatttacaacttaattttagcactctgatgctttagtatcaaaaaggaagcagagaaaaaatttttttaaaaatttttccttatattttggttatatcgttttgcttttggtggggtgcttggaacagtggaatcatgcgcacccgtccgatctggcaagttaagcaacgattgctgactagccaaaaggttcggtgccgtgatgaaacgaaccagcactgcttaccccgcggcacccggcacggtcccccgaggaatggatttaattaattctctccttcggggatttttttccattaagtcgtccgttagcgttcgattgctctagtcaatttttcaaaaattttttgttgaaatatttgtcgtgctctgaagggcgtgggggggggggggggggcgaaggccccaccacgaggccgcgaagaggccgagtgagtaccttcggtgcaggaaaattattaaattttaaaaattttttaattgctttttaaatatgccaaaaaatgtaggcttaacttttttagtgaaaattcgatcactcatattttttgctaattgagcagaagcgtaccaaactttgcagggatactccccggtaaaggactaacttacactgaaatgagcgccgagctagctggctcaaaaaaattttcgaaaatctgagtctttcgtttttatttattttttgcaaaattaattcttaaatattttttcagaaagggttctgaaacgcaccaaattttatttacatgttagtttaggcactctgatgctttttctatcaaaaagggagatgaataaaatttttaaaaatttttaattcctttttaaacaggccaaaaagtttaggcttaacttttttttcagaaactgatcagaagcgcaccaaactttgcagggatactgaaaggaagagaaataacctattttaaatattatctagtcagttcatttaaataatttttaaagaaaaaatttttttttgggttttcggggcagtccccctagaaagatgcgccctagatttatggggagaccagaatccttc

SEQ ID NO: 39447 - DNA, 1005 bp, Heterodera glycines
  misc_feature (989)..(989): n is a, c, g, or t
gaaaaataaaggttgcatccaaatgtaattttttttttacattgaagcatttggatggcttgctgtttacagttggcttagtcttctttgcaagaagcagcacaacttttgtttgggccaacgaccccaaaccattcgaatagcaatcgattgggctgactagactccatatttgcaggaatagcaatggcaggtctatcttaaaggcctgacgagttatgtttcgacaaacatcctgtacaccataaatcgatttgcaaatttagtcgaactatataaatttttcaaaaaatgattcatcttttttatggttagcgcatatgtctctagctttatagaaacggtccccgaatctgcgaggaactacttttttgagaatttctatagattattattctgcatgaatccttcgcttaaattcccatttatctcataaagtcagattaaattaattactccgatttgttttagaattggtccaaacacgcttgctaatagcttttcttttcgaaaagagaggcgaggaaaaataaaggttgcatccaaatgtaatttttttttacattgaagcatttggatggcttgctgtttacagttggctaagtcttctttgcaagaagcagcacaacttttgtttgggccaacgaccccaaaccattcgaatagcaatcgattgggctgactagactcaatatttgcaggaatagcaatggcaggtctatcttaaaggcctgacgagttatgtttcgacaaacatcctgtacaccataaatcgattttcaaatttagtcgaactatataaatttttcaaaaaatgattcatcttttttatggttagcgcatatgtctctagctttatagaaacggtccccgaatctgcgaggaactacttttttgagaatttctatagattattattctgcatgaatccttcgcttaaattcccatttatctcataaagtcagattaaattaattactccgatttgnttttagaattggtcca

SEQ ID NO: 39448 - DNA, 1066 bp, Heterodera glycines
gaggatttttattattaggaggtttttccagaaaaaaggctttttctttttttgataaattttatacccatacaaatgttcttgagcagaataggaggggcggtgcgcaattgaccttttttttttgaggggatttttaaatttatactctatcccagaaaaatgtctatctctttttttgagaaattttatacacatacaaatgctctcgagcatgatagggagggctgtgcgcaatagaccttttacttttgagggaatttttatatttatactctatcccagaaaaatggctatctctttttttgagaaattttatacctcacaaaagcgcttgcgtatgatagggagggctgtgcacaatcgccattttatttcacaggggatttttatatttagaggttatcccagaaaaatggctatctctttttttgataaattttatacacatacaaatgctctcgagcatgatagggagggcggtgcgcaatagaccttttatttttgagggaatttttaaatttatactctatcccagaaaaatgtctatctctttttttgagaaattttatacctcacaaaagcgcttgcgtatgagacggagggctgtgcacaatcgccattttatttcacagaggatttttatatttagaggttatcccagaaaaatggctatctctttttttgataaattttatacacatacaaatgctctcgagcatgatagggagggcggtgcgcaatagaccttttatttttgagggaatttttaaatttatactctatcccagaaaaatggctatctctttttttgataaattttatacacatacaaatgctctcgagcatgatagggagggcggtgcgcaatagaccttttatttttgagggaatttttaaatttatactctatcccagaaaaatgtctatctctttttttgagaaattttatacctcacaaaagcgcttgcgtatgagacggagggctgtgcacaatcgccattttatttcacagaggatttttatatttatactctatcccagaaaatggctatctctttttttg

SEQ ID NO: 39449 - DNA, 905 bp, Heterodera glycines
atcagagctcagattcgtgatcagccaattttttttaccctaaattcattggaaagaaaatttttaagaaaattaaaaacattaaaaaatcaagtgcttgatgaaaagtcatagataaaatcaatgatttttcaaaatctgagttcagattcgtggtcagcgtattcttttagcaatgaaaaaatgctttttgaaattttcctatttttttccatcgggaccgcaattctacacctttgccaaaagatgactttatgcagattcaaacaaatttcaatagtgaaaaatttgatttttgacttttgttcgtatttgagattcgaaatttatcaaactaatgtcagatacgtgatcactgatctgcaactcagaaaaccctttacaatagtcttttttctccgcgtttatatgaaaaaaactttggcgcctaaataaaagcattggggaacgcaaacaagaaaagtgccgccagtcttaatttcacatatatcatcattttgaataaaaatgcctatcattataaaaaaaataaagtttcgaagcgaaagttaaaaaacaataagtgtgaagtatgagttagacactattaaaagttaatagtgaacaatacgccaatgaaaaaacagacagctgagttagacactatatgttttatcattgtttttaaaaataatttggtatgctgaaaaattttaacctatgcacagattttcttcaaattttgcataggcccatattttaacccaacctataggatgatgctttattttttgtcaaaatgctttttaactcgagatcggctcttcagtttttacaagggaaaatctcggcaaaatttttaaattagtggggttttttggcgttttgtccttaggcaatttttgtcaaaatgatgatatatgatt

SEQ ID NO: 39450 - DNA, 1228 bp, Heterodera glycines
  misc_feature (29)..(29): n is a, c, g, or t
  misc_feature (55)..(57): n is a, c, g, or t
  misc_feature (67)..(67): n is a, c, g, or t
  misc_feature (70)..(72): n is a, c, g, or t
  misc_feature (95)..(95): n is a, c, g, or t
  misc_feature (98)..(99): n is a, c, g, or t
  misc_feature (103)..(104): n is a, c, g, or t
  misc_feature (107)..(108): n is a, c, g, or t
  misc_feature (111)..(111): n is a, c, g, or t
  misc_feature (113)..(113): n is a, c, g, or t
  misc_feature (116)..(117): n is a, c, g, or t
  misc_feature (125)..(126): n is a, c, g, or t
  misc_feature (129)..(130): n is a, c, g, or t
  misc_feature (134)..(134): n is a, c, g, or t
  misc_feature (136)..(136): n is a, c, g, or t
  misc_feature (139)..(140): n is a, c, g, or t
  misc_feature (143)..(144): n is a, c, g, or t
  misc_feature (146)..(146): n is a, c, g, or t
  misc_feature (148)..(149): n is a, c, g, or t
  misc_feature (152)..(153): n is a, c, g, or t
  misc_feature (156)..(156): n is a, c, g, or t
  misc_feature (165)..(165): n is a, c, g, or t
  misc_feature (172)..(173): n is a, c, g, or t
  misc_feature (185)..(185): n is a, c, g, or t
  misc_feature (198)..(198): n is a, c, g, or t
  misc_feature (208)..(208): n is a, c, g, or t
  misc_feature (230)..(230): n is a, c, g, or t
  misc_feature (238)..(238): n is a, c, g, or t
  misc_feature (263)..(263): n is a, c, g, or t
  misc_feature (268)..(268): n is a, c, g, or t
  misc_feature (304)..(304): n is a, c, g, or t
  misc_feature (408)..(408): n is a, c, g, or t
  misc_feature (415)..(415): n is a, c, g, or t
  misc_feature (422)..(422): n is a, c, g, or t
cttaaatctcgcaaaagtgataaaaatcntgacccaattttcatgaggggcagannnaaaaaaaganaannngcacaaaggaacctaaaaagggncgnnaacnncannaanangannaaaaaggnnagnncggngngannaannangnnacnngcngttttaganggggaannaaggaaaaaggngcggagaaaacgnggccgggcanaaccccagcaagaaaagaaaanggcacagngcacaaggcgagcgcaaccaaaaanagccnaaccccggagaaaacgaaaccacaaccggcaacggngcccaccgccgcaacccgccagacaaaagaagcgagccacgcaaggcggaacacaagccaaaaccaagcccccgcaacacaggcgacccaaccagccaaacaancacgganaaaccangcgagaacggcccaaaaaatcatcaaataaagcattgcaatttgaaaaggttacctcaaacggagaagaagcattggcgttggtgccgagcgaaaaggaggaagcggaagaaccacgagctgaacatcacatcattgggaaaagccgagaagcggcagttgaaacaagaaaagaatacactgtcagcaatgagccatgcgggaccaagcttcatccattatcccgtgtaaacaacaggaaatttaaaggactaaaccgagaggccaatggatgatgggctttgaaaaatttatgctaaattttttccctaaattttagcggatttttccaataaattctgccgtttgagatcctgagtctcggaactcaactcgataaggaaccgagttttgggattagactcagtctcatgaaattttttagccttgaaaagagcaaaactaaaattttcggcgctattatggaaaaaaatacatgttttaaatttttagatttataggttttcaaaaattttaaaatgtacacctaaaatctttttttttaaactcagattgaattcggcacggaggtcggcggagaacatgaatggccatttatggcacatgtttctgtaacatgtcacgtcaaaggcaaaatccggcaaatacaaacatgtggtggcacaattatccaaaagagatggattctcactgccgggcactgtacccatgcaaatatgacttttttcgaaaccaatgactgtgacgaatggaagcagccattttttgaaaaatcaaagatcagattcacggcaaatcaacggttgg

SEQ ID NO: 39451 - DNA, 920 bp, Heterodera glycines
acaatgtacaattgcaagtgaaatggggagattgaataagaaaaagtatattattttttttaaaattgttgaaaatttctttcgcgaaaatcattttgtacagaacccgggactgaactggacaaatgcctatgggactgaatcgtccaacgccttaaaaccgtaagaattttattgcgctaagattattggtgttatccgggcgcaagagcacggagcgagcggcgccccaactattggccgtcgtagtcgattgtgcggtgttttggccaaacttcactcccaatgcacctttaatttataacttcatgcccttgcctgttcaggatccgtaaccggtgtaaaatgcctttcgcaaaaaaatattttcgagtatatcatttggtacttttccgttttagttgccaaattccattttgtttaaaaagagtaacaagcctttcaatatgcaaatatacacaccgtttcaattatggcctctcatttgtcagttcaaaaaatatttgtatgtgtggcgaagtggtttttttagacagtaaagggaaaaggaagagaaaaggatggaggttcgagtccgttgtgctgcatgattagttttatttactttgtccaaaaaatttaaaaatatgactttaggaaattatttgtgcattttttgccgatcaaactggacaatcttggtatccttcgaaggctcattgttaggagaaactttttctttgcaaaagttaagcaatttgaataaagaaaagtacgccaaaatgagatgtatatatttttctatttccgccagatttcctaaatcctgcggattttcatccattaatccgttttttagatcatttttactcattttggtgatggtttcaacaaaagttcgggagtgttcctcgttgctcatgcgatttccgactaaaaat

SEQ ID NO: 39452 - DNA, 1585 bp, Heterodera glycines
atttgaaaattaaaatgcccttttgggtatggtatttagtggaccatcccagtaggggtaaaaacaacatttttactaaaatttttgagagaaagagatgggttaattagcccacaaccaaaatcagtgctttattgttatggtcaatttaatgatagtattcctgtactacaaaaaataggagtgcatgtgcacaaaggacctcctagggacgaattgctgacctctctaaagaaccctctcttattaattctagatgaccttttaacaataattgatgagaaaagcctatctgaattattcattaaaaaagctcatcatcttaatatgggtgtgattttcataacccaaaatttatttgaaaaaaagatgaaggtagcccgaattaattcacaatatattgttttaatgtctgctccgaatgctgcacttcaaatacgtaatttgggcgttcaactgtttcctaaaaatcttacatttttcctaagtgcctataaagatgcaaccgcatcaccgtatggatatttattcttggatttacacccagcttcgagccctttgctgagaatacggacaaaaatatttaaagaagatgaagaaaaagcattgtatattcaaaatgattagtttacctaaaaatgttattcaaaacttggattttttaaagaaattgacaaaaacaaaatcttttaaaaagagacaacaaatatttaaagaggctactagtgagcaaattggattattaattgaaattagttataatatattaaaggggtacttcccgctcacgaagagacaaaaatatagacttttaccatacgcaaattttgtaagaaaattagcaagagttagaactgagatgggtgcaaagaaagtttttcaacaaaacggtggtggttttttcgttaatttgactcctttattattaccagtacttattgccgcgctaaaatatggagaataaatttattctcgttccctcagacttgtacaaaaatttactaaagccagacgccggggaaattaatgttgataatgctaaaaataaattgtcatcacttttgaagcagcgaaaattggacgctacttcaaaaaatttactttacaaccaggaattgaggcgtttcttgaaactaaggaaggaagttgaagataaaccggtaaaggttgagctttcagatggctcattaatggtgtttaaaccaaaacagcgtgaaagagatagcaaaattcctactcaaattgttaatgacgaaggattggatgaaacaggctctattccaacacttgaagacccttacactactgctgaagagagtgatgctgagtcaacaacatcaacaccaaagacgagaccactgataagaccaatgcgtgtaggaacaactaaatttcgtcaaaagcaaaagtcttttgtagtcaagaaaaaaggaaaaattatgtcaattataaataatgatcctgagaaaattggggttggctctagaggacatatactgagagctgatggacggcatatttaaaagtaatgtaatcaagcatagagcgatattgagacggcacccgagatgctcatcacccatag

SEQ ID NO: 39453 - DNA, 790 bp, Heterodera glycines
gatcgatccgccccgtgcctccgtcccttcggcagttgctatagctcgttctgcagggattaacgttgtgatggtcacgggtgagctgccaatttagccaattgatcaaagcattttcaatgcttttaaggcgatcatccgatcactgcgcaagcgatcgcccgggcagttggcattttgacggacgaaacggaaaccgtggaggacattgccatccggaaacaatgcgacatttcgcaggtcgacccaaagtacgccgtccgaattcgcttttccaaatgccgcgcctccattcacagagaagcgagtgccatcgttgtgcacggcagcgaactgcgcgagatgagcgagcagcagctgatcgacgtgatcagaaatcaccgcgaaattgtattcgccagaacatcgccccagcagaagttggccattgtccaagcatttcaacagttgggacacattgtggcggtgagcaaatggccaaaagggcgactaaagaaagacaaatggaaagtaattgtgaaggtcacgggggacggagtgaatgactcaccggcactgaaaaaggcggacattggcatagcaatgggtgagcgaaggggggggggggcaaaagcggacaaagggacgcgacgggaaaaaatgaagcaattcagggataagcgggtcggacgtgagcaaacaggtgccactttgatgcattaattgcctaatgatttgctcttttttggtgactgacatggtgctgctggatgacaatttcgcgtaattcccctcaaaactttttctcgcg

SEQ ID NO: 39454 - DNA, 883 bp, Heterodera glycines
  misc_feature (10)..(10): n is a, c, g, or t
  misc_feature (750)..(750): n is a, c, g, or t
accaaaagcncggagacagcagacctacctcactcggctgttctgcttgtcggacgcgatggcagcagccaccttctcaaacgcctccttggccgacttgacgctgccctggcgaaacgtcgcttggaccggctcaatgacgacggcaccaccggccggtgagtgatcctgcactgcttgagcatgttgttgcagttgctgttggtgtttctgttgtgccgatgtcgtcgtcgtcgccgccgctgctgctttttcctttttgccgccaccgccgtttgttgtcggccgtgccgccgagtcggccgcttcacgctggaagtcctcaaagatgtggtccaagtagtcgatggcctccttgaacttgttccggtgctgactgtgccggtaccgggcctggtcaatcatctggtccagccgacgggtggccgagtccaactgagtgccgctgaaaaaaaacaattttttgaaaaatatgttgtgccattttccaccactcatttgataagagaggcacaaaaatgtttcaaaaaaaattattagaaaaggaaatttctctaagaaaatttcaagaaaaacttagtaattaattcttcatataattcctaaaaatgatttcgggtgggggaatgtaatgtacaaagaaatggacggtgctaaattcctctgatcaatgactgatcaaaattgtaaaaaaaagaaccaatttctatttgcaaataaattagaggagaaaaatatggcaaactttgnggcggacaaactgacccaaaaacagtaggagtttggcactttgtgtgcccatcaacggcagacattttgtgtgaacaaaaatttgtgcaattagcaaagagcaaaatcgggaaccacttactgatcggtttta

SEQ ID NO: 39455 - DNA, 711 bp, Heterodera glycines
  misc_feature (589)..(589): n is a, c, g, or t
aacaaaaagcgattaaaattatatcttcagtcatttgattcgtttgggattttggggctcagtcaaagggcccatggatttaaagtagggttcgagccccgtggggcgggggtggcttttcacgggggcgggggatgcgggggtcagagtcacgggggcgggggcgggggcacgataattccgctcccgtggggacgggggcgggggtttgctttgaattaggtccaaaaatctcacaaaaaaatattttctaagaatgatttctttggctccacattcctttatttgttgatcgcctcgatactatttcttttgacataaattgcacagattccgactaaaaagtaaccaaaatttagggatttttgggtaattttttttaagaaaaaaaaaatttttttttttggggggggggcgtgccgataggggcgaattttaaatttatttctaacagatattcaccaaaaaaattaagactttttcgataaattttcgttttttaactatattaaattatcgtgatttactcaaaattggaactcagattttttaaatttttttttcttgcggcacatttaaagtgcgaggnggagagttcccggcggtgccgataggcgccgccgggaaaattttttgaaaatttgaatgcaatttgttaacaaattttgtacaaaaaatgagcaaaaatcgcgagcttgggataatttttaa

SEQ ID NO: 39456 - DNA, 947 bp, Heterodera glycines
aaacttttcaagcccaatcccaaaaatttaaattttttttttttttttcacattttaaattttttggcttaaaattgccaaaaaaaaaccaaaaggcaaggaaaatttttgaaaaaaattatgtatttgaaaaaccttattattttatttgcaaaaaaatcgtatttttttaacccaaaacttttcatcattttgattgtcttgcgggttcgattccttaagagttcggtcataattttgcaacaattttttttgggtgttgggtccacttctatgtaattttcttaattaattcatttttcaaaactttttgtcgacgatccttttttttaacagaccgccaaaattttaggggtttaaataaattattttaaaaaaaagttttactggaaaaattattatattttttatgatttttaccgccagcgactgaccactttttgcataaattttgaaatttgagttgtttgtttaaatgtatgtcgttcgattagcacatttgagaaaattagctttttatcacacagccgaagaaaatttttgaatttttaatgaaatttgtagaaattttttagaattttcttaaatcttatttgataaaagaatcggttaagattctctgttgtagaagcttttgatcatactctcccccctccctcttaatcacctcgtcatcttccacattccgagagcattctcgccgaccctctggccagcttctctgatcatcttatcccctccaacctcggcatctcttatcattctcgtcaccggcatttgatcaatcaatcccccctccggcttctctgatcatcttaacccctcctccctcggcatctcttatcattctcatcccctcctcccccggcctttcatcaatcaatcccccctcaagcttctctgatcatcttaacccctcctccctcggcatctcttatcattctcgt

SEQ ID NO: 39457 - DNA, 658 bp, Heterodera glycines
ttgttttttttttgtttgaaaaaattgtgtgtccacccattttgaccctttgtggatgggggcgtgcggtctaacccaccccccccccctatcaaagaaatttttttaacgaagcggggggtggggggggactgggtataaaaatgcatcagccattattgatttattttttttagaaaaatttctaaattttttgcctttcccaacagcaggtggttcggctggtgcatggagtcagcaaatcatgtccacagcaccgaacgacagcatagaggaggaagaggaggacggctcggacagtgccgccgccaccaccgcaacaccggcgagtgttggctcgtcatcgttgtcgtcgccgacagccggcggcgccgccgccggtgtctcctccaatttgttcgccagcagcagcataaccacggcggcagcggcggtggccaacagtgagagcaatgacggtggtggtgttgcatcatcggaggagcataacaataacaacaacggtaggtggaagtgggtcaggcaaagtaggggaagcacgtcaccccccccccccccctccttcccctggaaattttttaacaaaaaaaacaaatatttaagaatactaaacattttgtttgtttgttttttttaattttcccgggggagggtattt

SEQ ID NO: 39458 - DNA, 1297 bp, Heterodera glycines
  misc_feature (1287)..(1287): n is a, c, g, or t
ttttgtttaagacaaccccgtttataagatttggacttctaagataaattttttctatgtaaagatggagcgcattttttttgggaaaactcatttggaattttttctttaaattttcggggggggggggacgcagtgggaaatgaaatgaatcaaaaaacaagcgaagatatttttaatcgcttttggcaaattcagagggacagaagggcccggcggatgccaacaggcgccgccggcgactaaaaaatcgttatgaaaaaccgggggaaatcttcaaaaaaaacttagattttttgaaaatatgaacaaatcttgtttttgttgttagaaatcacataattggcagacatgttaaattatgaattgtttgatattttatgtttttttaatgatatgtatttctttcattgtctattggataaaatttaaatgtgtaaaaagaaagggaaaagtaaagttaaataatgaaatcgcataaaatcgaaaaatgccaatttttcatacatacttttctgcaaaattgaatgtgcatattttggatcttccaaaactcacggcttctatttgctctcacctattttttaagttaaaagcaattgttacgccgcaaaactacaaaaattttccgaagtttcgcttctcgaagacactaagattttgacaaaaaaaaaaaataatcagcgaccccgaaaaccctcgggaaacatgttttcatgacttttgaaaacaaaacaaaatttttgaaaaatgggggggggcagccctactatgacccccacccacccctttcatgtatgaacatactattggcgtctatatctcaactgcacctaacaaaaataaacaaaaaaggaaaattcgaacgaacaatggcaaaaaaaaaaacaatgagataaataaaatatgtgtatgcatcattatcatattttgtccatcaatcagccgaactctgatcagcaatattgtgtgtgaggttgatcgatcagaaactccgctccaccatggttttgcacaaccgttccaactggtcacacacctggttcatcgcctgggcacgctgcgcattcagcagctcaccgccgcccgcctcggcaccaacctgggcacaaaaaggcactcaattccttttggagaatttttttcaataaaattcgtttttttttaatttttgattccgtcgtttcctgtgcataaaatgcttttctgacaaatttttttttgctttttccccccaatttttcgggggcaaaaaggtgtgcaaaaccttttaattttttccaaatnttttcggggg

SEQ ID NO: 39459 - DNA, 1028 bp, Heterodera glycines
  misc_feature (762)..(762): n is a, c, g, or t
ataacgttacaaagtctaatttagatgagtgtttttatcatttttaaaaccctgttcttggtcgctttcatggcacttttcttcaccggataccctgctgatgttgctggtgctgttagttcatcaggcaacagacgaaatgttaaatacattgattatgggccgcttattcgacaatcccggaaaaaccaaaaccgtgtaaatttttattacataccaaacatagtaagagatcagtaaaaaaaagcttgtcaagctctattagcagcaaaatttcaatttcgaatttcaatgggacaaaaaatttatggaccaaaactgaaaaagataaatttagctttagctgcagcatatcagaatttgattttgctttaattacctgacttttttagaataaaaactcgagaccgataaagacacggccgtcgccgagacgaggcgattgatgaccagcacagaagaaagaataatcgagagaaagctgatgaaaaattgagaaactaaggatgattaaaactgagtcgaaagtatggaaaatggatgaatgcattgtttttttgggaataaatcatattaaagtgttcccattcgtccttgggtgccaaggacgtccttggatttggcttagtgtcttggaaaatgaagaagaccttttttccaagaatgcccttggaaatcggcattagaaaaaaatattcaaaattttccaaaaattcataaatccgaaaaaaaattccctcggcgtcattctctttttcttanaaaaaattggcccaaaatggcaaaatttggtgaatctgttaacaaatctcattataaatcccaaaaaattttccggcggcgcttatcggtgccgccggacccctttggtccccaaagttaaaaacaacgccgccgaaaaagtggttgaaaaatgtaagaaaaaatgggaattgacagcggaacaaaaaaataatgatgacaaaatcacacaaaagattaatttatatttgacggaagagggcatttaaaaaaactgggtcccaaaa

SEQ ID NO: 39460 - DNA, 593 bp, Heterodera glycines
ttttaaaccttcttgtacctcttctaatcacttttgtacctcttctaatcacttttgtatcttttatcacttttgtacctcttctaatcactcttctaatcgctgttgtacctcaaaatttaaaaaacgggcgcgaagcgcccgtatgagttcaacgaatttaaaaaacgggcgcgaagcgcccgtccaaggccaacaaaaattgaaaaaccgggcgaagcgctcgactgaggccgtgaagcggcctaacaagctaaaaaacaggcgcgaagcgcccgtatgagttcaacggatttaaaaaacgggcgcgaagcgcccgttcaaggccaacaaaaattgaaaaaccggcgcgaagcgcccgactgaggccgcgaagcggcctaacaagctaaaaaacgggcgcgaagctcccgtctgaggccgcgaagcggccttaatagcccaacaaatttataaacgggcgcgaagcgcccgtctgaggtctcgaagctgcgttaatagcccaacaaatttagaaacgggcgcgaagcgcccgtataagcccaacaaaattaaaaaaacgggcgcgaagcgcccgttcgaggccgcgaagc

SEQ ID NO: 39461 - DNA, 852 bp, Heterodera glycines
  misc_feature (740)..(740): n is a, c, g, or t
  misc_feature (801)..(801): n is a, c, g, or t
tttgtttttttcttgtatttataaatttccctaaactttaagctttcgaatgataccaagaatgtctggattaaccaagtaaaaaaaaagttatgatctaaaaaagtgagggtggtcactcattggacgcgtaaacattgattggacgcgtaaactggaatagagccgtgattttaaccattatgttggttttttaaatatcgcctataatgattgtagtttaatcggcatacccgtcctggaagccgaccttggacgatacgagccctgaacaaaactattaccgaaaaaagttatggacaaagaaacggatgattggacgtctaaagtgcactaaaccctatttcggtttatttaaaaattttgggcaaaacgccaaatatgataaaattagtttttttttcaaaattttttttgattttaggttctaaaaataaaaacttagaaagtaggtgctaataactagggctgccaaaaatatgcacgaaaagtggccaaaatatgcacaaaaatcgcaaaatatgcaccaaatatgcacaaaaaaacttgaaaattaggggtgcaaatttaataaaaagaaattttttttcactagtgcatttgccaatgagctacatttcatttataaaattctctttagcaaatatttgacattttttaaatcaaaaattttgtaatgaaaaaaaaatttggggaaacaattttcgaaaaattttccaattcttagtggtgtatttttnaaaacatttttggtcgattcttaggggtgtattttttctgtatttttaggactatttttanggggtgtatttttccgttatatttgcatttttgttaacaattttccaaaaa

SEQ ID NO: 39462 - DNA, 1026 bp, Heterodera glycines
  misc_feature (117)..(117): n is a, c, g, or t
tgcatcggtgatcacggcaaggcttaaattagaaaaaaagtgtggattaaagagcaattaggactccaataaatctccaaattgggttaatacattttgtccaaaagtggccaattnacggaatggggacaagaaaatttctctcctccattacgttaacagaaaggtaattaaggcatggccgaatgagtcaccaaaaggggtttgtaaatttacagtttcataaaaaaaattatgcgacgaatttgaataaaaaattattccattgagcagaataatgaatttgatgaaatttgctacgctgcgataaactaattgatatgctgattaatgaattactttaattggttgtccctttttggcacttttttacctgtgcgccaaatatccgccgaccaattcagtaagcacaaaaagaagggtcaacacggaaacaatatagagcacacgttcggcacgactaaaaaaaaagtaaaacggcattattgggaattttttgaatgcaattcttacagaatttacttttaatttaaaattaaatatttttttctcacaaaaaaatcaaaatgaattttttgctaaaaaatctcaaaagaatgtttaaaaatttgattgtaaaataatcaaaccaaccgcgagttgtggtcatcgatgccaatggacagggccgaacttttctcgagattgcactgctgatcccacaccttttcaggcttttccgtcttttttgttagcaacatttttatgcaataaataatttaaggaataaaaacgaaaataattgctatagcaaaaacaaatcagagaaaatatcaatcagtttaataaaattaaaataaaataagaaggataaattaaaattaaaaaagaaacatttgaattcaaaaggtttaccaaagtttgacattttatctgtgttttttacataatgccagtaaatttatcattttttgtgttgtgccatcacttttgcatttttcacgtaaagggtaaatttttatctcactgaaggagaagtaatgaata

SEQ ID NO: 39463 - DNA, 138 bp, Heterodera glycines
aatcaacgaatttattattttacaaaattttaatattttgttttctttgtttagacacttttattttgcttctgtgctattccgatcattgttggagaaatgtgcacacaaagaacgcatcacatgtatttgccatat

SEQ ID NO: 39464 - DNA, 967 bp, Heterodera glycines
gatatttgaaatgctaacgaaaaaaattcttgccgaaaaaatggctatctcttttttctcttggggatttgaccgcaaacttggtaccaacatttgccttctctagtctggctctaccaaacactcacacgatatttgaaatgctaacgaaaaaaattcttgccgaaaaaatggctatctcttttttctcttggggatttgaccgcaaacttggtaccaacattttccttctctagtctggctctaccaaacactcacacgatatttgaaatgctaacgaaaaaaattcttgcccaaaaaatggctatctcttttttctcctggggatttgaccgcaaacttggtaccaacatttgccttctctagtctggctctaccaaacactcacacgatatttgaaatgctaacgaaaaaaattcttgccgaaaaaatggctatctcttttttctcctggggatttgaccgcaaacttggtaccaacatttgccttctctagtctggctctaccaaacactcacacgatatttgaaatgctaacgaaaaaaattcttgcccaaaaaatggctatctcttttttctcttggggatttgaccgcaaacttggtaccaacatttgccttctctagtctggctctaccaaacactcacacgatatttgaaatgctaacgaaaaaaattcttgccgaaaaaatggctatctcttttttctcttggggatttgaccgcaaacttggtaccaacattctccttctctagtctggctctaccaaacactcacacgatatttgaaatgctaacgaaaaaaattcttgccgaaaaaatggctatctcttttttctcttggggatttgaccgcaaacttggtaccaacattttccttctctagtctggctctaccaaacactcacacgatatttgaaatgctaacgaaaaaaaatcttgcccaaaaaatggctatctctttttt

SEQ ID NO: 39465 - DNA, 747 bp, Heterodera glycines
  misc_feature (62)..(62): n is a, c, g, or t
cataatgtactgtttgcatatggtaacaaagcaaatattaaatacgcactcaagtacccttntaaagggccaggacattgttatgtcgagtgcaaacaagagtccggcaataaaatcggaattgatgagccggctcaatatgccaagatgaacttccgtggtgcaacggaagcatatgccattgttcattcactgccatttgccaaactttcacatcaggttgtcaaacttaacatccatatgcctaatcaacaaccgattgtgtacagggcttttcagctggtgagcaaagctcaacaaatccagcaaggcgaactgccagagacgcaatgttctgcctattggaaacaatggcaaaatgaatggaagcatgatccgaagctcaaggacatgctttttgaaaaagtccctgagcattttatatgggcaaaggacaaatggaacaaaaggaaatataacctaacaaagagaccaccaatcggtcgaattgttcctgtacccccatcggacccggaaaggttcgcgctctattcacttatgcgtcactttcctggagacccagaccatcttaagatggttaatgggttgctttgtacctcattcactgaggctgcaataatgcatggtcttcttgaagacgacaaaatttgggacaaaactctggcggaggcagctctgtcgcgctggccagatcagatgagatggctctttgtgagcatcctggtctatggccagccgagtaatgcc

SEQ ID NO: 39466 - DNA, 1136 bp, Heterodera glycines
agttgtaaaaatggaggttttttgactcaaaatgagctttttgaaacttttaatctgggagccctgttttttgcatttttaatttgattcataatttttcagttgaataaatgcaattatttcaaacgtaatagtaatttttcataatttttaagaaataagaaaatataaaaaaaaaagtaattcccctccaagtagttgtttttcttctaatttttcaaaattattcatttttcggtgggaattcaatcaaaattttaacatttaaaatcataaaatattgtcatttttggactaaatcagttaacaaattgcacttaaattttaatgaatttttgttttgtgcgtttttgaaatgataaatattgtaccaaattgaatcaaaatttaaaaaaaaaccaaaaattagttaagaatagagtcaaaaaatgtttttaacgatttttaagcgaataggaaaattttttgaaaaaagtctcgagtctcgggttttttgggtctcggtctcggggttttcggtctcggggtcgagtctcggtctcgagtctcggggtcgaatctcggtctcgagtctcgggaaatttttggtctcgaacagcactagtagccagacccttggcacttacttagaatccatgtgcagaaaaatgcaattgatgggatggaggaatggggggattcggggatggcaccactcggggaaggggaacttatccccgaaaaatgccaagcaataataaacacctcacaaatcgttacagtaccttgtcccactgactgcagttgtggctcaacaactagagtatttagcccgggaacaaacagtagcggagcagagagcagcccaagcgtaacacggccggcatttgccaaccttttggtagtgcggttcatcatgtcacactcaatctttaacaaaattaaaatctcaacttttcggttgttaaatttgtttttttaaatttaaattacacggtagaattttttggcacgcagatacgaacaatggcacacacttggcttcccctcatattgccaatttccgtagatgtccgggtcatgaccacctttcttgtcctttcccattgcaaaaaattaccaaaaaatcaaaaaaaaaaaatctaaaaataggtaaa

SEQ ID NO: 39467 - DNA, 631 bp, Heterodera glycines
aaaatctcaaaatatggaaataaatggcaaaaatgtcaaaatatggacataaatttttcaaaattgagtgcaaaatttcttcaaatttattggttgaaattgcatatgagatacatttccaaattttttgactcggtaaggcgctttgacaaagacggctttcgtcttgcaattagtcggtcaacattcggaaattggtctcgaattttttcggcaattacgtgcaatcattttaaaagaaaaaaaacataaaagccaaaatttattaatttttaagaaaatttaaatttattcaatattctcgagaaattttggcgaaaaaatgattttttgaaaaatttttcgggttttgggctcaaaagggctaatttagctgctgggggccgttctaatagaggtttttttgaaaaatgccaaaatatggacataaaatatggaccaaaatgccaaaatatggaaaaatatggaaatatggacataaatcgcgaaatatggaaaaatatggaaaatatggatatagaaatccttcctagaagcttcaaaccaagctaaaaacatgtttttcgtgcgtttcaggcctcccacagtccaggaaaaaaatatggatttccatataattacacgccctact

SEQ ID NO: 39468 - DNA, 1064 bp, Heterodera glycines
  misc_feature (72)..(72): n is a, c, g, or t
catttacgtgtagcaaatgtgcgggagtaacaaaaaattgcgaagtatgtaaaacaatgaaagaaatgctancatggtcagtagctgatggtataaacccgctggagaaatttattgattggatattagaatttaaattttctaatactgttgcttttggtcattacgcaggttttgatagtaacatggattttcttaattaagattatttaggaagatatgattcacatttcgtgcttaacgaattaacaagaagagggtataagccgaaaattatgataactgacttaaaaatttatcaaataaaattaaataaactcgtttttcgtgatttctggctacttagccaaaacagactaagtgttttaccaaaaacattaggacttaatacgcctgcaaaactttttttcccacataaatacaataagccagaaaatttcggtaaggaagaggattaatattgaatgcaaaaatttttagggtgcaaattaaaccacttgccatgtattgacgactatggtcctaacaatatgaaagaggatgagtatgaccatttcatgaaatggtatgaacataatagagatactaaatttgagctcggtaaaagaaactaaaaagtattgaataaaacactttttaaggtgagcaattaaaaaaatattgtgaaaatgatgtacagatattgcttgaagctatattgaaatttcgagaattgtttttaaatataacacacgatgttcgtacgccttatggatatgatgtcattaaagatggcatcacgattgccggaattgttatgaaaatatttagaggaaaatttttattggaaaaacatatcccaatattgccggaaaaagggtaaaaattatatattaaattaggtttacatgactatttagttttgaaacagctgataatcagagtgtaattgccataaaatatttcaattggatttcattccgcgataatgttaaagtacgtcatgcatgtaacggaggagaggtgtcgtttggaggtttgaaggttgactgtatcataggtgcgcaaaaaaaaattattgaatt

SEQ ID NO: 39469 - DNA, 1016 bp, Heterodera glycines
aaattaaaaatccaagaaaaaataacattttatgtttcaattacggcctcatttcataatttcgagaaattccgatcaaaaatgcaatgatgaattgatggttaaaacgctgatgaaatgtaaatttttaaataaattaaataataaatttaattaaagttaactcatttttcatcgcaaatttcattcaaaatttctgaaattttcccggcggcgcctatcggcaccgccggataggctttacttaataatcctgtagaaattgagtcaaaaactgcgtcatttggtcaattttagacaaaatctgttaacaaatagcattaaatttcataaaatttttatgcatccaatcaaagttttatgcgtccaatcattttttatgcatccaataacatttaccatgtgaaaattattatcccttgccagtttttgtaaaaaaaatctcttttacactacacgggataattgcgtctcttttcttccaaaatatgctgatatattttggaatttccgtgaaatcgtctgaacatatactgatacaaatatgtcggcaacatatcctcatttgagccacgcaaatggcgaagagatgtcttcagagacccccacgtagcctcaatgccttgggtatgcacttacttgtctgtcatgagtagggtcgcaacttttagtgaaaaaacttttttttgctcaattgttttgaagaaaggagctcaaaaaacgcatttctgcgttaaaattttttcatttggacgtcacttttcgtcactagaaatcactattttggcgttttgtcactattttttcactatttcgacatttttttgaaaattctttaacaaaaatgcaataaaacgaaaaaatacacccctaagaaacgacctaaaaattttttcaaaaatacacccctacgaatcaacaaaaaaaatttcaaaaagcactcctaagaaatgaaaaaaattttcctcaaaaagggattttcctggggaaaattttaaatttaaaaaatatttttt

SEQ ID NO: 39470 - DNA, 1152 bp, Heterodera glycines
tttttttggaaaaagcacgccgcaaaaaaaacatttttattgattttttaaatttgaatatatttcttcaaaatgctgatttttgaccccaaatgaagattttttgtcggccaaatgcagattttgaaagttttccgttgaaggccttgtttttacgctaataaaatattgttttaagtcgatttttcatgtttttattacgtttcattcgcgctactatcagttttagaaaaaatcttatttttggggtccgagtcttagttttagcctcatctgtccttattttgaaaaaaaaaacttgcgaaccctgcttgtattttattttccttttcgcaacgtccctgcttcctctcccacttctcccatctcccctcattctttctttttgtctctccttattttattccgtcttaatctcttccttcacctctcctcccttctctcctctcttcctctctctcatttcctattttttttctctctctctctctcttgctttctttttccagtctgggcctattcagtttggcgcactttgacgctttataacttctcttgcaaacaaataaatttttaatttatatataattcgatagcctaagtgacctctattaccctgtaaataatataggaaacttagggctatgaatgattttaagaattaaaaatttagacgcttcaaagagaagttataaagcgtcaaaatgcggtcctattgaaacggcccatattgaaatgacccgcaccccaaattctgtcctttaagttccatgcccccaattaaaaaatatatagataagatgaaagtacttgcttatatgatttttgcattgaattttgcaattagtttgcaaatgattccttcaacgcgtcgttcaaagccgggctctttattacatagcgaacaatctgcttttgtgaaatacaaacaaagttctattaataaaggtaaaaaaggcttttttcatgaattatattaatttttagtttcttgttaagcagctaatgtgtttaatccaaatttagtaaaatttatcaatttttgtaccttttgacatgttttggcattttgtccatcataattaaaccatttaatctaaattgattcaatatataaatactctctaatcttcctttgaaataaatatcaaa

SEQ ID NO: 39471 - DNA, 768 bp, Heterodera glycines
  misc_feature (629)..(629): n is a, c, g, or t
  misc_feature (653)..(653): n is a, c, g, or t
  misc_feature (673)..(673): n is a, c, g, or t
  misc_feature (686)..(686): n is a, c, g, or t
  misc_feature (756)..(756): n is a, c, g, or t
ccgccgctgctgttgctgatggaaacccgccaaaaacaatttatgtaaaaattatattaaaaaaattagaggccggtaaattctattttttattcggttttttgttgttttttccatttggctttaacccaaaaaaataggattaaaatattttcaattttttcggctcatttaccgactcaattgaccaaatctcccttattcagtctctaataaaaaatttgcaaattttttaaaattttattttgccaaattgcagagacttgatgatccaacgtactcatttcataaatatattgaaataaaaaagaaaaaaattgtcgagaacatcaaacagaagaaagaggtcggtcataaaaatttggaaataaattataaaaaaattaatttttaaatttagacatttgcattgcacaaacgccgcccaataccgttagaaggacgtatcgtaatcgtagtggatgacggtatagcgaccgggctctcggcggaagcggcacttgtacaactgcgagacaaaaaagctgctgttgtgatgttggcatcaccggtctgcccactgagtactgtcggtaagaatcttgtgacaattttgcgctacagtaaattcaaataccgtatttccttanatcgagcccatacgtatctagaanagtctcaagaaaaagagtanatttcttttttanaaggctggcgggatacaaaaaaggtgagcatctataagtcattttggatgtccattttccatacccattnttgaagcatcat

SEQ ID NO: 39472 - DNA, 899 bp, Heterodera glycines
aaaaatttttgtatcattgtacacagatgaaaatgttcaacatgtggcagaccaaaaagatcaccatttcgacgtacttttttcaaaaaacttttggggaacaggagaggggcccgtagtaaaataatacggtttactcgtagtaaaagagcagcaaccccgaattgggggtaaccttccccggataacctaactttttacaatcagcagataacggataaggttctgctgctgtcaaatttttttgacaaatcctttgactttctttcattctttcatttcaccaaaatagggccaaatttcgtccaccattaatttttatccaaattttcttcgtcgaaccaaattgattttccttggattgctatgtcgatattcaacaggcaacaaggcgcataaattgctatagttgttgaggaacattttgacgagttctccccagacaacaaaaatgttgatgccattctgtgaccgtgcgcatttaggaatatttgaaaatgttcaaaattctcgccattggggtgccaaattttttctttgattcattcgctacgaatttacaccgcaactcatggtaacgctaccagggtaaggcgatctagggaaccttaccagagtagccttacctcgttctttacaggcacaggggttccaataggcgctgagagcaaaattgacgtgatttttaatagatttccttaaaaattgtcattattggatcttgaagatatgaaatttaggtttcttcatttgcacccaaaaattttacatctacaaaccctttatttcctcccattttatatatatcttttttatttcgtaaaaaaatttttacgttaattcataagaagaggattattatctttttattgaatattctccaatcaatttggactcta

SEQ ID NO: 39473 - DNA, 986 bp, Heterodera glycines
atacagtttgctatggcttcgcatcacccgcttcaacgggtgctcagtgtaaatatcgactggccattcaaattctgcctttccagccttatggaaagatattatggaacttttggttccatctcagttgtcaacgccgcgactgcatcgttattatatcagtcgatagaattttcgaatcgcttttaaatcgtctcttttgcgtcccttaatcttcactctgagccgagttactgcggtctaaacacgtttttggtagaattgcggccagaatttaaaaatacagtttgctatggcttcgcatcacccgcttcaacgggtgctcagtgtaaatatcgactggccattcaaattctgcctttccagccttatggaaagatattatggaacttttggttccatctcagttgtaaacgccgcgactgcatcgttattatatcagtcgatagaattttcgaatcgcttttaaatcgtctcttttgcgtcccttaatcttcactctgagccgagttactgcggtctaaacacgtttttggtagaattgcggccagaatttaaaaatacagtttgctatggcttcgcatcacccgcttcaacgggtgctcagtgtaaatatcgactggccattcaaattctgcctttccagccttatggaaagatattatggaacttttggttccatctcagttgtcaacgccgcgactgcatcgttattatatcagtcgatagaattttcgaatcgcttttaaatcgtctcttttgcgtcccttaatcttcactctgagccgagttactgcggtctaaacacgtttttggtagaattgcggccagaatttaaaaatacagtttgctatggcttcgcatcacccgcttcaacgggtgctcagtgtaaatatcgactgggcattcaaattctgcctttcagccttatggaaagatattatggaacttttggttccatctcagttgtcaacgcgcgactgcat

SEQ ID NO: 39474 - DNA, 374 bp, Heterodera glycines
aactgatgacaagctaatgtgataaaacaggttaattcttttcctttcagtatccctgcaaagtttggggcgcttctgataagtttctgaaaaaaaagttaagcctaaactttttggcctgtttaaaaaggaattaaaaatttttaaaatatttattcatctccttttttgataatataagagtcagagtgccttattcaacttgtaaataaattttggatcgcgtttcagagcagtttctgaaaaaaaatttatgaattaattttgcaaaaataaataaataatgaaccctcctccttaataattttcctgcgcccatggtactcactcggccgcttcgaggcctcgaggggggccttcggccaccccccccc

SEQ ID NO: 39475 - DNA, 968 bp, Heterodera glycines
attttggctaacgagaatttggcggcggactttaactacgccgaagttgttgaagcgacgcaaaagatgagcagttctgagctgaaggaggtcatccgtttcgcgttccttctgcgctaccagcaagtcgtccaaactcagatcagtgttcttcagcagtgagtccatggcagaacaaaacatttgcaattccaatgttttcattgccttaaggtcgtcttcggtggccaacgagggaagcgaaaatgaagcggagaaaatccaaatcaaattgtcgcacaacgacatcatccgagcgttccacgacttgaagaatgtatcgatggcgccattttccgagtcagtggtgacggaagaagtcgtcgatgtggattgatgcgttgacaatgagttctgctgataatgtgatcatatgcgttacaatataatcgcctcctcccaattcgtttaatgtatgtataaagtatgatatgatatgtagtacacaacccattgttcttttgtgttttgaataaagaaattgtcgagtcggaatttttggtttttgactaatacatatttccgggtcgttttttatgcaatgataatatccaatttattaggccataactagggcagggatttttaggtgctaaaaatcccaaaataggtgctaaaaacccccaaaaaggccaaaataggtgttaaaaattgaaaaatccagtgtctttatgtacaaaaattccaaaagcgactaattttttatcaatttcggccacacaattgcaattggtcaagaaaataaataataaatattgtggacgaatttttgggaaaattttttgtttcttaggggaatattttctgaaattttggtcaatctttagtgggtatatttaaaaacaatttttttggacaggttcttagggggtgtgtttttcaattttattgcatttttgctatgaaatttttggaaaaaggccaaaata

SEQ ID NO: 39476 - DNA, 1519 bp, Heterodera glycines
atagaaaatttaaattcataggtactactgctaaatcaacgcagagacgcctttccttgacctttttaggcccctgcaaaatctggtgcgcttctgatcactactcgaaaaatgagtgattgaattttcactaaaaagttaagcctaaactttttggcctgtttaaaaaggaattaaaaatttttaaaaattttattcatctccctttttgatagaaaaagcatcagagtgcctaaactaacatgtaaataaaatttggtgcgtttcagaaccctttctgaaaaaaatatttatgaattaattatgcaaaaaacaaataaataatgaactctcttccttaataattttcctgcaccgaaggtactcactcggccgcttcgcggcctcgtggtgggccttcccccccgcccttcagagcacgacaaatatttcaacaaaaattttgaaaaattgactagagcaatcgaacgctaacggacgacctaatggaaaaaaatccccgaaggagagaatttaattaaatccattccttcgggggaccgtgccgggtgccgcggggtaagcagtgctggttcgtttcatcacggcaccgaaccttttggctagtcagcaatcgttgcttaacttgccagatcggacgggtgcgcatgattccactgttccaagcaccccaccaaaagcaaaacgatataaccaaaatataaggaaaaatttttaaaaaaatttttctccatctccctttttgatagaaaaagcatcagagtgcctaaactaacatgtaaataaaatttggtgcgctttagagcactttctgaaaaatatttatgaaacaaaaaaatcgattttttcaagtgtccgtttggggtactcaaacatttatggggagcaaaaatccaacgcagaattaaagtacaggctatagggaagctactcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaataaatcgattttttcaagtgtccgtgtggggcactcacacaattatggggagcaaaaatccaacgcagaaatagagtacaggctatagggaagatattccggaaagattcggtctccccataaatctgggcgcatcggttcgggggggactgccccaaaaaaaaaaaaaaatcgatttttttcaagtgtcc

SEQ ID NO: 39477 - DNA, 1460 bp, Heterodera glycines
ggattacatatgtatttccttgttaaaaagagggaaactttgatactttagtggaatatatttaaagattcaattttaaaaatgcaatgcaaaaaagccaattttagtaaaatatttcctcatcaattaattattaatttagtctgcttaaaatgataaagttaatatgaatttttttattttggttccaaatattaaaaaaatgacgattttaataatattcaagaatcatttttgaaatgttttaccaacaaaattgaacaaacttggtatcattcgaaagctcttaatgaggagatgaggagaagctttttttaagcaaatgttaatcaatttgatgaattcgagaaaagatatggttttctagatttttttttgaataaatttcctatttaatccattttaatatagacctgacatgttttttctttacactctctctttattggttcatctctcgtttttttgaaacgttgtagtaagttagcatttagatgtagattaaaaaatgcaatggtttttgatcatagatcttaagggcatttgtttttatagttaagcgtatacagtaacccaccccaccgcatcaatcattcattcccctcctccacagtcgcattgtgttgtggcattgtcgcacactttgtggccaaataacacagacccattattaacaccgtcgctgctcaatgcagtggcctcattaatgaagaattgatgcggtggggtgggttactgtatacgcttaactataaaaacaaatgcccaaaagatctatgctcaaaaaccattgtattttttaatctacatctaaatgttaactaaacaagtttatataactgataaataaagattttattagcatgtttatctctctctgactcgaaatttttcgtctctctctctctctcttttctctctcaagttaattccaaactgtaatttaaattatcgcaaaatagcgcacacgttgcgagcggcgcggccgcgtcacgcctaccagatagtctatgcgggccgactggcagcccaggcatttggggcgcacatcgtgcccctcgatctgaaaatatgaaccaaattaaatttaattaaaaaaaaagttgtgcacccaaagcctttgactgtcctcatccccccgcacgagtcctgtccacgggtcgatgctgtcttcgacctgccgcgcggcctgatcgcgcgccgcatccgcatatctcgcccaccagccgttgtcgcagcatgtgtcacagattgtgacacagccgcagttgttgccgcggactgtcactgcacagtccactccatgctcgccatgccagaaggaagcactgatcggagaaatttaattctccgatcagtgcccccggcgcatcacccgaagggcttggcgtccgttgcggcactggccgctcaaagtgcgtgcgggggggttcccatccctgcattggttgatgttgttg

SEQ ID NO: 39478 - DNA, 1043 bp, Heterodera glycines
  misc_feature (78)..(78): n is a, c, g, or t
aaatttcaaaacggcagacaccagatgcatttcaacaattcaacaatataatataaatttagcaaaaatttttgttcnttcctctttgaaatgttctaaattttgcttgtaaatattcagataacaagttttttttactgaaaattttttacacactacaggatgaaacgcaataaataatgtttgtagacaaaagaaattggcgaaaaaaattgcctcaacaatcagtggtgaaactgaaagaaaaaaacttccccaaaaaatcggagcttttccgacggcatcagctgcatttccaacagttcaacagtataaataaatattaggcaaatgaaaaatttttttccttcctctttagaaagtgtctaaaaatttttgttgttaatattcagaaaacgtgttttttttactgacaatttttttcaagagaaggatatgaacaatcacttataaggctcatgcttggagataaaggaatcggaaaaaaaaattatctcaacaatcagtcgtgaaacagttcaataattcggaagcagtgccatattgggaaaagatgcacaagtagagtaggctcgaaataaaggcaactgccgaagattaacaaaaattcaaatttattggccccgttctgctttgacaggccatatctcgccagggagtggcggtagaccctttgttgatacatttgaaaatgtagagcgcgtctagctcattcgaataacatcaaactggtttgtttttgtcacgaaacaacccgctgatggccacgtcgaagaaaagtcccaaaatttgacatccataaaactccattttttcataggccagcgtgtttaaagcaaacccgaaactgataggaaatttaaattgatcataatagaagtttaatttttatttgtcccatgcattttctgggaaatcttttcgcgaaaagttgaaaaatttcaaaacggcagacaacagatgcatttcaaacaattcaacaatataatataaaatttaggcaaaaatttttgttccttcctctttggaaatggtcttaaatt

SEQ ID NO: 39479 - DNA, 1680 bp, Heterodera glycines
  misc_feature (34)..(34): n is a, c, g, or t
  misc_feature (71)..(71): n is a, c, g, or t
tttgacctttttgaaatatttttgatgagtcacncgttcggatcaaagcatatacaaaagcagcaattacnatcattaaaatgcatttcatgaacagtccaagccatttgctgcttttgctttggaaaattattcggtgttcgaatcggtcgtcgtttaattgcgccatcggagtgtattcagtgtttgaattggtcatttggagacagttggttggatttaaacgaactaaattttaattatcctttagtattaaaatgattttggtggattttctattttaaaatattatttccaaaattttttcagaattttgctaattttaagtatttaattaaataaaatgagcaattaatttaaaacacattatgtcttatattacactccatttttttgtttggaaaattatccaaatttaaatcttgcggagattaaaattgtgattacctttatgttctttcttcaaacaacgcaaaactatgtagtacatccgggttatccaccctccgaaaattttttaaattttttacaaggagaattttttagtgatgcgacatttgaagattggcactcgagcataatagggagtcgaaaatcgagaataaagaaatcttaatgaaattaattgaaatgtatttttttaaatcaaaaacatacatgaaaaaagggatgggggtcaaccgaaatttttggaggccggtggtgccgattaacgccgccggtaaaccgggaaaattctttgtggttttaaataaaattttaaaataagatcacttacaaataaaattaaataattaatttataaataataactccattaaaaacaattattctttgatgaaaaaagagaaattgttgaaaaatatataaatataaacattcacgaaaggaatggaatgaatttagagcaaaaattaaacaaataattgatatggattctgtgacgattgaaaaatgggcaaagaaaattggcagcaaagaaaatacttcaaaaagtaaacttttaaagactttggttttattatttaatttaaatatttttagggcggaatcattatacaattgctgaaaaaatggaaacattgaaaaaaataatttaaaaaaaaaatcccaccctcactgactgtgaaatgtcaaaaatattggatattccacgaagttctttacaccatatcaaaaataaatattattaacattgtcaaaatattatttaaaattagaaaatatttttaataccgtagatgaaccaaaaagggtactttacggttatctgtgtccagattttccaaaaaaattttttttgaaataaacttgttttagggttttcagggtcggggaaaccgattctggcatctgttttgacccaattcgaaccccgaacccggattcgaacaaaaaagtcaaaatccatttttcaaaaaaattcacattttttatacacaaaattgagtcgtggcctttttttggttatacgagtcgtcgtcgtggcattttttggtcatacgagtcatcgtcgtggcctttttttggttatacgagtcatcgtcgtggcattttttggtcatacgagtcatcgtcgtggcattttttggtcatacgagtcgtcgtcgtggcattttttagtcatacgagtcgtcgtcgtggcattttttggtcatacgagtcgtcgtcgtggcattt

SEQ ID NO: 39480 - DNA, 890 bp, Heterodera glycines
cactggaaaaaaatcgatttttttgttttcgggggcaggtcccccccgaaccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagtctgtactttaattctgcgttggatttttgctccccataaatgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataaatgtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgaaccgatgcgcccagatttatg

SEQ ID NO: 39481 - DNA, 1658 bp, Heterodera glycines
cagaattagagtacaggctatagggaagctactcccgatggattcggtctccccataaatctgggcgcatcggttcggggggactgccccgaaaacaaaaaaaatcgattttttcaagtgtccgtttggggtactcaaacaattatggggagcaaaaatccaacgcagaattaaagtacaggctatagggaagctactcccgaaggattcggtctccccataaatctgggcgcatcggttcggggggactgccccgaaaacaaaaaaatcgattttttcaagtgtccgtttggggtactcaaacaattatggggagcaaaaatccaacgcagaaaaaaaagttaagcctaaactttttggcctgtttaaaaaggaattaaaaatttttaaaaattgactagagcaatcgaacgctaacggacgacctaatggaaaaaaatccccgaaggagagaatttaattaaatccattccttcgggggaccgtgccgggtgccgcggggtaagcagtgctggttcgtttcatcacggcaccgaaccttttggctagtcagcaatcgttgcttaacttgccagatcggacgggtgtgcatgattccactgttccaagcaccccaccaaaagcaaaacgatataaccaaaatataaggaaaaatttttaaaaaattttttctccatcttcctttttgatactaaagcatcagagtgctaaaattaacttgtaaataaaatttggtgcgctttagagcactttctgaaaaaatatttatgaaataaaaaaatcgatttattcaagtgtccgtttggggtactcaaacaattatggggagggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaagctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcagggggactgccccgaaaacccaaaaaaaaattttttggataaaaattatttaaatgaactgactagataatatttaaaataggttatttctcttcctttcagtatccctgcaaagtttggtgcgcttctgatcagtttctgaaaaaaaagttaagcctaaactttttggcctgtttaaaaaggaattaaaaatttttaaaaattttattcatctccctttttgatagaaaaagcatcagagtgcctaaactaacatgtaaataaaatttggtgcgtttcagaaccctttctgaaaaaatatttaagaattaattatgcaaaaaataaagaaataatgaactctcttccttaataattttcatgctctagaggtactcactcggccgcttcgcggcctcgtggtgggc

SEQ ID NO: 39482 - DNA, 1527 bp, Heterodera glycines
  misc_feature (36)..(37): n is a, c, g, or t
  misc_feature (46)..(46): n is a, c, g, or t
  misc_feature (54)..(54): n is a, c, g, or t
  misc_feature (57)..(58): n is a, c, g, or t
  misc_feature (67)..(67): n is a, c, g, or t
  misc_feature (75)..(75): n is a, c, g, or t
  misc_feature (79)..(79): n is a, c, g, or t
  misc_feature (88)..(88): n is a, c, g, or t
  misc_feature (96)..(96): n is a, c, g, or t
aagaggtacaacagtgatcagaacattaacagggannaggagaggnacaacagngannaaaagaggnacaaaagnaaanagaagaggnacaacagngattttaagaggtacaacagtgattaggagaggtacaacagtgattaaaagaggtaaacagtgattagaagaggtacaacagtgattagaagagatacaactgtgattagaagtggtacaaaagtgatttgaagaggtacatcagtgattagtaaattcattaaattaaaatgaaaatattttttaacaaatttaattaatttattaactcaaaaaatattttaaatgaataaaaattgaaaaacattagaagaggtacaacagtgattaaaagaggtacagcattattagaaggggtacaaatctgattagaagaggtgcaacagtgattaaaagacgtacaaaagtcattaaaagagatacaactgtgatcagaagaggtacaacagtgattagaagaggtacaacaatgattaaaagaggtacaaaagtgatcagaagaggtacaacagtgataagtaaattcattaaattaaaatgaaaatattttttaacaaatttaattaaaaaaatacatgaaattctatcaattaaaaaaataattaattaaacttataaaatttatttataaaaaaaaattaaattaaatataattttttatttattaactcaacaaaatattttaaattaattaaaatcattgaaaataacgtaaaaatgcacaaaaaaataatgttacaccgtccggattcgaacctgcccccccctcaaaatgatgcctcagaatccccaatcacacagggattctgaggtcttgacgatgtcaaaagtaaaatctgatcacgtattcgtgatcagcggcccaaataacccctaaagacatatttttggaagatttttgtgagaaaaatttttccactcaaaaaccatgtgctcccccctttggtcccgaaccccaaaatcacttttatttttgtatctttttttaaaaatgtgataaaaatgtaaaataaaatttatattatagagaaaaaaattgtggatttttgtagtattttacttttctcaaatttcttttcagaaggcagttacgaatttttttctgaaaaatctaaaatttccagaatttctggaataacatttttcatattgatgttagaaaacctaaataaatcccataaaattctcctgatttttctctatttttaaagctttgttgtatgaaaattgacttaccctgaggttagttatgaattttcaaatattaggccaaaatcccgagggccaaaaaattgccaaaaaataaagaatttttaaaaaattcccaaaattctgaaacttaaaatagacatcatattcgtactcagcaccttattttaccccagaaaaatatttttgaccccaattttcaacccaaaaaaaattttcgaaaatttctagggggcctagctcgaaaatttttgaaaatttccgaaacatgtgcacatcatc

SEQ ID NO: 39483 - DNA, 970 bp, Heterodera glycines
  misc_feature (920)..(920): n is a, c, g, or t
gtcaattttgtaccgatcaaagggaaaatggcttaactctggccccaatgtgcgcctgaatcgctaattagcttggcactttcgaatattacatataaattagccctctcaaattttccttcgggcctcagaaaatggctatctctttttcggccaattttgtaccgatcaaagggaaaatggcttaattcaggccccaatgtgcgcctgaatcgctaattagcttggcactttcgaatattacatataaattagccctctcaaattttccttcgggcctcagaaaatggctatctctttttcggccaattttgtaccgatcaaagggaaaatggcttaattcaggccccaatgtgcgcctgaatcgctaattagcttggcactttcgaatattacatataaattagccctctcaaattttccttcgggcctcagaaaatggctatctctttttcggccaattttgtaccgatcaaagggaaaatggcttaattcaggccccaatgtgcgcctgaatcgctaattagcttggcactttcgaatattacatataaattagccctctcaaattttccttcgggcctcagaaaatggctatctctttttcggtcaattttgtaccgatcaaagggaaaatggcttaattcaggccccaatgtgcgcctgaatcgctaattagcttggcactttcgaatattacatataaattagccctctcaaattttccttcgggcctcagaaaatggctatctctttttcggccaattttgtaccgatcaaagggaaaatggcttaattcaggccccaatgtgcgcctgaatcgctaattagcttggcactttcgaatattacatataaattagccctctcaaattttccttcgggcctcagaaaatggctatctctttttcggtcaattntgtaccgatcaaaagggaaaatgggcttaattcaggccccaatgtgcgcc

SEQ ID NO: 39484 - DNA, 1098 bp, Heterodera glycines
atattcctaaattttataataatatatgcaaattatcctctttaattaatatgcaaaacatttgtaaaatcaatgagtttccttccgctgtttataaatgaacagacaaaatataatataatatataaatataatcaatcatatttgctatagaaataaaaatttatgcagcaaatcatataaccaaacaaaataatcatacttaattaaataataataatataatataataatgaattattaattattcttttagaaaataatgagaacactaatggacaattactatcttttattaatattattatttttattaattatttttaatgatgggcaaccatcaaaaaaacgtccaccaaagggtaaaagcataataactgataaccaaaaattggaggccgaaaatataaagagtattttttttatttcatttttcaattttttaaaaattaattgctcagatgacgctcatagatggtcaaatcggagtgaaaacacgaaaataatccgtgccatgtttccaaatgtgccaaatgaagcaaaaaagttggatatggaaggcgactttattcgaattgacggcaaagtttatcccgctaaaggtattttattaatttgtcgagataatgccaatgaatgattgacagacatgaggaggtcgaaaaatgccgaaaattaagaaacttaaaacattttttagaaaatttggtcatggaaagtttgtatcacgattttaaggaaattttcactgaaaacttgagtcatttgaaaatttataacaaaaatattttgaaatttaatagaatttttttttattaatgctttgttattgacttaaaaataatttttgaaattgttttttttaatttagtcatcaatttattttcacattgaatttttgagttttataaaataattaactttataatctggcatattaattaataatccaaattttaattaaaaaatatattatatgtatataaaatgttttagattttttggaatcatttaatgagaatggcaaagacagaactgaaataaaatgggacgaatcaggagacttttcttcagaaaatttggacattattgactcat

SEQ ID NO: 39485 - DNA, 941 bp, Heterodera glycines
tagttcttccgaaatgaataatttctccacggagtgctctttagcggtatttaacgaattaaacctaacaatttttttattattagagcgcaagaaatagtcaaatggatgagttgaacttccattatgctgattctgactgctacaggtccgaactggcggagctgtacacttattcggaaatggacgaattttcactgaattacgagtgttttatacgatatatgcgcgagaaaaaggttatatattctttaatttaaatattattattaatttaacgacagaaagaacccatttggcatgacttgccgaccaaggaaaagagcgaaactctgcagaaccttgtcgaatctttcgaaaattctgattctgaacaaagactggaagctgctcggatagttctttatattttacaggcaattatttatttacatgcacaattttaattatcatttccaactagaaaatttgttgttttcgctttttagggtgcatatggcgatttcgctgacgttgaagttaaagattttgaccgctggtctaccgaaggtataaagttactaaagaaccccatatggaagcgaaataaaataacggaaccttcctgttctccttttgcaaagctcacttccattttcagaattcaccactgaaacttacagtgttttcatttgatttgcaatgaaaacaaccctaaatttcaagtttcagcgaccacagaggaggaaaatggtggaaaaggtctcgacgcagcgtccaaatggtttggtgatcacgggacgggcggattcgagcaggactgtttggtccgtggtgcactgaatgcttaccacgtgtacgagcacgggctgttccaagtgagtgatttttgaatttgccttgtcattctgcttatgtctactagtctttatgttcgcttcttcggctcgaggacgctgtgc

SEQ ID NO: 39486 - DNA, 264 bp, Heterodera glycines
caaataaattatgccaacattttaagtgcgtgccacgtttttttctgcttctctgtttatatacaaaaaaaaaaaatttttaatgtttgcacactatgaaaatatgtttctccttataaaaagttctatcccgttcccttcagacgcccaaaagtgccggcgcccaactgagcgagtccgggacacggatctggttttcgaaaattttttgagcctcgaatgccatccctgccatggacacaaaatgtcatgggacgcgtaaaa

SEQ ID NO: 39487 - DNA, 1505 bp, Heterodera glycines
atgtacagtgcgccaagagaaacaaaaacagacagtttcatttagactctatgtttagggctaatattttatgttttaacttttgccaaaatagttaggttttaggttctaaaaaacgcccaaaagaggtgctaaaatggaaaatatgtgccaaaatgtttaatatttagtggtgtaaaatgacaaaatttatttaaaattaagctaaatcagtatgagatacctatcttttaaaatttatacttcttgttaagaaaataaataaataagttttggaaatgaattttgaggaaatttttcatttcgtaagggtatatttttgaaaatttttcctcaattcttaggggtgtatttttcggaaattttgaggtcgattcttaaggtgtttttcgtttttattgcattttttaaataaattggcaaaacgccaaaataggttattgtctgtgcccacttttggtccaattgattatacataaatgagcatttgtcctacaatttcccgtggcaaatcgtccaattatgctcgtgcttcggcttcttcccaattgccagttttggttgaccagggcttttgttattttgattaattctaaattaatagtgattaatcattcattagacaaatgccgaccagtgggatattcaggacaatctttggaaattttaataattaagcgaacttttctaggctttcacgcatatttttaaaaaccgttaatttgtctataaaatattatttcattcatttttccttttctttaaattcaattttacctttttcgtcgtcatacaacccagcagagttttttgcttttgaattgtttcctttttcgaactttgcagccgattcattgacggaattggtgaatttcatgagttctctaaatgacttttccaaatgtttgagacctgaaaatttttattaattaatttaccacagaaacacaaacaaaggaggaaaaattaataaattaacaggtttttctcttaaaatgcttaaattgcgattaagaaaaattttaggaccagctgaaaaatgagattcaattaaaattatacagtgtgacacaaaatgatacattcacctccgaatttgtgtttttagactgttctaattagggctaatggtttttgcctatttttcctaagcttccagtgatctgaaacgctcgaaaaacatttttttcggttgtttttaagctacttctaataaacgacccaaaatttgtgattttaaaattatttagctcaataatgatttggcctaatttttttattttttgaataaattttgtcattttacatacctaaaattgactttttgagaagcttcaaaaattaagctatgaattatttcaagtttttagggcgacattttccgatattatgaatttttgaaagtgaaagtatcgttttgtgtcacctattttataaaaaattggtggatattgaagaccaaaaaaagaaaaatttcttttatcaattaaatcaattcttattat

SEQ ID NO: 39488 - DNA, 828 bp, Heterodera glycines
ctctagagtctaattaggctatggagaatccatgaaaaaatatgtatttacataaaattagcatccctagaaatgaatattaaatgaaaaaaatcaaaattaaaaagaaaatttcattttaaattgaaaagtatatgattttatttatttatccacttttagcatttgagaaaatgcggaataaaaaagacgtgaaccgattaattgagccaatccgttcgataaaattcagtgaaaaggtattattaattacaaataattattttgccaaattatacacgtattgtgtaaaataattgtttaagtatgaaaatttcattgtgatcatttgcaccggcacacaattcaatgccgaaacattttgccaatttgtcgggacgcgacttcgctacgaactgctcgaatttgtggagaatccgttgtcaaattgggtggacttttgccatgtgtatccaaaattgatcacttccgcgcaatgtttggccgaaacggggccaaaaaagtgggcagataaaggaattaaaattaattaacttaatgaggcgttttaatggcggtttccaccgttcttttcggtagggatcggttcgtctgagccaagtttaaagcgccgtaacttttttttaattgataaaatttatattgacattattcgaaagctccatatgtctagaagttcttgctaagcttttactaagcgattagaaatttataaaaagttgcaacatgaaaaccgcaaaagtcagaaattttgcatatttttatttattaaccttttttttatatgtcggcatatctttgtgttttttggaaagccaatagaacttg

SEQ ID NO: 39489 - DNA, 600 bp, Heterodera glycines
tgccatcgacacgaattcttcagtgaccgttgcaacaactgcaatgccaacaacgaggccactgaacggcacagtggcaacaaattcaagcagtacaaccaacatttcgtctgccatcgacacgaattcttcagtgaccgttgcaacaactgcaatgccaacaacgaggccactgaacggcacagtggcatcaaattcaagcagtacaaccaacatttcgtctgccatcgacacgaattcttcagtgaccgttgcaacaactgcaatgccaacaacgaggccactgaacggcacagtggcaacaaattcaagcagtacaaccaacattttgtctgccatcgacacgaattcttcagtgaccgttgcaacaactgcaatgcccacaacgaggccactgaacggcacagtggcaacaaattcaagcagtacaaccaacatttcgtctgccatcggcacgaattcttcagtttcaagcagtacgaccaacacatcgtccgccattggcacgaattcttcagtgaccgctgcaacaactgcaatgccaacaacgaggccactgaacagcacagtggcatcaaattcaagcagtacaaccaacat

SEQ ID NO: 39490 - DNA, 1217 bp, Heterodera glycines
  misc_feature (96)..(96): n is a, c, g, or t
atcacaacacagcactcagtctctacggcataacggtgagtgatcaaatttggttaaaattgtcactaatcacactaactatgtttcaccattccnccttcaggatcacagcggtcggctgaacagtggccattacacatcgtccgtgatcaatttgatcagcactgatcgggagtggctgagtttcgacgacgaagcatgcattccgtgcggcaccgctccttcgcccgttgtgagaatttcgttcccgaccattcaaatgaaaaaaataataatttgttttcccctttttagagcaagcacgcattccttctgtactacaagcggatgaactcgaaagccgagcgcgacaacaatgccaatgcgaatccttcggtgctgagcgacgaagagaataacggatgatattattgtgtgtctacaagcggatgaactcgaaatccaattgatattattgtgtgtgtgtatgctctgtataatatgtattgtatttgtattgcattgtatgttcatattagtcgtcttgtaaataaatggcaataatcccataattcatgtttgtttgttttgatttgcctcttcaatttctccccgggaaaagcaatttcaaggttgtaaaacccgaatccaaagcaatattggagaattaggggtccatcaatgaatttcctgtgaaacaaagctttttcctccaagagaaaccacattttaaggcttttcagggtcgaaaaatccgtgacaatattggagaatcggggaggggtccacccaccgaaaaagcatttttttatttgtctgaaaatttctaaaatgatacatttgaaatggtgccaatgccttcaatgttcatatttccaaatttcatttccacgatcatatttgctcgacttcgaacaaaaagtcgaaaatccaaattttcaaaaattcgctttttggcgctctaatttggaaccgactgcataaaagaacagttttctcactgaatttctcattcgcctcgcaccaattttttcaccaaactgaaacagcgtcagtgcaaactctgcgaatgtgaatttcatttcttttttcgtgatccgtgaacacagctttttcgaaagtgcgtcccccacccttgacaatgaaaaatgctttttttttaatcgcagttaaattaggttgtaaatatgcagatattctgatgtaacttttatgatttctagctaaattctaaactg

SEQ ID NO: 39491 - DNA, 673 bp, Heterodera glycines
acccccgcccccgcgactctgacccccgcaatccccgccccgcgatcttcgcccccgcggggacacgtgggtgaaaatagaatggtatattcgtgggataaaaggcaataaatttatacaaatttgaatttttaaccatctttgacaaatttttatgaaataaagtaaattttgaaataatttccaatattttgtggtttagtggttagtgcttcaacactaacagtatttcttgttaggagttcgacaccggttgacgttttcattttaatttatttttatctgattaattcagggtttctttatgttcttatttctaagaaatgttctgattttagggcgtattttcatccaaaagaatgaaatttctgaaaaatttggctaatttctaacaaaattcataaaaaaaatttctcccggctgcgcctatcggcaccacaagccccaaaaaaacctattttttcttaaaaaattagcataaatcaataaagttggtcattctttagacaaaatctgtgtaacttatttaaaaaagaattgaatcgaggcgatacatcgactaaaggaatgtggagccaacacatcattcataaaaattaatttttttgtgagattttttggagctaattcaaatcaaacccccgcccccgtcaccgcgggggcggaattatcg

SEQ ID NO: 39492 - DNA, 370 bp, Heterodera glycines
ttttttttttttttttattatataaaaaaaaaaaaaaaaaaaaaaaaaaaaaaaaaaaagctttcttttttttttttttttctttctttatttgttggtggcacgccaaccacaaaaaaaaaaaaaaataatctttttttcctccccccccccccccccctccccccccccccttttttgagagaagaaaagaaagaagagaaaaaagaaagaaaaaaacaaaccacccccccccgcgggggggggggggggggtgtgtgttttttttttttttttttttttttttttttccccccccctcccccccccccccgcccccccccaaaaaaaaaaaaaaaaaaaatattattttttttttttttttttgttt

SEQ ID NO: 39493 - DNA, 959 bp, Heterodera glycines
ttgaaataaagttttactacaaaagttagtgtatattcaaatcatcaataaaaaataataataaatgattaaaatcaataaaaatctttttactaatattaatcaatttaatataataataaataattaaaacaacaaaatatttaattaaaaaaagcttctttgacaatttattaaaacatttaataagaattttagaattgtctaattcttaaaaaataaattaatataaaaataataaacatttaactaatcataagttattaaaaataataataatttgcaaattaagcaaaacgtaaacctatcaaaggaaaaggaaacacacacagaaaatattaattcttaagtcgaaaagtaaaaaatataaaaatgtagagtgagaaattagcaccattttccaactaaaactgaccaataattaatgcatttaatgaaatgtaaattattattttttatttcgttaaacaaaatgaacgaaataaatcataatcatctctagttttaaaacatatatattttaaattagtattttggttttgaaaattattaaacaatttgtaggaaaaaaaacaacttttctagtaagagaaatgtactttgaaaaaggcgattttacaaaatgtagcgccagaacctgcttttttcaaattgagcacttaaataaacaaaaactaatattaaataggaaaataaaaaaaaaaataaagaaaaaaataatctctttaaaataacactttaaactaaatatgttaaataaaaaaaaattaaaaaaacctactttatttaaattagaatagcagatgaataaaaaatgaaaaaaatgcagcacatatcatataagaaatgtcattaaaaaaagattgattgttaaataaaaccttaatattaatcttttaaatcttatgtgaaaagaaatttgattgaattaatttgatgatttgaaaaatatcataatg

SEQ ID NO: 39494 - DNA, 722 bp, Heterodera glycines
  misc_feature (606)..(606): n is a, c, g, or t
  misc_feature (667)..(667): n is a, c, g, or t
agaagaagcacttgaagccgtagcagcaccatcgtgtcgatgaacaactcaaacaaaataaatttctaaattaaaataaacttatttaaatttttggtatgttgaatgcgtgtgaaaagtggggccaaggtgtgccggccacattctcaaagattctaggcacaatgcacaaatggagaaagccggtgggaggggcaatgggccgctaatgatgtgcaattcctttcttttagcctgggacaatcggaaaacgcattaaaatttaatgcaaaaatttggcatcggcggaaatgcgcacacattggcaattacggatttgtccaatgcattgcagcaaaatgctgaaaatttctaaaattggggtgcccaacaaaaagtgcctgtcaatcatttcacccacccttccgcctgggggagaaaaatgccacaattggacatttccatttgcggcacacaaacaaataggaaattataggtgacagaaaatgcatgggggtgagtaaagaataaacaaaatcgcaccaaattctggatttggccaatgaatctcaatttgggatctgatcagtgaaggatagttaatattcattattaagcttccgctanaggattgataagatacgggaatttgtgaaactgttcagagagccatttgaaggttaattanattgaaatgagtgatggaaatttggtgctgattaagagaataataagcgttgatc

SEQ ID NO: 39495 - DNA, 367 bp, Heterodera glycines
ccttttttggagggaccagatcttacaaattaaaaacgtccctctttgtaagatttgtccttattttggcacgacctccttgttttgtgcttattcttagctttgaaaataaaaatactaaaatgaataactgttttgaattacatatcatttttaattgaagcgaatatttaattaattttaatttgaaaaaaattacattttaattcatttttgtgagtgtaaaatgcccaataatttcagtgaaaatctgttaaaaatggtcaaaatttctattttcctccggcggcgcctatcggtaccgtcgggtccccaaaacttattttttaataaaaaattggctcaaaaactcaaaaattttccaggt

SEQ ID NO: 39496 - DNA, 1168 bp, Heterodera glycines
gcacggttgtaggacatttgcggccacagccactaacgacattttcggctcaactttttcgactccaacaaaataaaaacctcagaaaattattttccatccaatttaaccgaatttaatgctctgctctttctaataagccgaatcaagttttttagaaaaaaaatttcctagcccacacccaactggaagcaatgaagaggaggaaaacaatatcagagaaacaagtcccaaaatgatggagaaagaagtatgaacattattaggaaatatcagatctctacagtagttggcagactgactagcaactttcgagctctaatggggttttgacaagcccaatttttgaaaaagaattactacattgaataaagtttggcgaaaatttaagaagaaaaaggatttaagataaatgagccctattctggtcttggtgtcgaaaaagtcgagccgcaaatgtctttttggaattaaaaagtgataatttggcgttccgttggccgcaaatgtccgattttcagcaggccgaaaatgtcggaccgcaaatgtccgaaaatggcccttaagaaatgggacgcaaatgtccgaggcgcaaatgtccgaccgcatttgtcgggccgcaaatgtccgattttcagcaggccgcacaaaaattttccgaatggcccttaagaaatgggacgcaaatgtccgaggcgcaaatgtccggaccgccatttgtcgggccgcaaatgtccggaccgcgaatgtcttaacacgcttttaagaatcctctcaaaaattctgttttaaattttggaagaaccgtcatatgaattttgtacgaaccccgatgaaactgcttcttaccacaatttggtcccgagctggcgtcgatcctcactctgttcaatttgcacgtcgtgtctgcccgatttcgtcttttccacgcttccccctgatcacttgctccgtcgagttcctcgtttctccacctgactgagtgccgcttgaaagtcgttcttccacccctcgttttgttccgtcttttcgatttccgaacgcctcgatcgctttaaagccgtcgcgtcggattcaccgaaaagccgaatgggctgccctcgggccctcgatcgacgcacaacggagggacgcggcatcgaatccgagcccggtcaatgaaaacttt

SEQ ID NO: 39497 - DNA, 1015 bp, Heterodera glycines
aggtcccggttcccggccttttgaaaagctcaggtcccggtcccggtagggcaaccggaaaaaacaagcactggtaagaatgagggtctgagtgaaaaattagtgatgaaaattggagtcaaaggaaaaaatttaaaaaaataattaatatattctttaaaagtaacactgcccaagtgtgcaaatggcctagtggctagtctccttgactttcctttcttctttcccctggttcaatccctctacagaaattagattattttcaatttttttttgtatactcgtgggtttcctataaagaaaatatgattcctcatagttttttttttaaattgatacatattttatcatttttaaatgaaaatcctaccaattgagcttaataatcccaaaaaccaacctttttttgttgaaaatctgttaacaaattacacccaaatttttaaaatttcccccggcggcgcctatcggcaccgccggaccccttctttcccaaaagttttttgaaaaagcgttccgaaaaaaagtgatgtgaaaatcaaatctgaatttctattaatattcgatgatttagtccaaaaatgattaattgtttgaaataattgaagaaaatttgtttgaaaattttcattaatttaaagtcccggtcccggttttggcaaaaattcccggtcccgtggcactctaatttaatgtgagtaccagatttcttttaatagagctctgagcagggctggacgtaactgattttcaattacggaaatccgtaaatacggcgattttttcagttacggccatccgtaatccgtaattcggaggtcaaattttttaatgcaaagtttaaattttaaactttaaaatttaccaaaaaaccgtcccccgaattatggctattgtatgaattgtatctcaaaatttattttatagtctagtttgcaaatttcatttgtaacttaaaatcccctctattaaatatacacagttatcacatacagtatatttattatgcatatat

SEQ ID NO: 39498 - DNA, 1316 bp, Heterodera glycines
ccgttatgtccttgtaaatcagtatattctgtccttgtgatagagagagtttaaacgatacgagcactgaataatataatattaatttgctttaagcaccgaattggagtcgcaaatgttaggcaacttttcgaattgtttcgggtgcacctagggaatggttcgaacgccgcattgttatcaatgaaacacctattcacggatttgattatttcgttacattttcgtatttggtaagaaaatattttctttttgggaatacaataaaatatttaatttggacatatatttttatgtgcttgttaagctatttttttattattagtgcatattttctagattttattgttagaaccaaaaagctaccaatttatcaaaatgcattttaaaaaaatattttttaaattttcgtgacaagaattttgattttatatgtatttcaatactgatttggttaattttgttgctttttggataaacagacgggaataaaagtacactggtaagaatgggggtctgagtgaaaaaatttgaaggaaattggtgggaaagggagattttttgtgaaaaaataaatataaattcattttaattcattagcgtacatatttatgtagcctagttgttaatacttctgttctttcattatttgtctcctgagttcaattccccattaggataggtgatttttcatattatctttaaattattttatttgaaatttaattaataagaaactttgtctaactttaaaaattatttttttttaatttttaaatagccataagcccacaaattaaccaattatagttcattttttggacaaaatttgttaacaaatttcactaaaatttcaaaattttccccggcggcgcctatcggcaccgcctgacccactccttgtaccacaaaggattttgtaaaaggcgctcacaaaaaaaagagattttaaccaaaaaaagattttgtaaataagttgaaaacatagaaaaattctctaagaatattttggaattttaaaaataatagacaattttaatgaaaaattattgaacatattttaaaaaattttcctaggattttagaaaagaaaaattaccctttttttgccggtacccctcaaaaatattattaccggattaatttcaaaaactcaagttttaaattttttccccattaataaagaaatgtttaaacctttacattaccaagaaattttttttaattggtttaaaatataaaatttttccttaaaaaaaaaataaattaaaaattatttaaaaaaaaaatccaaattttttttcaaaaaaaaattt

SEQ ID NO: 39499 - DNA, 1077 bp, Heterodera glycines
agcagtgctggttcgtttcatcacggcaccgaaccttttggctagtcagcaatcgttgcttaacttgccagatcggacgggtgcgcatgattccactgttccaagcaccccaccaaaagcaaaacgatataaccaaaatataaggaaaaattttttaaaaaattttttctccatcttcctttttgatactaaagcatcagagtgctaaaattaagttgtaaataaaatttggtgcgctttagagcactttctgaaaaaaatatttatgaaacaaaaaaatcgattttttcaagtgtccgtttggggtactcaaacatttatggggagcaaaaatccaacgcagaattaaagtacaggctatacggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaccaattatggggagcaaaaatccaacgcagaattaaagtacagcctatagggaagctattcccgaaggattcggtctccccataaatctgggcgcatcggttcggggggactgccccgaaaacaaaaataaatcgattttttcaagtgtccgtttggggtactcaaacaattatggggagcaaaaatccaacgcagaattaaagtacaggctatagtgaagctattccggaaggattcggtctcccccataaatctgggcgcatcggttcag

SEQ ID NO: 39500 - DNA, 608 bp, Heterodera glycines
ttttggtgcctggaatttagacttcccggaatattcatcaaaatttcattgttttcgtaagacttttttgaatgtcctaaagtgagcaaaaatcttaaaaaacggtttttacccctgagcacattaaaaataagagataaattttatcttatccgtcgattttaatgtgtccttgaaattcttatttttttaattatttaaaatatttaaataattttaaaaagattcctcgtaatcaaggctcccaggctgagtatttatcctcattttgtggtttatgataggtaaatgaagatttttttgaaatgaggatttgtagctttttgaaaaattttatggatttatgagacttttgaggaagatcatccgaatctgttaaatttatgataatttcaataaattgacataatgcttgacaatcatttaataatttgggttttaattaaagttgagcgtgaccaggacgggaattcctggggttttcaggtcccggtcccggcgggactaaataagcactcggtaataatggtggtctatcgtgagaaaagaggagaaatttttgagaaatacatttaaagtattttttcatatccatatatcaagggcgt

SEQ ID NO: 39501 - DNA, 1187 bp, Heterodera glycines
atttttgcaatttctttatcaaacatttttggtttttctttttttatttgccaataaatttttgttttttccattttttctttcttcgttatgcgtttcttgctaattccaaatattctcttccatctttcaattgttgaacagttaactccaattttgttgcaaatttcgacataattttgttgccattcttcgcttgaatatttttttatttgcttgtattcatttttcataaatttttgcacaatttcaattttttcttcataagtttttgaatttgttcccaattttttcgctatttttaattaaatttattccattcttttgctgagtatttttttcctttttgctttattttctctttaattttataatatttttgaattatttctcttttttcttctaaattttcttcttctttcccatttttctccaaatatttcgcaaaatgacttttgctgcaattttttcttttctgatttaatttgacagttaaaaacataattaaaaagaatatcgaaaataatttcattttgtcgtctcaaaatgggttttggaatttaaaaaaaaataaaaccgtaatatattgtttgcgacatataaatgaataaaaatgaattttttctgattaaaaaactgacaggaaatcatgactctactggtttaacgacgtgctgggtcgtttcttaaaactgccaccatgggcgtttcttaaaactgccagggcgtttcttaaaaactgccactatgggcgtttcttaaaaactgccaagtgggcgtttcttaaaaactgccaagtaggcgtttcttaaaaactgccaagtgggcgtttcttaaaaactgccaagtaggcgtttcttaaaaactgccaagtaggcgtttcttaaaaactgccaagtgggcgtttcttaaaaactgccaagtaggcgtttcttaaaaactgccaccttgggcgagaattaaactacaaattaaaacaactatatagaaatattttatctaaattttattgatataaagtttgtaaattaatatatatattccagaatttcttttttaaattttcttattctttaaaatgttcaccaaaaacatgaactgacaagcataacaaattctaaaaaataaactatttaaaatactaataaatacagacttttgttaatgaacattcatgcactttcata

SEQ ID NO: 39502 - DNA, 172 bp, Heterodera glycines
ctataattattctttccactttaataataattgcaaaattcagtcggtttgtcccgctttctcctctttcaattggttatcatgctgatgtttcgagtttggttcgcattagagacggatcgtttgtcgcaattagaacagaaaaaattaggcgccgatggcacttcgacgg

SEQ ID NO: 39503 - DNA, 1472 bp, Heterodera glycines
  misc_feature (11)..(11): n is a, c, g, or t
  misc_feature (17)..(17): n is a, c, g, or t
  misc_feature (26)..(27): n is a, c, g, or t
  misc_feature (31)..(32): n is a, c, g, or t
  misc_feature (38)..(39): n is a, c, g, or t
  misc_feature (43)..(44): n is a, c, g, or t
  misc_feature (47)..(48): n is a, c, g, or t
  misc_feature (50)..(51): n is a, c, g, or t
  misc_feature (56)..(58): n is a, c, g, or t
  misc_feature (64)..(64): n is a, c, g, or t
  misc_feature (66)..(68): n is a, c, g, or t
  misc_feature (74)..(74): n is a, c, g, or t
  misc_feature (76)..(76): n is a, c, g, or t
  misc_feature (82)..(82): n is a, c, g, or t
  misc_feature (88)..(88): n is a, c, g, or t
  misc_feature (91)..(92): n is a, c, g, or t
  misc_feature (102)..(103): n is a, c, g, or t
  misc_feature (106)..(106): n is a, c, g, or t
  misc_feature (115)..(115): n is a, c, g, or t
  misc_feature (127)..(127): n is a, c, g, or t
  misc_feature (138)..(138): n is a, c, g, or t
  misc_feature (148)..(148): n is a, c, g, or t
  misc_feature (158)..(158): n is a, c, g, or t
  misc_feature (164)..(167): n is a, c, g, or t
  misc_feature (172)..(172): n is a, c, g, or t
  misc_feature (175)..(176): n is a, c, g, or t
  misc_feature (182)..(182): n is a, c, g, or t
  misc_feature (190)..(191): n is a, c, g, or t
  misc_feature (195)..(196): n is a, c, g, or t
  misc_feature (200)..(200): n is a, c, g, or t
  misc_feature (202)..(202): n is a, c, g, or t
  misc_feature (206)..(206): n is a, c, g, or t
  misc_feature (220)..(220): n is a, c, g, or t
  misc_feature (224)..(224): n is a, c, g, or t
  misc_feature (238)..(238): n is a, c, g, or t
  misc_feature (254)..(255): n is a, c, g, or t
  misc_feature (283)..(285): n is a, c, g, or t
  misc_feature (288)..(288): n is a, c, g, or t
  misc_feature (293)..(293): n is a, c, g, or t
  misc_feature (298)..(299): n is a, c, g, or t
  misc_feature (301)..(303): n is a, c, g, or t
  misc_feature (311)..(311): n is a, c, g, or t
  misc_feature (314)..(314): n is a, c, g, or t
  misc_feature (324)..(326): n is a, c, g, or t
  misc_feature (344)..(345): n is a, c, g, or t
  misc_feature (353)..(353): n is a, c, g, or t
  misc_feature (356)..(357): n is a, c, g, or t
  misc_feature (362)..(362): n is a, c, g, or t
  misc_feature (370)..(372): n is a, c, g, or t
  misc_feature (374)..(374): n is a, c, g, or t
  misc_feature (385)..(387): n is a, c, g, or t
  misc_feature (395)..(396): n is a, c, g, or t
  misc_feature (399)..(400): n is a, c, g, or t
  misc_feature (407)..(407): n is a, c, g, or t
  misc_feature (411)..(413): n is a, c, g, or t
  misc_feature (416)..(416): n is a, c, g, or t
  misc_feature (422)..(422): n is a, c, g, or t
  misc_feature (440)..(440): n is a, c, g, or t
  misc_feature (442)..(442): n is a, c, g, or t
  misc_feature (444)..(444): n is a, c, g, or t
  misc_feature (457)..(460): n is a, c, g, or t
  misc_feature (462)..(462): n is a, c, g, or t
  misc_feature (464)..(464): n is a, c, g, or t
  misc_feature (1325)..(1325): n is a, c, g, or t
aacgagcaccngaaaancggaaccanncaanncgcaannaaannaannannccaannnccaccncnnngcacgncnccccgncggaancgnncacaacgaanncgncgcccaagnccacaaaggcanaagagaacagnccgcgcgcgncggccgagangaacannnngcganggnngcgcanccaaccgnncacnnccancngagnggaaaaggacgcgncggngagaacgaccaacngaaagaacgacggaannaggcgagaagggaaaaggaaggaagcgnnngcngacgncgaanngnnngacgaaanccnccgacagaannnccacagacaaggcacagnncacagggncgnngagcnccgccaannngncgaagcaaacnnnggcacggnncgnncccacgncgcnnnccngggcgnagaaaggcgccgacaaancncngaacgccaacgcnnnngngncgtgaagagtcaccgagcgaacaccgcctgaaaagcggcgattgtttagtcatgcaaagtaaaatcaaagaatggcggcaccaaggatcagattcttcgccacctccacgcccacggagccgaggccactgacgagaaccgacgccttgcgcaagtgttccatggcggaatgtccaagcgcataactaaacaggaaaaaccacaataagcaattatatcaaaggcatttgttgctgcttacatctgccgagagtacaaattggtgtcgatggccgccatttgttctccgttactctttggtgcctaaacggaaaagagtcagcaagaaaatgagcaaccaatagaacaaaaagtgacgttttctgatgcctcggagttcggcagttcacagatgatttttgcctttttcgttgctggttcctcaataataaggtcagatgactgcataaaccactggaaatggaaaaaacgaatctaattttcagtggccaattgcatccgagcaattattgggtcaaaaatcatcaaaataactccgaatgttattcaatcaaacggctaatattcggctctaattgtaaggcaattgaccactgccaataaatgagaataaaaattcaacggggcaaactaaaagaaagaattggaatgtgagcaaaaaccacttgattgttttctttttattacaaaatcagtcaacgaaaaattttggctaggtaatttcattcacattctcagaaaaaaccaatcataacgccaaagaatctatatttaaaacttgtatcccaaatatgtaagcaatccgtatttaactcgaacagtaaaaggctgcaaaacagtagcttttcaaattaattgttnaacgctttatgcaatataaaatggtaaggaaaacgaaaagtcgcatcattcctccgaactctcttccgactcattctcttctatcgtttcgcccgcttcttcagccattggcaatgtttttgcctccacttcttcagcaccttcgtc

SEQ ID NO: 39504 - DNA, 1505 bp, Heterodera glycines
tttttggaattttttaaaaatttttttatttttggcaaatttttgggccctcgggattttggcctaatatttgaaaaattcataacaaattgaaggggttgatcaattttacagaaataaagccttaaaaatagataaaaatcaggagaattttatggactttatttggaatttctatcttaaaaaggaaaaaagctattccagaatttctggaaattttcgatttttcagaaaaaaattcataactcggttctgaaaggtcatactgtaaaagtaaaatactacaaaaatccgcaattttttcctctataatataaattttattttacatttttatcacatttttaaaaaaagatataaaaataaaagtgattttgggattcgggaccaaaggggggggaccaggatttttgagtggaaaaatttttctcacaaaaatcttccaaaaatatgtctttaggggttatttgggccgctgatcacgaatatgtgatcagattttacttttgacatcgtcaagacctcagaatccccgtgtgattggggattctgagtcatcatttttgggggggggggtgcaaagttagaatccggacggtgtaacattatttttctgtgcatttttgggttattttgactgtttttaattaatttgaagatttcttttaaattatttaaatttattttttttaacttaaagaatttcattatttttttttgaatttctaaaaaaaataatttaatttcaaattaaataaatattcaattaataatttccaacgttgtttttaattaataactaccatttttttcgtgttttcattgttttattcatttaaaatattttttattttattaataataaattacatttttttatttgaattaaatttttataaaattcgagaaattagttccttttaatttcaataaatattctatattataaatttctaactttatttttaataagtaaaaggatttttttaatttgataagtttataatacatccaataatacaattttcttatttatttcattttaatccatgattgtacctcttctaatcacttttgttcaaattttaatcactgttgtacctcttctaatcactgttgtacctcttctaatcacttgtacctcttctaatcactggtgtacctcttctaatcactgttgtacctcttctaatcatttttgtacctcttttatcacttttgcacctcttctatcactgttgtacctcttctaatgactgttgtacctcttctaatcactgttgtacctcttctaatcgcttttgtacctcttttatcacttttgcacctcttctatcactgttgtacctcttctaatgactgttgtacctcttctaatcactgttgtacctcttctaatcactgttgtacctcttctaatgactgttgtacctcttctaatcactgttgtacctcttctaatcacttttgcacctcaattaatcacttttgtacctcttctaatc

SEQ ID NO: 39505 - DNA, 675 bp, Heterodera glycines
acaattgaatcgacatggcagaagttcaagcaggaacacaaagcgagatttggtagtcacagatcacttttttccacatacatttctgattttttgtggcgtaagcaatttggaggaccggacattttttataatttgtggacccaaatcgcggaattgtacccaataagcacataaatctcctttatttggtattcaaagcaattgcgacaataaaaaagaaaaaaaaaattttgaaaaaatttgacccaaaaggcggacccaaactccattagtaccgaaaagccttagaagcatgttttcactacttttaaaaacaaaaattaattttttcgaaaaatgggggggggggggaccagctccactattaccaaagttagtacctattaccaaaagggcattataatagccatccttgaagccccatacaagcttaaacatttttagaacttaatgtattaagtgcgataacttttgaggaaaaggattgaagtcaccatcatataggtatcagtatttcaggtatattcgggttcgggattagaaatcggtcgaaatggatgccatattcgtgatcagcgacctagaaaaccccaggagccttgttttcaggactttttaaaccaaaaaaaatttttgaaaaattccgacccaaaaggggggacccaaactgaa

SEQ ID NO: 39506 - DNA, 1268 bp, Heterodera glycines
  misc_feature (1212)..(1212): n is a, c, g, or t
  misc_feature (1222)..(1222): n is a, c, g, or t
cgaaggaagaaataaaaaagggagaaaaagtgactttggaaagtaaaaaggttaacgttaacagcaaaaataaaaagcaaaaaatggcggatgttgatgatttggaagtgaaatttgaggccttaaaattaaaagtgaatgaattggaagataaattggcaaataaacccgcaacaatttgccagcgggcataaaaacaccgaaatatgatgctacaggcgactttttcaaattcttaagagaatttaatttaatggcaactgtcagcaattggcatgccacggactgcgtccgaatgtttccattatttctcgagggagaagccaaagagcttttcttaatattccgcctgataaaaagaaaacatggcgagatttaacagatgccatggcggaccagacaaaaaaaattgacggtccaatgtgggcaaaaaaattgttggccagagcaaaaatgggccacgatagcataacagaatatgccaataaaatacgtgagttggtgcaacaagcctccccgacccaaattacacgagcgaggcccgagaatgcgagagtatccattatttttttaatggactcccgactttcctaaaaaggaaattattttttatgaaaaaaccaagaacgcttgttgaggcaatttccatggcaaaagaagttaaccaagcaagggaagaacttgcaaatgatgaaaagggagatgaaattaaacagcaaataaatgagataaggagcaaattaatgttatttcgagtcaaaataatggaaaaaacgaaaatcaaacagaatttgttaacaattcgtggcgtaacaattttggaaacggaatttcttggaatcgtgggagagaaaataattacagaggagggcagagagcacggaattttaataaattttatacaagaaacacaaatattacgagagggagaggaaatgacaggcaaaagtacagtatcaatatggagggaaatgaagaataaaccccttcaacatcgttcagacgttcacccaccccggtattaagctgtttaacaatcgcaatgattttttgtgcattatttggtaattctgtggcacaatatcaattgtgttcggaccgagtaccacaaactccgatttctttaccgaatatttctgaatgtactgtcccgaaaaacgaaaaagcagcggaaagtacagtaacgctttttcttcctattcgggaccaaanaaattctcangtttataatgttaccaaaactgacaaaatttgcactggcaccctct

SEQ ID NO: 39507 - DNA, 934 bp, Heterodera glycines
  misc_feature (47)..(47): n is a, c, g, or t
  misc_feature (57)..(57): n is a, c, g, or t
  misc_feature (59)..(61): n is a, c, g, or t
  misc_feature (67)..(68): n is a, c, g, or t
  misc_feature (74)..(74): n is a, c, g, or t
tttatttatgcaaaataaattgttttattaatctctataaagttgcnatcaaaaaanannnaccaannagcaancccttttaaataaaagattcctttttttatttaaagttgattaattattttttgctgatatttaattgtttaaaaaaattttataccacacttaaattgttgaattcaattagagtagatttatttatattaaagaaaaaacatttccttagatttctatattttaagtaaattttgctaaataatttataattaaatgtgaagtaacaaatgttaccgagcaagtccacataaaacttacgatgaagctgtccttatgaaaattgctcgcttttatagcttcttgttataataattttttttcgacttttattttgattattattttttatcatgatccttttcaacagttatttgtattttcaagtcttttttttctctataaatttcaaatattaagaataatgttaattttttaaaggttctattaatttattttatattctaaatttttgatccaatttttaaaaaaagttagtataacaatattaaagagaatattaaataatcgacactttataattttaattttcaatttaattgttgttctgtaatcacttttcttaattttttttttaaatttatatatctctcttaaaataagtttaaaaatattactttttatgaaccttattgcagaatgcagaataacactaaaaacaccagccatcttctaagacaaagataaataaatataataaaaagtaaatttaaaaaatataaatgattaaaaatatgaatacttttctattttcattgcccacccctccatcgagagcgaagcttaagattagttgtacaattgtataatcttgttttaatttaaatgattttaaaaaataaataaattttttgaatta

SEQ ID NO: 39508 - DNA, 1085 bp, Heterodera glycines
  misc_feature (51)..(51): n is a, c, g, or t
cgtggtttgtcactcagatgagaagtgatggtcgtatctttatttcattcnggtctaacaataatagagatcggaccgggccgggcccggtttttaccgggcccggaaaccggaatcagtgatttttcgaaaagtacagtttcatagcggattttgcgagaccgggccccaaaactggtcgtttttgaaaatgccaaccgagctcggaaccggcattttttgaccggtctttgatccagtcaaaaatttttcatttttattcattttccttgaccggtttttgagaggccgggccaggaaaccagttgcttctgaaaatttcagcccggcccggcagattcggaaaatccgatctctaaacaataagcaaaaccggagatccaagcttttgtctcacacttcagacttcagcctcaaaaaatttgtcttgttcaatttcgttcgaatttcgagattttttctgaattgaaaagttcttaaatactgcgatttcttcatggttgctttatgtttcaattgctcagattagcaattgatggatgaattagattttacttaaaattgtgtaaaaatattaaaattttatttttaatagttagctatttaaatttttgaatttaccctgccaggagaggaggggggggggggggcgtcccgcaaacaagcttgatgggcttctttatatccatgattttcctatttttccatatttcatgatttatgtgcacatttacatatttatatatatttttgaattatgtacattttttgtctaaatttttacatcagttatttatattgatttttttttgcaattttatgtcaatgtttgggtttaaaatctttgaaaattttaacgaaataagtgcagaaactggaacagttcgaacattggcacagaacgccaaaaatgcaaggtacagggaggcgaatggaaaaacagagcagcggattttttgatattttaccgcaatggcattttggccatttgccaatgccaacaatttttgtctttttttcgttcctcttttacactttctataaaagtctgttttcattcatttcattttgtacaatttctcata

SEQ ID NO: 39509 - DNA, 1241 bp, Heterodera glycines
tttcaaaaatttttcgagctaggcccccttagaaattttcgaaaattttttttggggtgaaaattggggtccaaaatatttttctgggggtattttgatgtgctgagcacgaatatgaagttcatttttcgtttcagaatttttggaattttttaaaaattctttattttttggcaattttttggccctcgggatttgggcctaatatttgaaaattcataactaacctcagggtaagtcaattttcatacaacaaagctttaaaaatagcaaaaaatcaggagaattttatggcttttatttagattctctatcatgaatataaaaaaagttattccagaagttctggaaaaattcgaattttcagaaaaaaattctgaacacggttctgaaaagttattttggaaaagtaaaataatacaaaaatccgcaattttttgctctattttataaattttattttagctttttatcacttttttgaaaaaagttatagaaataaaagtgattttgggaatcgggaccaaaggggtgagtataggatttttgagttgaaaaattttttcaccaaaaatcttcaaaaaacatgtcattagggctattttatgacgctgatcacgaatacgtgatcagattttacttttgacatcgttaagacctcagaatccctgtgtgattggggattctgaggcatcattttgaagggggagggggcaggttcgaagccgggcggtgtacattatttttctaccatttttttcgtgtttttcaatttttattcatttaaaatatttttgagttaataaataaaaaattatattttatttaatttttttttgataaataaattttataagtttaaattaattatttttttaattgatagaatttcatgtatctgttgtacctttttaatcacttttgtacctcttttatcaaatttgtacctcttctaatcactgttgtgcctcttctaatcattgttgtacctcttctaatcattgttgcacctcttctaatcactgttgtacctcttctaatcactgttgtacctcttcatatcactgttgtacctcttctaatcactgttgtacctcttctaatcactgttctatttcttctaatcattgttgtacctcttctaatcactgttgtacctcttctaatcattgttgtacctcttctaatcacttttgtacctcttctaatcactgttgtacctcttctaatctctgttgtac

SEQ ID NO: 39510 - DNA, 963 bp, Heterodera glycines
aagcgattgatttcgatttgcgctgcttccacgacttttcattcaaagttagtttcggtctcatttttcaatttcgttttactttttcctaaatgcctttaccattttttcttttccctcttcggcacttattgggcccgccgttgtcgccgatcgccgtcgtgtgccgaacagcgaccgattgtgccgcttccgtcccgcgtcgtccgtgccaattcgatcgccgctcgccctttgcagaaacctcccgaaaatgctgctgcgcttccgttcgcctttacaaatttttttaaaatattttgtttttaatctctcccactatttgtcggcggcgtttggcgttccgccgtccttccaaaacacttggattgttctcagcagccaatttggcagatccgaccagttgatgttgggactcattctgagccgaaatgccatttccattgagttggcaaagtgccaatgactgacccccgctaactctgtgtacgctgacggcacttcgccctccttgccgaatttgtccggcttttgggtgggcagttggccatagaattcgtccaccattgtcatcccaacggccaaatttcggtcgattatataaccgcctgaaaaagcgtcgaattgtttttcgtcgctgttcagcgtacgtattgcgaaacgaactctcaaagtcctcgtcgtcctcccccaaagggttgagcaaagattcggccattttcagccagcccatgtaacacatcagttgcagaaaagtcatcagcggaaagtaatattcgaagtatgccatggaatccctttgctcccaaatgcgaaattggcgcccaaacaaacacaaaaggaagtaaacgcgagtgggcaagaaaacgacctgaaaataagctgaagggggaggggaggtcacggcatctggccaaaggcaaagggaagggaaaggaatgaacttgcccacagggacgggca

SEQ ID NO: 39511 - DNA, 943 bp, Heterodera glycines
cttcttaggcaaatgcctaaaagttttgcgtgcatgccttagggatggcacggaattccgatttccgacatttttggggtcggaattccgatttacattatttttgataataagtcggaaatttttttttctttaaaaattggccttattcaaaaaaaatttgaattatttaaattaatttaatttagaatgaaagatataaacaaaattatgttttatgatgaagcttatatgtgtttttgatacctaaaagtgttaatttaaaaaaaaaatttatttgcctatttttgtgcttaaaaatatttattatttacaagcagtaaagagtaaatattcagtagaacgaaataccataaacaaaatattattttgttatttttgaattacattttcatttttattgtaaataatggcattttcattgtccattgttttcgctgacattttgcattgaatggaaattatgggcattttcagtgtccaaagtttcgatgacatttggtattgaatggacattaatggcattttcaatgtccgaagtttcggtgacatttgacattgaatggtcattaatggcattttccgtgtccggtgttgtttcgacaatatttggcactgtttcttcaatggtctgactgccttgcacatagtttggtacaacttaaaaataaatttattaaaaaaacaaaaataggttttcgttaattttgaaaaaagcctttgaataaatttgacctcgcccttcaaccaaaatgaattgaatggcactacaaattgggcaagttacatgagctttaaacctaaatctaatttattttaaaaaataaataatttttgaacgattcattcaccaatttttgatgcaaggaatgtgaaatttgtgctgtaaagtatgtaaatataaaacatatttcaaatattaatttcatattttagaaattaa

SEQ ID NO: 39512 - DNA, 1304 bp, Heterodera glycines
aaaataataacaacatcagttccatattagttacgcttataaacatcatatggcagactgagataaagatcttttaggcccaaacaaaatctttgtttagtaatttacaatgtatattttcatttttatttacaacagtgtccaattcttctggtgttcattttttcattggcgtccaattttctagtgtccaattttcggtgtccaattttctggtgtccaatttaccgggagccgcccaaatagttacaaaatactaaaaattgcccaaattgtattttataaacaatagtaaaacttgcccaaaaaagtttgtttattttcatgctcaaattgttacaaaaatactaaaaattgcccaaattgtattttataaaacaatagtaaaacttgcccaaattgtattttacaaacaatagtaaaacttgcccaaaaaagtttgtattttacaaacttatactaaacatgctcaactagttacaaaaatactaaaacttgcccaaattgtattttacaaacaatagtaaaacttgcccaaaaaagtttgtattttacaaacttatactaaacatgcccaaatagttacaaaatactaaaacttgcccaaattgtattttacaaacaataagtttgtttattttacaaacaacattaaaacatgctcaaatagttacaaaaatactaaaacttgcccaaattgtattttacaaacaacattaaaacatgctcaatagttacaaaaatactaaaacttgcccaaattgtattttacataacaatactaaaacatgctcaaatagttacaaacactaacttttgattctgatcaaaggcttttacagcaacttgatcagatcactccttcatagtgaccgagacctcctaaaatacactgaaaatcggagttttcgaaaaaaatccctagagggttgggaaatttttctgtaaaccattttattgttgttttaaatgattttagtcgtaaaatttatggggcatgaaaatacaaatttagcaccaaacgaagagatccaaacttcaacaaaatcctaaaaataaaaaaataaaaacaaaaaagcatgctgtcaaaatcttcatcgtaatctctttccgatcatgtcatgaagcagtagcaacagtttgtttccgtctcactgttctgtcctccaacagtctcttttcctcctcctcaacaatttggagtcgttttatgtacggcacaatgtgcgttcgtagtccccaaacaagtcgaaccgtgccctggccgtcgtcaaccgatgaatgcattcgccaagtctgatgct

SEQ ID NO: 39513 - DNA, 913 bp, Heterodera glycines
tagcaaactgtatttttaaattctggccgcatttctataataacgtgtttagaccgcagtaactcggctcagagtgaagattaagggacgcaaaagagacgatttaaaagcgattcgaaaattctatcgactgatataataacgatgcagtcgcggcgttgacaactgagatggaaccaaaagttccataatatctttccataaggctggaaaggcagaatttgaatggccagtctatatttacactgagcacccgttgaagcgggtgatgcgaatccatagcaaactgtatttttaaattctggccgcaattctaccaaaaacgtgtttagaccgcagtaactcggctcagagtgaagattaagggacgcaaaagagacgatttaaaagcgattcgaaaattctatcgactgatataataacgatgcagtcgcggcgttgacaactgagatggaaccaaaagttccataatatctttccataaggctggaaaggcagaatttgaatgaccagtcgatatttacactgagcacccgttgaagcgggtgatgcgaagccatagcaaactgtatttttaaattctggccgcaattctaccaaaaacgtgtttagaccgcagtaactcggctcagagtgaagattaagggacgcaaaagagacgatttaaaagcgattcgaaaattctatcgactgatataataacgatgcagtcgcggcgttgacaactgagatggaaccaaaagttccataatatctttccataaggctggaaaggcagaatttgaatggccagtcgatatttacactgagcacccgttgaagcgggtgatgcgaagccatagcaaactgtatttttaaattctggccgcaattctaccaaaaacgtgttagaccgcagtaactcggctcagag

SEQ ID NO: 39514 - DNA, 886 bp, Heterodera glycines
gttttctgttggtccgtcgttaatcgcgcgagatgaaagcaaatggacaaaatgggaaaaggaagcgattaattggcaactttatgatcaatggaacaaaattgacattgaaattgatgaggacggaatcggggacgggtcagtgaattattcaaaagtttcaaatttattgcatttttgttttaggcttcttgacgaaattcccggcccaagtgatcagcagaaatgaatgattgaatttgctgagaaataatcgatcaataattatggaattttcactttttgctcttgcattcatttttctggcacaaaaattattggaaaatgggcccgacgacgtagtgattttgtccaaaaaagccaatttttcaacggggaagaggtgaggaaggtgtccgccgagaaaacaaaattttagtttttcaccctgcctccccccgccgccctctacgcaccccttggacctgtgtgatttttaaaattttacgaaaaacaacactttttaatgattattgtttattgccaaacatttccgcgtccaattttggcacatacaacattgaaatgtgctatgaaaaggtgttgttccattcaaagaaaggcgtgccaaaagtgagcattttgcttcttccttcgcccttcgtcttccatgcttcttctcggccccattcgtccgggtggtccgcacttttgccaacgattggacaccgttcaatcaaaaattgatcatcctccccaattattcggcctgtcaaccgttcacgagtgcacgaattcaccagctcaaattggtccccattggaatcagcatcatgttcaaaggaatgcaaccaaatgataaagctgacggcaatggtggcactcagaaacagctcaaagaaaggcg

SEQ ID NO: 39515 - DNA, 1399 bp, Heterodera glycines
aaaaggaatacttttttatgattttccagctacattcttgataaaattgatggtaaaggtaaaaattgactttgggttcttaattgtttgtgcccttttttggcattttttgtgtgctttccaaccgtaaaaaatattctttaatggacaagtccaaacatttatttatttattttatgtaataaatcattaaacattcaaatcattaaattttagaatatttgaaatttttatcaaaggacaattcaaatttattgccataaaaaagctttaattccgttaattattgtattttctcgaatgggccttttcagtgtgtttttttatagagtcgacattgttacgcaaaattatttaccctttattttcttaaaataaaattttattattcaaatagaaaactattcttaaaaattagtcacaaattgtttgaagtagctttatcatttaaatttaaagcacaatgcatttcgttaaagtttgctcatcctttctcaatcagagaagtcaggtcatttcttctcactctcctcccatctctcttcttctctcacttcctcactctcctctctttctctcatcttctctcactctcctctccccttctctcatctctcttcttatcctctcctccacccatttttctcattctttcacttcctcactctcctctctttctcttatcttctctcactctcctcttccttttcttctcgttcctcctcctttttgtcccatcactctttcttcgctcctctcctctccctctccttcctattacttcctcttcctcttcacttcttccgctgctattgacctcctccgcctccgcccattgctcctcctatttcgtccctcacttttttgggcagtgactgcacttttctgttgatcatttccgccttatcatttgccgacaaattggggttgttcgcgatttcggtcagttcccttaagcattcgtgttttgcttttccgtcgttcttttttctcattttctcacttgtccgcctttttcgccgcttcgctgaactttctcaccgcttcttcgtgcgccgcttcgccctcggccttcgcccgttccctttcctgctcaaactcgacgtatttcttctgcaaatttattttgttgcttattttggcttttttgtcctttaaattgcctgaatttcctccgattgtttgtccacccattccttcactttttccgctatttccgtttcttttaaatgccccaggctcgtgacgtattggtagaattcgttgattttctcttggctggcctctgttaagaatggcgggggctgcgcatcgccttgggcagctgattcattttgggctcggcacaatgccaaaattaacaaagaataagacgcaaaggaaaggaaaatggacgaag

SEQ ID NO: 39516 - DNA, 976 bp, Heterodera glycines
aaaaaatgcacgaaaaatttcgcagtgttttcacaaggtgggcgataaattttttattgaattcttctatattgcaggtgattgttgtctgataagtgatgacatttctttcccaatttcatttttcagttgcgctgcaaaccgtgccgaggcaccaaagggcgccacgcgtgtcaatgatggaaatgagaatgtgtgatgacaaaaactaattgatgaagaacataacgaaaccgatgatgaagaatgagaatggttagacatggccaactttagcataaaacttgtgaattatttatggaattaattacaaaatttaatgtcttatcatgcgtacgagatgtatatatgtgtacatatagaattattatgagtccaaatacccacgactagagaagcgagaaccgaaccaatcccgaaactcgatacccagaccctgacttaagtccgaaagacaacctggagattgcaaataaaaactcaagaatttctcggttcaagtcaagaatcaagactctcgaataatgaggactttggaatacttttgtcaccaaagactgatagaataggaaaaataatagtcaattgaacatgcacatgacatggacatgagggggggggggggggaatttagttacaatcaagattgacaataaacaattgcagaattttgcatttattttcgtaacgaaataactagaatctagattaaaatggaaaaaatactacacataaatcagcggagaggaacggccaataaggcaattgagagggggaagatgtatcaaaattttaccaaataaaatatagatgaatgtcttatttcatgtaaagtgagatataaaatacaagaatgttctatgaagtatgtctaataataaagtcatcttacacaaatattaaaagtgatggaatgttgtagtctcctaaaatatcacagcaaattttatattgttctgtaaacaaaatcaactta

SEQ ID NO: 39517 - DNA, 946 bp, Heterodera glycines
  misc_feature (900)..(900): n is a, c, g, or t
attcgagagcacctgagtggataaagattaaattttatttagtgtgtaagaaatggagatagaccttttgtcaatctttattaatgtataacaaatgtcatttatgcgttctttttatgtttgaaaaccaaatgctaatagattattttaatctttattttaaccgtgcaaaattctaatatcggcaaaataattggagctgaataactgtaagcctttattcaaagagccttttgaaaggccaacctttttcaaataaacacatgttattataagtacacggttcattatttcgtaattgagcagtaaatttggggagttgaaagctatattctggctacattttgaagcatttttttatcccttgacagcttataatattccttatttttatgcattcgagagcacctgggtggataaagattaaattttatttagtgtgtaagaaatggagatagaccttttgtcaatctttattaatgtataacaaatgtcatttatgcgttctttttatgtttgaaaaccaaatgctaatagattattttaatctttattttaaccgtgcaaaattctaatatcggcaaaataattggagctgaataactgtaagcctttattcaaagagccttttgaaaggccaacctttttcaaataaacacatcttattataagtacacggttcattatttcgtaattgagcagtaaatttggggagttgaaagctatattctggctacattttgaagcatttttttatcccttgacagcttataatattccttatttttatgcattcgagagcacctgagtggataaagattagattttatttagtgtgtaagaaatggagatagaccttttgtcaatcttcattaatgtataacaaatgtcacttatgcngtctttatatgtttgaaaacaaatgctaatagattatttttatctt

SEQ ID NO: 39518 - DNA, 1189 bp, Heterodera glycines
cgctactggcttaataaaacaagactcagcgctactgaattgcagtctaaatgattctgacccaattttcatgtattttaataacaatgtaaaatttaagcatcttcaaatataaaagttaaataaaaattcatatgaattaattcatgatatccacttctccatcctctgaattaacatcaggcgagttttcatcttgcacttcattcaaacccatttcttcaaagtattgatcaacatgcagcccattttcatccaaactttgttcaagcaaaagccttgcatcttcttcaattatcatttcttcagcttcattacggtttgacggcggattgaagccaaccaaatgtccaattcttccataataattagacatggcttcaacaaattcatcattgcagtaatccgtgttcaaaaaagccaaaatatccgccttcgctgaggcaattcctctgtccaattcaagagttaattcaagcgggcgagctggcaattgtcttccttcatcaacggccactgcggtttcttcttcagcatgacttagttcctatcatttacgatacaaaagttagagacaaacaagtacctgaaaactcgctatccatcggccgagcaagaaaccaggctggtaaaagcgttgctgtcgtccgtggtaagactcagcatggttgatggttcgatgccgaacaacgtcaaaaagtgcaaaaaagtgcagccctattctgttgttgatccatgtgttgttctgtatatttggtgttgtctaagtagttttacatttatttacgcagtaatcgagaagttcactcaatgcgccctgttgtaaagtttccaatggagagtgtgtgatgagatggcgcatgagttgaagcgaacgggctaaatagttgggaggacagaattgtagagccccaattttgcgaacaaggcgctgaaactcaagtccatttggttcttttgagctgtacaattgcataaatcccattgattgaattcggcgatttatcgcttgcttcacatgaaacgcgcacatttttggtctgacagttggaaaaacatcgcaaaatgcattcactgacgcagattcgtagtcaaaattcgcttgggaaatctgagcaaatcaagcagtttataaaacgtgaattaccattaaaatgccgggaattttgtccaattcttgccgcaatct

SEQ ID NO: 39519 - DNA, 1533 bp, Heterodera glycines
tttctctaaaatattcgattggatttagtcgaactaatccgcatccattttgagcgatacaaaagtaatggagtaaaatatttctacttaagaaagaccaaattttaattgaaaattaaattcacaagaaataggaatgaataaaaatgtaaggacttttggattaagttgcatcacaaatattagatcgataataacggagaggcaagcgtaaaaataggaaaggtgaggggaaaggcagaatatttgatatttaaaggacacattttgcaaaattttttatttaaaatgtcgaattaaattttgtaaaaatgcatttttcacaatatttcttttgaataaaaaattcttgttataaaaaacaataattatattgaaattttacattctataaacaaaatagtttttgatatttttctataaaaatttgtaaaattaataatcaaacctaagaaatatgtataaaaataaacattaaaatactattacattttttagccatttcacagttttgtttgtgaatgctttttttgtatgaaaattgttgccttttaaatggaaattgattagcatttggtgggcacacaaaaggcaaatgctttgtgttgaagcaaaatgttaagagctgttcccacaatttaattatagcaaagtcacgcattggagaggagcggaacggaaaattggggaggggcgaggcggcattgagaaatgaatttgaaaagcatcactgtgcattaagcttgtttaataataaaaattaattaattaaatttaaaaaaaacggaaattaatgttttgattgaggactgattttaggtgctgatttagcaatttttttcggaatttttacagcaaaaaatgtaatacactaaattttcaacttttcgatttttttttcaaacaatatcttttcaattttctccagtcactagtacaagctcagcattgattcttgtaaaaatttatttttttaataaaaaatgaattttaaataccttaaataaataataaataaacatcataaaatgggaaccgtgtaaatgtctgtctacacattatgtacaaagcaaattgattattattggtatttgtgtttgtgagaataaatgaagtgaaatggggggggggaaagaatgggtggcggcgcggcgaaaagaattgacggcggacggacgacggacaccgaccgacccaaaagaaaagacacggacaaacgaaccgagacaaagtgtaaacgcaaatatttgtgacaattaaataatgggtgagtcgagtgagtgaatgagggtaattagtgtggccagcaaacagtgcgtattctttaattcattgcctatgggatgggacacggattgaaaaaataatggggacgcaattcacgcaaaaaagcggaaatgcacgggtcgtgagaaactaaaatttcccgagactggagaccgagaattgaccacgagaagagaccataaaaagccgaaacttttccagggtgaaattaaagataacaaaaatgcgtctcgaaaaagtgggaaa

SEQ ID NO: 39520 - DNA, 836 bp, Heterodera glycines
gcagtttcgctggtgaaatttaagcccgttttagcccggtcaaattgaccgggaccgggccgcccggtaaaagcccgccgggcccgtccgggctctactaagaacataggaattgaccaagtaaaaaaaagttatggtctatgaaactgcgggtgttcctcaaaagaaaggtcagtattgcgatgctcggattcgcctcattcaccgccaccggttaacgacatcttaacaatcgtcccccaaatgcctaatttgtaagatcaagttcaccagtcgttgctgctgaatttagtgaaaagtgaatttccgcttttttattcgaattggggtccgtggtcccaaattattcgaaatggattccggatttgtgatcaaaatgaccctaaaaaccagcacgcattagttcccatagaaaaaataggggcattttttcaacttatcctcacctcatgttaagaaaacacagtcttctggtttattagtagattaatttaattttaaaaaatgttttaaaattaaaaaaaaaataaaaattatcgaaattttaaaaatagcgttgttattaacgttgatggcataatgtatgttgatactaaataaataccgtatattctttaattaaggccccgggggggattatttttcaacctcttcagaaaaagggacataattggagacagggcctttaatggagacagggggattatttttcaacagatttttaatgactagggccgcgacttttagtgatgaaaaatctcgaaatagttaataaaataatgacataaccccaaattttttaattatttttggtgagaagcgtcaaagtctgattt

SEQ ID NO: 39521 - DNA, 950 bp, Heterodera glycines
cttttcaaaagatcgttaggatcgtacgttttcggcccgtacgcaccatagcaaaaatggcgtagtttgaacgacacttctttagggtttgaggtgttttgagtcagaagtttcgcttttcaaaaaaatctttgggatcgtcctttttcggcaaaatagtgcaccatagcaaaaatggcggagtttgaacgacacttctctagggtttgaggtgttttgagtcagaagtttcgcttttcaaaaagatcgttgggatcgtcctttttcggcaaaatagtgcaccacagcaaaaagggcggaggttgaacgacacttctctagggtttgaggtgttttgagtcaaaagtttcgcttttcaaaaagctcgttgggatcgtcctttttcggcaaaatagtgcaccacagcaaaaagggcggaggttgaacgacacttctctagggtttgaggtgttttgagtcagaagtttcgcttttcaaaaagatcgttgggatcgtcctttttcggcaaaatagtgcaccacagcaaaaagggtggaggttgaacgacacttctctagggtttgaggtgttttgagtcaaaagtttcgcttttcaaaaagctcgttgggatcgtcctttttcggcaaaatagtgcaccacagcaaaaaggacggagtttgaacgacacttctctagggtttgaggtgttttgagtcagaagtttcgcttttcaaaaagctcgttgggatcgtacgttttcggcaaaagagtgcaccatagcaaaaatggcggagtttgaacgacacttctctagggtttgaggtgttttgagtcagaagtttcgcttttcaaaaagttcgttgggatcgtacctttttcgggaaaaaagtgcaccacaagaaaaatgggcgaagtttgaacgaccctttcttaagggtttgaggggttttgaggtaaaaagtttccctttt

SEQ ID NO: 39522 - DNA, 972 bp, Heterodera glycines
aaacaaaacccgggacttttatttacatatttttacatattcgggctttttatacatattatacatatttcgacgttttatacatatttggtacatttttggacttttttctaacatttttcatttttttacatattttacaaaaaaaaaccaaaatttcggcaaatttttcgtacatattttcatatttatttttgaattttgagaatttttgaaaatttagagaaatttcttctgtaaaaataacaaatatttttttgaaaatgtactgctaaaaaatcaaaaattaattttttaaatactaaaaattttgttcatcattttctaaatttggtctttttttattatatattccacttttcctatcaaatgcttttaaagataaagttgctctacagtatagacatacgtttcttaccatatacaaatgagggtgacctgtagttatgtgtggggtttagggacgaaattttgtatgtgaataggacacagttgttcttaacaaaagtgttttcattttctgccaaattattccgagttatgacgtgcttgctctcgagtctctaaaattttcggtctcgaacttcattagtggtgtatatggtaatgctgctttcacaattttttgggtcacaggtacgggtccgctcggtgcaagtcattttttccccttttacttttgcattttgtcaaattatttggccgagtgaaatgtttttcacctcataatactttcagcaaattggtttacattgtgataaaaagcccgtttttaatgcttaattaattaaaaaaagcaacttttttcaaacaagtaattaagaacgaactaattaacaattaaaattataaatttttaagattttgcccgcccttcaaattttggcggaagaagtgagcaaaatggcatgatgaattcattaaattagagctgatgtgaaaagaaatatctaattgtcatttgatttttag

SEQ ID NO: 39523 - DNA, 991 bp, Heterodera glycines
tccccgaaaacgcattactatatacgatgagccctacaaatggtcggttggaaaatggctccataactaagaatagatattctcagaaaaatggctatctctttttctacagccttccacatgaggttttcgccgaaaacgcattactatatacggttgagccctacaaatggtcggttggaaaatggctccataactaagaatagatattctcagaaaaatggctatctcttttttctacagccttccacatgaggttttccccgaaaacgcattactatatacggttgagccctacaaatggtcggttggaaaatggctccataactaagaatagatattctcagaaaaatggctatctcttttttctacaaccttcaacatgaggttttccccgaaaacgcattactatatacggttgagccctacaaatggtcggttggaaaatggctccataactaagaatagatattctcagaaaaatggctatctcttttttctacagccttccacatgaggttttccccgaaaacgcattactatatacggttgagccctacaaatggtcggttggaaaatggctccataactaagaatagatattctcagaaaaatggctatctcttttttctacaccttccacatgaggttttccccgaaaacgcattacctatatacggttgagccctacaaatggtcggttggaaaatggctccataactaagaatagatattctcagaaaaatggctatctcttttttctacagccttccacatgaggttttccccgaaaacgcattactatatacggttgagccctacaaatggtcggttggaaaatggctccataactaagaatagatattctcagaaaaatggctatctcttttttctacagccttccacatgaggttttccccgaaaacgcattactatatacggttgagccctacaaatggtcggttggaaaatggctccataactaagaata

SEQ ID NO: 39524 - DNA, 1027 bp, Heterodera glycines
caaatatattttccaaaagtctgtgacactttctgaaaataattctatactcatgtatttccacttattagattttgcaggcttattgctgcatgttctttgacacttcttcaaaataacctatgccctttattcgttcaaaacagcatctttgttgtttcgctttggattgacaagcccgatgataaatagctcgagcgcaaaacgtgtgcatgtttggaaagtatcgttcataccaataattgagggtttatttttaattgaaattttatgataaaccttattatctcagaagctatttaattgattcgaatgtttttatcccggttaattagagcaacaaaaattggtttgaatcgtgaagtttatcatttctaactcacttctcaaaattgttgataaattgcaaatatatttttccaaaagtctgtggacactttctgaaaataaattctatactcatgtattttccacttattagattttgcaggcttattgctgcatgttctttgacacttcttcaaaataacctatgccctttatttgttcaaaacaccatctttgttgtttcgctttggattgacaagcccgatgataaatagctcgagcgcaaaacgcgtgcatgtttggaaagtatcgttcataccaataattgagggtttatttttaaatgaaattatatgataaaccttattatctcagaagctatttaattgattcggatgtttttatcgcggttaattagagcaccgaaaattggtttgaatcgtgaagtttatcatttctatctcacttctcaaaattgttgataaattgcaaatatatttttccaaaagtctgtggacactttctgaaaataaattctatactcatgtattttccacttattagattttgcaggcttattgctgcatgttctttgacacttcttcaaaataacctatgccctttattcgttcaaaacagcatctttgttgtttcgctttggattgacaagcccgatgataaatagctcgagcgcaaaacg

SEQ ID NO: 39525 - DNA, 897 bp, Heterodera glycines
  misc_feature (30)..(30): n is a, c, g, or t
  misc_feature (784)..(784): n is a, c, g, or t
atctaaaaattctttcaattatttaatttntggctaaagaaataggaattagcttttacggcatcttctgacaatgttttaatttaatttaatttttttaaatttttattttttacagaatgtgcatcttttatgattttgatattttgacaattttaactacttaatgtttaagtttaagccaataaatttttggattttttaattaaaaaaaattcaaagttgttcagttattttcaaagaaatatatttatactcacggaatcatttcagcttgtagtctaaatgcatttaaatcaaatgatttcgctgactttatttcaaataactgctttgtccttagtttataattttttaatttaacaaatatttagatttaatcattcatacatcattttttaaattaattttattcttttttttacatttttttggttgttaaagaagaaaaattaataaatttatattatatttttttagttcataaagattttatggttcttatttttcttattttacaaatttattaaaataattatattctctatcctaaaaaggatatttaattatttttttattgtatttttattagataataatatcacatcattatgttttttaaataattttaaaatcatattattataaatgcaatttaaaaataaactgtaatttattttaaataattaattacttgctctttatcttttataaaaatgaagttgtgaactgtttttaaagtgagttaattttattttattaatgcgtattattttttttttanatttattgacatttaaaaaaacaattattctttgaactttagtaaaataaatcgttgtttatatgttctttaagaaaatattaattcagaattttttcttttttaacatttta

SEQ ID NO: 39526 - DNA, 1031 bp, Heterodera glycines
tcataattttttttaaataacacaaattattaattcacttttttggcgacttaaattaattttcacatgattttaaataaatccggatgttttaaaaaataaatttgcttatggattagttactgacggattgcccacgataggagattttcagttgggataggatttcaaggtcccaaaaattttcgtaaagggaaatcgcaattccgaggcaaaaaatgtcggaaatcgaaatttagtgcagctggtgtccagcattaaattgccaatattcaaaaatgtacccataaaattttgtatttacgttttgggggacgagttcgaggcaaatttttttaaaattttgttttcaggggggttcttggaattttctgagtcccaaaattctttattttttttaaataaattaacaatcttttaaattttttgcttttaaatcgctgtttttgtggcaatgttttttcaaaaaacttttttggaacagtgggagggggcggggtccggcggtgccgataggcgccgccggaaaattttgagcgagatttgttaacaaaatttgtcaaaaaatgacaaaatatttggttaatttatgggtttttaggctattaaaatgaaaaaaataataattttaaattaaaatattttttattaattaaattcaattaaaataatggtaaagaaaataaaaaaaattttctgttccatcagggaattgaaccgaagagacaaacaatgaagctcaggaggtttagccactaaaccacataagtatttaaacatttgctttaaatggaataaataatttaatttattttacaaaaatttctgatccctcaccaattccttctcttttctcacccagacccccattcttaccagtcttaatttagtcccgccaggaccgggactggcaaaaccgggaccgggatttcaatttttccaaaaaccgggaaggaccgggaccggaacctgaaaaaaccgggatttcccgccccggtcccggtcccggtcccgctcaactctaattgaaa

SEQ ID NO: 39527 - DNA, 919 bp, Heterodera glycines
ctgcagcaggagaaaaactggggcagcaataaaaaggtaaattttttaatttccaccggggctggcctctccctcccttgattgcctaattttaggaggattttcgcaaatttttagacctccccaattttgggtgaaaatgcaaaaaaattccaagatggcagagggtggacaaggactagtccaaaaaatgctgctgatgattaccgacccaatacaaggggaaaccggcatattgtgaaagccagccaggcaaaagcacaccggcagcatgcttagattaattaggagggaaaattggactaattagttgcaaccgaaacttaaaagtggccaattaaaatgaaagaaaaacgaaatactgtggtcatctgcaaagcaacctcggtcacacataaatttggagaccaaaaagttaactagcgcgttgcgctggtgaaaaatgtgtgaaaacagacagactgcccctgggggatattttgcggaacaaaaaacgatccattaaatcccattaatcctccgccactgtgaaatgagtcattcatcccctgaggggatcacaaaaacagattcaaatcagcagcagaagctactattatttatacatacaaataaaaggcaggcccttggctcacgcagcgggaaatgaaaacggggacaaaacagaagcaaaaaataaatgaataaaccccccccccccccggggttgaatgggcaaatggaaaaatgaatagaaaaactccctcagggcaaaaaccggaaaatcttctatttgtctatttttacttttctggcagttataaaactgttgttcaaagggccttgaaaatggatggaaaaaaattcaaattttattttaagtaaattaagaataaaatgtgggggaggcaaaatgaaaacaacataatttgatgacggt

SEQ ID NO: 39528 - DNA, 1231 bp, Heterodera glycines
  misc_feature (1182)..(1182): n is a, c, g, or t
gatcagttggggacgaggttgataatgatgaagcttcttggtcagtcgaagctgaaactgctaatgatgaaggcgcttcttgaccagttggagcggatgttgctaatgaagcatcttgatcagatgaagctgatgtcaataatgacgatgaagatgaagcatcttggtcagttgccgacgacgttgctaatgacgaggaggatgatgaaaatggggtctgatcagttggggccgagattgataatgacgaagcttctttgtcagttgaagtcgaagccgacgttgatggagatgaagatgggttcagatcggttgtagctgatgataaattcgccgtttcttctccactcagcttcatcttctgtatgtccatgccccggcacattttttctgccgttttcagtaaatctaaattggcacataattcacggataaaaatctttattcgtttatgattttcatccaaaaaaagtgattaaaagctcacatttcactgcacatgaaatgtaatgaaagtcactccgatcggttgaggagggcataagccgaaactgtgcctggaagtgaaagcaaaagttaaattcaattgttcagcttacattagttgttctgcctaagaatttttgttcaacttcgatacaacctaaaaatatttttcagccttttctcgagaataaagtcgagaaaacccttttcttttgctcttccctggcgtgtctgtattagatctcgactttaaagcaaagtcaattattttctcgaattatggcgtgactcaataccttcggtccgaaaactgttcaccaaacggtaaactgggccaagaatttctcggaaattttttgtgccctacaatatccaattttggtgtttattttaaggaagtccttcagggtgccggaacatccatccgttaaatgatgattgcttatattagttttttcacacttttaaaaatttatttaaacttaaaattaattagattttaattgaaacatttaagtatttttttagaaatttaaaaggatttcctagtaagccgtccttcttacgctgtgctggtgctgatccgcactgttcagcgtgcatatccctcgcccaccgcctcccttttctccgtccatttgggtgtactgtaggcttcgacaccgtctccgtcgcccttctcctacggtcgccggnccaatttcgttgtcggcaccgccgttgtcctcactttgtccctcctcaa

SEQ ID NO: 39529 - DNA, 1042 bp, Heterodera glycines
atttgcatttcagctcctcttaaaagcataaatatttttcagaggtcatagtcaaatttgaaaaatttgtacgcgatgaaacacgcaattttgacgccaaattggtggccctgcgcattgaaaatgctctaaaaactggcgaaaatttggacgactcttcgcttggcgcaggcgcaaacagcagtaccgacgatgttgtgaccacaaattgcgatgttagtcaccacgtaaatgtgcatcatctttttgcccatttcacttaaaatttttaaaaattaaggaaaaaaaatgaaaatttcattttttagagctctcctaaagctgtgaccggaaacgctgacaatgaggcagaaacgctttttgaagagcaatttcaggtgcgcaattggataaataaaaattggactttttttcatttgggaattttaagacttacaattaacgcgttgaaattttcgtgtgtaaatttttttgtaattttgggaaaataatgagtttttaatttttagcattttcttttatttttcaaagttaacaaaagcttattaagaactttcaaactataccaagaatgtttaatttggttgaaaaggaaaaaaattatgattaaaaaactcgtccagtgactgtttgtccaactccgttaaaaatagagcctcaggtggctcaattagaaaaaaaattgtatccaactttccatatgttttttaacaccatttgtagagtaagccaattgatatcatggcagttcgtacaattttttatattgaaaaaaaattaaattttttacgaagaagaaaaaaaaaatcataattttttttttaactcatttttgtcagatgcgttcattggtccgtacgcgcaacttgaggttgaacgcatcaaactcacttgtgagcaaacacttgcccaatcagttgccgatgccgtcgagtttgacaaacattcctatgaaatttcgatgctcaacaaaaaattacgggttgaaaaaagagtttttgaaaaaaattaaattttaaattattttcagcaagtttgcatc

SEQ ID NO: 39530 - DNA, 977 bp, Heterodera glycines
  misc_feature (907)..(907): n is a, c, g, or t
  misc_feature (912)..(912): n is a, c, g, or t
  misc_feature (918)..(918): n is a, c, g, or t
tccccccgaaccgatgcgcccagatttatggggagaccgaatccttcgggaatagcttccctatagcctgtactttaattctgcgttggatttttgctccccataattgtttgagtaccccaaacggacacttgaaaaaatcgattttttttgttttcggggcagtccccccgaaccgatgcgcccagatttatggggaaacgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataaatgtttgagtaccccaaacggacacttgaaaaaatcgatttttttgttttcggggcagtccccccgaaccgatgcgcccagatttatggggagaccgaatccttcgggagtagcttccctatagcctgtactttaattctgcgttggatttttgctccccataattgtttgagtaccccaaacggacacttgaaaaaatcgatttatttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggagtagcttccctatagcctgtactttaattctgcngtggnattttngctgcccataatgtttgagtaccccaaacggacacttgaaaaatcgattttttttgttt

SEQ ID NO: 39531 - DNA, 941 bp, Heterodera glycines
tcgagaaaaatatcgggtcgggtttcgggtcgagaaaaaggccgggtttcgggtaacccggaacaaccctggtgggcacggcctgccaaaattgcagaaatttttctgacttggaaacaagtcatgaccagagaaattctaaaaccagatttttcgtatgggtttcgtcgacgaatttttttggtttcgccgggactggggttaattattcaatggtggcgttaaggattgcagtcgggattagatttttgtatatactttaattaacaaatcttgaatcttgacccttaatttatgacgggaaagaattaccacgatccaattaaatgctattgtgttttagataattcaaatggattttgcaacggggccaacgaagaaattctgcgagatctgtcggagctggattgacttatttgaggataaaattcaagtggaaaagttgatgagtaagccggagtgttttgatttaaaataattaattaattttttttaaacaaaaatgtcatctaaaagcattgtaaaaaaataaaaataagtttatgagcattggaatattattttccattttttaaaccttagatatgaaaatttgtataaataattattaattctttcctataagcccttgaattctaaaatatcttcttatctaattcaatattaattaattaactaattaattaattgcccattttcaaatattagtgcacaagcgttgcttcgtttgcgcaatttgcgactgtccgcttgagccgggcaactgttcccgagatgacgggatcatctactgccaattcatgtgcaacgaccgtgtgccagtgtggttttgttctgcccatatgatgttgggatcgggcgaaaaatgccaattgttgaaggaaaaatggatgaaggaaaatgaggaaaagcaggaaatatgacacaacaaatgattaatg

SEQ ID NO: 39532 - DNA, 1073 bp, Heterodera glycines
gcataaatttattcaggcattaattttcccgaattatgatttatagagaatttaaattgtttttggctatccggtctccaacaaaaaaaagactcggttcgggtccctaaaggtcgttttgtcctcaaaagatgggattgtggagggggggggggggagaaatgccgtccctcggtgaaaaatgagcctttgtgtcaataatttttttattttataccccaatttgtacagcgttcgttcgttcgtttctttctttccattttctacctttcgcctctgttctgtttgtattgacccttctccaattcgtcctatcgttagtttgtccatttgaccttcacaatgattgggtggcgagtgcgtcgtgcccttctccgtttgcccttcgccgcttcttccgctgatccgattcgatgctctctattcgcttcattctcttcactcatcacttcattaattcattcttccacaccctttctcagcaggtggccttcgttagccattccctccccccgggcgatttactaattcattctttcattcattcgtccgtccgtctctccaaaaagggaccgttcctttcctttttgatattttacttaggcttttgatgctacgaattgcttctctttttctgcataacattcactgaaatgggcgatcatttgtcttcatttgcctaaaccctttcaaattttcttctttattaattatttttattttcagccatttttaatttttgcactaacaaataagttctttcttcgtcatctaaattaacactaaataaggcttagttttgaataatttgctctttttcttctctcattttttctttttcttgtcgcgcggcagcaaaatctgacaaaaggcggcacttttgtggcgggggacggacggacgagagaaaattggcggacgacggatatggcgatttgtgctgtttttgttgctgttgccgcgtgaaccgccgattcgctctcctccatttaagctttgtcaatcgatcgatcgttttctctgtttgtgttgtcgccgccgccgaatccgccgaatattctccaatttcaaaa

SEQ ID NO: 39533 - DNA, 1323 bp, Heterodera glycines
ggaactcattgagaagcttcaacaagccaacgacaaagttgaccaacaaatcgcagaggaacaccaattgcgaaatgaagtccttcagatggcaccgcgcgcgatgaagaaatacctcgacacacgctttgaacgactggtgcacaatttagtcaaattttcaaaaattccgttttaaattttagatgaatgccaaattggaattcccccaaatggcggacagtgaacgcaaatccgaggctgagttggccaaggcgaaagaagaacttcgccagttgaaactccaagcagccaaagaggcggaggaacagaaaagggagttggaggaggcgcagcgaatggagagggaattgaaagagcgagtgaatcggaagttggccaaactgagggcattggaagagatttgatggaaaagttgggcattttactttgattacttacacttttgattttactgtacttacatttttttatatttccttaaaaattctgaaaaacagtgaattgcaattgaaattcaaaataatatttatttgtattagattcgtgttttaaattggttttacaaatacagaaacatgcataaatatccgtttggtaatgcaaaaggcgtcacccgcagctccgctcgttcgaatgcgaatcctccaagtgcagcgaccgaatggttccaccgcaaattcggcgctgccattcaactttcggagcgaaagaaaaagtaaagtcggcttacaatcaacaaaatcaaattggtttttaattttagcgaatgcgaacgcaaacaaaaaaagcaaagtaaggcaaaaatgtacaaatacaaatctttaacatttaattaaaaacaacaggttatcaggaagtgaagaaaaatttggagaaatgtttggccattcgacgacaagaagcttacgaacggcgatgtaacttttaacacgcagaaaatgaactgtttgaaaaaaagggtggaaaaggagggagaggataggggagagggatcatgagaaggagaaagagggaggaagatgaggaaaaagaattggaaaagaaaatcgaacaatattattaaaaatagatgggcgtgattattaaaatatatgattaccgaagatgaatttttttttttggaaaaaaagaaaacttgcattatattaaaacaaaatagaaaaaatatataaaagtgggaggtgggcggaattccaatcgggatatttcggggaaaaaacggtgacagaattcagggttcgctttttttattataaattttatttaaaaatcccggaaaattctcttggcaaatacaaggcgaaacccctgttcctcccc

SEQ ID NO: 39534 - DNA, 355 bp, Heterodera glycines
cgtggtgagccgaagttacaaaagtatcaatgtgggcgaagttacaaaaagtatcaatgcttgaaatatttaaatttaattattatttaaatttaatttgctaaataatacatcataacttagcttaagcttagtcaaattaattaaacttagtatttagtgacagcttcaagtatcctctactacttatgtaatttttaaaaaattagtaaaaacttacaaaaagttgtaagcaaaaaagctcaaaaaatttagagtgaacaattttggccctaacttttttgaaattcaataaaattttttgaaatttagcagaacaatagaataatctttgggctattttttcatatcaagt

SEQ ID NO: 39535 - DNA, 1142 bp, Heterodera glycines
  misc_feature (1030)..(1030): n is a, c, g, or t
  misc_feature (1050)..(1050): n is a, c, g, or t
gtgaacaaatatgtaaggaagttgattatcacagcatttaaataggactcacgaaattaatttgatatgaattttgcccaattccaattaaaaagcattttttgggtgttggtaaatagctgaaaattttttggccgttgaagagcaaaaaaaaaaagagtcgatgacttgccaaacagtcaaaactttataaaaatttttggaattggcaatggctcttaagattgatcaggacaggcccaattcccgaatcgctgtctattcaagaacccgagaatttaaaattagaatttaatatttttagctgctggcaactcactcagattttttccgtgctttattttttggtccaaatgcagatgaaaacccaaaaattgtgatcgatgacgagggtgaaaatgccgtggcaaattttgaacggacaatttcaatgctgagttcacccgatgcagaattggatggtaaataaaatcggaacattcatttattatattttaatgaactaattgaatgtaagaaaaaatgaccatgtttttgggttagagttggataatctcttccagttttggttttttgggttttaaaagcccgaaaatctttttgcatttaccaaaattttgattgaaatgcaatcaatgcaaaatgcaaaaaataagatcttaaatgactttttctaaactaaaaattcatgaaaaatcaaaaaaaaattgagtaaggaaaattttcattttatgcttttctaagattaaaaaaataaaataataattattaaaaaaataaataaatttcagatgactatgtggaaaatgttcttctgttggccaaccgttttctgtttgattccattgagaatcgttgcgtcaattttcttatgaacgatagccaaaagccgaaaattttcaagtttcgattggctaatcagtgtgccatcattggcatgaaggtgaaaaattggactaataaaataaagtcaagaaaagaacggcagctaatcaaacacgcttcccccctcatttcggccattttttanataggagaaaattccattanatcaaaaattgcaaagattcctgccaatttgtcataatgtataaaataataaaatgattttaaatttagaaagcaattttaaacgacttgac

SEQ ID NO: 39536 - DNA, 78 bp, Heterodera glycines
tctaactcgagatcggctcttgcatttttacaagggaaaatcccccaataaattttaagttttgcaaagttttggcgt

SEQ ID NO: 39537 - DNA, 480 bp, Heterodera glycines
  misc_feature (5)..(6): n is a, c, g, or t
  misc_feature (21)..(21): n is a, c, g, or t
tctanngagtcactgaaaaanagcggaaaattcaatttattaaatataagaaaaatttggaagtgtccttttatccaaacatcgttctttagcctaatatatatccaaaatgattatgtaaactttctaacataaaatttgttttaatatgtgatcctaaatgccgaggtcaacaaatttttaaattattttcgaaaaccgtcattttttaattttatgggtcaaagaaatgagttttaaagcggactcgaacctcctcaatctacatattttcaattgcatttcttacaaaacccattgaaatcacactggcaaatactttcagcccaattaacgggattcaaaattgaatcggtgtggcaatttcttgactggaccaataaaataaccttaattttttttggtacttatttcctttaccgggtacttttaacatacattttcagatgcctataaatgtgttttataaattaatgaaaa

SEQ ID NO: 39538 - DNA, 864 bp, Heterodera glycines
cgaccccaactgtccccgaagttttaaaaaacgcaccgcaaaaaaaaggtggaaaaaatggacaaataataaagtttgtttctaaaataaatatatttcatgaaaatattttttaattttcatgaaaaaatttttaaagatttttgtttggatttttcatgacttggactcggtttaaaaactaggactctgacccggctttctgtacccggcaataccctgacccggtatttgcccaaatacccaggcccgtacccctaatttaatatacgattttgaagttttttaaattaaaaataaggctacagaaaaaattgaaaaactctcgcctctcgtcctctcgccaactctcgtgtttttggggactctcgcctctcgccaaactctcgctctcgtctttttggggactctcgcctctcgccaaactctcgctctcgtctttttggggactctcgcctctcgccaaactctcgctctcgtcttttctgagacaagtcacacccctgatatgcagggctcccagatttttggaaaatttgtgtgagattttcgttttgacgctttttaaacacccaaattattaaattattatcaaacattatcagggttgccagatctgaggatttatcctcattttgtggctttttgataggtcaatgaggatttttttggaaaatgaggatttgaggatttttgtggctttttgagatgccagaatctgaggatttatcctcattttgtggctttttgataggtcaatgaggatttttttggaaaatgaggatttgaggatttttgtggctttttgagaaattttgaaatttttgagggtttttggggaaaacactcagaatccttttaaat

SEQ ID NO: 39539 - DNA, 940 bp, Heterodera glycines
ccattgaaacggcacttttaatttatcccatgacttttttctgttctttttgccagaaattggccgagaatttgtcttttatgagcagcgattgtcagggggtaaaggcgtgacaagttgacgacagcacaaaaacgccgtcaacagcacaccgaccacaataaaaacgatgactgaaaagggattggaattggaagggactgatcagtgatcagcagagagagtgagagaggaacagcgaaataatcaatcaatcaggaaagggactgagaatgaaggcattgaggggaaatcgaattatgatcaacgacaggaaaagccaaaattggaatggaatgctgatcagccaggagaccctgattagtgcaggaatgatcagaatgatcaaattaaaccccgggtattatgtttgactagcgggggttgtggcatacgcacccaaaacgaacaccgcaacattggcatggcgttgtgcgtcgctgctctcacagttttgctccgtctgtccttctgctgctgttcccatttctgttgtcccaatttgctccgtttggcttccgtttcccattgcttttcccatttctttttgtccttccctttttcctttttctctttgcctttcttcttcacccattgcttcttctttttcttcttcgtcttccttttctcccttttcggcttcttctgacgatgaccgtgccgtactgctccaatttccgctgctccctccgccgtcctttgccattggcctcccccgtctctcttcgcttttcgaccgatctgtccaccatttgatcagctgccgataattggacaagaggaacgcctctcagatcggtaagtttctatcattataaagacatgtttaaatcacaaaacatatttcattttcttatattgaattgtcatataaaagatcaattgatttacttttttattc

SEQ ID NO: 39540 - DNA, 1224 bp, Heterodera glycines
cagattaatgcggatgactgttcccatgacgggtctctgtctgtggagaatgtgctttgggccaacacggtgttagcaagcggtacagccattggactggtggtgtacaccgggcgggagacgaggtgagagaaccaaccgatcgaccacttattttttgtacactttttcgctaacattttttggttacatgctgccgataacatttacaatattattcaggtcggtgatgaacacgacattgcccgacagtaaagttggcctgctcgatcgtgaggtgaggcaaatttgcgaggaaaaaagttttagttgaacaaagggcttacaattagctaggggcacaaactgaattgtgtctccaggtccagaaaagaaatacaaaaggttacccgccaaggtttcagaaaacggcagaattttgaaaaaaaaccaggctaggacacggctttaagagtcttactcggaaaatatttctaactaacaaaacgtcttgttttaatcagactccggatcctgatgaattcctctaatccggaagaattaaaacccccaaaaaaaccacaccaaaattgtcatcctttgtcgttaaatgaggtgccttccccctcctgaacaggtgaacaacttgaccaaaattttgttcctgttcgtgctcactttgtccgctgtgatggtgctgatgaagggtcctgaccatctgtggtaccgttatctgatgcgctttgtgctcctcttctcctacatcatcccgatttcgttgcgcgtcaacttggacatcggccaaactgttctactcgtggcaaattgggcgggacaaggccatcgcggagacggttaccattttattttgttgaaaattccgggtttttatggtcgagcgatataattaatgccaagtatccttgtatttggtaattatgtcgatcattattcgaaaaatgttcaattcgtattccgaattttcttaaagtcactttttaggtggtccgaagcagtaccatccctgaagagcttggccgaatctcttttctgctgtccgacaagacgggcacattgacgcgaaatgaaatgcgattcaaaaaggttaatttgtatatccaatttgagagagtagggcgggagaaaaattttacaaaaaatcgttttttaagtcttggtaagtgatggttttgaggatccccgtgaatttgcattttatggcttcatttttaaaaacattttgtt

SEQ ID NO: 39541 - DNA, 1112 bp, Heterodera glycines
ccctcggattatttttatccatgcgcttaaaatttttctttggtgaatcatattgtaaataaattgttaaatttattacattttatggctttttgtgtcggacatggcatcatcgtacccactttcgctgctgctgtcgctgcctttgctttcatcgtcgtcggacccactgttttgcttgttgccgtccttattatgcttcttagccattgctcccgctaaaaagtttattttaaataaaagaataagtaattagaaatgtaggataataagaaaacgcgaagaagaaaaaagcaatgaaataacaataggcattaaaaaaataaaaatttattttgcgtctctgcatttattggagtgagagcgtagacagagaaagatagagataaaaaaattttccgaaatctgagtcattcggttttatttattttttgcaaaattaattcataaatattttttcacaaagggttctgaaacccaccaaattttatttacaagttaataagattctctgatgcttttctatcaataacggaggtgaataaaattttaaaaatgatttaattgcgttttaactttgggaaaaagtttacgcttaactgtttagctgagagattgatcactcttattttttgctaattgagcagaagcataccaaactttacagggatactccccggaaaaggactaacttacactgaaatgatcgccgagctagcttgctctagaaaatttttcaaaaatctgagtctttcctttttattcattttttgcaaaattaattcataaatattttttcagaaagggctctgaaacccaccaaattttatttacaaaataagaacattctctgatgcttttctatcgctaagggaggcggataaaatttcaaacatgttttcattgctttttaactttgggaacaagtttaagcataaccttttagtgagagcttgatcactcatattttttgctaattgagcacaagcatacccaactttaccgggatactccccggcaaaggactaacttacgctgatatgagcgccgagctaacttgctcctaaaaaatctttccgaaatctgagtccttttcgtttttattttttttt

SEQ ID NO: 39542 - DNA, 1000 bp, Heterodera glycines
  misc_feature (867)..(867): n is a, c, g, or t
  misc_feature (873)..(873): n is a, c, g, or t
  misc_feature (901)..(901): n is a, c, g, or t
  misc_feature (976)..(976): n is a, c, g, or t
attttgtctttaattacatatttgctttaaaattactgctaattttataagtaaactgcattactaggcggtaatgggcttccgcggttagtgaaaggatggtagtcgtatgttcgtgtgagttaaaccagtcgacaaattccgtcattttcgccggcacttcttcccaaggcacggcgacatgctcgcgcacactgacgtccgttgttcggaagtcgccggcgatgagtgggttagtcgtccacattatctcgcggtgcaggtgcagcaccatctagtaaaaagcactatgacccgacccataaaaattcattttcaaattttcagactttaaattacgatgaattgataggacaccattttttcgttataaaaaaatggccgcaatattccctttttagatgtttttctaagattttcatataacgaaattaacctccagtgttagttcttttgcgtatatgaagttagcgtttaaaagtccaaaataacgcgcgtcatgcttaaaaagagagcgctgatcccataagaattgttgatattccagattggccattattgtgcttaatttcactttcaaacagtttttaatttgctttctatccatactaccgggttttttcaataattaatcgctagaaaaaaccttcgaacctcccatttctgacagggaaagaggtgggtggggcattaaaatgaaacaaaattttgtcgacgacgggaataagcaagatggaaaaagccgaacaacaaagacgatggtgctgcagaacgacgcgttgtacactgctcaaaactcgcggaacgatcaaataattcgaacgccaaggtttatgggcccattttagcataaggatttcagagggnggaaangtcaagtctaaaaatgagcaaaaatatnccatgattttggtgcactccgtcctgtgaaatttttaatattgtcagccaataaacggctaatggaaagtttcangaaaaatgggtggttaaaattaaa

SEQ ID NO: 39543 - DNA, 831 bp, Heterodera glycines
tcacagaaatgttaaagcgctagaacagagttgaaaaattttcattaatttaaaatgttctgctgcctaatttacaaatttttcataggctaactttgaggcctcctatttcgttcaatttttcaattttttttttataaaaatttttttgtaaatttattaaaatagcggcgaatgctttttagttgagcatgtccatcactgatggacgacctgccgatccgtcgtcaacagctgcacttggggtggtcaccagtgctggaagtggtggaaaacgtgttgtgcaagcaaaacataaccaggtgggcgtaaatttttaaaattttcttattatttttttaaatataaaaaaatctctagtaaatatttatttcaattttgaataaaattttctttttattttttttaatataaaaaaaattctttgataaatatttacttctaattttgaataaaattttctttgttatttaaatatttctggattaataattttcttttatttttaaaatgatttttttgttgtttttaattttataattaattaatttgtaaaaagaaattttataattccgtaaatttttaattatttttttaaattaaatttttattttaatttttttattagtttgccattttattcctctatttttccctttcttttttccacccacaaattctcacccttaaaaaaaaattaaaaaaaaatatatttaaatgacaattttttaatttaattaaaatattttactattttttttttctttaaaacacatctcttaaatgacccattttcgggggaataaattctatttggatgatgcccaaaaa

SEQ ID NO: 39544 - DNA, 458 bp, Heterodera glycines
ttttaatgaactgcttttaattaattttttaattactcaatccgaaggtaattaaagcgaattctgttgggcaacggacggtcgggcatggaaatggcatatatttgccattaatccgcacatagttttggtttttagtccggcgcccatgcgaattgttaattctctccaaattgtcaattctgttttgccatcgaaatgtttgttcaataaaacatcaaaacgaggtgaaagcattgccaatttgaggccgagttgaggacgatcaaaatgagggaacatgtccatcaaaacatcggtacaaatccaactgaaattgtggaataattgagcgatttaaaatttttaattcgataaattctcaaagtttcctcaaaattcgtttattcattttctttgccacgcgaacacttcgtcgtttgccaaatgatgtcaccagtgaacccatcgattgctgt

SEQ ID NO: 39545 - DNA, 1249 bp, Heterodera glycines
ttgtgaaattaccgtaaccggaagaccgacaaatgttgacgagtgtgaacaacacattctttccaaagtagcgcaattcaacacgaacagaccttttgatcaattcgcgtacaaaactaactgatttacaatgacaattttgcaatttgagcaacaaatcatatatcccttcttttatcgaaattactgccatctatctaatttatttaagaaattccgttttcgtctaccaggaaatatttcttatgtatttttgatcttgttcatcttcatcactacttatcatgaaaccctttgtcacaattgtatttaagagactctatagccatttgagttgttgataaaatacgaaaacccagtgggtaacacccaaattaatctttttttttcccctgtcaatggtttgtgatacccacgaaactttttatttaacatttcgggatgtgcgcgaccgagacccatctccatactttttggcttagctacttttttgcgggatttctgcattaggctcccgtaccgcgaaattctcacccattaatttttaccccagattgctttaaattttctttccttaaaatttattgttttaaattaaaaatttacatatcatttgagctttaggctacatcaacgattttccgagtttttatttcccagattctattaccgtccgcatttataccgaataaggctgcttaatttgcaataagaacggcagttaatttatagattagaaagagaaatgcaagagcactatgggtacgccccagtggtgctgaaatttggtcgttacttaaaaaaccatcataatcaatatttgcgcaactaattacatgatttaatttccggaaatacgtcattaaaaaattaattaataaatggtataataaaaataaaagcaatgtaaatttaatatttggcaattcatttaataatttccattcctgttattctataaaattttcaacaaaccctattaaataaaaatataatatatactttcttgaatttaaataataattgaaattaagaatgaatttgtttaaatatactccaatactaatctgtatttttttactcctttttttataaaacgaaatcactatgagaaaatcaaaggtggggctcgaacgtccaattttgatgcatttatcaatgataatacattaaaaagtcggtacttgtttggtttacctgatagatttcgtatacatttttagatgcctataaatgtattcattttaca

SEQ ID NO: 39546 - DNA, 965 bp, Heterodera glycines
gagataatcaccactattcatcgcactccgtagagccttatattccgcctcgggaatcattaacattttctttgcaaatttcatgatgttattttttctaataaatgttgggctaaaacactcaggacaggtatcaagacagctcccagggctataccactcccctgttgtatcctttttcttgccgttttctctgaacgagatttggcaatttctctataaaaatcggcgtattgtgccaaccttcttttttgtttgttcgttagtttaaaactaaaactcaatatatttgcacaaatttcaacgattgccaaaatttggtcagctgtagcgttttcgattaattcgttcttcttttgttctgatctggtggaggcaagcttctttaggaatgctgtattctccttcacttcggagctaaatttatacatttttaatttaatttaaattcatattcttatatactattcaattggtaaataaatttccagagtctcatctggaaaaattttgctacataatctgaattcctcatcagaatttgggtgcatgttaatcatgagatagctaaattgattattggtcgcatcatgatatgcatccatgaaataattcagtctttttgggaacagttgtgaccctagagtcctcacttgtaattgtcctgaagggttgcgcattaaaaccagataatgggcgttcgctcttgccgttttaatgtcccgaccgtagagactctgggttacaaaaattacgcttacgttccaattatgggagcccctggtaaagagtaaatcgagaaaagtattctgcatgttaagcattaaatcgtcaagtatcagtaagaggggtttttcctgttctttatcttattcatgtccggaatcccattaaaagtctcgacaccctccccgaataatccctaaaatactatcattcatctcaccataaaaataaagaatttt

SEQ ID NO: 39547 - DNA, 925 bp, Heterodera glycines
catccaggggccaaaccgcactgatgcggaccagcactgttccgccgaacaggtcgaccccgccgggccgactgggcggccaggcgctccagctcggcgcccattgcggccggtgtgttctgctccggcgcgcggtgcggaatgtgatatggggaggcgaactgcggtggttggcacgacatgccgatgcgcatcggcggcgcacggcccgaaagcacacgctgcagcagatgctcaatgcagcgggccaacagtgtgtcggggcggcgcgcgccctcccaaccgcgcagcgacacctcaaccgcctcacaacgcgtgttgcggctacggcactcggtgcgctcccaggcgccaatcactttgcagaaacggtccagtcgctgcccgtcggcttcgccggcatcggcttcgtcatcgctcggcgcaacgttggcactttcggcggcacttccactgctgctgctgctgctgcccaaatttgacaccgccggatctctgctgtcgcgcatcggcggcgctccgctgacgtgctgttgagtgtcggagcgattgatgcctccattgctgctgctgtctcggtccgagtgatcggtgaacgacggccggcctcgcccaatttgacgccaaacattactctataaatgcaaaaagcaattttttgctcatgttcctattttcccatcttgtgaaagcccttcccatgaaatggcactctctcttccaaagcccaagtcgctctcattttccgcaagtaaccgccctaatcacaccaaaaaacacacacacacacacacacacaaggaaaaatgaataaatttaatgaatttgaaattaaaaatgaatataattttattaaaaatggcaaaaaacaatataaaaattggcaacaaaatagaaatatgataaaaagaatggaatggaatga

SEQ ID NO: 39548 - DNA, 1380 bp, Heterodera glycines
ttgcgcgcctgctgtcatcgttagacgtagtggccatttctcagacccttctccggagtcgaacccttatcctccgttacccgtcatcaccatggtagtcagatacactaccatcgaaagttgataaggcagacacttgaaagacacgtcgccggtacaagaccgtgcgatcagcttagttgttctgagtcaacactggacgcccggagggcgcttggttttgtggcgaacaaatgcgctccgctctggggagattggagctttggtgcatgtattagctctagaattaccacagttatccaagtaagaagtcaaggtcaagtaaattatagctggtgtaatgagccgtacgcagtttccctgtctggcaggttaaacttacacatgcatggcttaatctttgaaatgaacacatcagttcaggcaggatcaaccagatagctgctagcgagcgttgccaagcgccgctattacagccgtcttgtaaagacggatagtttcagcagaaacaactccgttcagcgcaagcgtgcgcatgggcagcgaaggagacagagcaagtggtaatgacacagcgctggccaggcatccgagcttcccggacttgggaagaaccatctcgccgctggacacagctccgagggcagtgcacaggcactcacacgagcactccggatttcccggttaggacacttcctcaggccaaaggccttcgggcgcttatgtctcgtgttttttcgaatgcaagcacactggtccccaggcaaggagttccgatccacgaactcatagggcttgtcaaccatggcaatacgccactcactcgtataccaacaccaccaccaactttaggttcagcatccccagtgctgagttccccacagcatttgtgccttaggccacatttacacaagtcaattaactcgccaaatttctttaacacacagacgagctgcatgtttattcatttcgacagctgccaatcgctggagaaactgaggccacgacaaaggtggcaccccagcagcagccatcaccgttcaatgccgagcacaagcgcaagcaagcacttgaacccagacggccgcgctccccatagcgaaatcgcatcttttttccagccataatatcgcaaaaacggcccaaccaccacagtcacccacgccaaccaaccaacgcaaagcacatacgactaggaactttatacaaattttaaaaaagtaatattttgtatatgcatttaatcaaatttctactttctttataaatgttagctaattagtcagcgtctatttattttctgtaaaaatttgcctctttatttaaaattaaattatatagaagttcatgaaataagacactaaatgtatagagaatgaa

SEQ ID NO: 39549 - DNA, 997 bp, Heterodera glycines
attttgaagaggctctccggaaacggattagcatcggggttacgagatagaagaatgtcctaaaaagagatagccatttttctgagaattaattcacattttctgcagctcttagggtaatggaaaaaattttgaagaggctctccggaacggattagcatcggggttacgagatagaaaattgtcctaaaaagagatagccatttttctgagaattaattcacaatttccgcagctcttagggtaatggaaaaaattttgaagaggctctccggaacggattagcatcggggttacgagatagaaaattgtcctaaaaagagatagccatttttctgagaattaattcacaatttctgcagctcttagggtaatggaaaaaattttgaagaggctctccggaacggattagcatcggggttacgagatagaaaattgtcctaaaaagagatagccatttttctgagaattaattcacaatttccgcagctcttagggtaatggaaaaaattttgaagaggctctccggaacggattagcatcggggttacgagatagaaaattgtcctaaaaagagatagccatttttctgagaattaattcacaatttccgcagctcttagggtaatggaaaaaattttgaagaggctctccggaacggattagcatcggggttacgagatagaaaattgtcctaaaaagagatagccatttttctgagaattaattcacaatttctgcagctcttagggtaatggaaaaaattttgaagaggctctccggaacggattagcatcggggttacgagatagaaaattgtcctaaaaagagataaccatttttctgagaattaattcacaatttccgcagctcttagggtaatggaaaaaattttgaagaggctctccggaacggattagcatcggggttacgagatagaaaattgtcctaaaaagagtaagccatttttctgagaattaattcacaatttctgcag

SEQ ID NO: 39550 - DNA, 1366 bp, Heterodera glycines
  misc_feature (1267)..(1267): n is a, c, g, or t
  misc_feature (1348)..(1348): n is a, c, g, or t
  misc_feature (1357)..(1357): n is a, c, g, or t
tagagaccgactaaaaaggcaccaaaactgcaaaaaggcaccataataggcaacaaaaaagtggaaaaaggcatgaaaggcacgaaaatctcgaaaaaggcatgaaaaaaggcattaaaaatttttttattaaggatttttagatgagcaaaacaacgtaaaatttaaccaaataacttaattttggccctttaaattattaaaggttttataatagttattcgaataaggaaaattttaaacctaagacttttttataaagaaaaaaatgaaattttaacgattaatttttgagaaaatttttcgattcttaagggtgtatttactgaacattttttcaagtcattcttaggggtgtaatttcacgattttactgctttttttaatggttttggaaaaacacgccaaaaaggcaccaaaacggcaaaatggcaaaaaaggcataatagaaagtaaacgtagaagcctcaaaccaagtataaaatttgttttttatgcttaatatatctaaactagagggccgaaaaaaggcatatgcctcaaaagtaggtctctactaattatattaagtaaattttttattgaaaattattcgaaccttttacatattcagcaacatattcgcggaacaaatactcgtacagaatgaaagcaaatttgcgtgacctttcccattctggcgcataaaattggttctgcttaaaatcatgaaaatattcgacaattcatataattttgaattaaaaaataaatcaaaaataaaaaaattctatttttgaaaacgaaaatcaaataattacttttcacaaaaatagaaacaaaaaaatatatattttgaaaaaattaacatgcaagaaccgaaatttttatcataatataaaaatcaatttcgttaggaaattaaaaaatttaaattgcgaaagcgaatttttttctcattttttatattttaaacttttttatggttttaaaaattaatattcatttgtcagcggatgctcttactttcgtaatctgctgaatctcatgccaatccattcttagataatacaaagtgccaaggtgtgcctcatatttttcagacaacaattgctttttctcatcaatggttaagccgttaattgcgcaaaatctgtcaaaatgttccgggcctttcgcaagtgcaaccaaagcgtcatcttcattcttgttataatgggattataaaagtatttaaattagctaatttgttaaaatggcaacttacaaccgcagcatttacacttgngaaggcattgaaattgcgatgatttaataaaattagaaaaaatatacaaatgaaataataataattcattgatgtcgctanattgcgtcnaatttgact

SEQ ID NO: 39551 - DNA, 1112 bp, Heterodera glycines
ggaagcaaacccatcacaaatagggtttgggcgccaccgacccggaccgtacatggaccattctccaaccatccaactccttactgcgcaggtggctctccaccttggccctttcccaggggtcctccgaccaatcagcaacctgcaacgcctccaattcatcggcaattgtctcgacatcgcccagctctgggagaggctttacaactcccatgaggccgtgatgactccgctgtctgcccaattctgtccctcctctcggagccgcgccgccattttcgttgcccattcttcccctcctcgactctcgtgctgcgacccaaaagggatgcttttcgtcggtccgccggtccgtggggggaagtgaactcccgccgtctcgcatgcttctgccaccgtccatcagatcaaaattgccagaaaacatgaaagaaattggggaaatgatctgtaaaaatccaaatttatgggacgaatggacgtgaaagagagaaggggttgatgcgcgtggattgatctcccccgagtagccgaatggaaataatgattcgtttggctgggaggggcgacttaaatgtccggggggggggaggggcctttgccgctcgcctcctcctgctccgccccctcccctgtcgctcgcttttgacttccccgcgagcgattggctgtcttttttgtgtctgcccaccagggacgtagggaaattgtctccctctctccatttcggctctctggcccccgttaatgaattagcagcgcagatcgcccccaaaatgacaacggtcaatgggggaggggcaaacaaaggtgagatgcgatgtcggggtgtccaaagcaggcggcaaaaaaggccaataatggtgaagtacaagtaaatggcaccaatgatgagggagaatgctccctctgaaaaattgttcggatctcccttggcagtcgtttgtggcgtttcagtcagtcgttgaggcccaagtgccacgaaatctgtcccggttgtcacgcttattttttctccattagtccatcgatcaaacgtggcgggggagatctctcccctcgaatcttttgcttccgtctttccgatcagtattacaagcagaattgggcca

SEQ ID NO: 39552 - DNA, 1789 bp, Heterodera glycines
aaatttgtggtgtcatgtggcagaaatctgaccatttctcagcaggggtacggagtgaaagtctttaaatcagtgacactgaagaagcagaggaaaaggcgtgctgttgaaagcgtagtggcagactctcaacttcaatcggaactttcctacttaagttttcaggtcactcattccatgcgtttttcatttagccatacaatacaaagtctttgtgagcacttagaccaaatcaaaagatgggtaatgtcagctgttttttctgatccttcaaccttagcacgcattttgttcaattcatatctcttacatgctaagagtgttaccccagggctcataagagtctggccatgtattgaggtcaagcaaaaagattttgaatttgttcccttaggggaaatcagtcaagctggtaaagacaaaagcagatgttttgtacatttaccgatcaaattcagacatggtggagttgaaaggcttgcctttatcgatacgaatagcatggaaataagagcaacttccgaaaagagagcatgttctgaatcgcagtaccaagttgttcgcttggacaacaaattcatagaagttgatcagatcactgcgaaaaccaaaattccaaaaattgaattaattgataaaactgaattaaaatcattttctattccttcaattcccctccatgtttttcaccacttatttttaaccaatacctctgatttttatagtcattttttggtctctgatcccatgaatttgaacgaagtctcctataaaattcatgaaaaagatggtgaaattttgacaaccccatctgaacaatggcatgcattaaaagataatttggtcaaacatataataggagattggacccttgcttggagaggagtcatcaccgttttagttggaattttaatttttgaactgctggtccgggtatatttcatgtttaaacgggaatacagtaggggaaggcacggaaattctcataacaattttaatggcccttccgataattcacaattgccagaaattagatatactcccattaagaatctccaattacgcagaacaggcagtgtaccatgtctttgcatagtttgtgctttgaggacgaacaattcagcagttgtgcccgcacgagtcaattcttcattgatcaattgtctgatcgatacaggcgcatcagtgacaattgcaccccgaagtttggcaatatggttaaacaccgaaatttttaaaacaagtatgtatgcagtcagtgcctcagggcatatgattcattttaaagaaaaaataaacattgaattaatgctggccggtttcaaggtaacaattggcgtttatttggtaaatgacaacgaatttcacaccgccaatgaataccaattgcttgtaggtacggactctctcagaaaactcccaaaaatttcttttgatttcacaaaaatgaaattttttgttggagaaaattgcatacccatgggcccaagtaataagttagctcaaggcttaagaattgcagcagtacaaaacatcacaattcccgcgaattctcagcaaatagttgaagggaaaattgaatctttatttccggttcaaaagaatttattaattgaacgagctgatcagaatgtctcaaatcggaacattggtttgatatcatcggtaagcgcgccccttggggacactgtcaaggttttgctttggtaaatccaacaaatgaaccgatatattttgttaaaaatatgcacgtggcatatgccaatgagttagaggacaatgacggcat

SEQ ID NO: 39553 - DNA, 1021 bp, Heterodera glycines
ttggcttttattcctacggacaccactcgctagtccaccactaagcactaggaaattgtggatgggacgcagccacgccttggcttttattcctacggacaccactcgctagtccatcactaagcattaggaaattgttggacgggacgcagccacgccttggcttttattcctacggacaccactcgctagtccaccactaagcactaggaaattgttggatgggacgcagccacgccttggcttttattcctacggacaccactcgctagtccaccactaagcactaggaaattgttggacgggacgcagccacgccttggcttttattcctacggacaccactcgctagtccatcactaaacactaggaaattgttggacgggacgcagccacgctttggcttttattcctacggacaccactcgctagtccaccactaagcactaggaaattgttggatgggacgcagccacgccttggcttttattcctacggacaccactcgctagtccaccactaagcactaggaaattgttggacgggacgcagccacgccttggcttttattcctacggacaccactcgctagtccatcactaaacactaggaaattgttggacgggacgcagccacgctttggcttttattcctacggacaccactcgctagtccatcactaagcactaggaaattgttggacgggacgcagccacgctttggcttttattcctacggacaccactcgctagtccatcactaagcattaggaaattgttggacgggacgcagccacgccttggcttttattcctacggacatcactcgctagtccatcactaagcattaggaaattgttggacgggacgcagccacgccttggcttttattcctacgacaccactcgctagtccatcactaagcactaggaaattgttggatgggacgcagccacgccttgggctttattcctacggacatcactcgctagtccatcactaggcattaaggaaatggttgg

SEQ ID NO: 39554 - DNA, 1025 bp, Heterodera glycines
cgagcattataacagatcacatgcgcctttcgttgcagcggcatatggccacggtcggcaagccattggccaagccagcacgtgcaatggccaagcattgaaatggccaaagaaatacgacaggagggcttcgatttgctaagcaaagatttgtgcgccagcagcccatccacaagcagtgcagcaaatgctgctgttcaacaccatcaaaacaacaacaattataacaacaacaaagcacaacagtaccaacagcagcagacaccgcaacagcagacaaatactgtaaatacagtaacaacagcggtgacaacgactacgatgatggagggcgacgcgtggttgatgagcacagtgcaagcggaggacaaactgttacaagcgcacacgaacagggaaaaagtattttccattctgaagacattgcgcgacagacacttggacttcagtggatcagcaacaacaaaacagctggtcaaagtgagcagagaagggaagggtcagatcaggtcaaaaagagatgagcaacaatgaatgataggcaaaagattaccaatacaaaccaaaggggggaaaggaatgtgaaccaattttgggtcgagaatttaaattgaaattattggcacaaagcaaataattaataaccgttattatgcattatttaacataattgtcaggtgctcgtgctgtatgagtgcgaaaaacattatgccaactatgaatggaacggtaacatttttaaaccttttgaaaacgtacaggcaaatggtattttcagatttctgtcttggcgaccgaatcattggcattcttctgcaaatggtcaactgtttgcagtgccggcggtgcccccatttttttctgcctcagatggacctgttgaaaaaccggtcgcccaaatcgctagacgaaagtgctcgagccgtgtgggcattggtccggcaactgatgctgaatggcaaagcattggaacagctttgattgtgggaacatcaatgtcaatgatgatgcaccctctcaaccgg

SEQ ID NO: 39555 - DNA, 925 bp, Heterodera glycines
  misc_feature (61)..(61): n is a, c, g, or t
agatcggctaaaccttaactgaaacataccatatcagccattcgccatgctgatttgttgnaatcataataaaaaggccccttttgtttaattctgcctttcctataagcacaatgtgtttgatgggctctacaaaatattgcttgtgcaaagcaattattttcttggaggctgtaattttctgtagtcatttgatatgcatctgctatttttctagtcacaaacaccaatatttttcggcccgaattttataggcgtgaaaagtactgatttccaacttctttctattcggatacacccaaaatttgaaaagcatctgtaattcagcctcttttaaatcttaattttctgaaacccgaatttagaaaatatgaatgtatttctgcgacgccttctatacttaattcatccataatgggccaaaaatcataggttaagaccaaaagagggattttagtttcagccggaatttctataaaaatgttcgtgtgtaacctatctttgtctattcggataagtaagaaattgaaatagtcgtattacttttcctcccttaaagctttataatgaaagcgtcgttgtctatttaggatttgccgtcgcaattctgtaattccactttggaatccaaaggaatttgattcgcttttacaaaatagacagtgccgaaatttgtagatcggctaaaccttaactgaaacataccatatcagcgagacgccatgctgatttgttgtaatcataataaaaaggcccctattgttcaattctgcctttcctataagcacaatgttgtcggaactctgggattccgactgccgatcaattgatcagcagaattgaagaaaagaagtgggcgacccttcccccctccctttcccatgccccccgcacccccgtccccctcctctgccccccatttccc

SEQ ID NO: 39556 - DNA, 1550 bp, Heterodera glycines
ttttctgacgattttatccacagaaatttacgagaaatttgatttgtcgcgcaacaatacatttcactacgcaaaaacatcatccgaaatgtaagtcggccatgtcactcctccctcactcctctccctgctcaggcggtggccccacatacggcaattgctcgaggtaacttcccgccgacgaaccgtgtccggaaccggcatgggaattgccagctgccgaactttgcccagccgaccccaaaaacgatgaagaaatcggactttggtttggagtcgactccaaaaacggaggaggcattcctccttgctcgaccttaaacttttttagatcagttttctttaattttagtttaattttggcgtctcttataaactaagggtttaactaaaattcaaattaattttacaattattatggacatttttttgtgttgccaataaaatattgttttttaaagttagttttaaaaagtgattccttaaccaactaccgtatttactgaattagaaaccccaggggttctgtttttcacccctttaaaatgggggttaatccaattacgggcgtgaatatgagaaacttcgccagcaaaacaaaaactaaactgattcttgcaaaaatctaccgtacgaatcacataaaacaccgccaacatggcgtcgtgccatttttgtccaaattgaaaaaatgccgccgggacaaccttgacactgagcacgtcccattcctttcagaatttgaaattaaaagtgtaaaatataccttttttaacctaacaaaatatatttaaaaaaatatacattcttttcaactcattttttctgcctgaaatttgggaggggtcggtgtggttttgatcaggggtgtatcaatagtttaaatttaaaattttaaaaatttcctctcagtccttcccggggacacagaatttcaaaagttggaattcgaattcggacgcagccctggctgagacccctccccgccccttaaaccggctcccattggtaagtgtcccctacttttggcttctttttaacaaatcattctttagccccaattttttttcgctttccctttttacgtatattaatattatattaaccaattggtcaattctcaaaagctgaatttcgcagaaaaatcgctgtccaaaattcgtagttgtttcctcgcgttgaaaaaacgtgcggagcctctctctctgtattaagatttattgttagaaaacactcgtaatttggtcacaagtttttaatagtgactttgaagagcttcggtagcggaaattaacaaatagagtcataataaaaaaaaatagttgggtgaaaatttgttaacaaaaaacatcaaacttaaaaaaaaaattcccggtagcgcctatcggtaccgaagaacccgaatgttccaaaaattttaaaaatcagttttttgaaagcaaaaaaagtcgtcggaacaaaaaaggctatattgcagtttctgaccataaaatatttcgacaaattttctgcactacatcaaaaataaatttttgattcagtagctccaa

SEQ ID NO: 39557 - DNA, 1274 bp, Heterodera glycines
ttttttaaacctccgtaattattgcagacatttggccataaataaacaaaaacaatgataaaaaaacgattcaaaaaactgatttgcttatctcttatgttaaacttaaattagctcatcatttgcaaattcttttcaaagtgcgatcgcgccaaaactgatgtctctcgcttcgattccaacttcgttgacgccccttcgcacgcggaaaaagccgccctcgccccaggcgtcgctccacgagttggcccagccaatatttggtgcttcgtccgtccgtgcagttcacatggccgtatccgatcagtcgaacgatatgaccgccgccaatttcgttggtcatctccaattttaaattttcaaaattagttaggctcttctgtccaatggtactgcgtggtggtaaattccgccagcgtaaaatcggacaaagctgccatacgcaattatgtccacgggcactgtgccgttgtggaagatctcttctttgatcagctgctcccagcccatctccaggcccaaagtgtgccaattggacgctttccaccgattaattagcattaattgccatcattagtgcctttgctcacttttaactttgtcaatgtcgtattcctgccaatgtttctcatttgagcctcgcttttcgcattcgccaacgtatttgaagccccattttttcctttgtttgggactttagtggaaaagggtacggtttgcagccgcctgaagcgccggggcaacggaggaaaagttagaaaagattggtataatgaaatggcaaatacgatacacacaaaccccgccgaaggaagccattcccggacacaacgccattttcgttcagaaaacgccacactttgtatgaccagcctccttggcacctgaaggttttgtccgaatccgaactacccatgttcgactaactctcttttctctcaatttcctttttttctcgttcattacgcctcctctctctctctcattttggccttttctctccccccccctctctctgtctctcctctctctctttttctctccctctctctctctcatttttgccttttctctccccccccctctctgtctctcctctctctctttttctctccctctctctctctcatttttgccttttctctccccccccctctctgtctctcctctctctctttttctctccctctctctctctcatttttgacttttctctccccccccctctctctgtctcttctctctctctttttctctccctatctctctctctc

SEQ ID NO: 39558 - DNA, 987 bp, Heterodera glycines
gggagggaattgagtgaagcccaatcaatttgctattatcacttccctaattgggtttttgttggacgaatgatcgattgattagacaaggaacaaaatgagcagtgatcaattttgttcaatgtcgtcatttcaaatcactgttcatttgtgctcgtttagccctaattttaatgttcgctcattatctccaaattaaaaatgaaatgggcaattaaaatcactttaaaaataaaaggcaattaaaatcactgtttgacttcgttcggcctttacccgcccccaatccaatcaaaaagttcaacggaatcgttaaataaacccattattcgttcaatggaactggggggggggggtgagatcgattgacaaaatgggagataatcaaaagtgtctgtttaaaatgaattgggtgaataccgtgaagactaaaactgatcagctcagagggcaagtgaccaaaatgaaaaaatttggacacatccaaccgcagaaaaaccatcgacgaatcaaagaaaaacctatggagtcagttttacaaaatatttatgttttacagaattcaaagaataaatgaatatataaaaataacaaaataattaataagtcagtgcaatttatcggacggaggtcaggcggggaaacgtcggaagagcagcacaccgactagcgagaggaggacgagcagaagggtcaggacgagcagaagggtcaggacgagcaaaagagagccagccgaggtgggcttcggcgctactataaaagtgaccgtttttgaaaattttcactttttttttggtaaattttttttttgtttaaaaagtcatgaaaccaagtacccgggggttttagaggtcgctgatcaagaatatgacaattatttgggcctattaagaaatttccactgttggataagggatcacacaaattattgatttatattttccctttctttccctctcgcaattgtctctctccccgcccctt

SEQ ID NO: 39559 - DNA, 915 bp, Heterodera glycines
gcagatcttggtggggtacggcacaaaacgaagctaataactatcttttggaggttgtttaccctattatttaatatttgctttttcttttcacattttttgctaacacacaacaaaattacatttaaaaactattgtacattcaggagaattcgcatccacgtttcgaaactattgtcttggacgaaaccgaagatgatggccaccacaacaatcttgtgggtacggattcagacaaagagaatgatgaattggaactttagcgttaaagccctttagatttttttgattactatggttttttgccttttgcgctttttttgttgcaattattcttctttttttataaaatcattccctttccccttggtttatgctcttattgcttctcggtcaaatgatgacctaaacatcaaataaagtttttcagccgttttacaattaattaagagatgtaaaattataaaaaaaacgcattttgttgaaaagttgttgaagagttgttgaagagttgttgaggagttgttaaagttattatggagttgttaaggagttgttagggagttgttgaaaagttgctaactttaccaccgaaccccaccccccagtatcttggtgaaattataacccagagtactgattctttgttttacccttatataacaataaattaagaattcctaccgttttaatttttatttatttttttattcaatcattaacaattctcataaaatttccaaatataatagcattttgatcaaatttggccaaaccatacccagaccatacctaacaatattttaatccccacgtacctgctggcgccagtgttcaaagcgcccccggcgctttaccacagggccccttggggccctggttccctatataagaaggttctacccatgatccaag

SEQ ID NO: 39560 - DNA, 698 bp, Heterodera glycines
ggaaaatgcgtcagtgaaactttttttgtcataaaaacaagttccttggggtttagggatcattgatcacgaatccggtatccatttcaaccaattcagaaccccggacccgaattcgaacaaaaagtcatgtgtctacattttcgaatttagcattttttcaaaaactgcgtaaataatctcattaaaggatttgatggctttcaatttgctttcgtgtatttaaaccgatttttaaaaaaatcccaatttcggaaattttgaattttcgttcgaactcgggtccggggttcggaattcagaacgatgtttttatgaaattttacttctatattaacaatactaatgccatagaactttattttaaaatattgtatcactgacgcattttctggtcatgaatgggtgtgttgctctttaaaataggtaaacccttgttcggagggctttaactagggaggggatttcagaggcgcaaaatggtaaaattgggacgaaaattttgaaaaaatgcggtataaaacttgttgttttttagtttaatttgttttagcattttaatatttgatacttttttagattttggtcgtcgcttttccaaaaaattgttcgtaactttataattgaaattgtttgcctctatttgataatttgataaatgataataaatgttcccccctaatttgtaagatgattga

SEQ ID NO: 39561 - DNA, 442 bp, Heterodera glycines
atatttatcatttcaataaacaattttttaataagtttgttaaataaaataacaaaagtgacaacagaaaaacctactgctgattggagtgtcgccatttgggacaaggaaatcatttttatttttaaaaagtatgaaaaatttggcttaaaagtcgtaaataatttatgcgaaaaacgaaaaatgattgaaaatttaagaaagggttaaggcaaaaattgttcgtttatttgtaagcacggcaaaaaattttgccgcatcacgaccatatattgatgaaataattacgcgacaatgaaattcgggtgtggaaagaaaaattgggagaaaaaaatttaatctctaaaattttatcggcctgtcgaaaaatacaaaacaactcccagccgtatttatggataaaaaacaataaaaaacaaactaaaaatagctatcgtaccct

SEQ ID NO: 39562 - DNA, 224 bp, Heterodera glycines
aggaagggtgggattgctcctttgcctacgtcttctgctcggttgcccaggtcaagagcgacaaggacatccagcagctgctggggcgcgtgctgcgcatgccgtatgcgacccgccgcaagcaggaggccatgaacaaggcctacgcgcacgtcaccactgcggcgttcaatctggctgctgcagagctcaccaagtcgctcatcgacatcgggttcaaccct

SEQ ID NO: 39563 - DNA, 955 bp, Heterodera glycines
gaaaattaaaaattttggtttttgttctagaactgattaaaatacgataaatttagtcgcaaatcattgaaacatttacaaaaggtcattatgtacagattcaaacataaaagtaaaattaaaattttcgacttttgttcgaattcgggtccggggttcgaagagttattgtccatgtttacctgcataacccattccacttccgtgtcattcttgaaactgttcacttcggcggcggatggacggtcgacgcgttcggccaactcgcggaccaaaacatgcgccacagaatcggcagagacactgaaatgggagcaaaataacccaattaaggaaaccattattaaatgggagaaagcaaaggttgttttcgttgaacacctggaaaactgtgacaaaatgcccaatttcggagcacacaattcgatgggcggccattcgtccgctttttcattctctgcccgattttgagtcgccaaagaagtcattccgagtttcagactaaaattaacagagcatcgaaatgtaaaaaggaacaaccaaaaaaaaactgcttaaaaaacccaaattaaaatttatcgtaaaaatagtcggcaaaactttggataaaagcgcgatgagctaaagcaaaaaataaatcgggcgtttaagcgtttaacgcatttcaacaataaatttgcaaaaagagaaaaacaaatgaatgcggaaaagatcaaagaaattttccttttaatttttttattacctataaaatttaaaattaattgcttctcattaataaagcttgcattaaaaattaaaaattcactgatttttttacaagtatgaattcgctcgagggctctgctgaatcttcttcaacaaaaattgtaatttcgattcattttcatattagcattgtcaaattaagctttgttgttggtgcaacaacccctccccaaatgccaatcactgc

SEQ ID NO: 39564 - DNA, 962 bp, Heterodera glycines
ttccccctctgtccggcacaatgtccgccttcacgcgatggtccgttacgaaagtgcgcttcccccttctcagttgcgcgtcacttgttttcgtcacatataaaaggtctgaaacaattttagtccgacggattaaatgtcagcgagtaaatatttacggaacggccaatgaattactcacccaaattagcggccaaaacatcgtcggcatggacagggtcaaaatgaacatttgtgaatccgccgacttccaaaacctgtcgaattttgtcctcaatttgtttgacgcgatccgacctaaactcaaaagtacaaatagtttagcggtactttaggctagttccgaaaaagcaaccgaaatggacccattcactgatggtgcttttggggaggttttaatgtatctagaccaaaatataccaatcttctgattagccatcctaaaaacttaattaacgttaccaaagaaaagaatcgatggtcacttcggcacgtctcttcagcaataatgccctctccgcataatcggcattcattaagtcgacgtactgtccaaatttggcccattcgttgtcattcaacgacaaattcgacggaagcaataaactcggaatggctttttgttttttgctttctttagcaaattcagtcagctaaaaatacaattagaggttattttattggtctccccgccctttcattgcttcggttaccaaccttagtcttgaagagtgacaaatgggcattgtcgagattatcagttagcggaagacccaaatgacgagaaattgacaaaatattttcgcaaatgctgtcaagtgattgatggtcaacctccattagcaaaagctattaagggaagttttaaattagcaatcgaaaaatacaattttaaacagataggtatttaaattttgctttttgtttttagtactggcataatgaatgtggcataatgaagt

SEQ ID NO: 39565 - DNA, 1286 bp, Heterodera glycines
  misc_feature (919)..(919): n is a, c, g, or t
  misc_feature (923)..(923): n is a, c, g, or t
  misc_feature (957)..(957): n is a, c, g, or t
  misc_feature (974)..(974): n is a, c, g, or t
  misc_feature (995)..(995): n is a, c, g, or t
  misc_feature (1006)..(1006): n is a, c, g, or t
  misc_feature (1041)..(1041): n is a, c, g, or t
  misc_feature (1046)..(1046): n is a, c, g, or t
  misc_feature (1095)..(1095): n is a, c, g, or t
  misc_feature (1102)..(1102): n is a, c, g, or t
  misc_feature (1106)..(1106): n is a, c, g, or t
  misc_feature (1117)..(1117): n is a, c, g, or t
  misc_feature (1145)..(1145): n is a, c, g, or t
  misc_feature (1149)..(1149): n is a, c, g, or t
  misc_feature (1165)..(1165): n is a, c, g, or t
  misc_feature (1174)..(1174): n is a, c, g, or t
  misc_feature (1180)..(1180): n is a, c, g, or t
  misc_feature (1195)..(1195): n is a, c, g, or t
  misc_feature (1197)..(1197): n is a, c, g, or t
  misc_feature (1223)..(1223): n is a, c, g, or t
  misc_feature (1239)..(1239): n is a, c, g, or t
ttcaatttcccactggggattgaagatttttcatattttctttaccattatattaaatgaaattttattaataaaaaaatattccaacttttaaattctcaaaaaatttttcggcatctaatcttttcaatttttaaaatcataataaagcaatttattttttcatttgttatgaaaaatagttttaaagtaagataaattatatttaatttcgatgggcattattttgagtagaatttagattattttgattctcttgccatggttcttccgctttccgtactttgtcaactcaaatgttttttttataattttttttatctttgttcttttattcatataaaaattaaaagtcgttaaaaataatataataatgagaaattattaattcttttacctttttaatcaataaaaaatattcgtttagtaaatttgagaaaatatttcatttttatgaattattggatgaaatattttttataattttataaaacaaagaaattttatgcattattgtttttcctttccttgtatttttttaaaataaataaaaattatttaaattcaattattttaggcataccgacattatttatgaaacagaatttgcaattattaaattatttattgattttaatttttgaatatttgtaagagcttgaaaaaaataataattttgttggttcgtggtaatcggcgatgtttgctctttttatttaatttacataaatgctgcataattttattattaatttaataaacttatttattcttttagtttataaagtttttttttttcttggaaaatttggtattatttttttaaatttcaagcttttttatgtattttttattttcaaagaatttagcaataatattattttttaattaacattttaaatattattttttattatanaatnaataaaatattttaactcttttattcatttttanatatattataatttttnaattattttaaaataccttanttttaaaaatntatttaattataaaaatattaaataaattaatatncttcnataatcaatttttttttaccttttctctctcacaaatcaccattttttnacaaatnattntacaaataaanttattcaattaaaaaaacttttttcaanaaanaataatcatcataatnatcaaaatntcaatnaattaaaatccaaananaaaattcataaaaggtctttttaatnattaattaaaaaattnaactcttaatggcgttctcattttgtgaaatatttttcgcataatta

SEQ ID NO: 39566 - DNA, 580 bp, Heterodera glycines
ccatttttcgaaaaaaatatcacaatagaatccgtgtgggacaaaacagcttgtcagactaaaacgaccccccgactaaaacggccagtctaaactagggttcgagccccgtcaccgcccccgtcaccgcccccgcccccgggggcgggacaggttttttgggctcaaccccgcccccgccggtttatctgtcgttggacaggcgtccaagatgacacgatcatcgtgacagggggggtggcgttggttggcgttttgctctgtttgccattctccgccccttttggccctccgatctcttctttctcttctctctctctctctctgccgctgtcgcccaaaacttgcgattataccaaaaaaatggaagacaaaaataaaaatgaaattaaattaatcagtggcagtccgacgccggggagaaagtgtgtaaagtgcgcagacggcggaactgtgcgcacattttgacggagttgggggacggcaatccttttaagacattgtgtgagttttttcctgaccgaccgtcgcagccgcaaaaagaaggggtcacttttttgccaatttattcagttctgtg

SEQ ID NO: 39567 - DNA, 1055 bp, Heterodera glycines
aaatcagaaccattacacaattaaaactgttcaaaaatgttaaggcaacgtcaaactcataaattcgaacaaatgcgtaaataccgataatttgtttgccgagaaaaggaaccccggcaccggcggtttgaaatgttatgacgagatcaagcaccaatcttatgactgctcctgtcacggtgataagaaatgccttgctgaagaaaaatgggcgcacgacgcctttctttgtccaataataaaggtaattaattaatttattattaattaatgccaaaagacaccgccacagacaaattcatataatataggaaatttaatttttaagtagagtgaagcgggaccgggacctggtagcggacaactgagtaccaaggtttcggttttgacatggacctggactagtcccggttttcccagccaaaaattaacggtttttcaactcgaaaaggtcccggtccggttttacccaaattcccggttccgcttaactctattttttttgtatcaaaaaaccggaaataataaaaaaatagggacgataaactggaataaggataaatatggcaaatgataaaaactctattttattaattaatttgaaaattcaggtcaattcacttcaaatcaaaggaagccgacaacgagtgtttactaacccaaaagattttcgatacaattggactcggattgaggttgattgttatgtgagttggggttttctaattccaaaaatttgtttaattgattaattttacagaaggccgatgcgggcactgtaagcttttggggctacagtaacccggagacaaaggaaatcattcgggtggacgaattacactgtttgacttatgaaactgctggagtgccaaaacggttcaaaagtttgcaagtcgaagaacagccgccgatgaaaaaactgagtccaagtccattcttggccaataatgcttcatcacttatccatgtgttcgtgccatttgttggccatccatgagagaagggcgaaatcagtgatcagtggatctgtctgctgagtgatggtgatcagttgg

SEQ ID NO: 39568 - DNA, 612 bp, Heterodera glycines
ttttatattttcttaaatatttgatgacttaaacgccctatataaaaaactggaataaaatagctgaaattttagagctccttaatttatttgttttgctatttttttttgatttctattttttgtcatcaaattatataaagccattttaggaacttttattattaacaaaaatgttttaaattttgaaaatatttggaggaccaaaagcgttcacatatcctagataagaccggtctgatctaatcttttcaaatgcatttaagaggaagctgtgcgtaaatttatgtaagagaaaacttatttattttctttttttgtaaataagaacaataattataataataattttgtttttttctgaataatgtgaaaatatttaaaattaataaattttgatcgaatttataagataattttaatataaattctttcttttttgattcactataattgaaatgattgttttcgacaaataggatgataaattcgtctttaacaaagtatagttaaataataaagtttaaaaaattgtttaaatttgaaaatttatttttacgaaccgttaaaccaaaatggttgataaattttgttaccgtatttatataactg

SEQ ID NO: 39569 - DNA, 765 bp, Heterodera glycines
ttctttttccttcaaaatattcacaaaatctttttacttttccgacagcaccgcccacgaatgctggccatgtcttttaattttagcatagaaatttttggctcaaattggtctgatattcgtaacgcgttagtcaccaatgttccagctcgtgcaaattgttttatgccaccaattagcaatgaattttgcttttgtagttcgctgttccctattgtgtctgatttttgttgagacggtgatgcttcttccgcgtgagaaaccttaaaaaatgtgccgtagctaagttgattaatcggtaaattacggaccaagcgagggttacacgggttcgggtacccggtcgggcccagactcggatacccagtttgttaagacccggacttgatacacgaatcaggttttcttgacccggaaatctgggagcattatgtaaaatttattttttcctggatctccatgctctaaattaggaaaaaacttatatcattctcttaagaaattgcaccaaaattctaaaatttcgcccggcggcgcctatcagcagcgccggacgaacatttccaaaactagatgtcagttttgaattttattaaaaaactaaatggggagggaggaaccgtttggtttgcaaaattattttgtgataataacgcgtgaaaacttgtgctcggcggtttttggcatcgttgatcactaaatctctaacccgcagttgaacaaaagtcgttaattcagtttaaaggtttatgaccttttttcttg

SEQ ID NO: 39570 - DNA, 966 bp, Heterodera glycines
  misc_feature (935)..(935): n is a, c, g, or t
agcatctccaactaaacctgagaatctagtgatgaatagtggcactaaaaacgaaaattttttgaaaaagaatttgtttttcgtgcatttctcatcaaaataaagccgcagaaaaaatagttaaaaaactagaaatccgcgccctagtcatcataaatatgtactaacattttcaaattttccatattactttctaaaaaattctctatagtgtcgaatttactcaatgtcgatatggtccagtgtcgaaaatgcaggaaaacagtgaaagtttttgaaatagttcagtgtcgaaatttctctatgtcgaaaacgtagtgtcgaaattacttagtgtcgaaaatactcagtgtcgaatttacccaatgtcgaaattaccagccacgaataagaagtaggtgaaatgacaaacaaaattattctttaattatggaattgactattatcctaccaatttttgattttcaaagcactcttacttgattttcagaaaccataagggggggggggggctttttgttaaaaaaggatgtctattgtcagttacagtgttcatggtcggctgattatgtatacattgcaaataaaaaggatccaccccaaatggttttccttaaaaaatatcgtcctgcaccaagttaaagagtgattttttaaatgttttcatcaatttaaactcattaagttcttgttttttcattcatttagtaatttaagcgaaatttgatatttttagcatattttcatcactaataattttttgctcaaaaatttccaatttttttgacagattttcttgtttatttttatttgaatattagcgctgggagacgacaaaaccaatttccgccctgtcaatagcctaaatggggtgcatccacagtgtgagcgacaaaatgcgaaggcaaggagcaggcaaattgacgaacaggttnccttttttggccaattattttcaaaaaaaaa

SEQ ID NO: 39571 - DNA, 867 bp, Heterodera glycines
aaaaattagtcggaccaattttcaattttggcatggtcgcggaaaaaaggcagaaaaatctatcaatcgaataaaaagtgaaacgatagtaagatataaaagaggacaccatgaagaacaaaataaaaaaagaatcatttaaataggctcagaaataacggaattatgaatttttaaaaattggaaaaaatttgggtatcaaaaattatgttccaccctaagtatttgattttttaatcgaattcagtaacatgacaatgatcaggcatcaattttcatattaatagttatagttgattggctttaatataattaaatgaagcaaattatttatgttataaatcaacaaactataaatttgttctataaattatttaacattttttttcaagaggcaattaaaattttttgttttctttgtttctattttccaattttaatgaataggaatcaaattagcaaaaaaataatagaagaattaactaactataataatataaaaaaataatgacaacattgacaaaaagtatataaaaacatttcgctttagaatttgtatcgtatttcatttttaatttttaattcaaggttcatttaacgcgctcgtttcaatttccattttagtttttaaatattttcaaaattctatcaaaggtcacaaaagtgcccatatagtccttctgttatcaagagcgccgcaattgtcatttgtttaagtgtgtatattatgtaaaacgaaataaatattttaattattttgaaaaagatttattttcaataaactagatgtaagtgagaatactaaaaggttagatttattaaatgaataaaaatattttcatttcttaaattgagtatcatcgcttc

SEQ ID NO: 39572 - DNA, 1145 bp, Heterodera glycines
  misc_feature (415)..(415): n is a, c, g, or t
aatcggtcagtcggtcaccggcagcgaatggtcggacattggcggggaataatccgcgcacatccgccgtttgatgatcatcaaatcaccagccaaccaatgcgttggttaattgcccctcggggacaaaacaacaaaggctaattgatgggaagggttggcacaaagcaaaatttattttgggagggaaaagcaactgccaaaagacatttacaaaaaagaaaaaacactagaattcattttgtccatcattatttggaattttaaatgaatgccaacttttatttttcctctcctcccctcctctctctctcttccctctctctctctccctatctctttccctccccctctctctatctcccctccctttctctcgcactctcctcactttctctctccttttggggccagnggccgtttttcgtacgaacacatgtttttggactataacttttttctttaccaactaaatccaacattgttggtatcattcgaaagctctttagatgctctattagcctgcaaaactccaaaaaatttcgtcaagttcaaaaaaagttcgagccaaaaaagttggaaaatttggttttttgaattcttctggccataactttttgaaccttaacgagatttttcgaaattttgcaggctaatagaggatacatagggctatcgaatgacaccaacaatgttggatttggttggcaaagaaaaaagttatagccaaaaacttgtgctcgtacgaaaacggcccgtacgaaaacgaccccgacccctcttttttccctctctttcttttctccatttctctctcttcccccatttgccggttgattctttcctatttttcctacacaatgtcgttgctaattgtaagtggaaatggttttgaatggctacagtattttcctcaatgggaatgatcagtcggacggagcacgaaacggagacggaaagagggaaaggaagggaaagggggggggagagcgaattaaacgacacgaatcgttgagggaagggggaataaaggaagggaaagaatggtcgaaccaaacggaggatgaaaaagaaacacagcaaaatgaaagcattaaattgaaaaggacaaaaaaaaaaattaaataaaattttaattcgaattc

SEQ ID NO: 39573 - DNA, 993 bp, Heterodera glycines
gatgttgtttcagttcggaaatttagaatttttaaaattcgaaaatatttgcaatttttggccctcagaaatttggtcgaatattcgaaaattcatatctagcctaagggttgaccaattttacaggaataaagccttaaaaatagagaaaaatcaggagaattttatgggttttatttggattttctagcataaatatgaaaaaagttattccagaaattatggaaaaattcgaatttccagaaaaaaattcagaactcggttctgaaaagctatttgagaaaagtaaaatactacaaaaatccgcaatttttttctctataaaataaattttattttacatttttatcacatttttaaaaaaagatataaaaataaaagtgattttgtgcttcgggtccaaaggggggtgaccaggatttttgagtggaaaaatttttccacccaaaatcttccaaaaacatgtcattaggggttatttgggccgctgatcatgaatacgtaatcagtttttacttttgacatcgtttagacctcagaatccccgtgtgattggggattctggggcatcattttgaggaggggaggggcaagttcggatccgggcggtgtacattatttttctaccatttttttcgtgtttttcaatttttattcatttaaaatattttttgagttaataaataaaaaattatatttaaattaattttttttaatgaataaattttataagtttaaatgaattatttttttaattgatagaatttcatgtattttttaaattaaatttgttaaaaaatattttcattttaatttaatgaatttactaatcactgttgtacctctttttatcactattgtacctcttctaatcactgttgtacctcttctaatcactgttgtacctcttctgatctctgttgtacctcttctaatcactgttgtacctcttctaatcactgttgtacctcttctgatctatgttgtacctct

SEQ ID NO: 39574 - DNA, 797 bp, Heterodera glycines
tataattgcacaaaatgataataaggtgagttaaaatctatgcttttggatggattacagccttctaaaaatattgaagtctcaagggaaacttggttaaaagagagaaagtaaaaaatcagacaatcgcactttaaagcctttcatatcttagcataactttcaaatctgctgaaaatgatgatccattacattttgatagttggaaatatttaagtttcggtagctgttactgcacagccaaccgaaactcctgccggatgccacgcatgcgcctttgcgaagccatcgttcgcaaagccccgggttccaactcctgccggatgccacgcatacgcctttgcgaagtcatcgttggcaaagcccccgggttccaactgctcacgggtgccacgcatgtttcggtagctgttactgcacagccaaccgaaactcctgccggatgccacgcatgcgcctttgcgccggtagctgctagtgcacagccaatagagactcattccccgaatgccacgcatgcgcctttgcgaagccatcgttcgcaaagccccgggttccaactcctgccggatgccacgcatacgcctttgcgaagtcatcgttggcaaagcccccgggttccaactgctcacgggtgccacgcatgtttcggtagctgttactgcacagccaaccgaaactcctgccggatgccacgcatgcgcctttgcgccggtagctgctagtgcacagccaatagagactcatttcccgaatgccacgcatgcgcctttgcgaagccatcgttcgcaaagccc

SEQ ID NO: 39575 - DNA, 1572 bp, Heterodera glycines
  misc_feature (234)..(234): n is a, c, g, or t
  misc_feature (273)..(273): n is a, c, g, or t
  misc_feature (362)..(362): n is a, c, g, or t
  misc_feature (379)..(379): n is a, c, g, or t
aaaaaatttacaaattttttttaaccgcggaaaaattaataaaaaatttttaatttttatcaaaaaaaactgtttcccaggccacaaattttggggaaactggggcccagaaaaccgaatattagttacttggacaggggacccgggaggcccttaatttcccagcgtccgggaaaccccaaaaaaaaaaaaaataaaataaatgaaatttgtcacaaatcaaatgttttcttnacgttcagcaacccggggccaaaagcatttggattgtgnactggcaatcccacatgagcaaatggaatggaaaataacaatttttttaaattttattaaattataaagaataaaaataactcgatganaatttatttcagaattncataacaaaaggcaacaatatgcttataattatgttaaaaaataacaaaaattgacattttgattaaaaagcatattaacatcccttcaattcttgtccattttggatttatccaattttccaatcttgccagccaccttaaaattttaattttacttaatggatttattctcatttccgaaaagaaaatcttagaaagactttgatttattttttcttattcttataaaaaaattttccgtaatttgttaatacttattctctttttgccattttcattttttcgtgcctatttaaggtgcctttttcaaaaattttcatcccttaaatccgattactgttttttccgcaaaatatcaaatcatccacaaagtcggttgaccaattcccctaacaattgatcacagacagccgttttccctggcgacaattggtcgcggttagccttgtaaaatgcacgcaatttgtcaacctccaaattcaaaaaataattctaaatggggaaatttttctttaaaattgaaatgtttttgaaaaattatgccttaaaattgtcgagacgatagtgatcgatcatcaaaaaacggtcgatcaatggaatttcagggcaattgatcagatgcgcctcacagcgcgatttcagccaatccacttggaaatagtcggccaatttgagcagaatgagcacattttttgctaaattggaaataataaaaaatttagcgcttttttaattatttgtggtcctaaatttttccaatattatatccgagggttttcaaggtcactgctcaagaatatcatatccattcagtcattttgatattcgataaaaaaccgaataaaaaaaaaatttatttgctcggtggtttaaaataataattttataagaaatgtccggtgtcaatgttaaaaattaatcgaaatggatgatatccattttcataatcagaataagtttaataattgctgaaattatcaaataatgaatttacgatttggtaaaattggcttgtggatagctgtggttgagatggcctccacaaattccatgaactgctccatgtcgatgcccaactcgtccaaagtgagcgttcgctgctgcttttccttcatgtccacgctgagcattcgattgatcaccggcgaaacggaaagaagaaaatgcaaggacacatcgatctgaaaagttt

SEQ ID NO: 39576 - DNA, 499 bp, Heterodera glycines
  misc_feature (52)..(54): n is a, c, g, or t
  misc_feature (56)..(59): n is a, c, g, or t
  misc_feature (62)..(62): n is a, c, g, or t
  misc_feature (70)..(71): n is a, c, g, or t
  misc_feature (119)..(119): n is a, c, g, or t
  misc_feature (122)..(123): n is a, c, g, or t
  misc_feature (144)..(144): n is a, c, g, or t
ttcctcagaattgtttttttttaaatatattcaaacctataaaaagggcggnnngnnnnaanaaaaactnnaagaaaaacctttgaaaaaggaaacaacaaacaaaagaaggggaaaanagnnaaaagaaaagcgcaaaacgcnaagaaaaaacttttgagacagacacacaaaaagaaaggggcaattgaaaaaacaaaaaaaagcaagcggggagggggggggggggggggagttaagaaagaccccgataaaatgaagcacacttttttggaaaaaagcaatgaaaaccgtcaaattgaattagtatttgcattcaccaactacagttacggcatccaaataaacggccgtctcctggacggcagagaattcttcccgtaggaatggaggaagggcgactatatgaacagatctcaaaatttcaaatacgaggtaaaacataacacaaacaaatttgaatgtgaattggacggagcccgtcagttgggctcgcacg

SEQ ID NO: 39577 - DNA, 996 bp, Heterodera glycines
  misc_feature (851)..(851): n is a, c, g, or t
  misc_feature (871)..(871): n is a, c, g, or t
  misc_feature (947)..(947): n is a, c, g, or t
cacattttaggcatttgccaatgcttcatctcctgccaatttcattgccatcatttcgtttccgttgccttttgctgactcagttgtgccatttgcgctgaccaacgaattgactcgcgaacaattggcattgaaagtgattgacaatagccatcgttttctgtttgtccgttgtccaattgcgcgagacgaaagcaaatggacaaaatgggagaaggaagcgattggctggagaatttcttatctatggaacagaattgatattcaaattaattatgagcgtcaaatcggagatgggtaagtgaatgctttctcaaaatttatttaggtatttcatttttgtttttaggcttctcgatgaaattcccggcccaagtgatcagcagcagaagtgaatgaatgaattgttgagaagggatcgatcaatttgaattgcggcgttggataaagaatttgatgttcagaaaattgttctttttttgttgcggtgatcaatttgatctaattgaattatgtaattgccaaatgaatttgatgctattttgacctatgatcataaaaattctttactttttttgttgttggaattatcaacataataatctttgttaagccctaatttgtaaggttaatttagtgtttatttcattaaaaaattttccgtggcgtttatctgttaacgcagagcagaaatgttgccaatcaaaaagtggcacttttaccgatcaaaaagcaagcttccgttggtttatggtaccatcatacgcaattttcggcacttttgcagatttttggtattatttgatagcccaaagtgtcctttattagtctacaaacattccctaccaaanagtttaatatctcaaccacnagagtttcatcccgcagaaattcctaccgttggaaatgtttcgtttatttcttaaatctgtctcccgaactcgatntttatccctaactcattttttggatcgaaatgcgaaatggaggtttaat

SEQ ID NO: 39578 - DNA, 816 bp, Heterodera glycines
cagtccccccgaaccgatccgcacagattttggggagacggaatctttcgggaataacttccctatagcctggtactgtaattctgcgttggatttttgctcccccataattgttggagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggagtagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggagtagcttccctatagcctgtactttaattctgcgttggatttttgctccccataattgtttgagtaccccaaacggacacctgaaaaaatcgattttttttgttttcggggcagtccccccgaaccgatgcgcccagatttatggggagaccgaatccttcgggaatagcttccctatagcctgtactttaattctgcgttggatttttgctccccataaatgtttgagtaccccaaacggacacttgaaaaaatcgatttttttgttt

SEQ ID NO: 39579 - DNA, 1374 bp, Heterodera glycines
  misc_feature (1298)..(1298): n is a, c, g, or t
  misc_feature (1313)..(1313): n is a, c, g, or t
aaggatttttttttgtaaacctgaacacagataaattcacaaaaaccccgaaaaggcaaaaaaaagcataataaaagtcatcgtattctccccaaagcaagcggaaattcgtttttcgtgcttaccggagcgtattaagtgcgcaaattttttggtatttgtttaaaaatcccatccgtttgtgataaaaaatagagtatacttagcaaacattttatatggtagttaaataatgaaaatttcaaaaatttaaacataaaaaataaaaatccttaataaattttttcttttttagattttttgataaatatgagtatcgacttttcttttagattcgtaaatttttaattaattaatgttactaaaattgagtcaagttaaaaaggaaaaaatttacagatgataattaattttaatcaaaaatatttgcttacctgaatccaccattataataatttttttaaaatgaatggtgccacgaacgtacaccttcccccttaataggtgattggctggcagtcggatcctcggcggcaatggtggcggagctgatggcgctctatcggtggcgcactaaaaaaattttcttcacgcttcaaggaaattgattgattgggagttaatttatttttgaatttccaaactttgacttttttgaaaaaggactaaatacattagccattaagcgtaagtgaactatttcataaaatcaagacctcgtctatgcatttaaataaattgatttctcctgattgaattttgtaaacacaaaatgaaagaaattctcttacatagcgaattctttgtaacatatactcaggaaaacggtggtttgaaaagatttttttagcttccatttggataaattaaaaatctaaattaatatttaaattaaattcacaaatcgatcataaaataaaaataatgcataatgaaaaatgaataattatgaaattatttattaaagcagagatttaaatttttataaaccatgaagaattcatgtaaaccaaaaattaccaagttattaaatcggacttttgttagtaagcctcaatttcaactaatcaagatacttttaatgcatttgactctgaaatgtgtcagagaattattttacgaatcaagctgacatttttacaaagcatacctgcctcataaatattaagcacacaaaaaatttggaaaatagaagaaagaccccaaattaggcgttcataattataccttcaaaactttgaagccatgcaacaattttaattgggcaaaaaaatcctgaaaattttcctgtttaactnttttgtgctaatcanaaaagtcaattacaccacatgatcagagagcattcctcccagtgtctgaaaagcctaatct

SEQ ID NO: 39580 - DNA, 1529 bp, Heterodera glycines
gcccaacgattgcctgcataattggggaccaattcactcttaacgggacggagacaggtcggaaaaggagtggtcaaacttgcattttccaatctctggcccattacaggttttactttgagaaccccggcattttcgccgacgctcagacgacggaactgaaaaagacgaggtgagtcggccatgcgcagggggaggagatatcagcaacacccgcccccgtgggggggtggggatttggaaggaccgatcgtttcggctaagccaaaaaggcatttttgcagtctttcgcgcattctttgcgacaacggcgaccgcatcaccgaagtgccgtcccaggccttccttctccccttctctgctggcacttcctcttgtgcctcagtcgtccatttggacctttccaaatggcgagaacagtgaacaaatcaaaggaattacatttttatggcacattttcctctgtcatttgccatttcccccgttgcccaaaatttcagtcatttttttacagtcaaagtgatgacagatcgaactctcacttcatttgtcagctcacttttctgtcctccacaattcattcgctttttcttgtccatttattaattaattgccatgtccgtttttctctcactttttttctctgttttccttttcccaattcacttttcacttttcttctcccccctcccctctcttttcatttcccatttcttttcagttcttttacgggtctctcttctctctcctcgcctctctctctctcttccgcacttttttcaattaattacataaatttctcctcaaataatttgtaatgaaaaaatgtttttgtacaaatcagaaaattacgataaaattcgataatggttaaaactcagaagttcgaaaagcaaaaattcataacagattgcttttttggatgagagttttcgacgtttggctgaaaatttacactgtattggagttccaactactgtaaaagtgttaatggtatactgtaagtattagtaatattttgtggaaagtcaagctttaaactttacaaatgatttatttgctgtttttttttgcataattaaaaagcttttttcggtaaaaaaaatctgacaaagacaaaagtaaaaagtaaaaagcctattgtaataataacaataatttataatcactttcattaaatgttattttattattattattggcatgtcaaattcactgggcaattgaggcgacggacgccgcgccgctggggaaatggtggggcaagcaaattctgtcaagcacatcccgcggaatgtgttctcggagaatggcattttccgcctccaatcgaatcacctaaaggggaaaagcctaaaaagtgaacagagtcaaatcgaggaaatagccaagcgtaaagaaataacaaattgttattatttcggagtcgatgaagcaacaaatcgaaaaccccaaaaaacagaaaacgaaaagttttgtacttccgtaggaatattgatgtaggaaacatttaaatcttgaaaaaaaca

SEQ ID NO: 39581 - DNA, 1003 bp, Heterodera glycines
  misc_feature (977)..(977): n is a, c, g, or t
tcgaaaatatctcaaaatttcgtcaaactcactaattaaagcaaaaatctcgaaatgactaaatattttatttaaatatttttttggaattcatatttttttaaaattttagttttataccattttaacgtagctggcgcagtatgggagtggaggcttaactattaaatttttaaacatatttcaacagttgcacagacgtgacaggtttttatgcaaatggaaaaacccgaaaatgaaaagaaaaaaaaaagttaaaaaaccaattgaaaatggaaagaaaaaaactattgctagctaaattggtagtgaggtgttctgagcgacaatgtcgtgataaaggagaaccataccaatgaaagacagacaaaaatagccacaaaatttggacaccaggtattgcacggaattccgattttcgacatttttggggtcaaaattccgatttaggatttccggaaaatgtttgggcctcggaatgcctgccaacccgggtggacattagctacggatgagttcgatcaatgtaatgcgtaatgtattggtaagttggtaatttcgatattttaaagcctttttttgttgataaacccactctttaggctattcttatcatttctccgcaaaaacagaagttgatgggcgcaaaagcagccataatgtgtagcattagcatttcacaaaattaccatatgaacaaaatttttttattttttttgtatggtgttatatttttgggggtttttgattgattttgtaaatttttagttgtgtttggaagaaatgggtttttttgaataaatttacaaattttttgagaatcttcaagccctaatatttttgaaaaataattggtccgctattcgctggtatgagcaaaaaaaaaaaaggtcgttcgggcgaaagtttttcaaaaatacacccctaagaatcgggcgaagaattttcaaaaatacacccctaagaattgatttggngaatacgtaccccccccccccccccc

SEQ ID NO: 39582 - DNA, 835 bp, Heterodera glycines
  misc_feature (12)..(12): n is a, c, g, or t
atctcgtcgccnggttgcaaaaatgctactgccagcggcccagtagcttttgttgctgtttttgttgttggacattttcaaaatgagatatgagtaaaatttaaaaatataataagtacatagtgtagtgatgcagtcatacatttgaacttacgccaaatgatgctcatttgcctcctaccaattattgatttattcctctgacctcatttattcattcatccccattttgcccttaacaaataggtagttcatcttttactttttttgtgtcaattggacatcgcaacaataagttaatttataaattttaagagatataaacaaattaacagacgcaaaatttaaatttgtttttttggccttttgaactaaattttagcagttaggtacttcaaaaatttccctgttcataacaaaataattatttggcgctatgttttaattttcaaaattacaaaaatatttcgtaatacaccgaaaaaatgatgatatcccagtccgcaatcccgcattttttggaaaatgcgggatttgcgggattaatcccgcgggatccggtcccgcaaagaattttgaattccaatcccgcagctggatccgcaaatttgactttttgtgaaaatagtcaaatttatggaccattaacagattttgttcccgatctctttttaccgtctgctccattcgaaaaatcttcatcgacccttttaatgcatcccgccagtccctaaaaatttctttttcaaaacgtcaggtattttttcttttttggaaattatttggaatttaattgaaattttttcaaaatttccataatttcgcaatcccgcac

SEQ ID NO: 39583 - DNA, 1077 bp, Heterodera glycines
gttttttctaaaaaagttttaccaatatgaaaaactctgaaattttgcagggtgataggaatcattttaaagtattttcatgcaaaatttccagcaattctggtgatcctgaaccaaattaccaaaatcaacttgagcaaaattgaagtttttagtcactaaaattcacatccctaataattatatattttgtaaaattctgatcatgaatcatgattaggtctgtaacgtacgatgaaacagccgcacaagacggacgccagaaaggttcgcaacggcaacacgttgtttaaccagttcaattgcggcatggaaacgcaacatcttaataaatttcttatttatttgataaagacgaaattttacaatgcacaagtaaaattggcaacataaaacttacttcagcggagattggctcctgctgttccattttaatgcaaataaattgtagaaaatagcaaaaagtgacgaaaactccttaaataattaatgggaaaatagaaaaaatcatgaatatgtgtaaaaaatagacaggaatttaagtgcctggctttgggctcgggcttagattctgattttcgaaaatttaacgttcctggatcgggtggtccagtaaaatcccgtaaggtgcccgtgcctgtccattctctaatgaatatattacgacaaaaaatgaaaatgttcaattatttattgctcgttgcttagaacgaagttatgccagcagcgttttgagaaagatataaaattctataatttgctgtaaaaaggttttattatatcaatttccagaatatttttttactcattcaaaaagttattctacaagcaatttatttaaaatcattttttaattaaaattaacaaaggggtttttgaatctattaaaacggtgaaggttcagttcggcgtgccgattaattgtaaaaatttaaaaattttggacatttttcttgagatggaccaaataaggtaaacaaaagtatgaccagcagacccggatttctgaaatcagaaccgtttgataagcctcgaaagcggtgctattagcagaaccttggctgatggagggtaaaa

SEQ ID NO: 39584 - DNA, 1540 bp, Heterodera glycines
ataattggccgtcgtcgtgcaaccgactaatcagcgcaaaatttccctgaaattgttgttgcagcatatttaataggaaaatttaaaatttttatttccgaaaaattcggaggaagctaaattcaaactaataacaagttttgttttttgctgtgaatttgaaatgcagttttttaatcgaaaaaataagtgccaaattctccaagaatacgtaatccattgaatttcatgtttggatggacaatttcgaacaaatctgacaaatgggtaagtaagtctgaccagcgaatcgtcctggtgccgtgccaaatgcacgtagaagcggtggatgccggactgagtgggcacagccaaaagcagcaacttgcggcgcacaatgcacagttgggtgcccgggatcagcttaacgaagggaaaaggtgttcgcaattggacccaaatttaggcgcttttccgtttttgtagctctcccggccaccatctataaaattatacttttttctttcaaccattggagggattctttttttgaatccaacttgaattgtgttcgaactttgaatattgagtcaatttcctggctcaattaaatagaaaaatgcattaaaaatatcgaaccagtgattgtgaaaaattaatgcatagcgacgcgtcaatcaaatcgcggtcaacagagtattcattgaggaataaattcgctccttcggcacgccttaaaaattgacattttgagtattgatgaaagagaattctattagtaagacaatcggtcaaaaattagtttaaaaaattggaaatttaaccccaaggacatagtggttttggcacaaaaagatttagtcggttggccagtgtgaaaatgcatgccataaaatgaagcgactctgaagaccgccatcactgcttgaaaatgagccggcggatggcggaatttcggcggtggtcaacgaacggacaggggtatctgaaaaaggtaaacaaaccaatttggagaaaggaaaagcacactgttcacctgaactaattttgataatgcgcgagtgtcgtgtcggtccaaaataggaattgctaaatgccaattcggtaccacaaaacaaatccatttttggctgttttgtcggcaataacctgtcaagaaccaaagactgagtagtgacaccgaaaatgtttgttgcaattcagtattaagtatttcataccaatactttcaagatttgttcaagcgctcaagtaaaactgtactatacccgattttatgtaggtcaaaggcgtatacaaccaaaaaataggttattaaaaattaaaaaaccgccaagataatgaacaaaacagaacgccaaatacgagaagaaaacttcaaaaaattaattttctaaaaaataaaattttttggaattttcttttatcaaaaatattgaattttatgcttctagaagaaattatagttaaatttgcaaaattattttacggtcggtgtaaactgcaataaatttactgagagacacattaaacagtttacccaaaaaaaaaacaaaagcat

SEQ ID NO: 39585 - DNA, 1498 bp, Heterodera glycines
  misc_feature (703)..(703): n is a, c, g, or t
cacaagcaatgcaatctgagcaccagccaacatttacggcacaagcaatgccatttgagtaccaaacacaagcaatggcacctgagcaccagccaacatttacggcacaagcaatgccatttgagtaccaaacacaagcaatggcacctgagcaccagccaacatttacggcacaagcaatgccatttgagcatcagccaacatttacggcagaagcaattccatttaagcaactgacacaaacaatgcaatctgagcaccagccaacatttacggcacaagcaatgccatttgagcatcagccaacatttacggcagaagcaattccatttaagcaactgacacaaacaatacaatctgagcaccagccaacaacatttacggcacaagcaatgccatttgagcatcagccaacatttacggcacaagcaatgccatttgagcatcagccaacatttacggcagaagcaattccatttaagcaactgacacaaacaatacaatctgagcaccagccaacaacatttacggcacaagcaatgccatttgagcgccagacacaagtaatgccatctgagcaccagccaatatttacggcagaatcaattccatttgagcaccagccaacatttgcagcagaagcagtgccatttgagcaccaaacacaaggagggcaaactgagtaccaaaatcaaccaacatntacggcacaaacaatgccatttgagcaccgaactcaaacaacttttatcaagcaagcaaatcttattaggtaccaatcacaaccagccgaaaattgcaactcaagttcgcctccgccagttttctggcattatgaaactgacaatgatcttaatgggatttttgccccataaaatgacgtttatgaaaaattccgaaagatttaaataaatatttacgaaaacaccaaaatatttacaaaaaattctttattatttataaatatggttataaatagagtgctcagttttcagcacaaaaaatcaccgattaagcactgtaaacagcaccagattttttcaaaataagcatgaaaaagcacaaaaaaggcaaaatcagcacaaaaaattggaaaaaagcataaaaattaagagattaaatgcaccaaaaattgaaaagtcgtcaaaaaaacgtttatttgctccctgactataaaaaacctccaaaataggtgctaaaaatggtaatgagatacataattttaaaaaatcaaaatcttgtcaaaaaaataaattaaataaattttggagatgaattattttgataaagtttttcatttcttggggtgtattctgaaatctttcggatcgattcttaggggtgtatttttcgtttttattgcatttttattaataaattttttgaaaattgctgaaaatattttaaaaagttcctcaaaatgacgaaacagcacaaaaaaagcaccaaaatgccaaatcagcacaaaaatcgagaaatcagcaaaaatcagcatgaa

SEQ ID NO: 39586 - DNA, 956 bp, Heterodera glycines
ttgtgccaattaactaaatagctaattttgatgatttaaattaaatggaaatatataccatttttaaaatttttttggctttcattcatttaaatttgattttatatttattgacattttatcggtgtaagccaatgaaagagaaaaaagaatccctatttttatttgtcgtttgaaatttttcttctcgacaatatctctcatccggaaattataatcgtcagtgggaatatttaccattttttaaaatttatttgcaatttcctatttatttaaatttgatttaatgtttattggcattttatcattgtaggctaatgaaagagattaaagaaattgtcgtttggaatttttcttcttgacagtatctctcctttggcaattacaagcgtcattggtcataatcaattgttatttctgtgatttaaaaatttaattattttaagttaaatactgcctttgtatgagtatctattattttttcattttaaatttatttagtaaatttaatttagtttattcgcattatcggagatataaggttgagaatacagtttttcgtattgaaaaaataatttaaacaaatttatttaaataaaaattcaaaaaatgaaaaaaaatttgagaattttcaaagttcttcctaattttggtctttagggatgtattttttgtacttgtggtgcacttcccgaattttttgttgaaaatgtcgaaatatggaggaaatttaaaagatgaatataaatatggaaaaatactgaaaaaacgaatcatagagcttcgatcaagttaaaatactttttactagggtagcacggtaccgatacttttgacgaaaaccggtaccgatactagccggtactggaaaacccgagaccggtaccggtacttaggttttcaaccgataccgataccggtaaccggtactaaccggtacttttttgaggtaaaaa

SEQ ID NO: 39587 - DNA, 429 bp, Heterodera glycines
ctgttatttgccataatcccttcttcccccccccccaccttcttaaaacgttcgtccttaactttgcctttctctctccttttctccaacttggcatttggcaattttccctttcccaaattttgccaaattttggcttttcattctgctcttccaacgcccagcccctcccttcctattccgttttttgcttatgcgaccatcgaacatttcacgcgtctctcccccccccccccctccttccagcattttatgtcattgatgtgtctcggctgtccattttggcactccatttcaattttccaatttagttttgtgtttgtgtttatcctaacccttcgtccaaactgctgctgctcctggtgaaaagcaaagtttgcccaatttggccattcctcaaacaatccctccctcctcccctcctccccc

SEQ ID NO: 39588 - DNA, 922 bp, Heterodera glycines
attataagtagaaaccggatttttaggtgctaaaaatcctgaaataggtactaaaataagtgccaaaaaagtgcaaaatagatgttaaaaacgcccaaaatgccaaaataggtgataaaaactggaaaaattcagtgtttttaagcacaaaaaattcaaaaagtgactaatttttttccgacctcacaattgcaactggtcaaaaaaataataaataaattttgaagacgaattttgtaaaaatttacttttttagggatatatttttgaaattttggtcaatttttaaaagtgtattttctcagaaatctttggaatcgattcttaggggtgtattaggtaaaaaagataaaaatccggactctaattataagcattttcagataagatgaatgagaattttaagaatagagctaaaaaaatccagtttaagccggcaacacaagggcctatttaaattgggtcaatctcagttttaatatgtcaaaagaagattttagactaataaaaatccatataataagtagggctccaatttttaggcaaaaggctatttttttcctgagctccccgtggcctgaaatgtacgaaaaacatgttcgtttgggctgttgttaagctacttttcgagttattagtgcctattttctaggcttttatttttagcgcctaaaaagcctaagaaattttgcaagagcctatttttgccttttttggcgttttgccgaaaatttgttaacaaaaatgcattaaaacaaaaaaatacacccctaagatcgattttttaggaattttaaaaatacacccctaagcagagattcaaaaatttctgaaaataaatcccctaagaaatgaaaattttctcaaaaatcgtctttaaaaatttttttggacaattttttgaatttaaaaaataatgtaa

SEQ ID NO: 39589 - DNA, 1821 bp, Heterodera glycines
  misc_feature (1666)..(1666): n is a, c, g, or t
  misc_feature (1680)..(1680): n is a, c, g, or t
  misc_feature (1692)..(1692): n is a, c, g, or t
  misc_feature (1716)..(1716): n is a, c, g, or t
  misc_feature (1767)..(1767): n is a, c, g, or t
  misc_feature (1773)..(1773): n is a, c, g, or t
  misc_feature (1776)..(1776): n is a, c, g, or t
  misc_feature (1783)..(1783): n is a, c, g, or t
aaaatgaaaaaaataaaaaatctaaaatataaaaatacaaattttataaaaagaaatccaattgggagataaattaaatttaatttaaattaatatctcataattaaagtaccgtatggtagctcaaagtgacagtcaacgcacacggaatggcccgttgagcgtacggtacccaccgtctcgccgttcagtgtttgaaattcttgatcaactgaaatgagttaaatatttattacctaaattaattaataattaagtaaaacacatatttttaactttaaaaatgttttaaaaacaatcatttcatcttttttaattttaaaattttttgtacgaataatttttacttcgtatttattatttttttaaaacaaaaattattttttacttcattgctttaacacatgcaactaattattttactctttttattgcataaattaattaattcgcctgtttataattatgttaattattcgcccataatgttattattattattattattattcaaattaattattttccctttttttataattaaattattaattttcccatttatttttaatatttatggcatttttttcttgccctggagccatcggccgggccccgcctcttgggcatagccaatctgacgaagtggcaagaagtgaacaccgagcagtttgtcccacaacacgcccttgttccacagctcaagtaccaggccctggtccagctgatcagtttcactgaaatggcaaacaaaaatgatcagagtgatcagagctaacacaacaaatccaataggatttggcaaatttggtgccattaattcttggggaacctttgcccaatcccggcacaacgttcgacccgagtcggggtcaaatgccgggccgaaaatatccccgaaaatggtgccaaaacaggcggagtgatgaatgtataaaattaaaatttgaaaaaattattatcaaaaaaactaaatgaaaaattaattgcatgcctaatgaggcaattataataattatgcacataactcattgaataatttattataaacgtttaaatgggaaaaaaaaatttgtgagtaaagtaaaataaaatcagaggtgccatactaggccggtccgtcaggacggcatatgtcagtggcgggcactttgtgccaaataattcctttttaaattaacggcagaattttaattcactctatattaagttaatttttgttcaattcacatacattgaaataaattaagcaataaaaaatgaaataaatggatggatgagtcatcagagtaaattttttgatataaaattaaattaaaaataaattcaattttaataaattttatttattttatttatattctcttacaacacaaattcctgctcccattgcggctgattgcctttgacagcgattgttgttgacttcacattttgtaattttaacgtcacataggcatggaaatcttctggaaaagaattttagaaaatttaattttggcatttttaatttttttttaataatttaatttatttaaattatttaatttgctaaccgattgtgccttgaagacgagcctttttcactgaataattaaataatttttatttatttgcgtttcattttatttattttatcaaattattattattataattattattncataattgtttaanaaaattaataanattttttaattaatttttgattantttatttattttatcaaattattattttatgatatattattatttcataantattantanttttttnattaatctaaataattttcgatttatttatttaatttt

SEQ ID NO: 39590 - DNA, 1371 bp, Heterodera glycines
cacttttgcgtttttttatcggcaaacgctccaatgaaaaaggcccctcaaagagaaacaaaacaaaattaattctatgctaattgtatgttttaatgaaccaacaaaacccctttctcttcgggagaggcgatgtgaaaggaattcgaaaaggaaacggacgaagagcgaaggacggagaaaggcctaacggaaaaggaggagggagaaggacacattcaaattaattaatgaatggtgactcacttaaaacgcgccttcacacgacagtcattcaagggaattgccagcgaattgcgcagtgcgaaaatgagagaaaagggcgaacgattggacgaacaaaggacgaaaggtgcggaggcgaagggcgaacgacggacatggacaacggacaggggaaggggcgcggaatttgggtccaccgacggcagagaggaccaaacggatggccaaggcataaaaatggcactaaagcaaaggaaaatgaacaaaaacggcattttggcatccaatcatcgctcactttggcttctgttccgtctcttccgctgcttttcgttcccgcgtcaattcactgattttcgagtgccatcgtccaatttcgattttattattctccgactgatcgatcattgaaagaaaggccaaacagcagccaaaaagactgaatttgaaggaaattaagccttgaacacagcggcccaattttgggctcccagtacaattatgcttattttttacttagtaatcagaacgccaaaactttgcaaaacttaaaaattttatggggattttcccttgtaaaaatagaagagccgatctcgagttaaaaacttaagtttcacaaaataaacttggaatcgttagagggggtcaaaatatgggcctatgcaaaattttaagaaaattggtcaataggaaaatttttttttcaagggcaaagttttttctttttctcttattttgacgcactatttccatgtctctaacatataaaataacacatggttcatttttttgctaataaactattttttaaatttttatttaactttgaaatattcttcagaattttctcttcaaaatgagcacaaaatggttttgtttggtctattattgaaaaagttataagctaaaaaaattcataaaatcaagggtaaaatatagtgtgtaccttttactgtttgtatttgttcttttggcgttctgtatttattattattttatttatttgctttaaaaaattgaaatttatacacaaacacaaggaggaattgaacttgagagcccctttttggtgactaactcacagaccactaagacgaaaaatccagcataattgtacatggagcccaaaattgggccgctgtg

SEQ ID NO: 39591 - DNA, 1586 bp, Heterodera glycines
  misc_feature (797)..(797): n is a, c, g, or t
  misc_feature (800)..(800): n is a, c, g, or t
  misc_feature (817)..(817): n is a, c, g, or t
  misc_feature (824)..(824): n is a, c, g, or t
  misc_feature (843)..(843): n is a, c, g, or t
  misc_feature (850)..(850): n is a, c, g, or t
ttaatgttctgcatagaataaaaaataatgtatatttttttctattatatttttgttggcggatttacgaaacgccctgccggatttacgaaacgcccatagtggcggaatttacgaaacgaatcagcacgttattttagatgtaaaggtttatagatttttaaaataactatcgttaaagtaaattatgagtagagttattgtcttttttattttaatattttaatcatgtttaaaaattcttaaacttttaaggttttttagaagaatctttatgtttaataaataatttgtaatattatttaaattataaaattgtttaatgttatataatatgaaaatcaaaaatgaaaaaattaattattttactattaaaataatcaaagatttaatgaattgataaagctgaacattattgtaggtcatttagtattaaaaaaaattgcttaaaatcaatattttttgtattatgttaccaatttattatttaaaagcaaaatattttttgaataagtcagaataaactgttaaataatgttaaatttaattcgttttatgtatttagctttcaaaatccgaaatttaatttaatatattgattatttattattttcatattataaagaattattaaactctttatattgcatcattagtttttgtaatagtttatctgttctaaaaatattttttgtggctgtgccaaatttagtttttttttaaattatatacatttttattttttaatttataatttaatatctatttttcccatttataataaaaggaaatcattntanctaaatgatctaagatntcatgtntagccataaataattattnataactnttaaattaaaaaaatatttgctgtaaactaaaatattatacggttaagtcttttatgcttgttaataaatccaatcaattacttttttatttatttcagttgcattttattatcagctttatcgtgttctacttctttttgaatatccgtgataaatataaaacttttaaaaattaatcctaataaaaaagcattcatttaaaattatttatttgtgttttgctatttttaatatttattttttatttttaataatttatctatatattaaaaatttttgcttctatgcccgattatttcatgttatcgaaagaactgtgtatatattaaataaaaaataagtaatttaaaataaatcattaaaaattacggcaataaagtgtatttaataaatattaaacttattatttaattgcacgggaactttttccgcaccttgttgctattagatttaacttcgattttcttttaactttaattttttgcgtaatttctcgaattaaaatttttttattgtgtgcttaaaaagtaatatttaaatataataataatgtttttaagtaatttgctagtgcttttttataaatttgattaattatttgtctaaaatttagttctattataaataacaacatatttattctatttgaaaatattcagttgatttattcacttaatcatatcttaatttaatatattgtcttatctgctgcaatatttgataaaatttatgcat

SEQ ID NO: 39592 - DNA, 663 bp, Heterodera glycines
ttcttaggggtgtaaaagtcgcatttcgcgccaaaaagcgaaatgcgaaaagcgaaacgccaaaaaatgcgaataatgcgaaatgcgaaacctaggcacatccctgctaaaggattgtctgtatttaaagcttttgttgatttgttgcattttaattataatttttatgattaatcttgttaaatctaataaaatacgcattaaaattgcatgaatgtgtaaattttggtgaaaatttacgattttcgactttttgttcgaatccgggtccggggttcgaaattggtcgaaatgaatgtcatattcgtgatcagcggccccgaaaaccacaggaaatgtattttcatgacttttttaaaaaattttcaaaaaggacaactttttaactagcgccgtaatgtctaaggtgtcgaaaatttgtttaaatattttttatataaaagaaagatttaaaaacggcttagaaatcctaaaattgttattttgagcaaaatccttcaacgaatggcaccctatttttgaattcatgccattctcatttttggtatactctctccacccccatggcgcataaagtagctcaataggttagactcgaatccaattagcgccgtggtgcactctttttttaagtggtgcgaaaattggggattcaatgaaaaa

SEQ ID NO: 39593 - DNA, 690 bp, Heterodera glycines
cccccccgaaatgaaaatttttaaaaattttccagcaaataatggaaatttttttcgaattcccccccccccctcccaaacgaaaattaaaaagtttaataggcaaatttcgtaacaagtagcactcaaatttccaaaaatgtttcccggcggcgcctatcggcaccgccggacctccattttccactatttttacaagttttttgccttaaaacggccaaaattgggtcatttttagtgaaaaagtgcagttgttacccagcagtggaaaaaaaagttattggttaaatagcaaaaaaaaaaggtcttcaggtcgggtaccccccccccccccccgaaaaatgtttctagatacgcccctggtgcccgtgccggatcgggacagtccatcaaatcgtccattttcacgtcgccccggcacagctcgtcaatttcttcggctggcacgcgatttctgaggtccaaaatattttttgtcaaaaaattaaaaccctaaactaaaccttagctcaaaaaagattaaaaatttttattcgaaacaaaatgcgtgcaaattcgaacagtggctaccgtatatttgtcctccagatggatcgcctaactgtcgccatccgacgagggtgatcatcggcaaaacggcaagaatgaagggaggaataaagcataatcaacattggatctcctcatttc

SEQ ID NO: 39594 - DNA, 930 bp, Heterodera glycines
tttgaggcatcgccgcgagcataaatttttgtgcaaaatggaaaggtgggaatgatggtgggattattaaattaccatatgtaaaaatgcgtaatcaactatttgcctaaatatacaagcaaaaaaataaccttatgagggggctgtccattctcatcccttctcggaaaattttccagaccctaagaattttccttcaaaagccctgatttcaagccattttggcattgcagatcacccaccatgaagggatgatctgactgatcaagtcagtgtaaaaacttacctccgggaaagaaaatttaacatttcttttaacccttttacaaaaaatccaattcttaccagtacatttttactcccgcatttggtgagaaaattggagatgagtcccggaaaaatcccacggaaagaacggtgcaaggcaaatttgcttgcgagagagagagagagagatatgtacagttactgtactgaaactataagagaaaacccagacgaaattcaaacttataaaaaggccggttataattctaattcagtgaatggtattatcttttaacagttttaacatcactgattgtgaacatggcgaagacgacatttcaaagttggcagaaaaactggcgaatgatcggattcagacggaaaggaatttgaaagtcgaagcggaattggcaaagaaagcagcgatttccgcgcagaatttgggtctgccggttgttgaacacataaacagatatatcgacgcaattaatcgtgcacaaaaggtgaaaaacggcaagataacatgctcgagtcctgtaaacagcggggggggggaagggcaactgaccgccggaacacccgattcgtcctccaccctcattcactcctccgattttgtttaagaatcttagtttttcgtttttgcaaatttttgtaaatttt

SEQ ID NO: 39595 - DNA, 785 bp, Heterodera glycines
aatggtaattgtatttttttttgtaaatattaattcgtttcaattttcaaaaaaggttgctttaacctcaccctcgtccccgcaaattctgcgctttggcatggcattcggcgaaatgaaccacgaatgggttggcaacgaatggttgccttcacttggtcttggcaaataccgtaccgagttcatggagtgtctggtgagggtcgcgtttgtatgggactcagaagcccaaatcggacccggtcatgtaaaattagggtactcaaatcccccggggacgacatctttttcaatcgtttttttgttgttgttttttactatcaatttttccgtttcaaggttgatgcgcgaatgttggaacatttgagcaaaagagacctcagcaaaatgaaaatgatcgacagttttcaccggtgggaaaagaatttgaatgaaaaagtcaaaaaatattatcctcggcttttcattattttgattggcttattttgatggttctttcaaggacaagcttacactacggcattgtgtgcctgaagaaattgaattatgatcggaagcaatggaagaacggcgaaacgcatcggaaaacgtcaacagaggtgaaaaagagggaattcaatgaaatgcaattaataattggcgatttgcaattagatctaatggtctgatcaaatgagcgggtcattaccaaaactattcgaattagcgaattccatcttttttcatgtgttagagacacgaaaatagtacgccaaaacgagaggaaaagaaatgcaaaaatttaa

SEQ ID NO: 39596 - DNA, 1005 bp, Heterodera glycines
acccgtattttttgtaccccgatcacattctgaaaaaaataattgatgcgctaaccctaagtctccccagttattctgcgcattgctttctccaacgcgagggcaaagccgcgaatttgtttcattttcctcctttttgtcttttttcatgccgatctcgaccctaactcagcaacgcgtgggcgtacagcagcggcgactgcagcattcaatgcagctcttcaaaagctgtccgaacatatttttctttcttttctaacgcatctccaagcggagttacacccatttttgtacccgtattttttgtaccccgatcacattctgaaaaaaataattgatgcgttaaccctaagtctccccagttattctgcgcattgctttctccaacgcgagggcaaagccgcgaatttgtttcattttcctcctttttgtcttttttcatgccgctctcgaccctaactcagcaacgggtgggcgtacagcagcggcgactgcagcattcaatgcagctcttcaaatgctgtccgaacatatttttctttcttttctaacgcatctccaagcggagttacacccatttttggacccgtattttttgtaccccgatcacattctgaaaaaaataattgatgcgctaaccctaagtctccccagttattctgcgcattgctttctccaacgcgagggcaaagccgcgaatttgtttcattttcctcctttttgtcttttttcatgccgatctcgaccctaactcagcaacgcgtgggcgtacagcagcggcaactgcagcattcaatgcagctcttcaaaagctgtccgaacatatttttctttcttttctaacgcatctccaagcggatttacacccatttttggacccgtattttttgtaccccgatcacattctgaaaaaaataattgatgcgctaaccctaagtctccccagttattctgcgcattgctttctccaacgcgagagcaaagccgcgaatttgtttcattttc

SEQ ID NO: 39597 - DNA, 1256 bp, Heterodera glycines
ttgcttttcctgctcttatacaaggccaaaaacttttaaatcgattttggttctcgactttttcttacgaattctggtcaggggttcaaaattggtcaaaatggatgccggatgagccgcttttcctcctaaagaaaaattggatattttcgttaaaaatgccttcgatttctcactgttcactgcaattacctatatttttatagaatctttcttaaaatatgtaaagtaatgtaaaaattttcagatcatctaattaattgaactttgtttcctcatttaatcaattgttgttgtgaaatggaggcaatggaagttgacagcaaagcatctggaggtggcgaaccgatgaataacaataacaacggttattactaataaataccccccatttatgtctgtccaattttgtcttttttagcgattgtactttaactaacaatttgggcaaaaatggaccctccgccctagccaaaatattattacataaatctgtttaatcctccacggttcttcactttaagccaattcgtcgtcaaatccgcgcaccgttctcgatgagagtggtggaccgaaaaagatgagccatgaactaagccgagagttcatcaaagacattgacgaatggatagcgcagttgtacgagtgcaagcagctcagcgagacacaagtgcgactgctctgtgacaaggttggccatttcaaatttggtcaatggaaaattgccgtaatgtcccgaaatgtaacaaaaattgcgttaccaaaatgccattttttgttgggttggagttgtttacagtgtagagcaactaacttttcttagagacaaccaaattaaacatactttgagatatggttcgatagtcctaaatcttttctattagaaatgaaaaattccaaaaaaaaacatttcgtaaaatttgccaatagtatcacatattttttgaattaatttttattttttaaaagctataaaacacactttttaggggggttttcggtcacaaatttgacatccgtttcataggattccaaatttcggacccgatttcgaacaaaaacacaggctaatagcgtatcttttttatcgttatcgtgtggtactcaaatgcatgtttacaatggttgtttcaacaaaaaagttacaaaatccttaaattgctattattccactctaaaatgattccagtttgtttcggttttgcaatgtttttacttgccccattgttgtgacttggatgtgttccacatggccg

SEQ ID NO: 39598 - DNA, 1023 bp, Heterodera glycines
  misc_feature (25)..(25): n is a, c, g, or t
  misc_feature (988)..(988): n is a, c, g, or t
aaaagagatagccattttctgcatnagagaataatttaaaattccctgtagaatagaatggccatgctctccgcgcccctctgcccatgctgggaacatttgtatggtacaaaatttctcgcaaaaaagagatagccatttttctggcatagagaataaatttaaaaattccctgtagaatagaatggccattgctctccgcgcccctctgcccatgctgggaacatttgtatggtacaaaatttctcgcaaaaaagagatagccatttttctggcatagagaataaatttaaaaattccctgtagaatagaatggccattgctctccgcgcccctctgcccatgctgggagcatttgtatggtacaaaatttctcgcaaaaaagagatagccatttttctggcatagagaataaatttaaaaattccctgtagaatagaatggccattgctctccgcgcccctctgcccatgctgggaacatttgtatggtacaaaatttctcgcaaaaaagagatagccatttttctggcatagagaataaatttaaaaattccctgtagaatagaatggccattgctctccgcgcccctctgcccatgctgggaacatttgtatggtacaaaatttctcgcaaaaaagagatagccatttttctggcatagagaataaatttaaaaattccctgtagaatagaatggccattgctctccgcgcccctctgcccatgctgggaacatttgtatggtacaaaatttctcgcaaaaaagagatagccatttttctggcatagagaataaatttaaaaattccctgtagaatagaatggccattgctctccgcgcccctctgcccatgctgggaacatttgtatggtacaaaatttctcgcaaaaaagagatagccatttttctggcatagagaataaattaaaaaattcctgtagaatagaatggccattgctctccgcgcccctctgcccatgctgngaacatttgtatggtacaaaaatttctcgcaaaaa

SEQ ID NO: 39599 - DNA, 412 bp, Heterodera glycines
tgcattttaggcaccggaacaaaaggaattgatcaatttaattgtgatgaaaagtatgctgcaaattgagcaaaaagtgcgccgaattcgctactcacagacgccgattccagaattattttacacacaatgtgatacatttgaatcaattttttcacgaaaattgaatttgattgaattgaccaacgaattttcggtaagcgaatccataaaaaaattgatgaatcctttgaattaagactaaaccgacccaagcagttccagcattatatcttgaaaaagtacgtcactttggacccttctgtatagggccagcacccgttctcatggatttgttatgtgtattcgaaattcgcaaaacatttccattctttgcgcagcttgacaacaatgacaaggtgcagaaaaataa

SEQ ID NO: 39600 - DNA, 1007 bp, Heterodera glycines
ggggggggggggtgctgactctgaacagtcggcgattttctccaatctcttaacacaaatttattcaatttcttctcgacaattaaatgaatacttctcgattccccccgcccgcggtgaatgtttctcaaaatgcttctcaatttgccagcgatgaacaaaattaaacaatttttattaaatttaacaatcattttcaataatttgatctcaaataaaaaaccgtcagaaatcatttttattattccgctttaattattgatgaggtggtgaattgaccatacattatacccataaatatgtaataaaagtctgcaataaacgagaaatgatgaactcttctcttgatcagtgatcagtctttctgatcagtttcgtcctctcttccttccgcctcccctttgtctttgtcctccgtccatccgtcgtcccttccgtcgcgtctcggccgaattggcaattcgtcccaatttggcctttgtccggacaatttgcgcaaccgctcgacatcgaagtgaattcggttcaaaaggctcacggagacttgatgacaagtgaccaaatgccgtttcatattgcctttgtacaaagtgacgaattgacaccagcggcactgataccttacaaaagagcaagggatttgtagaaacaactcattaaacgacaattaattacggattggaagggtccacggaggcaggcgaaaggcaaatgccgccgttgttttgctggtcgatcgccgcatcgttcactgaattggcaattttgttaagcctttggcattggctaatgtggcggcgaatgtcccctttgaggcgggggaaagagcgattgcctggcaattagtgaatgaattacgcaattagtaagcaaaaaaagacactcacagaacggacaaattgggttggtcaacggttgggggggagagggaacgctcggccgacttgatggcacagaattggcccagcggaacaatagaaagcgactgttttttaatgattaattgt

SEQ ID NO: 39601 - DNA, 1295 bp, Heterodera glycines
gcagctgcctcacgagccatgcttttggggtgcttccatacgttggagctgtggtataccgctcagtgctgcacatgttaaagcctgtgtatggctgctgcgtggcaatgtgtcggtggcgggctgcctcgcttggttggttcgctgcgccaatgtggggtgcacgctcgtggggcgacctaacggctgtgttggcgtctgtgcgtcgttgagcggttgttgtggcaggcacataacacactgactggggatggtggtttcgttcccggtcttacgtgccgtaactagcggtgtgtttgtgcttgctgctacgtccgtggccgtgatgagacgacgtggtagggcccgtgcttggcctagcacgtggcttaagactcaatgagtgtcagctcgggcaccgccagctttttcttttttttcattatttttttttacacttctgttgaagaatgaattctagtcttatcggtggatcactcggctcgtggatcgatgaagaacgcagccaactgcgataattagtgcgaactgcagaaaccttgaacacaaaacattcgaatgcacattgcgccattggagttacatccattggcacgcctggttcagggtcgttaccataaaatgcactgcttgtgcgttgcttcgtgggatcatgtacttgtacgtgttcttacgttacttgctcagctcggctgtggggttttggtgtgctggcgcgaacttgtggttctaattcgcgttttacggaccgtaactcaagcgcaccaatgctttgcatgctgtggcggagtgcctggattactggcattcctgctttgatttttcgacctgaactcagacgtgaacacccgctgaacttaagcatatcagtaagcggaggaaaagaaactaacgaggattcccgtagtaacggcgagtgaactgggaagagtccagcgctgaatcgcagctcctctggggttgcgaggtgtagcgtatagaccgtgagcttgggttggcccgcttgttcaagtttcccttgaccggggctccagagaaggtgcaagacctgtccaactggcggtgcctacccatctttacgtgtcttggagtcgggttgtttgggatcgcagcccaaatcaggtggtaaacttcatctaagactaaatacggccacgagtccgatagcgaacaagtaccgtgagggaaagttgcaaagcactttgaagagagagttaaagaggacgtgaaaccgatgaggtggaaacggacagagcagaagtatctggtctgcattcacccgtttgttctgtacg

SEQ ID NO: 39602 - DNA, 1033 bp, Heterodera glycines
tgtttgctccgataaataatccacatggattcaaattcatccaacgccaagaaaattattgtttctttttcaatgtgacaattttccattgtttctttattgtcctcaagcactttggcatatggattgttgagtctcagtgtttggcgctcgggcggaatgccaattctgcttttgattctttgtttcagtgtttgcaccgtgtttccattgttcatcttgatggtgtacggtttgccaccatgcaaaacgaaaatttcaaattcaaaagtcgaagcataaacgattccgagtcttccaatgccataatctttcattgttttgttgtcatcaagcgcaatgtcataatggctaccatgtctaattgtcagttgatgtgcataaatagtacgaatagagtgaaaactgtcaatctcttccgcgatcttgcgcttcaaagttgccacagtggcggtggcattcacgaaataaatgtagtagggcttcgatttccacttcacaacaccatatttatcaatttcctcctcctcatattccaccaaaatttcaaatccatccactaatacataaatatttgcctctgcctttatgccatgttgggccattgtttttttactgacctcttcatcaagcacatcacaatctgcttttcccattgtttcttcaattcttgttgctcgtgcgtcgcatcaagcagtactcgttcattaattttctctccaatggcactttccaaatcagcaagatcgaatttgtacaagttttgacgtgcggggtcaatgttcatcacaccttggaccttcttcttcaaaactgacacagtgtccgttcctttcacccaaacggcgtgttttttgcctatataccacacggcaatttcaaattcgtccaacgacaagaaaacgggttcattatgcgaaatttcaccagaacacggaatgccatatggttttttgcatctcaaggtttgtctttcgggtggaataccaatttattgtttgattttatactttaaatctgccacaagaataga

SEQ ID NO: 39603 - DNA, 1090 bp, Heterodera glycines
aaagaattgagccctttgaaaaaatcctgaacgaaatccgattggaattttttaaaatgaagacaattcgcttcaaacgaaccaaatcagtcaagcaatttccaaccgaagggtcaacgaaaacactgcacgaaattgatttattcagatgagagacgaatgatttgtccgaaggactcagtccaggcccagccagaaacttacgaacaatcttgaacgaatttacacagatttgaaaaatattatgcccttttcaagacccttttcgcatttgaaatgtcggttttattggcggcactgcgctcattaaaagtcacgatccctgccacaattgacccatagcatgccgacatgacaaaatgtgtggcattgtttacaggcaactgctgcagaatgatgtcacgcatttttgggaggcccaatttcagtgaaattgtctgcaaacatagttttcatgagtaaaaagtgcctatttctaccgtttttggcacaattttaatgaagccaaatgagttgccacgatcggtttgagttgccgctttttgtaaaaattgaccaaggggacggacatcgtcaaaatgcgcaagttggctgatcacactcaactgtaacaaaagcaaaacaaaatcttattatgattgtattaacaactttctgatcaaggcccaatattttggtgcgttctttcaaatcgtcaaaactttcaatttcaatgatttcttcgcgcatatttggcctgtcctgcactgtcaaatttttgtagtttttggccattttgttgacaaatccatgatcattcaaagtgacgaaattgtccgttgaaacatcgtaaagattggcgagaggcgccttcacctcggagagaagaaagcgaccgctaaatatccgataaaatggattttagagaaaaaaagaagcaacaacaaacatataagaatttaaaagacaattactttaaaatattgccttttaaaaaattattccatataccgtacttactgaattagtacctccatctgaattagaacccccctttcgaggggggttgaaaaatagaacccccgggggtactaattcagtaagtacggta

SEQ ID NO: 39604 - DNA, 1037 bp, Heterodera glycines
tttcacccgcactcaaaaggtcagtgttttttttttattaaaatatattatttcttggcttttggccatgccgtttgaaaaactgaacacggattcatttaaatttattaaaaaatattaaattagaaagtaaattataaatctatgtattaaaaataagtataataattgattacaggcattctacatatctttttcaatttccgaacgtgtccttgatttttataataaataaattaattatatattaaatatttttataaagatttttatttcatttattattcttctattcataaaaaattaaaatataatattaatattgtgtatttttaaatacaccttttatttaaaaaaatagaagctttatttacgaataattaaatgaaagttctcgccaaacggacgactaattttgcttcttaatcatcgacttgagttgtacaatattataatgattacattatcatcatattgcacgaaatcagtctatttaatgaattaaaacaaataacaaactggcaacagatcgactggttgatttacttattaatttattcaacattatattgcctaataaaattatcggatacctacaaatattatttttaataaatgtttaattcaaatttatttaatttaaccgttgtcttttttatataatcttcctttcgttttgtttatttttttataacaaatcaataatagccatttttgtttgttttcattatgtttttctgaaaaattcctacttcatgaaattatttttttttgtttttcttgcctttctgccgaatatgagatctcagtactacttgctgtttagacttttttgtttcagtattcagtatcaataaaattttcaactgtttagatttgggttcggatcccgtgggcgggggtgacttaccaaattttagagatttttggctaattttttaagaaaaaataggtttttggggggccggcggggccgataggccgcctggcgaattttgaaatttacgagtggagactaacagatgtttacaaaaaaa

SEQ ID NO: 39605 - DNA, 2342 bp, Heterodera glycines
  misc_feature (1909)..(1909): n is a, c, g, or t
  misc_feature (1935)..(1935): n is a, c, g, or t
  misc_feature (1944)..(1944): n is a, c, g, or t
  misc_feature (1967)..(1967): n is a, c, g, or t
  misc_feature (1986)..(1986): n is a, c, g, or t
  misc_feature (2039)..(2039): n is a, c, g, or t
aacatttgtagaaggaatgaattgccaatgttatggaaattaattgctacattgaaatataatagataaattatttgttctttttttcgcattaaccaattaataatgtttttgttgcgtaacatttgaattgacatcactgatttttattgacttgtctggataaatccaattaatcattgtttataaaaaaataaatttattttataaaagcgcatcctaattttatttgatttatataaaaatgaatgtctgtatcaaattaatatttaattaaaataaataaacattgaacctacagaatcatttgcaaatttatttcattttgaactcagataaaattgctgtggttctctttttcatctttatatttcttaaaattttagaatatttgaaaatgcatttttcgttgattcaaatgatgatgaccattttcacaaaatgtgccttaattatgggaatgttagaaaattcggaactaattgctgttggcaataaattagtaacaactgtggctcatgaaagccaaatgataccaacgctttctacaactttggtgccggtcaagatccgtgtaaaataccgtgaaagtggcgaaccagggcatgtctatgttacagtaggagattacggtaacaatcattagaatatgttaaatgctcctaaaattcagaatttgatatgacgcggtcaagtgctaggcgtagaaaattgtaagttttggcgcaattttattgtagaaatgtgaatttattcatatcccttcgaattaatgacctgaatacacacaaaaaaaacaactaaatttcggagtttggattggcatttcttgccatccgagtaaattacattttaaaacggatatatttttttataacgagcttagaaaatggactatattactagatagggaatgaaatattttgaaaatattgatttaatacttccgttgacattttttttaccaattatgcccaaaaaattaaaatattgaaaaataatttatttaattcatttttaaaaaaatgtttaagtccaattttatccgttttcccttgaccattccttaaataaaaagaaaagaaaaaggaaaaaccttccaaggccggggattttttttgagaccaaaaaacgaaaaaaagtttttttaaaaaaaacaaaggttttggtttgaaaatccttccaccccaacccaacccaatttttttggaattttgggtttcattttttggaaaaggaatttttggaggcgggaaaacccccccccaaaaaaaaaaaaaaaaaaaattttttttttttttttttttttttttatatatattaaaaaaaaaaaaaataaaaaaacacctccggggggggggggccccacgggggggggggggggaggaaaaaaaaaaaaaaaaaaataaaattattttttttttttttttttttttcccccaacaaaaaatttttggggggaaaaaaaaaaaaaaaaataaaaaaaaatttttggggaaaacccaaattattaattattttttttttttttttaaaaagtgccccgtttttcccccgggggaaggggggatttttaagaaaaaagggggagaaccctttttaaaaattttttaaaagggaaaaaaaatggcccaaaaattttttctttttttttttaaaagaaaatttttttcgcaaaattttagggttttcaaaaagttttttttattcaggggaatgggggcgcccccgttattaaaaatttatttcgtcagaaattttttttgtgggggggttattgggccaaaaatccttgtttaaattgattttgtcaggtgaaaatttttgtcgagaaaaattttaaaaaatttatgtaaaaatttttcttgactaaaatcaaagaaatttaaaaataaaattgacgaatttnaagtttttgataaagcataaaatganatataaaanttaatttgaatattattaatatntaaaacaaatatgtacatnttctgtggttattgttgttggtgtcttgttgatcgattgctgaaaaagcaatntaatattatttttccaattaagttttatttacaaccaaatgttgatcggaatgatggtgctctattaagggttgatgccgcttaaaataatgaaattaaaattcaaaaacaaaaataaaaatattatatattaataattgtgccagattttccgaatattcgtttatttaaaaatattttaatgacaacaaatttataataaaaaaaatttgttcaaaaatattgatcagctttattaattttgcaaaaatggaagtaatgtatccgttacaaatgtccaagacttttaattatcattaatta

SEQ ID NO: 39606 - DNA, 1255 bp, Heterodera glycines
  misc_feature (1169)..(1169): n is a, c, g, or t
  misc_feature (1184)..(1185): n is a, c, g, or t
  misc_feature (1235)..(1235): n is a, c, g, or t
  misc_feature (1248)..(1248): n is a, c, g, or t
gagctcgcattttgaggcatatgcctttttttctacgccctagtttcgatatattaagcgtaaaaaagcatttttccacttggtttgaggcttctacgttgacttttattatgcctttttttgcctctttcgggattttcgtgccttaaatgcattttttggcattttttttcaaatattgatcgacaaaatttgatatatatatatatatatatatatatttttgataaaaattttaggtgtaaaacttttcttattcgaaaaagcaatattaataatcatttaaatgaccaaaaatgaattttttgattaagttttacgtgttttgctccctataaatccttaataaaaaaattttaaatgcctattttcatgcctttttcgtgattttcgtgccttttaatgcctttttttcaaatttttggtgcctattatagtgcctttttcgcatttttggtgactttttagtcgtgctctacttattattgtatttaactcacaattatccaaattattattacagtcgattgtgtgcccattcgctcatatcttttggccaaaaaggttgaacggattcgttcaaatgcaattgcaaaatgaaaacatgggtaagcgatggagtacaattttggcggtcccaaaaacatcgggaccatccaaacagggctcagaaagtcacaaggatgtttatacgtgaacatttgaatctgaataagcatttaaaaattaaaattatttttaaaatccctgcatttttaatttgcattcatttaaatttttaaaaaagctttgggattacccgatatcgtaaaaagaagacaatccaaaccagtgaattaataatgtaaagaatgatggtgttgacaagtagaagcttaaaaaataattatgtatttaaatattcaaaaatttgggttaaaaacaatttttcatgaaaaatttcaaacatttttttttgcatctttcgatagccattaatgttaatctttcattgctttttcaaaaaaatttgatcttgtttcaaaaaagataaagacgaaattttttttaacaatttttgtcatcttttttttgaaacatgagaaaattgacgatttttttgtcgaataacagtacgagttcgtttttaccgtataatccatagaaataaaagaaactttcacctttanattcttatgaattgnngatgcatttttgttgtatttgtggatcaatgaacaaatttgcattagcancacgccaagcaanaaacagt

SEQ ID NO: 39607 - DNA, 502 bp, Heterodera glycines
gtttaggattgaattagaacaaaataaatgttatattcggaatctacgcatcaaaaaacccgagactcatttacgatttggcaaattatgtcgtttgtcgtttgaataagccattttttcgtttgtcgtttgtctctgtcgtgtgaattgtctccaatcacaattgacataatctaccgtaaattggtcgtttgtcaccaaaataaagttgttttggctttgaaaaataatcttcaatacggcaagtgggccggcatttcggaaaatgatcgacaactgctggattgaagttgctgaagaatacgccgaattggggcactttcgatttaaggacaaaacagtgaagcaattgagaggggatatttggcaaaaaaagaaggaagcggcattaaaaaatatgatttttcacaaaagacaggcacgggagcaacaaaatttgaagaggtcttgaccgaagcaaactaatttaaactaggcatttaagtgggagctcgtaattttg

SEQ ID NO: 39608 - DNA, 1005 bp, Heterodera glycines
aaaaatggctatctcttttttgttatccaaattgcgcattaggtattttcatacagtgcgtagcacaggttgcctttcttatccggccaaacgaagcattagtagggtgttggacacagacagaaaaatcgtaacgtgcccaaagatagctatctcttttttgtatccaaattgcgcattaggtatttcatacagtgcgtagcacaggttgccttttcttatccggccaaacgaagcattagtagggtgttggacacagacagaaaaatcgtaacgtgcccaaaaatggctatctcttttttgtatccaaattgcgcattaggtatttcatacagtgcgtagcacaggttgccttttcttatccggccaaacgaagcattagtagggtgttggacaccgacagaaaaatcgtaacgtgcccaaaaatggctatctcttttttgtatccaaattgcgcattaggtatttcatacagtgcgtagcacaggttgccttttcttatccggccaaacgaagcattagtagggtgttggacacagacagaaaaatcgtaacgtgcccaaaaatggctatctcttttttgtatccaaattgcgcattaggtatttcatacagtgcgtagcacaggttgccttttcttatccggccaaacgaagcattagtagggtgttggacacagacagaaaaatcgtaacgtgcccaaaaatggctatctcttttttgtatccaaattgcgcattaggtatttcatacagtgcgtagcacaggttgccttttcttatccggccaaacgaaatccaaattgcgcattaggtatttcatacagtgcgtagcacaggttgccttttcttatccggccaaacgaagcattagtagggtgttggacaccgacagaaaaatcgtaacgtgcccaaagatagctatctcttttttgtatccaaattgcgcattaggtatttcatacagtgcgtagcaccaggttgccttttcttatccggccaaacg

SEQ ID NO: 39609 - DNA, 924 bp, Heterodera glycines
aaaatggctatctctttttttgataaattttatacacatacaaatgctctcgagcatgatagggagggcggtgcgcaatagaccttttatttttgagggaatttttaaatttatactctatcccagaaaaatggctatctctttttttgagaaattttatacctcacaaaagcgcttgcgtatgagacggagggctgtgcacaatcgccattttatttcacagaggatttttatatttagaggttatcccagaaaaatggctatctctttttttgataaattttatacacatacaaatgctctcgagcatgatagggagggcggtgcgcaatataccttttatttttgagggaatttttaaatttatactctatcccagaaaaatggctatctctttttttgataaattttatacacatacaaatgctctcgagcatgatagggagggcggtgcgcaatagaccttttatttttgagggaatttttaaatttatactctatcccagaaaaatggctatctctttttttgagaaattttatacctcacaaaagcgcttgcgtatgagacggagggctgtgcacaatcgccattttatttcacagaggatttttatatttagacgttatcccagaaaaatggctatctctttttttgataaattttatacacatacaaatgctctcgagcatgatagggagggcggtgcgcaatttaccttttatttttgagggaatttttaaatttatactctatcccagaaaaatggctatctctttttttgagaaattttatacctcacaaaagcgcttgcgtatgagacggagggctgtgcacaatcgccaaggatttcacagaggatttttatatttagaggttatcctaaaaaaatggctatctctttttttgataaattttatacacat

SEQ ID NO: 39610 - DNA, 943 bp, Heterodera glycines
tcaggcctaggtagcgaagctccgaaagcgcgaagcgctttttcccagctaaatagccgacggttcacgcacccgctagtttactatatatgttatattgacaaggaagtttcgtttgcaaaaacaaaatctcccggccgaaggccgggagcgccctgaaagtagtggaagggtcttacaactttttgaggagaatccgggaaaactatagaaaaaaatttagcgcggacgactgagtcccagggacggatttctcattttttcgtgcatttgggggcccgtaactttttttctaaaacccaaatcaaaaaatgtctgctgtgagggggctaagttgaagtgttttctaaaaaaaaaaaaaattccaagcctctatctgcaataggaaaggctgtaggttcgtggactttttcagtaccaactttgtccagttcagtcccggttgaataactcattagggtttgatctgggcggggagttaccagcagacttattgtagagttcaatgagctggatttttccagtttttaaaatttcgaaaattttcaaaatttttcgagctaggcctaaaaaacggttttcgggtttttgaattttaggaatttttaacgaattttcccagagaaacgaagaccacttccaaaacatagtttttcgagctctatcgattggtaatttttttggaaaattttcgattttttcccggaaatagaaaaaaattttggcctgagcgggacatttgagtcccgggcctataactcgtcaggggttgattttagcgaaaaattgacttaggacatttttgtagagcattttaaatgctatcgaatggtgtgccatatagccggaaattttcaaaatttttcgagctaggccccctagaaattttcggaaattttttttcggacgaaaatgggggtgaaaaatatttttctggggtaaa

SEQ ID NO: 39611 - DNA, 1029 bp, Heterodera glycines
ttaaaaaaaaagttttttgggggtccgggatgcccgggggggggggattgtctcctgatatttcggcataatttcgggacaacttgcataagtattatattttaattgattagggtgctaatcgctgtctcgtcagtcagtcaagtaaaacacggttttctcttgtgtcttcccactggtcctcctcctcgtcctcacctgtgcagcagcgatcagcagccgctcgttgtccggcccgggcgatcagttgcacgcccgtgggcagtccgttgtcgttcaggcccagcgggcacgcgagcgcgggcagtgccaacgtgttccacaccgcggtgtaaatgatgtccatcggggtgaaaaaacggttggtgtgcagcggcgccacggtggtgaaggcggggaagatgaacaggccgtcgtcgccgagcagcgagatgagctcacggcgcagctggtcacgcttgctttcaacctttgggggcggggaatgcatgggtttacggggaaactccatgccaacataaaaatttgtttttaaagtttgaatcattttggacataggcgaaaaaatgtctggatcgaatttttttcttcaagttttttttaatttgaaatttttttgaaaaatttcacggggaaatttttgtcccactgcctccgccgcatgcaaattttccaaaaaattaattttcccaaaaatccataaaatagcaaattttggtgaaaaccttgggaccgttcctatttttagcatttttaaaaaaataaaaattcaaataggggggagggggaaattgtaataaatttaatctttttgaattttaatgaattttttgaaattatttttgccccccccccctaaagaaacgctctctcacaaattttctctgcgcgtcgctctgttgcggcaatttgctgcgaatgccggtgataatggcgggcaaagtgtgctcggaccagccgaacgggtatttgaccagctcggcgaagcagttcacctcgtactgaaaatacacataaaaatgcggaaat

SEQ ID NO: 39612 - DNA, 740 bp, Heterodera glycines
atttaaaccggttcaaaaaccggttttaacgctttgccgcgcagttttttgatggtttaggcgttttcagcaccttaagaaaacataacatataaaagtgtttttatgcaattttgagtctgggacctatgatggatattttccctaaatttcttccaaggcatttgccaatgccttttctcgtgccaatttcatcgtttacattcaatttcgcttctctgtttggagtattcggattcgtagtccgacctttgaactgttcaacaattcaactggggagcgattgacactgaaacagatttatgataagtatgttattaatcttacattatcaatcatttgggttcggtgggaccgcagttggccaaaaagccaaacataaatttaaacttcaaaattttagatttcatttgtaattttttcttctaaattgtttttttttaatataattcacccatcatttcgtgatttttaacgtaaattttttcagtcattttgtcttattttgaagaaaaaaaaattccgaactctgttattgcatcagtacatggttggtactaatcagtagggatacgatttttatgtttttacctatttttcccctaactcgcagtgacctgataagcacgaaaaatatgttttttcagttgttgttaagctacttttgaagtttttaaagcccatttcttggtttttactttttagaatctaacctaaaaatttcgtccctactaatcact

SEQ ID NO: 39613 - DNA, 1390 bp, Heterodera glycines
  misc_feature (1293)..(1293): n is a, c, g, or t
  misc_feature (1331)..(1331): n is a, c, g, or t
  misc_feature (1361)..(1361): n is a, c, g, or t
cccccccccctttcagttaattattttatttctttttagggacgatttgtttcgaaatttattctgttgcgttattttgaaattctgtgctcaaattgttcctttcgttgctgaagtcggtgctgtgataagagactttgtcaattgcgctctaatcactgtcctccaggcaatttgcttcagaatttgttcgaatttgccttttccacaaatttcagaattgcacagaaaattttttttcttcgaacgacagaatcaaagaatgtgacgatgaaattgcgatgcattggctgctgatgggtcattccgcactgaatttggtcattcgttatgagaacgttgtcagaatgaacagacaaaacgaggactacagagagatcgccagagtcattaattgggattaattaatgtaaattgaaatgttcccttaattaaggaatgggttgaattctttggtccatccgcagcaaattacgtctttcattggtttttgcatttttccaacattggcaaaatgccgccacaatttttcaccaaaacgctatgtaatgccacccaatcgattgacattgaccgtctcatcaaagccgaaattccaattgaatttttgcaacgggcgaccgattgctgtcccgaagacgaactttcgttcttgcaaaatttcgaggggttttttcgctgttcgtttgtttttgttatggctttacattttctagttattccgatgagagacgctcccgacttctcccgacttcagttttgttcttcaattcgttgcctgaaattcaattcgcttctgccaccgttttaaaggggtccattcgaataagaaatggaaagggaaataaaagcttcgccatttgaacaattcagctttttgtttgaaatgttctcatcggagaacgccaaacgcggctcatttgctaagaaaagtttgaatggaaatgaattggagtccgaggccaacgagggggacgcggaggacattgggaagagtttggaggagcagtcgcatcagttggcactgccacggcttttcaaggcacttctctcttttgagtttgccaattactcccgtctgaacggtaagtacgtatgcatacaattccacgccaatttcaaatgttctccagaatccgaagtcgaccctttgctgctttcctgggatgttctgatgcgtttttttggagatttggacgtcctttcccgggttcgcttttgcgatgccatcgatgtcaaaaccctttccaatgcgttggcccatttgtttaattctctctccgaccccccggngcataaaggttttcccccctccccggcaataattactntctttttgcttctttcgatgcatttgcgtngttctaatgtcgacgagctttcactggcc

SEQ ID NO: 39614 - DNA, 800 bp, Heterodera glycines
tccaagaaaaggaaaggagtgctattaagcaccggaacggtctaattttggcactcacatgtccacgcccataaatccgttgccaaattcgctgggccaaatgtgatacaaaacgatggcgtaaacgccgatcagctgaagaccgaacacacacgggccatagagtggagcagtagccgaagaaaacggcaccatcggcggaagaaaagttgcaaagttattagccgaaaaagggaaaataaatgaaaaagatgggagaggagaaacgaagggagcgatttggagaaggaattgatggaaatgcaaagtgatttatgaacatgccactaatacagagaagaagctttcccgagatgaagataatggaccaattgagataaattaattgatcttatatgatcgagcaaattagggagaggcagctcagctggtagaaagaacactgatcagcaaagccagagacgccggttcaaacccgacccgccccaatacatttttcctcaaagacttccccagcagcttgttcatgcccgggatgagatagagaagaagaagctcccacgagacgaaatgaagattaatggatcaattgagcgaaaattaagagaaaataaatgaaaaaaggagcgacgagaagcgaggggagtatttggagaaggaatggatggaaatgaaagtgattttgcgaagatgcaacttttgcgaaaagcaaagaaaacattttggggttaccgcggattttgcggcgaaaatgtgaagcattcgcagaaaaggcaattggtaggaaagtgagacgaata

SEQ ID NO: 39615 - DNA, 831 bp, Heterodera glycines
tatttaattgattcgaatgtttttatcgcggttaattacattacgaaaattggcttgaatcgtgaagattatcatttctaactcacttctcaaaattgttgataaattgcaaatatatttttccaaaagtctgttgacactttctgaaaataaattctatactcatgtattttccactcattagattttgcaggcttattgctgatgttatttgacacttcttcaaaataacctatgccctttattcgttcaaaacagcatctttgttgtttcgctttggattgacaagcccgatgataaatagctcgagcgcaaaacgcgtgcatgtttggaaagtatcgttcataccaataattgagggtttatttttaaatgaaattttatgataaaccttattatctcagaagctatttaattgattcggatgtttttatcgcggttaattagagcaccgaaaattggtttgaatcgtgaagtttatcatttctaactcacctctcaaaattgttgataaattgcaaatatatttttccaaaagtctgtggacactttctgaaaataaattctatactcatgtattttccacttattagattttgcaggcttattgctgcatgttttttgacacttcttcaaaataacctatgccctttattcgttcaaaacagcatctttgttgtttcgctttggattgacaagcccgatgataaatagctcgagcgcaaaacgcgtgcatgtttggaaagtatcgttcataccaataattgagggtttatttttaaatgaaattttatgataaaccttattatctcagaagctatttaattgatt

SEQ ID NO: 39616 - DNA, 941 bp, Heterodera glycines
agcacagagagcgttctgttccgtcctccgtgccccccatcgaccgaccgacccccgtccgtccgtgtgtcatcactcacattcctgttaaaaatgttggcagtaagtcgatactaggaccgatacagacaacagcagcagcaacaacaacaacagagttaggcgccacggacagacggcggggccaagacggaggggacggtcgggccattcattcagtcattttatttgagaaaacatcgccgccgcctcgtcgtccccccgggggtttctccctttctgtgtcctctccgttcccccatttttgtccgcccactcgcaagtttcgcttcccctttccgccccccgccttctcccgttccatgtcagcaacagcagaagacgaagaagaagaagagcattagaaccccccccccccccctccctattataacccaccacaaagtgtggtggtgtcgcttccgctgttgctctcttatctttcctctctctccctccttcctttcccccttggattgctattactgtaagcgccacagtaagcccaaataaaatgtgaaagaaaaatgattgggtgcagaaatgcataaattgaagagaagtgaagaaaaaaagtggtcattttgtcgtgcatttccactaatttggtcaatttaaaattttaattttatgatttaattgtcggatagtcagaaaatttaattaaaaataaattaattaatcttgttcaaataaaataacaaattaattttttggcattgattttctggacctggaaaattttgggactatgtctaaaaattgtttggcattattggtttacctttcttttttttgccgattttggcaccgatgccaaatgaacaaagtagagctcggtattttgaaaaaagcctggacctggacctggattttttttcacattggacctggacctggat

SEQ ID NO: 39617 - DNA, 975 bp, Heterodera glycines
aacagatataccgaaatttttgtattttttaaaaataacttttatgcttattttatattttagttttatttaatttttccattttctgttttttttgtagagcaaaaaagatcctcatttgtatttggacgtgtccgaagtgcaatggggcaatgtgtacatttttgacttgaacaaaacggaagtgatcgctgttcggccgcgcagagttgcggatgaattgaggaagttggaagagcgggaccaaccaccggtgaagagggagcaaccaaaacgtactcatttttggaatttagtaaaaaaaatattaaaggtgggaggttaatttaccagtcaatcgaaaaattactcccaaaattaagggacaattatatatcagttaatttaataatttttgaatataattaaacaattttttaatagattttggggttatgaatttgcgcgagcattggacaaagttcaattttttaaatgaacataactttatcttgggaaaggtcctaaaatgtacataaattttgaatcaaagaaaataattatgaaattgctttaattatgaaaaattaatttttaattgaacaagctccaagcggggcaatcaaattccaaattaattatggtttaaaaatttttttttttttaaattaactatatttaaaatcagagggtcaaaaatgaacatttttaagcgcaaccgcagccacaaccacaacctcaacctgtgacttttcaaaaaattctgtccggtttggtttggccaaccactgaaaagtacaccctgctggtgtcatcgcgtgattttgatttggatggacgaggatcaccgatcaaacaacgcgccaccaatcccgacccgaccagagccgagacaaactacaagggcacattcgacgtcaaaatggcactgacggaaaggccggaaactttttacgtgtgggtttcaagtgccaaggtaagaaacggcagtgtgag

SEQ ID NO: 39618 - DNA, 451 bp, Heterodera glycines
gggggggttacaacggattaagtggccatacactactttcgaacctgttaaatactcaatacaagaaaatacatttcaaaaaattttgcaagatttaaaaatgtaaatcaaaaaaggatttattgtcataagtttttagtaaaggaaatatgcataaaaaatactaaaatatgtatgaaatatgtgcaaaaaccctcaaatattggcagctcacttttaaagactattaattattattttttaatttattccttttaactccaattttcatcactaatttttcactcagacccccgttcttaccagtgcttgattttcctggttcccgtttgccctaccgggaccgggacctgagcttttcaaaacccgggaccgagaaccgggatctggacctagcagccctaataattaatcaatcaatcaatttatacgcaaaagcgtgacaccgaca

SEQ ID NO: 39619 - DNA, 610 bp, Heterodera glycines
tgcataatgatcccctctccgtttttccttgttgaaattcgattagaggtctgttttcctcatcatcttcatctgatgcggtgtattcggcttgatcaatctgctctgcgtcctcgcgttgggtaggaaaaatgttgctgtcgtcgtaatcagcagacggctctccgaaccgctttggtgtttttcgtcgatgttgttgttcaatttgtttacggatcgatttaattgatttgctaaaattgaaaaacaaaattgaaattgatgcaatgtcaaatgcgcctacaattcgcctggtaaagcattacataaagactaaaaattaagcatccctcgaaattcttgtcaattgctttaagttccattttttaagtaatattgattgagttgacgaatcgtcacattttggctgggttgacgaatcgtcgagttgacgaatcgttgacatttggctgagttgacgaatcgtcacattttggctgggttgacgaatcgtcgagttgacgaatcattgagttgacgaatcgttgacatttggctgagttgacgaatcgtcgaattttgactgagttgacgaattgttgagttgacgaatcgttgagttgacgaatcg

SEQ ID NO: 39620 - DNA, 379 bp, Heterodera glycines
  misc_feature (321)..(321): n is a, c, g, or t
  misc_feature (365)..(365): n is a, c, g, or t
gcgcggggcagaccccccgaaccgacgcgcccagacagacggggagaccgaagcccgcgggaagagcaccccaaaagccaggaccgcaaaaccgcgagggaggcgcgcgccccacaaaagaccgagcaccccaaacggacacgagaaaaaaccgaaggccgagcgaccggggcagaccccccgaaccgaagcgcccagaacgagggggaggccgaaccccccgggaacagcgccccaagagcccgcacgccacagccgccgcggaccggggccccccagaagaggccgagcaccccaaacggacacacgaaaaaaccgagnccgcaggccccggggcaggccccccgaaccgacgcgcccagaancaaggggagaccga

SEQ ID NO: 39621 - DNA, 1492 bp, Heterodera glycines
tgtcaagatgataagcattggtacaaaggattcaacatcgtctgcctaaagaaaataccataacatcataatgcactagcatagtctttgaaaagcaaaattcaaaaaccgaattaaagcaatcatttcacttacatttccattattgaacacaaatgaaattgtattaagaagtttgtagaaaaaattgacccaaagaaatccactaaaatggaatatataagaggaaagaaaacggtaaaacacctcaggatgcaaaaacaggagttagtccgaggtgtaaatctgcaaaatccaaaagagtgcatagaatgtgcatcggttaatacaaatgtgaagagttgaacagcatcattttcgcttctaaaaaagttaatcgctcatttgatgtcacgaacaaatcaattcattacctcatactccttttcaatgggaagcaaaactgttttattgaacggagaatgttttcatcagaaaactccaaaggataaagtacctaaaaatagtataaattgataggtatttacttaggtctgtatgaaatcgaaaaaaaattatctgatgtgagataaagggaattttatggtttgggtgatagccaaacagaaccatcgggcaaaaatactaaaatgtcatccttactaaaacatgcctttgtttttgtttgttgaaattcttttgccgcttcaacttcgcaacacacatcaaaaatagtaggcgtgtccaatctagaaaaaatttaagataattaaatttgttaagtaatattttttaaacctgtgcctagaagccatcagtttgagagaagaaagaaaattaaccactcgcacattggttttttaattaggataatcagacatcaaagaatctgaagaaaaggctcgagagtccactcaatgacaatatttttatcatacaaaaaaagatagttttcaacaattttttaagattgcaaagtaaatcataaattaggtaggtaaaaatggtcattcgacgtgccatatgttttcgacagggttgatttctacattgagtgattcgccagtgtgatttcgaccggacctttaagtttttcttttttatattttccataaaaaaatattaaattaaaaaaaaatagagatcttttaaaaattgtattaaacatccacacgtatttaggtattagattttaaatgcactaaaattaacatacagtgtaaggtagaccgaatatgggacctacttggttactaactcctcacagaccactgacagaaaattcatattatttgaacagaaagcccaaaattgagtcgctgtgaggagaaatgttttcttacaaacaagcaaagctaacaatacaaatgaaatcattcatgagatttacctatgtatttattaacagtcacttattgaaaaaaatgccacttatcaatacgagagatagcaagacacaacaaaaagagaacgaggaaaatgatgggaatgcaccctattgagacctatattt

SEQ ID NO: 39622 - DNA, 1166 bp, Heterodera glycines
agttgaatgtttttgatttggcgttaaaatgccattttttaaatgtgtattccaatggaggtttttggccaagccataaatgccggaaatgtgtaattccgtcgcaaaaagctcccggaatgcggtgccgccactgacggtatccggaattccggacaatccgtcagtggataatctttcggaagacaattctatcagtgacggacaattcatcagtgaaggacaattcgtcagtagaattcgtttcatccaagtacatctcgtcgataattaaaaaaaaaatttgttgacggattgtccactgacagattgtccataaccgactgattgttttactgacagattattattctggattcccactggcgcacatccagtagcgacttttgccaaaaggcccaccgcttactgtatgccaattagctacagtatattctttttataaaaccagcaggaagaaatgtgtgaaattgctcttgcagagtcggccacccatactgtattttgcagacagctacttacagtatatgtaactgttacaaaagcccatcccaattctacagtacccttcccctgctgccgccgccgtcctccattttcgctgttgttgttggtgtcggtgttgttgtgctgtcctttttgtgccgcatgaagtcgatcattctgtcctgcacaatgtccggctcggaagcagcttcatcttcctcatttcgtgactctgtcgaaatggagcgaccgccgccgccgccagcagtgatccatcgctcttaaaaatgcaatatcccattttaaaatatttcttttatctccgaatgccgtgctgggtcgttttataaaatccaccaattttagcgaatttttcgacaaaacatggcataactttgcttaaagtcaatcaaattttagattcttggtaccattcgatagcccagctttttctctattagcttggaaaatttcaaaaaagttaccaaatttaacataagttatggcagaaatagtacttattttcatacaactttttctaaagttgaccaatttttatttttattttgcgggctaatagagaaaaagctcggctatccgatgatacccagaatatacaatttttattgcatttaagcaaagttatcccatgttttgtcgaaaaatttcgatataattgg

SEQ ID NO: 39623 - DNA, 797 bp, Heterodera glycines
cagttgtcaacgccgcgactgcatcgttattatatcagtcgatagaaattttcgaatcgcttttaaatcgtctgttttgcgtcccttgatcttcactccgagccgagttactgcggtctaaacacgttttttggtagaattgcggccagaatttaaaaatacagtttgctatggcttcgcatcacccgcttcaacgggtgctcagtgtaaatatcgactggccattcaaattctgcctttccagccttatggaaagatattatggaacttttggttccatctcagttgtcaacgccgcgactgcatcgttattatatcagtcgatagaattttcgaatcgcttttaaatcgtctcttttgcgtcccttaatcttcactctgagccgagttactgcggtctaaacacgtttttggtagaattgcggccagaatttaaaaatacagtttgctatggcttcgcatcacccgcttcaacgggtgctcagtgtaaatatcgactggccattcaaattctgcctttccagccttatggaaagatattatggaacttttggttccatctcagttgtcaacgccgcgactgcatcgttattatatcagtcgatagaattttcgaatcgcttttaaatcgtctcttttgcgtcccttaatcttcactctgagccgagttactgcggtctaaacaagtaatcggaatagtgctcgccaaattaaaaattacgggaaaaacccaagagggacccttttgatggcaaaaagaaaggtgttttgagaaaacaaaaataaaaccaaaaagg

SEQ ID NO: 39624 - DNA, 1071 bp, Heterodera glycines
ggagaaaaatggggaagaaaaagaagtaaaaaattagataaaaatgcaaattccgatcattttctcgccgcttctcgctcctgttcctcaattgcgacggaagttgctcccgctcgaccacttctttcttttccctctcttctcccggcgggggagtgccaccgggtgatcgagcgcaccccctccaaaatagtcctcctcctcccgcgacagcacccggggttttccgtcgccaacaccgaacaccaaaaagccttcccacaaattgcctctctcgtcgcatttagcgacataaattatatttcaattgagaattcaaaaaaggatcgatcatttctcaaataattcattcattcattccgctgatcactgcttggcaccgctgggctcgagaacagttttccgttgcttttatcggtttgagacaatggcctaatttaattacaatttaatttgtgaaaaggaaaatttagggttcttatcctttttgtccccccccttgaattttttttttaaaataattttttctagactaattttatacgctgaacacgaatctagcaatcgttttggccgattccgaaccctggacccgaactcgaacaaaagtcgaaattcaaatttttaaaaatttacttttatgttagaatctgtacagaataaccagtattgatgtttcaatgaattgtgactaatttatatctagtattaatcaattttcgagcaatggtgaaaaattttttaaaatttgaattttcaactttttcttcgaattcgggttcggaattaatatgaatggatgtcagattcgtgatcagcgacctcgaaaacccccagggaatggtgtcctgatttttttaatttttattatttttttcgaaaaatggaggggggacaaagtacattttttaccgacaaaattctgtagttgactagtcaaaacatttcacgtaacacacgcaaagagcataagagctaaaaataaacgttcatatatgttgtcagcgcataaaataccctagaaaaaaatattaaaaaaaaaatcaagggggggggggggaccaaaaggga

SEQ ID NO: 39625 - DNA, 939 bp, Heterodera glycines
aaaaaaagagatagccatttttctgagaatatctattcttctgagacagcaattttcaaaccgaccttttgtagggctcaaccgcagatagtaatgcgtttttggggaaaccccacatgtacaacggtgtagaaaaaaagagatagccattttctgagaatatctattcttctgagaaagcaattttcaaaccgaccttttgtagggctcaaccgcagatagtaatgcgtttttggggaaaccccacatgtacaacggtgtagaaaaaaagagatagccattttctgagaatatctattcttctgagaaagcaattttcaaaccgacattttgtagggctcaaccgcagatagtaatgcgtttttggggaaaccccacatgtacaacggtgtagaaaaaaagagatagccattttctgagaatatctattcttctgagacagcaattttcaaaccgaccttttgtagggctcaaccgcagatagtaatgcgtttttggggaaaccccacatgtacaacggtgtagaaaaaaagagatagccattttctgagaatatctattcttctgagaaagcaattttcaacccgacattttgtagggctcaaccgcagatagtaatgcgttttgggggaaacccccctggaccaacggggaaaaaaaaaaaaaatagccattttctgaaaatatctattcttctgaaaaagcaattttcaacccgaccttttgtagggttcaaccgcaaatagtaaggcgtttttggggaaaccccccttgtacaacggggtaaaaaaaaaaagatagccattttctgaaaatatctattcttctgaaaaggcaattttcaaaccgaccttttgtagggctcaaccgcaaatagtaatgggtttttggggaaaccccacatggacaacggggtaaaaaaaaagagatagccatttt

SEQ ID NO: 39626 - DNA, 1010 bp, Heterodera glycines
ttcgtccgaagggagttcgctcccctttttttccttctcctcacctttgaagcacacaagattaaaagcacaatttattaagtagctcaaacttgggcaattaaacccgaacaaaaatgggggggtgacagtgacagacggcagggggtaaatgaatgccgcgatttgtggtgggggaaattgaaatttggggagacaactccccagtggtgattagtggaaaacaaatgttgaaaatgagatagaattatgcatagatgaaaaatgaggacggaagagagcagggggaggagccccctaacaaattggcgaaagaaatgaaaataaaaatggccaagttacgcaatgacaaagagagggggaggagaccggaggaaacgcccccgaataaatgttgtcgaattacaattcaaagaaaagacagcgaaagagtcggccaaaggccgatcggataaacaaaatggtaattcagaagaaatggggaggggatgaatgaatgaatggaatgaaaaaatgtgcaaaattgggataaaagaaatgttttcggataaatgacggccaaaggccagcgaaaaatgggggattggcagattgggaaaatggcgaagaaatgcataaacaatttgcaaatcggagaagtgagacgattggatacggtaggcgaagaaaagagagagagagagaaaataagaaatgtgaataaaataagaaatggcaaaataaagaaggaggaaattgtgagggcactgtcggatgaatcaaaatggactgtcgggattggctctcccggtgaagtgtgggatccgtccggctcatcggcgccatttctttcgttttgcgtcctccggtgcgcgccgcggcggcgctgcggggtgatcaaggacgccgcctccccattgattttcctcctcttcgaccaattccaccggcgtaccgtcctggttgaactccaggaagtcgacctccccccaactgcgccaaggaattctcccgctttcttcctccacctt

SEQ ID NO: 39627 - DNA, 1528 bp, Heterodera glycines
cagccaaccatcagtgatttgcgatatcagcagcccttttgggctttagtccctgctgaagacaaacaggaatacttccttgaagtgaaattatcattttggaaagtaaatttgttttttctctcttttttcagattatcaaagagggcactgtcattggcactgtccgtctccacaacagcgcccatcaaaaatcattttggtccattggccgttttgagccgtgtgacatcaaattggagcatccgtccgtttctcgtttccacgccattttacaatacggagaatgtataaaggggagaccgggatggtaaaagatggaggataaaaggggttttaccaatcaaatgttttctctttccaggttcatcttcgacatgaacagcacccacggggtgaggctgaacaagcagccgctcaaaaaacgcacttacgtcccattgcacaacggatttgtgttccaaatagcgggtcggaattaaatattttaaattgaatgaacaacttttggcaatgtttttcaggcagttcacgtcttttcactgtttgcggtggtcccaaaagagaacagaaagaagaagaaaacaaagaaaaggcacaaccaatgggaaaaacggagaacaaaaaggacgcagaagaggaaggagaggacgaagaagaacaacagctccgatactacgagaaggacccgttgggatggctgcaaaagtgggcaaattcaacattttttaaaatttaaattgttgacggagaaaacgaactttcagatactttgagcgcgaaggacttcccatgcactttcaggtggattttgaattttaatttaaaaaattcataaaaaatggatcccgatattttgtccggtatttttcagtttacaaaatcgtcgtccgatggaggcggcggtggcgctggggatttactggcagaatttgaggacgaacagaacaaaaagaggggacgacggcattccgacgagggccattggacctgttcaattgagtgagtgccgaaaaggcgccttttccttttctgtttccgtttttaggttggttagcgatgtttctctgaccagtggcaatgtggtcactgtgtcggccccttccaaacgattggcccaattgcaatgttcgctggtcgcatgcgaacggctgaacgacgcgtgtcttttgcgcatttcgtccctttggaacaaacgcaaaaattacacggagaatgacttttacgacagcgacgaggacacttttttggaccgaactggacaaattgaggagcaacgggaaaagcgccggaagcgatttggggtagtcaatttgaccactgattaaaattgatttgctttccttgccctcacccccgcgccattttccacacaattcctccaccgatcccttttcctctaacaatttttgtttaaaaatcaaagctttacatttactttttagacgggtatttttgcctcttccgctggccatgcaaaaaattatgcagagttgataaaagaattggcagaaactgaggccaaatt

SEQ ID NO: 39628 - DNA, 1254 bp, Heterodera glycines
gaattaaataatatattttcttgtaagatttaaggaataatggcaaattgaaagccaagaaagctttaaactgtggcagctttgaaaggacaattgattgataaatggtaataaaatataattaactgactaattgattaaactcaaaattggtcggcttttccacttactttcccaattcttcgtccaattttccgtaagcattcgtcacttctttcacttcgtcctttcttcttcttctgctgttttcttcccgctcttttctcttcctccgattgttgtctttccattctttccaatttcgccttattttgttccgctttcactctaagcaaataaataattgtgtaaatttgaattttttgttcattttctcgctgatttatttccgttttggccaaaaaatagtccaaaaagtgaatgtccaacagaatgtgctgcattccgccgctctgattgtgaaaattgaagcgaaactaattgtaccaccgattaagcgctgaacaaacaaaaaaaggcattgctaattacatcattaatattaagcattatattattattataatccccataattaaacatatattattagataattaataatcatttgccagttttttaattacttgttttaattttgcatgctttttatcagtttttctccgggaaacgctgacgaaaatggggaaaaggcaaataaaataaggaaaaatagacaatgatacattttcaattatagattgacattaaatgacgaaaggatgatcttaatattcgattaaaataaatagagaaatgtttaattaataattaattaattattttatttaaaataaaaataaaagtaaaaaatagtaatatttattatattaaaaaatataatataaattatgtaagtctaattttgaatggattgggcataaatatcgatcttttcaatttgtatcatttcatttcctttgctttgttttgtttcaattttgtgttcatcgattgcttttccttctcattggcaaaatattaaagcattgggcgtattaaggcttaaatgtgctttttccttcttcagatttggcattgattgggggaattccctttgaaattcattcccaattacataatttaaatttctgttaaaaattgagctacgcaaatgttttttattctttataccccaatttttcatcagttttttattgtgtaatttcgaaattgcacattttctgctcgaactgatcacttttccatgccaat

SEQ ID NO: 39629 - DNA, 1241 bp, Heterodera glycines
gtacatactaaataaagtacatttttgaccattgaaagtagtgctttatattgccattcttcaaattaaacttttgctaaaattccatggacgaatcggcgaaaaagacgctaaaacaaattccactgctgaaaacaaatgcagggccacggtaaataaacaaaaagtttacgcattttaaagtccaaaatgagttaggaaagtgacacatgacaaaattcatacagagaccttgccaaaacacttgtttttttttaaattttgggtaggagacagggacgatcatttattgttgttaacccaaatatcggcagatatttaaaaaataataattttttgcttattgccagagacggacccctttggcttgaacggttgaaggaggagtacaacagtttgatcgcgttcattgagcacaacaagcagggcgatgccgactggtttcgacttgagtcgagcgcggatggcactcgatggtcggtgaatttggcatgtaaattggtgatgattgttaactttgttttctcccccccccccctttcttacaaaaatgtttcattttttcatgaaatccttgggtttccgggatcgctgagctcgaaaacgacattgattttgtcggacggatttttcgaatttaattttggtgtgaaagcggtttatataatgctgaaagcatttttcgaagtttagtcatttcagcgatgggctggaattcggaattgttgcacgtaattaaattaatgcggtgttttttttaaatttttggtgccattaaatacgcctgccgtttaacgaacccttgtttttaagtaattgcttggatctcgattgttaaaatgggaaaatggcttttgttggttttatatggcatggaaaacattcaatttttgtttaggttcggcaaatgttggacctaccacaacaaaatcaaatacgaattcgatgtggagttcgacgtgccgattacatacccaaaaactgctccagaaattggtgggtaaatggaaatagaatttaattacttacttctcttctggattttcatattttcagcccttcccgaattggacggaaaaacggcgaaaatgtacaggggaggcaaaatttgtttaagtgcgtttttcattaaaaaaataccgaaaattctattttttctcctcgttttttaggtgatcacttcaagccattgtgggcgaggatggccaatttctctttttttaaacttagaaaaatttaaa

SEQ ID NO: 39630 - DNA, 1167 bp, Heterodera glycines
tttttgcacccaaataaatttattcaaaatttggtttattttaggcgtttgccattcagtttttgacgacgatgaagaggatgttgctcgtcgttttacagatggtgctggttcgtctaccacttcatgcggtaataaaaattcaaaacattgtaaaggataatatctaaattttttttttttttgcaaataataggccccttttcctttgaattttttttcggcggggcgtgcaattatttatgggcctgcaaataaacagcaaaaaacaaaaatttttcccacaggcaatcgctgtgaaaatggcaaaatgccgttgctgatggagtgcccgtcaccgccttcctcctgcccaatggacgcgtccgttttaaatgaccatgattttgatgtacaccacaatcgccgctgtcgctccatcactctgtccccgccggcgtcatcaaattgttgccatcgccaaagcaacgggggcaccaataaaaatattgatattgggtgagtgggtgaataataattgtaattactaataaaagaattttcggtgcggtaaaaattccattggaaaaattgagaattctcaaaaaaaaaaaaattttttttttttggaaaattaagaagacattactttttttgtaatttttaaactttgcatttaaaattgagacaaaatttgtttgatttcaatcgaaaaatgtggagttttaaaagaaagtctccattaaaaaaaaattttttttaatataatttttaaaacgtataatcactaaaatatgtattattttttagaattcttgacgacaacaacgatgaccaactgttgttcataccaaggacagcagcagcagatggaaatcaacgtcaaagccatcgccttttgctttcgtccaccaccaccagtcagtcgtcctccgtgtccgtctccacctcgttgatcaaccaaaacggcaccaaccgacagcatcagctgcagcacaaccaacaacagggggtgtgttttacaatttggagttcggcacgaccgatttttggggtgcactatggccaagccctgcatccgtactttcaccccttccaaaaaaagtttttttattttaaatttttcatgaaaacccatttttttgaacaatttttcgatcgtaaaattgggttttctttgattctaaa

SEQ ID NO: 39631 - DNA, 939 bp, Heterodera glycines
tagtaacttaccgataaattcaaatttgtcatacattgaacctttactgatttttctacctggctgactcagcgagagatctgttgagggatcttgaaacattccgtcacaaaaattgatgcacaacgccaaaataatgacaatgagcagccgcaaaggtaggaagaaacgcattttgttgaattttagtcaactttaaaagatggggaaaaataattggtctttttatatctaatcttttttttacaattcattgggagcagaattaagtaaaaattgttgaaaaatttggtaagactgtcgatggtgaacactcttaagcaaaaaaaaataattttcaattttttgagctaaaacagttaaggttttggggtcagaggattcgacactgattgacatcatttacacccttttggactattattttataaaatgatggattctgcttatctcatgccccctatttatgcggcccatcagtcattatctgacaaattgatgtggatttgtctgccccaattgtgcgcgaatttctttgtgattgtatccacgccaataatatgcactttcacgaaaacctgaaatagacttttataaacacgctattgcccttaacatttattactttacgtttattgattaatttaatatttttaaattttttagtgtcagttaatcaaaaaaataactttaaaaaatgggcaaattcaaaatataattttaacgtttcctaaaaattaccggataacctttttgtgcagttggtccgaaaaattcatagtaattttggaataattgccgattttacgaaattccattgtacgaactgccattggagggggttgagaaaaaatgatttttttgaaaatttagagaaaaagaaaaatttttaaacgaaataataatttgatgttcttttaaacaggaaccgctcagttg

SEQ ID NO: 39632 - DNA, 580 bp, Heterodera glycines
  misc_feature (13)..(13): n is a, c, g, or t
  misc_feature (16)..(16): n is a, c, g, or t
gaaaaaatcaagnagntgatgaaaaatcatagataaattcaatgattttcaaaatctgagttcagattcgtgatcagcgcatttttaagcttagaaaaaatagctgcgaaatttttaacattttttttcatcgggacacacattcttgaccattgccctacccccccccccccccccggattatccccccttaaaattttataaaaaatcgaaagttttttagttttaaacttagaggttttccttagtaaaaaacataaagtcgctatattttaggcccaggccgagtatttggaggcggtggcgaacaacgaccacctgaaaatcagagagttgcaaattcgctatagcactcagcgggctactgaccgccgcacttcgccttcgcaaaggccgcgtagtccaaccgccgtcgggggagcgggcgcattcgatccggaaacaccggggccagcagagagggcggggggcgaagacggcaaaatgggaggagtgaaagtgggggaaagggggggggaagaatggcgtgggaaaatggcactttttaaggaaagaaagggagaagagagagaaggggacg

SEQ ID NO: 39633 - DNA, 1431 bp, Heterodera glycines
  misc_feature (109)..(109): n is a, c, g, or t
  misc_feature (155)..(155): n is a, c, g, or t
  misc_feature (1264)..(1264): n is a, c, g, or t
  misc_feature (1313)..(1313): n is a, c, g, or t
  misc_feature (1373)..(1373): n is a, c, g, or t
ttaaataggcatattaaaagagcctattttttgcctttcacaagagatttataaaaaaggcaaaatcgccttaattaataaggtgaaagtttgaaaatgtttattaaanaatttaaggatgaaatataattaaaataaatcaaaagaaaaaaaantcaatttatttttctaaataaataaaaaacattgtcagaggcagtgcctgccgaaaaaaagacaaaaaaattttcgaaaaaaagctaaaaaaattgaaaatttaaataaatttacaagtgaaaaaaggaaaaaagcttacaacaccttcgattcccaggacgtctccgttccaagtactaagaaggcccaactttgcttaacttgccagatcggacgggatggcgtgctttcaacgtggtatggtcgtaagcgaaaggaaagcaattaaagtaatttaaataggcatatttaaaagagcctatttttttgccttttcacaagagaatttattaaaaaaggcaaaattcgccttaaattaataaggtgaaagtttgaaaatgtttattaaaaaatttaaggatgaaatataattaaaataaatcaaaaagaaaaaaaataaatttatttttctaaataaataaaaaacattgcaaaaaatttttcgaaaaaaagctaaaaaaattgaaaatttaaataaatttaaaagaaaaaagcttacaacaccttcgattcccaggacgtctccgttccaagtactaagatggcccaacgttgcttaacttgccagatcggacgggatggcgtgctttcaacgtggtatggtcgtaagcgaaaggaaagcaattaaagtaatttaaataggcttatttaaaagagcctatttttttgccttttcacaagagaatttattaaaaaaggcaaaattcgccttaaattaataaggtgaaagtttgaaaatgtttattaaaaaatttaaggatgaaatataattaaaataaatcaacaagaaaaaaaaatttatttttctaaataaataaaaaacattgtcagaggcagtgcctgccgaaaaaaagacaaaaaaattttcgaaaaaaagctaaaaaaattgaaaatttaaataaatttacaagtgaaaaaggaaaaaagcttacaacaccttcgattcccaggacgtctccgttccaagtactaagaaggcccaacgttgcttaacttgccagacggacgggatggcgtgctttcaacgtggtatggtcgtaagcaaaggaaagcaatgaaagtaatttanataggcatatttaaaagagcctatttttttgccttttcacagagaattnattaaaaaagcaaaattcgcctttaattataaaggtgaaagtttgaaaatgtttattaanaaaatttaaggatgaaatataatttaaataaatcaaaaagaaaaaaaaatttattttt

SEQ ID NO: 39634 - DNA, 1094 bp, Heterodera glycines
  misc_feature (21)..(21): n is a, c, g, or t
tttttatatttgtcctatttntgggtttgttaattgtccttctaggattttaaatggttttgctaattccatttgttctctttttcctcccatctttccttttcattccgtgccaatgccaataattcctctcgtccctttcacttacgtaagctaagcccttctctcttctcgccggcccattatttgcggatgcaaatccattaaacagtcattcttcactaatctttcgttcatcacctcaaattaaattgacgcggttggcggagagtgccaaaaaaaagggagggcaaaatgcggggaaggaaaagcaaacatgcgaatttacttattgtttttggtgctgcttaattgctttttgatgttattcttttaattatgcttattgagttcgtatgttcgcttatttacattttccgtcccctttctttcctttcctttccccccgggggtcattctctcccttcgcttgtaaaagtgccaatttcccttttctcctttcgtcctcgtccttttttggtcaattacccattcgtgtgcccatttggccttactttgcttctcatttgaatgcgtccaatcgctgtaattccttttcctccttttctcttctcttttctcttccctttttccccttttttctcttttcttccctttttttccttttttcctttccctccgccggttttcctctgatgatttattgcaatttgttattattgttattattattattattattatttcttgttatttttctgatgggttttttcaaggaaatcaaaaaatttaaaaataatttccctttttataaaataaaaaataattccttttttttgcccttaaaatgtttaaattcgtccgtcgctcattcaaatgaatgaatggccaacttttccttctccatttattcgccgcccattgtcagttgcaccggcaaaaaggtcactttttttgtgtctgtcctccgaaagccccgggcattaattaattaattatataataattaattaattaaaatttttcctaggcactcaccgattcggcccttcgcccgtccactccttctgatcgcttatttggctctgtttttt

SEQ ID NO: 39635 - DNA, 1059 bp, Heterodera glycines
tactgttgagcagaaaaagagatagccaattttccaaatttttcccaaacaaacgcgcagagaaacaaatcccagaacaattagtatcggcgtaattattctgagaatgcggttggaattcctattactgttgagcagaaaaagagataatagccaattttccaaatttttcccaaacaaacgcgccgagaaacaaattccagaacaattagtatcggcgtaattattctgagaatgcggttggaattcctattactgttgagcagaaaaagagatagccaattttccaaatttttcccaaacaaacgcgccgagaaacaaattccagaacaattagtatcggcgtaattattctgagaatgcggttggaattcctattactgttgagcagaaaaagagatagccaattttccaaatttttcccaaacaaacgcgccgagaaacaaattccagaacaattagtatcggcgtaattattctgagaatgcggttggaattcctattactgttgagcagaaaaagagatagccaattttccaaatttttcccaaacaaacgcgccgagaaacaaattccagaacaattagtatcggcgtaattattctgagaatgcagttggaattcctattactgttgagcagaaaaagagatagccaattttccaaatttttcccaaacaaacgcgcagagaaacaaattccagaacaattagtatcggcgtaattattctgagaatgcggttggaattcctattaatgttgagcagaaaaagagatagccaattttccaaatttttcccaaacaaacgcgcagagaaacaaattccagaacaattagtatcggcgtaattattctgagaatgcagttggaattcctattactgttgagcagaaaaagagatagccaattttccaaatttttcccaaacaaacgcgccgagaaacaaattccagaacaattagtatcggcgtaattattctgagaatgcagttggaattcctatttactgtgagcagaaaagagatagccaattttccaatttttccccaacaaacgcgc

SEQ ID NO: 39636 - DNA, 724 bp, Heterodera glycines
aaacagaaagagaagtaagagaactaaaaaagctgaaatttacataaaaacattggcacaacgtttaattgttcatttaagaaagtgctcgatgagttcaaaaatgattaaaaattatttaaatgtaaaataaaaaatacattttttaaacgaaaaaacagaaaaaaataaaacaaatttgaaatatcattcaaaaaaaatttcattttgaaaaggcattagagaattaaaaattcctattttttaaaatttgttaatggcacaaatttttttagttatttttttacttttggcacttaaagcccatttgttttggcattttaactactcataacgacagaaaggtagtaatgacgtgatgattaatgaatggcaccggcataacccattaatttaaatgggagaagggtgcgaaaaaaaggcaattgtacttagaaattgaattattgccagccgccggtcatatagctgccgaatggctctaaaaagcgtgccgccttatcgtcggcacaaaatgccaccatcccccagttaatgatgatgatgatagcccactgttagaggtgcggcatttagctgctgcaatagacaagttttttgtgtgttggttttgacacagtcagctcagcgggcggctgtcaattggcatggccaatgaatgccaacgctcgccggccgctctatcaaatgggcggacagatgggagggagcgcgggtggcagaa

SEQ ID NO: 39637 - DNA, 911 bp, Heterodera glycines
ccccccccgcccttcaaaattttgaaaaaaaaataaaataataggagactcagaattttgaaaattttttataaaaactgatgacaagctaatgtgataaaacaggttaattcttttcctttcagtatccctgcaaagtttgaggcgcttctgataagtttctgaaaaaaaagttaagcctaaaatttggcctgtttaaaaaggaattaaaaatttttaaaaatttatctcatctcccatttttgatagaaaaagcatcagagtgcctaaactagcatgtaaataaaatttggtgcgtttcagagcattttctgaaaaaaatatttatgaattaattatgcaaaaataaataaaaatttctaaaaatttgatcgtccataaataatttgtaattgatcaggggctcaccaaattttgcagggatacgtatcggaacactacaaatgcttactaattttcctagattttttaaacccggtgaaaattttttgcagacaccaccacttttgcacttaaaaaaatttcaaaaaactttaaaaattcatagaaaatttaaattcataggtactactgctaaatcaacgcagagacgccgttccttgacctttttaggcccctgcaaaatcaggtgcgcttctgatcactactcgaaaaatgagtgattgaattttcattaaaagttaagcctaaactttttggcctgtttaaaaaggaattaataatttttaaaaatttattcatctccctttttgatagaaaaagcatcagagtgcctaaactaacatgtaaataaaatttggtgcgtttcagaaccctttctgaaaaaaatatttatgaattaattatgcaaaaaacaaataaataatgaactctcttccttaataattttcctgcaccgaaggtactcactc

SEQ ID NO: 39638 - DNA, 673 bp, Heterodera glycines
ctctctctttgtctttcgtccgatggcaccgattaatcgcatcggaccaaacgccggcgggaaacgaacggatcatttgcccatccatttgacacacaaattgagcggtaggtaatgaatgagacgggggggggggggacggacgggggacaaaggccaaagatcggtcggtgcaaaacgcaccgctgcaacggatcggggtcatccgttcactcactcactcactcagtcatccattcgttcgttcatttattcatttgctcatttgctgctgatcggctgatcagcgccggagggttcggtagatgagcaaaatgggcgggggggggacaaattcccaccgaaagaggcgcccccgcgggggacggacgaacgaccgaccatttgttatttccctttgtcatttgccgcattattaacccgctaatgagtgcaataaaatgactttgcaaatcacccaaacttttccggtttaattttatccacaaaaatttttttccttgcaaaaaatacttaaaattacgtcactgaaaaaagggatgtaaagctgcgctttaaaaaagctgcacttccgtttgatcgaaaaattacatattttaataattgtcaaacattggcaccgcccccgaggggataaaccgccaaaagcccgcaaaatgcaaagacacggcta

SEQ ID NO: 39639 - DNA, 949 bp, Heterodera glycines
  misc_feature (896)..(896): n is a, c, g, or t
gaaaagatataaaatctgaattccgaatacaaattcttcctgggtaccccagaaaaatgaatattttgaaaaaacacccaactttttgttcgaattcggatcaagggtccagaatttgttaaatccgagttcagatttggattcagaaccctcgcaaaacccttgaaaactgtttttgaagcataaaaaaatagggactgcaattcattaaaattgcaacaaaaacgtaatgaaaaagcaccaaccgttggccgcgtctcttatgggtgcaagggaactgttgacaacgcccaacttttcctgaacagagcgcgactttgctggaccattatttgggcaataaaaagaaatgatataccgaaacgaagtccctcaattggagcgcaaccaagcggaaattgccgaaaacttcctcaccaaaagtggccggcctgccaatggtgtcgacgggccgtgcagcacgtgcggccgggacggactcggccttgtaaatgggcaactgaaagtgaagcgaaggcactaattgatgggacagattatcgttaattgactcgagaacaaatgaatttttacaattttaataacgtttagtccgatgaacttacgtcttggatggcgacaagttttggcggtggcggcgattcggaggcactgctgcccatttttttgtttgtttgctgaaagtgtcaatggcaaaacaacacgcaatgatgcctctccttcacaaacatttatacatcgtttaaattgcattttgcaacaatctgtgatcgaaagcgcatttggtacgatgcaacccgtttttatccattcaaaaacaaaaatagagagattcaaaaatggtcgaataaataagaggttcaaaaatagtggtaaaaaaacaaacaacggacaanatttgcgctccgttcatcgtttcccctcgtgggacgcactccgtttgctcatc

SEQ ID NO: 39640 - DNA, 712 bp, Heterodera glycines
tttttaaaatttattcatctccctttttgatagaaacacttcagagtgcctaaactagcatgtaaataaaatttggtgcgtttcagagcattttctgaaaaaaatatttatgaattaattatgcaaaaaacaaataaaaatttctaaaaatttgatcgtccataaataatttgtaattgatcaggggctcaccaaattttgcagggatacgtatcggaacactacaaatgcttactaattttcctagattttttaaacccggtgaaaattttttgcagacaccaccacttttgcacttaaaaaaatttcaaaaaactttaaaaattcatagaaaatttaaattcataggtactactgctaaatcaacgcagagacgcctttccttgacctttttaggcccctgcaaaatctggtgcgcttctgatcactactcgaaaaatgagtgattgaattttcactaaaaagttaagcctaaactttttggcctgtttaaaaaggaattaaaaatttttaaaaatttattcatctccctttttgatagaaaaagcatcagagtgcctaaactaacatgtaaataaaatttggtgcgtttcagaaccctttctgaaaaaaatatttatgaattaattatgcaaaaaacaaataaataatgaactctcttccttaataattttcctgcaccgaaggtactcactcggccgcttcgcggcct

SEQ ID NO: 39641 - DNA, 962 bp, Heterodera glycines
atcgctattctcttctccatccgtctcatcgctattttctttctcataatccaactcatcactactctcttcgttctccgtctaccatctttgttcatcactgtcttcgtcagcagtttgtagacacaatggaggcttcccaataactctgtaaaattgaaaccaattgaacaataattatggcaatttctttatggtggtttaatgggccggcagctaaagcctaaatttcacattaatgaaccaaaaatagtgttaaacagaaggcttttatcaatttcaatttagctttttgaatgcaatatttacatttttggaaattttgccctaatttttaaatctagaaattatgatgcttcagtggatcagtcagtattcaccgccggcgaaaatatttgcaatttggtttggttttcaaaatggactgagaaagagacagtgagaaggaagagagaaattagaccaaagaaaaaacaagtagggaggaacaaaaatgaagttaattcgaaaaataacaaatctaggaacaagcactaataatcacggggagctaaaatagcaaaatattcgaaatagtgtatatttaagtttaaacttccagatccccaaagtaaataaatgcgatatcttatttaaatggaaaagcaattttgatgcatttacgagtacaaaatatgagtaaatctcacaatatcccagaatctttaactaaataaaaagtaagttacgtctactcatggcaaattttttcagaaatgaacttacttgtacacttcttgaatagtcatattgcgtttggtgaatagggttattgcaagctgaaatttatgtaaaaaaattattataaatattcagcactatttcggttattttatgtttacgaatagatgataggtatatgttataataaacatatgtgatatttttgttattcttaaaactacgtcagcatttttagaaaa

SEQ ID NO: 39642 - DNA, 1573 bp, Heterodera glycines
  misc_feature (80)..(80): n is a, c, g, or t
gtgcgctctacagtatgtataaattactgtcaaaattcaatggtagccccaaaaagcaatttgaatatatatttaaaaanatatttttaccaattttaaattttttggtcgatcaggaatttaatgaaatgggggaccgcccatttacttggcccaatatttgacacttggattaatcttaaaccaacccaagacaaattctttgcccattttcttggccctcatttggtcttggtttaattttaaacattcgtccaaaatttgacacttacattaattaagcaaaagtgaaaccattagatgggattgacaaccgacaaattttatttttacattcttaaattttttaaaaattttattaagccggtcaaagacatgggcagcaccaagttgggaacaatgaacggcacaaatattatgagaagcgcaccgaatgccaacagcacaaccagcagcaacaattcacttacaaaacgttcatgctgctgttgtccgtgctgttgctgctgtacgtttattgtgaatttgtgaaaaggaaattatcatttaaatttaaaaagaattttttatttaatgcaatttattttttttaaattatttcttaaaatgttttttcatttttttaaaataattctattaaaattgaaagaaaatttatttatttctttcaactttttcttttttttattattttttttagctaattttggaattttttttcctcgctaatcttttttttatttaaattttttcaatattttacaaaaaaaaaagtatttaggtaagccatgttgctgttgtggttgtgggtgtggctgctgcggttgttgttgtatgattttttcgcaaaaaattttattaaattaaattaattttttttcatccaaaataggcaacaaatgctgctgctgtccatgttgtggtgggggttgttgcggaggtcaattcaataaaaaaaaatttcgaaatttttttttaaatagcctaagaatatttataggcccacctgtctcgccctccctcggaaatttaaaaaaattcaaatgaagaaatgaaacacttttctagtgttttttttttcaaaactttatggtgaattactatttttttcaaattttttcaaaaatcgctagaaattttttcaaaatttttttcttgaaattttcttataaacaattttctacgattttttttaaagtttttaaaaaaaaaatttgggaggcgggagaatgtaatgcatccttttcaccactctgaattaggaatatatattttgaatttgaataaaatttaaaaattatagaaaaacattttaatccttcccggcttttcattttcagagggttgccccaatattaaatgggctccttgctgtgagtttcgcaatttttgatgccaaaccaacaatttttattttatttttgaatttattaaataatcaaatgtgaaggggtgccacagcaagaagagaatagtgccatattcagccatattcagaaaaatttctaaattattcgaattgacctccgtttttcataaaaaatcaaaaaaaaatttccaattttgctctaga

SEQ ID NO: 39643 - DNA, 1183 bp, Heterodera glycines
  misc_feature (60)..(61): n is a, c, g, or t
  misc_feature (64)..(64): n is a, c, g, or t
  misc_feature (68)..(70): n is a, c, g, or t
  misc_feature (79)..(81): n is a, c, g, or t
  misc_feature (121)..(121): n is a, c, g, or t
  misc_feature (135)..(135): n is a, c, g, or t
  misc_feature (141)..(141): n is a, c, g, or t
  misc_feature (150)..(155): n is a, c, g, or t
  misc_feature (165)..(165): n is a, c, g, or t
  misc_feature (169)..(169): n is a, c, g, or t
  misc_feature (176)..(176): n is a, c, g, or t
  misc_feature (179)..(181): n is a, c, g, or t
  misc_feature (187)..(187): n is a, c, g, or t
  misc_feature (191)..(191): n is a, c, g, or t
  misc_feature (195)..(196): n is a, c, g, or t
  misc_feature (200)..(200): n is a, c, g, or t
  misc_feature (210)..(210): n is a, c, g, or t
  misc_feature (212)..(212): n is a, c, g, or t
  misc_feature (216)..(216): n is a, c, g, or t
  misc_feature (223)..(224): n is a, c, g, or t
  misc_feature (228)..(228): n is a, c, g, or t
  misc_feature (233)..(234): n is a, c, g, or t
  misc_feature (239)..(239): n is a, c, g, or t
  misc_feature (243)..(243): n is a, c, g, or t
  misc_feature (254)..(254): n is a, c, g, or t
  misc_feature (256)..(256): n is a, c, g, or t
  misc_feature (263)..(263): n is a, c, g, or t
  misc_feature (268)..(271): n is a, c, g, or t
  misc_feature (275)..(275): n is a, c, g, or t
  misc_feature (283)..(284): n is a, c, g, or t
  misc_feature (294)..(295): n is a, c, g, or t
  misc_feature (298)..(298): n is a, c, g, or t
  misc_feature (304)..(304): n is a, c, g, or t
  misc_feature (307)..(308): n is a, c, g, or t
  misc_feature (317)..(317): n is a, c, g, or t
  misc_feature (328)..(329): n is a, c, g, or t
  misc_feature (343)..(343): n is a, c, g, or t
  misc_feature (345)..(345): n is a, c, g, or t
  misc_feature (363)..(363): n is a, c, g, or t
  misc_feature (367)..(367): n is a, c, g, or t
  misc_feature (373)..(373): n is a, c, g, or t
  misc_feature (375)..(376): n is a, c, g, or t
  misc_feature (1094)..(1094): n is a, c, g, or t
ctctagagtctttttgatagaaaaagcatcagagtgcctaaactaacccttcaggggatnnggngcgnnncagaacccnnncggaaaaacttttcaagaaccaaccccgcaaaaaacaaanaaaaacgaaagacncagaanggcgaaaannnnnnggagccagcnagcncggcgcncannncagggnaagnaagnncccnaccggggagnancccngcaaagnngggnacgcnncggcncaangagcaaaaaanangagggancgaannnncacnaaaaaagnnaagccgacannggngggcanagnnaaaaagcanagaaaaaaganncaaaaggaaaaaangnccccgcaccgaagggacncacncggccncnncgcggcggagagagagagagagagagagagaaagagagagaaagagagagagagagagaaagagagagaatgagagagagagagagaaagagagagaaagagagagagagagaaagagagagagagagagagagagagagaaagagagagagagagagaaagagagagagaggggagagagaggcacatgccgaattcggacaaatgccccccccccctctttttagggtcaattttaattgtttataccgcgaattaaatgaaaagtcctttaaaattgcatcatctcctccattaacatgcgattttttttttaaatttattattcttcaattttttctgatcggaaaaattccgagaatgatttttcctgcactgcacagtttgtcaaaaatcgcatttgcaaaaccctaatttagaaaaaggcccaaatagaccaaccaacttaatttttacatttaaaaaggaatacaattggcacataaagtataaactatattttattgttgtctattcggttataaattctgcgtgaaaataccagtaacaaaacttacaaaatttgatcaaaaatgaaaatgtgtttgttcaccgtcgttttggtttctgtgtgttccactccaaaactggcaattccgttaaaatcagttcggattttgggattaaaccaaatggaggggaacgaaatgaagtaaaaatgccaatgattcaacatggnaaatggggttcagttcactcatcagtcagttcaagtcaaagggacggctgcagcaccaaactctgcccgtagcgaagtttgtcgccggc

SEQ ID NO: 39644 - DNA, 831 bp, Heterodera glycines
tttaaaaatggaattgaaattattcctgttttttaaaatataaaaaaatttatgattaaaaaagagagggacaaatctgctacgaaaccctacaattgtacaagaaaattaaaaattttcattttttacaaaatcaatattttaaactaatttatgcaataattacaaataatttcatattaatttaataatttaaaagttttgtgagaagcgacggacaaggcaattacaataaaactttaattatttttatcctgccaaattattattggaaataataattgaataaccttcaaataaaagtctaattcaaaaacgaaaaaataaaaacaaacaatgttgaaatgaaaacaatatagaaaaagaattaggtaaattgaaaatatttgacaaattgaaaaattaaaaatttgcattaaatttatagaataaaaaccagtgatatgattgaaactatttaaagataataaatattcgcaaacgttaaaattaaaaatttgtttaaaaaagtttttaatacaattaaaaaattattgtaaagggaaaatcatttagcagtaaataagctaatttgaataaagcaattgtcctattaaattagaaacttaaatttattaaataacagctcattaaattttatcaaaacaataaatctctttttaaaataaattaaaaaaaactgtgcaatagaatatatatcattaaaaacacatcaccaagaagaattattaaatttaatgataaaattagctgtgctttacaattttgaggtgcaattcttttacgataagattttttattaaatataaataaaaaaataatgcatttaaa

SEQ ID NO: 39645 - DNA, 814 bp, Heterodera glycines
ccccccccgtaaaaaactgttcaatttcaaaaattttccttccacccacccctccccccacctcttttacaccggccactctcactgcgaaggggtggtctcccattcattttggtgccctttgcgagcgaaagcggagccccgacatttgcggcccgacttttacagtcccgacatttgcggcccgacttttacagtcccgacatttgcggcccgacttttacagtcccgacatttgcgcctatgtccaaaattggattaaaagttgaattttttcaagccctgatagcctaacagcattaaaattaagaaaacacggtcttctaatttattaggaacataattctttattctttttttaatttactgacgatcaaatgaccggatacattcaccttcaatcagggacggtcccaggattttggcttgggggggggcacctccccccgtgcgacgaccttttttttttttttgcttttcacacccgttttttatgtggcgcggttttttcagggggtccggtggggtggatatctcatttacgccatacaattcgttgcctgcattgatcattcttctccaatccttcccaacccccgccacattccatccaaagaacttatgccgtggataaataaccaaaatgtttttctttttctttttttgctctttttaattttggaaacgcatgaggcggatggcgtcgcaaatggctccgtgcagagagtgtgagttgttggaatatttatttgctcagagatcactcttcccctttggggcttcccccttgtctctttttggccactcctactct

SEQ ID NO: 39646 - DNA, 670 bp, Heterodera glycines
ccacctcttaatcactttttgtcttttccttttctcctctcttaccttcggcttttgccccgtcgtccgtcccaatctctcccctcaaatcagaggtgagaatttcggcacaaattggaagaagaacaaaggaaaggagaaaaagggaaaagagaaaagcaaattgggggaaaaacggagaaaccatcgcccgagggaatttggggaattcgaaaattgaaacagaaaaatgggagggaattcgatcggaaatgggagaaacgaagtgacggacgatgggacgaaggaaagtgtgaaataaacaaaaggacaacagacacatttggaggaggaaaaagcggacaaaaggcaaaatgagcaacagaacagcccatggagagagagagagagagagagagaaagagagagaaagagagagagagagagaaagagagagaatgagagagagagagagaaagagagagaaagagagagagagagaaagagagagagagagagagagagagagaaagagagagagagagagaaagagagagagaggggagagagaggcacatgccgaattcggacaaatgccccccccccctctttttagggtcaattttaattgtttataccgcgaattaaataaaaagtcctttaaaattgcatcatctcctccattaacatg

SEQ ID NO: 39647 - DNA, 1601 bp, Heterodera glycines
tcaacctgttggttgatagtctcgacttggttctctatgagtgagcggaataatgcgaattagcgatcggaggaggctggaaactgaaatcgctgacgggccgacaatgttgcgaggaccgaaattggccaagtgaggaggacaccggtcggaatgacttggctaaaaggagatggaaaggtgaaaaaaggaatagcaacagacagtcctttggatgacaaatccaaatctaacaaaaagcgtaccgttcacattccatcctcccaaaattggacagtgctcgtacgaattcagttgttgttgttgttggtggtgcagttgttgtgcaacaaaatgaggcgattggcgttgcgaatttgtaccagaatgggtggaatcgtctgtatcttaagagagaccaaattggaattagaaaaacgcagttgtggttagcgttcactaaatttcgtaaacaaaaaaatgaaaaatccatcaaaattagtggtaggctatgcaataagttctgacttctcacattcccttcacacctgatccggcactgctgtgcgcctgactgccgagactcgacggttgctcgtctggtgaaatggacgtttggttctttggtggaagtcgccattgactcaatttgcttccttcctgctaaaggcagagttattttcggcaattttattaattgttttaccagcaatggcttttgactgttcaaatagtgagtcgtctgcggtgccataatgtccaatgttcccatcatttttaaatcttgaaattataaacaaaaataagaacatacatatttgaatgtaaattacaaaacaatgaattgtcgagatcgactgaaaagtgcttaatttttttaatttccaaatacatatttaatttttatttcttacgtacaaaattttctaaaattttcttagcacgttgagtaaaatattaatagtccaagaaagggcgtttacatattaatttcgtgaagaagagaaatagggaaggaaaaggatggagaaaatgggagtctcatgaattgaagtgagaaaaggaaaagcagcagaaaggggagggaaaagtccaactgacgggggagggcagcaggacacacccatcagactcagtaattgtagggacagcaaagatcgataggcttttgctggttggaagaatggggggggggaaggaatcccgaatacatatttctatggattcatttgctttaaatatattttattcattaaataagaaattttcaaaatattttttgaaaattaatgagaaaatgatggtttttgtcttgtcatcaaacggcgcgtaaaaggcctaattagtatcataaaaaatattatttattggtttgatggaagcaggcgaaaatataaagttaaagggaagaaacattggagaggaagtgacttttttattaccaaacggagtttctgtactgttcatatatcatccacacacgcatatggattatttgtcgatttgtgttggtaagaggggaacctccaaccaaaaagtgctttctttttactgctcctgctgctgttgctgctctgattgaatcggaatggagttttaatgatggacggacggacgaatag

SEQ ID NO: 39648 - DNA, 903 bp, Heterodera glycines
cctggattttcctggatttttgtacaggaaatccaggtccaagtcaaatgtgaaaaaaaatccaggtccaagtccaggcaaaacaggaaaaaacctggattttcctggacgaaattttagaatttattttttcaagtgaccaatgttttttcaagttttcaaaaacagattaaataaatttaaaaacacattattattattaattagatatttttagatgcttctaagcaaataattaattttttcaaacatatttttgatttttaaaataaatttcaaaaaatccaggtccaggcctggatcctggtctcgaggagcctgaatttttcctggacctggattttcctggatttttgtccaggaaatccaggtcaaggtccaacatggaatccaggtccaggtccaggcttttttcaaaataccgatctctaatatggagacaaaatttaaaatttttacttagaattgatttaaatttaagaaattgctggatgcttggaacaaaattctttagcctaaaaacgatgaattttttttcggaaaataaaaagttttggattttaattttatttccaattttggcttgtctatcatttacatgaaattattgtaaaagaaaacatttttgtaaaaatatggccttcatgggtgtcatatttctggaaaattggcttttgccactttttgtcgcatcatccaaaatgttttttggcacccacaacaatggcaaggctcggcgagagtgggcagtacttttggcacactgcgggagccgagccgtgccgttgggacaaacagtcctgtgaatattggcacaacagtaccgggacccccataataatgaatggaaggaggaaaagggccccccccctccggggatcccttaacttgaaaaaggatctt

SEQ ID NO: 39649 - DNA, 874 bp, Heterodera glycines
accgtgaacattatttctattgagtccccccccctcccacgccgttcagagcacgacaaatatttcaacaaaaattttgaaatcatgtttcccactcccttctcccaggggtattattttgtaaagtcttttttccccaataaacttgtcaaaccccatttttcgcaccgtgaatgttatttttattgaattctgaaccgttttgagtagattagactataaaaaattgaaaattttgaaatcatgtttcccactcccttctcccaggggtattattttgtaaagtctttttttcaaaataaacttttcaaaccccttttttcgcaccgtgaatgttatttttattgaattctgaaccggtttgagtagattagactagaaaaatttgaaaattttgaaatcatgtttcccactcccttctcccaggggtattattttgtaaagtctttttttccccaataaacttgtcaaaccccatttttcgcaccgtgaatgttatttttattgaattctgaaccgttttgagtagattagactagaaaaaattgaaaattttgaaatcatgtttcccactcccttctcccaggggtattattttgtaaagtctttttttccccaataaacttttcaaaccccatttttcgcaccgtgaatgttatttttattgaattctgaaccgttttgagtagattagactagaaaaaattgaaaattttgaaatcatgtttcccactcccttctcccaggggtattattttgtaaagtctttttttccccacataaacttttcaaaccccatttttcgcaccgtgaatgttatttttatcgctcttagagccgttttgagtagattagactagaaaaaattgaaaat

SEQ ID NO: 39650 - DNA, 688 bp, Heterodera glycines
cgaaatgaaaattttaaaattttcaagcaaataatggccttttatggaatttccccccccaaacgaaaataaaaaaattttatagacaattttcgtaacaaatagcactcaaattttcaaatttcccggcggcgcctatcagcaccgccggacctccattttccactatttttacaagtttttgccttaaaacggccaaaattgggtctttttaatgaaaaagtgcagtttttacccagcagcgtgaaaaaatttttaattgggtaaatagcaaaaaaaaaaaaaataggtcttcaggtcgggccccccccccccgaaaaaattttctagatacgcccctggggtgtacccgccggaccccattttaccatatttttgaaaaatggagaccaaaatggcaaaaaaaaattattttttggcgaaagtggctaaaaatttttaaaatacatccccataattcgggatttcaaaaaaaacgaaaaatacagccctaaaatcgactgaaaaaatacacccggatatttaagagaatttttgtctgttgcctttattaatgctaagaatatgggcattaattaagtaagaaaaagaatgagctaaaaaactgaggtggttattcagtagacgcgtaaaatttcccgattttttttttggtaaaaatcgagaaaactcataaaaattactaggt

SEQ ID NO: 39651 - DNA, 1292 bp, Heterodera glycines
  misc_feature (1188)..(1188): n is a, c, g, or t
cacggcggggcttaaaagcattgtactgcataattaaaagctaaaataattttcgtatattttttcacaatttatttcaaaaagccaaaaaaaatgattcaattttgaaacgaaatagtgcacaaaagggagggatggttagacgaaaagaggaatttttagaaaagagcgcaccccatctgatattcccatttttccgttccacaactggccaaaggcgactgtgctcattgacacgtagttgtccaataaggtacttggactttccacagtaaaatgtggtacaaaattttggaactgtcccgcctcacggcggggcttaaaagcattgtactgcataattaaaagctaaaataattttcgtatatttttcacaatttatttcaaaaagccaaaaaaaatgattcaattttgaaacgaaatagtgcacaaaagggagggatggttagacgaaaagaggaatttttagaaaagagcgcccccatctgatattcccatttttccgttccacaactggccaaaggcgactgtgctcattgacacgtagttgtccaataaggtacttggactttccacagtaaaatgtggtacaaaattttggaactgtcccgcctcacggcggggcttaaaagcattgtactgcataattaaaagctaaaataattttcgtatatttttcacaatttatttcaaaaagccaaaaagtccggaaccaattttaaaaactaaaatagtgcacaaaaggggagccgccgcacggcggggcttaaaagcattgtacagcataattaaaaccgaaaataattttcgtatatttttcacaatttatttcaaaagacaaaaaaaatgattcaattttgaaacgaaatagtgcacaaaagggagggatggttagacgaaaagaggaatttttagaaaagagcgcccccatctgatattcccatttttccgttccacaactggccaaaggcgactgtgctcattgacacgtagttgtccaataaggtacttggactttccacagtaaaatgtggtacaaaattttggaactgtcccgcctcacggcggggcttaaaagcattgtactgcataattaaaagctaaaataattttcgtatatttttcacaatttatttcaaaaagccaaaaagtccggaaccaattttaaaaactaaaatagtgcacaanaggggagccgccgcacggcggggcttaaaagcattgtacagcataattaaaaccgaaaataattttcgtatattttttcacatttatttcaaaagacaaaaaaa

SEQ ID NO: 39652 - DNA, 1383 bp, Heterodera glycines
tatataaagccttttatcgcggcataaatatttacaaatttttgattttttgccttgttatgttttattatgtttaataatttttaaaattaaaaatttaattaaaatcatggcaagttttcattttagacatagtcaaaaaaaatcattggatttttaaaaaatatttttatggaataaatattttattttaattcattggaataatcttttagatattcttgattctggccttttatttttacattgagagaagccctttagttttaatttattataatttaatgaattttatctcttggtaggtattctactggtaatattctttttcaattcaattccctttattttccgtttttttcattttaaagatttttttaaattatacttttcattatgcttttattaatccataattttgtactatcattttttattatcatatatacgtcttttaatcattcctcatgcatatgtgtagaagtaaattatttcaaacttatggaaggtttgcatgtgagtttctttttttaatataaaaataaaacttcattagttttaattattttttattataatttaaaagtgctaatatattttaactatttagttatatttaatttgtttttttatatttttatgtataaaataaactttttcttatatttattaataaatattttgggatttttttggctgcaagcagcagtaataactcgccaagcatttttatgggtaattgtatatcttatatatcaatcaatataaggtttaaatcaggccgctaactcttgttgactgcgctggattcgtcaaaatcttaattgctctcggcattatatttcagaatttagttgcacaaaattcatatttctattttaattttaaggtagaactcaaatcgaaaactataaagtatattgtgatatttttttatcaatcgaagatttacagtaatttattattttttgttttcactcgaaagttttttgtttcatcattatttttatttaaggtctatttttttacagttattcattaattatagaaattcccaggctcattcataaacaatttgacttaaaataattatttttaaataatttatcttttgacaataataaaaaaaataccaaataagttagaagacttattttactaattatttcataagttctgaaatttttaatttatttttactgtttgattcaaagataattttatgttaacaactgattggtcaaattttaattctatactgtaatatatttcagtaataattcaattttacataaaaatgtcgctcttccacagcagatggtccaattgttcccatccttgataacacacttattgtaattggcgcaaatattttatttatta

SEQ ID NO: 39653 - DNA, 796 bp, Heterodera glycines
  misc_feature (50)..(50): n is a, c, g, or t
tttacgccgagctttcaatctagtaattctttcaaatcctttagaggggncaaaacccatcagagctggaaaggggctaccctttgaaccaactcttacagaggccaagagaatatatatcagatttcctagcacttcgtagcgcaaaaaacctttttgatcgatctgatactttccacgtttttcttttgtatttttcagttcgcttcttgatccaattcaaatgggcgggatttgtttggctgatattcttttcctcctttactggggtagtggttaggaacttttctactaatttgattcggcttatcagaaagagcataaaaatttgcttaaattcgatggatagtgaggtttatattttgcttgggatcgaaaaagttgggccgctaatgtcttttatggctggtagccgcaattgtcggaccgcaaatgtcagggcaccgtctctatgatagaacacaacctatgtcaaacacaaggacaattcttggaaattgaggactcaaaaattttaaaaaaaaatgtttttttaattttttttttgccaggtgttgggccagtgcaaacatccgttccacatgcattgcattgtgaagtggacgaacacgcaaagcgggcagaagcccgcctgtccgctgtgtcgtcaggagtggaaatttgcgaccagctgattttttgcggggaaggcgaagaagactaataatgacttaatgtttttgttagggttggcaattattacatttataaattcttaaatgtataaataaataatcgtaaaataatgtgttgactg

SEQ ID NO: 39654 - DNA, 1015 bp, Heterodera glycines
  misc_feature (52)..(52): n is a, c, g, or t
  misc_feature (64)..(64): n is a, c, g, or t
ttgtttcaaccgcgcagagaacctgcgccaactgcctttggcagccaaattngagagcgaaagngaactgcgcgaacttctttctgcttaagtgctcaaagtcggagcaagaagaggaagcggaaggctgctgtttggcgtcggcgttggcgtcggcacgcgtcgcttttcgagaaaaaaaaaaccaaaaaacgcggcgactgaatgaatcctgttagcaaactgagttggttgattggtccgagtcctgccagcaaggagggggtccttcccgtgccgtagtgctgcagcttccaccaccaccaccaactcctaacctcccaccaccatttcctacataactgcccaactttctcctcgtccccccccctctctctaattgcctccattcttcatttatttattcattcattttgtcttcgtgttctcttcgactctgctctgctgctgtgctgctgctgatgaagaacagaattttgggggatgttgttgagctccgtgcgctatatgccgatgctcaagattaaatcccctctctcttccaatcattcgcataaactgaatcaaggaggaggggaaggaacaaatgggagacgggagagggggagggggggggggaaagtgtggttggttatgtggcgccatcatggggtttgggttgtccggattggcgccgccgatttgattagtggcgacagtgacgaagacagtttcggctaaaatggattttggagatggacgagaggagaggggaggggggggggaagttcagcactttgtctcctgacttatgggatttttgttcatcgaagttcagagcatgaagtgataaattgaatttagtggctggtttctgcgccgcaaaacgcatctttccctcttccgccgatcaaaaatgaaatgaaattgaaatgggaagcaaagggaacgcttttctctgtgctctgatcagtgattgatcagataaccatgggagtggtgccattggaaaaaaacacacacaaaatgttgggca

SEQ ID NO: 39655 - DNA, 981 bp, Heterodera glycines
aaaaaatcgattttttgatatcggggcagtcccccgtaaccgatgcgctcagatctatgggagaccgaatctttcgggagtagctcgcgtatagtctgtactttaattctgcgttggatttttgctccccataatgtttgagtaccccaatcggacacttgaaaaaatcgatttttttgttttcggggcagtccccccgaaccgatgcgcccagatttatggggagaccgaatccttcggaatagcttccctatagtctgtactttaattctgcgttggatttttgctccccataaatgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttccggaatagcttccctatagtctgtactttaattctgcgttggataggaagtcccccataattgtttgagtacccccaaacggacactg

SEQ ID NO: 39656 - DNA, 964 bp, Heterodera glycines
caaacaaaaatgggtaatgggcaacaaaaaaagtcaacccttatttattaggatgaaagtactggtttccaaggacagaaagagaaaattttatgacaattaataaccgcctaaaagcaataggaaaaaaattttttgcttcaaaaaaccaaaattaaaaaattatgattgatttcacaggaaattttcttgtgaaaagatgcattttaacgagtgtaaaataagtttaaaggacgcgtccttggaaattagattcaattaggcgaattttggaattttaacgaatttttttaagaaaaatgtgaaatttgccttcttaacagcccttaatgaaaatattttaaattttacaattaaaaaaatgtagccccaggctggctgtatatatgtttttaatgagtgacgtcataatggcattttccaatgtgcctattttgtttgtgccaaaagggcacacaaattgagctgctaatggccggggatgaataaatcatcatgcattcttcagaaagttgttgatgaatgagatgacagacagcagctcagttggccgacgatttttgcgtcacaaaattggcgtaataataacaaaaataaagtgttggcaatttatgtttttttggaaacgaaataattgtggtgtcattagtggcagaaaaaaaaaactagatttgagaaaaatggaacagaatgccaatggaacagaattaaaaaggatgaccggtcggggagctataattaatagagaccggatttttgaaatggccgggaacaggacctggaaaatggacggggatgggttccggggaccgggactcaagttttttcgggattcccggtactttgcccaaaaaaaaactgggaccacaagtcagggtaaatccaggcgagggttcggtcccatccgttcagtctctaataattaattccccataattaacattccttaatgaaattgattttt

SEQ ID NO: 39657 - DNA, 144 bp, Heterodera glycines
actttttctatgccatgagtgagaaattctgcgcataaaagggcacccgtggccattcacttcactcattccatcgcccgtcactcattttcttccctttcctttgtcttccattcattccgcttttccctccccatttctcaa

SEQ ID NO: 39658 - DNA, 1009 bp, Heterodera glycines
taatggttaagttttatttcatgaatatacttaaatcttacataaattgcttaaatctttcattattaaacaattttttttgcttacctcggattttccactgtaaaatccaatgtaaatttttttacaattttctatcaatataacatcatccactggtataaatttctcaaattgaccatgtttatcagtgaaaatattcgagaccagtaatctctggccataaaaaatgttaatcatctaaatgataatttaaaaaatatattttaaaatatttataagtttatatttaatataaaatatatatatggttattagtgctacaatttttaggttttacttatttttttctggactacctatggactgaaatggatgaaaaacatgttttttcggttgttgttaagctagttttcgaattattagcaactattttctagtcttttatttttagaatctaaaaatctaaaaaataattttaaaaaataatttacaattattttggcgttttgcccaaaatttgttaacaaaaatgcaataaaaacgaaaaatgctcccctaagaattgacacaaaaattccagaaaaatacacccaaaaatatgaattttgactgacaatcgctctcgtctttctcccgaacaactcaaaatgttacttgtttgcaacgtgaatctcaatactgattttgttccaaattctgttgctttttgagtaaaattttacgattacatccctaaatttaaaactttttggcacctattttcccatttttactaccttttatggggttttttaaagcctaaaaaacattaccacagtttcatcattctctttgacctctctatagcttaattcgccttcaattttcttgccaattttaactgttcctgtcaaaagtttaaagaattcatcttcattagcgtcgtcatcactggtaacgtcgtcgtcattagcattcacattgtgttcaccataaaagtatattttgatcaaaacaaccaataaaa

SEQ ID NO: 39659 - DNA, 450 bp, Heterodera glycines
agggaagttgaccttgaccatatggaaatgggccatggcataatccgcatgattggctgcatacttgggctactgactttaaaatacaaattcttttttaaattaattattttttcattattcgaaaaaatgaaaaataaaaacctaaaaattaaacaagtaaacagattaatttattaaagtttaatgaaattttaaacagattaatttattaaagtttaatgaaatttaagaattttcaatattaaaaagactcaatttataatattggttgtttaagaaaccaaccggaacattgcaatgtgtgacaaaattgaggcaagactcttccaaatcaaagcaaggcggcacttaaaataaacaagctatttgtaataataaaaggatcagtctgcctccaccaccgccaaaaattgagccgatttgtccatgatgccaagcgggaagagg

SEQ ID NO: 39660 - DNA, 1294 bp, Heterodera glycines
acctcgaacagttgccgttcattttccacgccgaaaatcgcctgccaggcaatttggcaagaaaacgctaaatgaaaaaatatggaaaataaatgaagaaagcagcccccaacccaaccttgatcaccgaagcggctgtgtacacgctgatgtttgaaatgttgacgaggcggccatgttgctgcaaaatgggagattttttacgatttttatatagtatttgccacattaatttttcaaggaagagggtttaagcgctcaataatttttgaaaaatgtctcaaaattagctcccttaatatcattagggattgccaaattaaatcgtaaggttaggagcggaaaaaaaaatatttttgaattatttttcaaattttatcattgactgtgagaagtttttgagttagttcgaaatcccgactcgctaacagatttatcgcttctttcctctatccctagatcggattccacctctacaaatgtgtgtgcccacttgatacaatgtaatttctgaaatggcactttctaccgatagcccttccaccagaaaatgccaaaatcacaaaagcattttgcttttttaaatggaggcccataaagccaaccaatgctgccaccacttaccataatatgggacagtttgcgcacttgcgcctggttgcccggcgctcgccaaatgtccttcttcaacgggccctctttgttcactttgagcaaaagcacctgaaaatgggaaggcatcttcaatctgttaggccaaccaatcaatcatcttatgacaaataatcattattttgttgagattggaataaacaattggcaaatgataaagtttggtgaacggaaggatggcaaaaattgatcccatttttatgggttttaaacattggaaatgattttcagcatgacattcattattgtgaatgccttacaaatttatttataaaaaatcaatgaatgaatcattaaaaactcattgaattttgaggaattgggatatttcgaatccaacctatatagatatttttttaaacaggaaattccaatttgtaaacatgtctttgtattattatttggtaataccaaccaaaagtgtcgccggaatgtccggacaaaaggcctcgttgacgggaacgccaaatttgactctgtgaaaataaatggcatttttacgtcgtttgttggggccacaaacttctcaatgcgtcctctgtaccgctgctccatctcatcactgccgcacaacactaaaaaacgcgtaaaaattagacaaattaaaatgtgaaaaatatta

SEQ ID NO: 39661 - DNA, 131 bp, Heterodera glycines
tgttcgtcggcgcgcgccgcttccgcaccgcgcttgagcttgccgaacaggtcgaactggtagctgaccgcgaacttgccgtcggccaggttgatcaccggcagctcatgctcctgcaggaacgattcggc

SEQ ID NO: 39662 - DNA, 1134 bp, Heterodera glycines
  misc_feature (1107)..(1107): n is a, c, g, or t
tagaggtagtagcccaatatcctaaatttgtttttttactatttttgtataaaatttatgggggaaaaaattactcctcaagctcatccgcaataattgtcctacgctcatgcaactcaacagcgaactaaatgtgggaattgcattaatgtttttactaatttttattttagatttaaaaaagatgattgaatgaaacgaaattgactattttatgaacggttttaaaatcatcaaaagtaagactgttaaaccctgatgatttttcaacattattttagcagtttttagtttaaaaataactaaataccctttcaatcgcactccaatttgcttccaggaattctttggccgcttcagtcgactcgtcgatgacctttttgattgctcgatccagagctttcttcgcattcttccacgtggcggcttccatcccctttttcaaagcagctaaattttacttatgccacttacaagggaacactccgattttaaatgttaagaattcattgattcagtttggttttttttcgctacagctccaatgatcacaaaaatttttccaaattcttaaaaaaagatcgaaaaaatacttttaaaattatcaaagctttatgcatattcaatcccctgttagcaacgttgggttttcacagcataaattaaacctcccgcgcgttcacggtggcctcttcaatgtccccttcgtctccgtggctttcgcccaccaacaacaattccaccgctctgcagggcctgaatttgtttgatcaaacaatttctcggctgcactgcacttgccaacatcagaccttcattttctggcgtggcaatgttcgtcgcagaaatgaaatcatgcggcatgtgtgtttgcatgatcacggcgaccgaatgggcggcctcatgccctgcgaccaacgctggcgtagagtcccctgtgtctcgtgccatctttatccccttataaaacatcgcattttctgctgccattttttctcggcttttcctcggggcattttctaaagcaatattaaaaagtagagtgccacgggaccgggaatttttgccaaaaccgggaccgggacttgccgggacctgagaagccgngaccgggacctcgattttttttcggga

SEQ ID NO: 39663 - DNA, 639 bp, Heterodera glycines
  misc_feature (629)..(629): n is a, c, g, or t
aaaaatcttaacaaatcgtactaaaatcaaatttttcccggcggcgcctatcggcaccgccggaccctcccccctcgcccatttcccaaaagttttttggaaaaatgcgccgcaaaaaattcttaaaaatctgattttttgatcccaagtgcactgaaatttacgatttgttaatttcctcaccaaaatttttaaaggttagactaattaataaccctttgctcattcgttcctcgccccagtgcctccccttgggtaatatttattagagatcgacattttgaaaaatgcctggacctggacctggattccatgttggacctggacctggatttcctggacaaaaatccaggaaaatccaggtccaggaaaaatccaggctcctcgagacctggatccaggcctggacctggatttttttaaactcattttaaaaatcaaaaaaatgtttgaaaaaattaattatttgcttagaagcatctaaaaatatctaataaataataataatgtgtttttaaatttatttaatctgtttttgaaaacttgaaaaaacatcggtcacttgaaaaaataacttctaaaattttgtccaggaaaatccaggtttttcgtggtttgcctggacctgnacctggattt

SEQ ID NO: 39664 - DNA, 1117 bp, Heterodera glycines
cattaaattttcaaccaaaattaataaaaaaacaaatttctgttttaaaatcatagacacataaaatcgtagatttgatgattttgccctccctactgctatcaattgaaagcttagtctgtctgtggaatttttaagtgccgaaattctggactaataggaagaattattcttgaatacctatactcgaaaaaaaattgaatttcatgttttccattccctttctgtggatggttattgaatggatgcgtaaactgtgcaaatacataaaattgaagttggccctcttcccccccccccccccaagccaggaaactcgacttttaggctttttgttcgaatttcggggatcagcggggggttaaaaattgatcggaacggttggcgcgatcactgatcagcaaacgcgaaacattcgccgaaacgtgaattcaaaaattgtgggaagggagaaaagcgtttagccgccgcccccactttcggtgaaattggtgcgcacagcccatggtcacacgcgtgattgagctcaatttgcgccggcacatcatgcatttctcccgcgcatttgcatagcgtgcctgaaaaatcggcaaattaaaaaaagacactgaatcaattagtgtacaaattgcccccccccccccccctcgcgcgtcactcacaagtccggctcgtccaattgcggcacgcgctttcttggcatttcgacgattgattttgatggtccgtgctcgcgctgctgatgcccttgtcctggccgttgttgctctgaccatcctgaaaaaagggcacaaaatttaatacattttgaaaaccgaaataaacaaaacaaaaaaaaactgacgggaattatctttattgtacagcagcagcaggatgaagattcgaccgatggagggaaaagaatggaagtgagtgcagcaattaaatgaatggatggttttggtggggaattcaccgcttaaatacggagaaaaatgccattttttctcagtcatacagaaatttgaacttttttttttgtccattttttggtttgaattcatcaaattcactcttccgctctgtccattttctccctccgtttgtccctttttaattgtcctaccattttttt

SEQ ID NO: 39665 - DNA, 1372 bp, Heterodera glycines
ttgagaatttaatgaaaagccctaaatgttaagttattctcgaccacattaaataataattacgttataaaataaatccactggaaaaataatcaaatatcaataaaataaatcatttcaatcaatttaaggtaaataataaaaaagcttttaaattaaattaaaaaaatttattgaatattaacaggtcgaaaccaagacggtttccgtttttacgccacgagagtaaaaaagtaaaaagaattaattgtcgactctagataaaaaataaacctgaaataataaatattacattattaaaaaatgccataataattaattatgcttttggttttgtacgaagaggaacaaccgacgagattattataaataaaaagaatataatatccatattttttgaaagttatttatttcttttatttaagaataataaaaattatattaaaaaaaataaaatcaaacacttttaatttaatataagattatcattaagaattttatttattttttcttataattgtcaagttatcatattttatttatttcgtcatagcaattttatattaaactaatgagataacgaaaaaacaaagttaaaaaattatagttaattcaaaaagaaaaaaattaattataattaacaataaaaaaattactttctaaaatttatacaatttccataaattattatatattttttgcatcatttaaatttcattaaaatagattgattataaatgcaattgataatttttctaatttaagaaaaacatattcattaattgaacaaaataaataataaacaatgaaaaatgtaaattctttaacaatatttaaattaatacaatttctaatatttaaataacacaagaaggaccatttttattgagatgaactttaattctgggaaattgatcagcttattagttaactaattgactgtactgcatctatatcagggttcggattcatccttgaaaggcaaggacgtccttgaaattgggccctctcacttgaaaatttgaaaatatctttgaattcaagatgcctatgaaaatgagtactcaaaaaaacagtcaaaattttatagttttttataattttataccaatattttttattattttatggcatttttttgtgcaaaatctgttactaaaaccattatatccgttattgggaagcgagttttatcgtatcatccgaaatttaagtacatactcatgaatatgctgttaataattgttatttaacctttcttcatttttttgcttttaaaagtattaaatgaaataaatttggtataataatattcagcacttatatactttctgttatttagtactatatttgaaaaaaaataacctaagaa

SEQ ID NO: 39666 - DNA, 961 bp, Heterodera glycines
  misc_feature (907)..(908): n is a, c, g, or t
  misc_feature (914)..(914): n is a, c, g, or t
  misc_feature (945)..(945): n is a, c, g, or t
gagaaaaaagagatacccattttttggccaggaatttttttggtaaccatttcaaatatggtgtaagtgtttggtagagccggattagagaggcaaattgttgttaccaagtttgcgttcaaatccccagaagaaaaaggagatagccattttttggccagaattttttttcgttagcatttcaatatcgtgtgagtgtttggtagagccagactagagaaggcaaatgttggtaccaagtttgcggtcaaatccccaagagaaaaaagagatagccattttttcggcaagaatttttttcgttagcatttcaaatatcgtgtgagtgtttggtagagccagactagagaaggaaaatgttggtaccaagtttgcggtcaaatccccaggagaaaaaagagatagccattttttcggcaagaatttttttcgttagcatttcaaatatcgtgtgagtgtttggtagagccagactagagaaggcaaatgttggtaccaagtttgcggtcaaatccccaagagaaaaaagagatagccattttttcggcaagaatttttttcgttagcatttcaaatatcgtgtgagtgtttggtagagccagactagagaaggaaaatgttggtaccaagtttgcggtcaaatccccaagagaaaaaagagatagccattttttcggcaagaatttttttcgttagcatttcaaatatcgtgtgagtgtttggtagagccagactagagaaggcaaatgttggtaccaagtttgcggtcaaatccccaggagaaaaaagagatagccattttttgggcaagaatttttttcgttagcatttcaaatatcgtgtgagtgtttggtagagccagactagagaaggaaaatggtggtaccagtttgcgggtcaatccccnnagaganaaagagacagccattttttcggcaagaattnttttcgttagcatttc

SEQ ID NO: 39667 - DNA, 946 bp, Heterodera glycines
ccccgggagggggggggcggaaactgtggcccatgggacagcatttgcgggtctcggacggataacagcactcgaagcgatattttggccgaaagggtaaaattttgcgggaaaataagtgccaaatggcattgcccgaggcaaaggatgaatgaactgtttgataacggaaggaaaaaccgatgattggacacacattctgtgttccgtgcggcgaaaaagtcgcaattccttgcaattttacgacgcattgtaaaaggcagacaaatttagagggggggggggggggaattataaaaatgcccaattattaaaaatattaaaaggggagagagggaaatcagcaaagtgattggtcacccactgatcagttgcgcaatgccaacgggcaatttcaatttcaatgaatattatatttttaaattctgaattcagatcgctttatttctcctccaattttcttttggctaaatttcgaaaattgatgaacaccccgaggcatacccctcttctgcccccttctctcctcctcccctctccgatcactcttccggccgttggctttgtaaagagtttggcccctccggggacaactgcccccgggggctggaagattggattatcggaggattattaatggcgttttttgggtttggagtgagtatcagtgatgagaagaattcataaattatccgccggccgaatttcgcggaacattgcgattggccagggcacctcggcagaaaatgaatgattgttttgctgagggccaacaaatcgacatttggaggaccaataacaaagtttgccgaattggaaaaaaatagggaaaattggagggaaggggggggggggattaaatcgaaggggattaattaacagggaaagggtaattaacactaattaacagacaattaaattaataatccaatttgaaaaaataata

SEQ ID NO: 39668 - DNA, 119 bp, Heterodera glycines
atcccggataatggcgtaacaatcccagaacccatgcacgaaaggacggcccagcaacggcttgataccttgcgtgggcattacctcccggatatcaccttcaggccaactggcgatga

SEQ ID NO: 39669 - DNA, 885 bp, Heterodera glycines
gatctggtggtcaatcacaatgttccccgctgttctaaaacgtatgtccatcgtgtcggaaggtcggccagggccggacgttttggggcggcggttactttcgtcacacagtacgacgtgcttttgctcaaaactattgaggtgaggtgggaacggaagatgcatgtccttcccttacggtattgttttgaatttcagggggtaattggtaagcaaatggaggaattgaaagtgagtcacaaagaagtgtcgctctacgctggcaaagtattggccacaaaaagggaggccgaaattcgaatgcaacggcgaggctttggagaacgacgggaaatatggaaacgaaaggaattggccacggaaggactgagtgaagaagaaatagagaaggcaattgagcaatggaagaacggcggaagaaaaatagtgaaagctcacaatcaacacgaggcagaagaaagtcaaaaggggagaacaaaagagtgaaaaccaacacaagagaatgaccttgaagaatgccgcatttattctttaatgtcctcataatcagcaataaaactagttggaaaatataattttacactttctcatggatataaattcaaagaatttaaaattattagacgaagagatggaaagtagcttttgttcccatcttcaaatggcagaatggtccaacccgcactgctccaaactgttgttgtacagaatttcacacgcgatttcgtcttctgcgaattggtgcactttggcctctttgcagtcgctagaagaacaaaatgaattttacaggatcccgcgccgtaaggacctgtaatattttcccggaacgccgttaatttgtctacttagcgctaaaaacaacggtgtctgagctccggcccg

SEQ ID NO: 39670 - DNA, 1178 bp, Heterodera glycines
  misc_feature (1143)..(1143): n is a, c, g, or t
  misc_feature (1168)..(1168): n is a, c, g, or t
aagtcaaatacattggcagacaaaacagcggtcttgcttcgttgggtggaacggaaggcgatgaattcgagcggggaattggaggggaaagggaggggggggggaaattggaagaaaggggagggaatggaagaaagggggagggaatggaagaaaaggggagggaatggaagaaagggggagggaattgggccgagtggaacggaccgacggacgcaacaaaaagcacgggaattgataatgcaaactttcaaaaaataatcatgccgtgagcaaattttattttttcgcaaaagttgcaagaatcaaccaaccacagcaaacattgggcgggggggggggaaatgtctgccgacgcattgccaatgagtgatcaattggcgaagcgcctctccccttaataaaagtgattagctcgaccatcgtatgcctcccaatctgctcaatatccgcctttctattagcggatgctttcaagattctcgcgcaatgttttcgtacttttattggcgatttggggggaaggggtcaatctcttcccaccattaatagcagatgaacaaatttcacaattaacaactaaatgaatcacactaatggctccgtctgctggtgcctttttgtggtgtcttccgtttctctgtttcccttttgcctccgattgcgtcggccccccttttcctcgcccccctcccgccactcctcttcctcctcttctcggtcttcttcttcctcgctcttcctcctcctcctcccccaccacaatccaccgctccttctcgtccttgcgcttttcctccctctcctcttctccctcctcctccgtccgtttccctcctcttcttcttcctcctcttccgctttttctctgttccgtcccctcccaccgctcattcgtcgcatttctctttgtgtgcggaatattatgcagaagagaattgccaaaaggatgaaaatagtgagcagaaacagaaggaagagcagcagaggttggtaaagttggccggtggctaaaacggaaaatggcaaaggacagaaatggcaacgaacactcggccacattcctggagatggcctccacgttgctgatgatcctgccgatgtcgtcacccacctaataaataagtgcaaatggcatcattnaattaagcgtttgtcccacaacgtncgcaactgtc

SEQ ID NO: 39671 - DNA, 118 bp, Heterodera glycines
accggttgattatcgttgtatagcaaataatatagcgatgagcatggcgaaacaatcagcgggatcaaaccggatgcgggtactcgggaggtaaaacgaggcgtggatgcgatcctgg

SEQ ID NO: 39672 - DNA, 1351 bp, Heterodera glycines
ttgaaaatttgagtgcactttgtttcgaaaaattgcctatattcactcatgaaatttttaaattttcgtttggggggaggaattcgaagaatttttccattattcgctggaaaatttttaaaaattttcatgcctgggaggggggatcttggattttctgagcccaaaattctggatttttaattaaattaacagtcttttaaattttttaaatgcctctttttgtggtgctgttttttcaaaagattttggatttattgtggcggtggtccggcgcgccgccggaaaattttcgaaattttaagtgaaatatgttaacagaatttgccaaaaaaggaccaaatatttggttaaatttgcagttttaggttgtttaaaaaaagaaaaaataataatattttaaaatattttttattaattaaatttcaattgaaataatgtaaagaaaatagaaaaaagtatctgttcggttggggaattgaacccaggagattaacaatgaatgtcagaagatttagccactacgcaacataaggaaacaaaaaaacactttaaatgaaataaataatttaattttttctcaaaaaattctccttctccaccaatttccttctcgttttctcgcccagaccttattcttaccagtgcttatttagtcccgccgggactggcaaaaccgggaccgggatttcaattttccaaaaaccgggaccgggacctgaaaaaaccgtgaattcccgtcccggtcccgtgcaactctagaatttacataccgtattttctctaattatcccccatggggatgataattattttaaccttcctcatgaaaaggggggaggaataataaagattgggtggcagttagagaaaaacgacgacaaatgtgttcttgtggcacaaataagaaagaacagctcactcatcgattaatgatttttcgctatccattttttgagccgattataatgatactcgaaagtgccttcactgttgcccatgtcatgaaaatcatcaaaattccactcttcacaatgacacttccaaactttggcatccttatattccttggggaatatggcacgacaagagacgtcggaatcttcattcgatgccggattacggccccattcaggctagtgatgcttgccaagtttcactgataatgagtggcaattaaaaaccaatttgcgaggaaagggcacttaattaagtcggcaaatatatatgtatcatgaatgacattccgaggccccaaaagtgctcggaaaagcgtaattccgaccctataagtgctgaaatcggaagtcagaattttttatataatatattaaattttctaagtaatttt

SEQ ID NO: 39673 - DNA, 1328 bp, Heterodera glycines
attagtcagtgatagacaattaatattcaaaataataaatttgatttttatactccgaaccaaccttgtggtcctggtgcgcccggaggacctgtaaatggcagaaacattaagaaaaataataaatattcattattcaatttttggaaaacccaagggccctttaatataaattatgtttttctgacaatttcacaaagtgtggcgttttgatttgccctttttactcaccgggtggtcctggcggtgccccgttaatcaccttaattttttgagggttgaaagtgccatcaatagctacgattgttttttaccttccccggctctcctggggggcctttgtccccgggaaggccgggcggtccttgcggcccctggggccccggcggccccggcagtccgggcgctccatctctgcccgatgaaccagctggcaaatttaacgaattcttaaaatttcaaacaaatcccaccttcgccttgggggcctggcaaacccttcggccccggtggaccaggcggacctttatgaggaaaagttttcaattttcatggagactattattaccaggcggccctggagggcatttttggcacgggggttttggaggctgaattttttagtttttttttcaaaactcatctccacgtctcaccggtccgggtaaaagcacgccatctcttcctggaggtcctgggtttccaggacgtcctggggcactgaaatagggcacaattcttttatccacttaccccgggcataatttgctttgtctaactgacccgggccgtccgtctctgcccggcggtccgggagggcccggcgggcccacttggcaactgcagcagctgccgccctgcgggtttccactgctgcccggcggcgaaccgccccccgctacagcacccgctagcatttgggcatcatacgccgtagtgccaacagtttgacgcttcactcgtgcagcggtcacagccagcggggcggtgccgttgtcggaggacgtcggcaaaccaccagtaatcgcctggacgtgcagcatttcgcgccacatatcacgcgagcgcgtctaaaaatggcatggcaaaaatatagtagatgcctgaaatgctcgattgtctcagttttgattagatgaaaactttgggttttcgtggtcttagtctcatcccgagtctattctcgagacttcttcagtccagtctctaattttttataaaataaattctctctttgtttgccatcgtaaaagtcttctcggtgaccaattaattattttagcaatgaatgaatgattcgctttctctcaccttgcaaaagtcgactt

SEQ ID NO: 39674 - DNA, 914 bp, Heterodera glycines
ataaagaaattaattcattaaaaattataattcacaaatttaaatacataatgaaattaaaaaaaaatccgcaaaatttttcatgccctaattaatttgaagaaaaaacacctgtggtcaatggcatggcaaaaaatcattaccactcaaaatgttaacatgatcgagacttttgagaattacttcaaaattttcattgaaaatttagattttgttgcaaatataatgaaaattttgaaaaaaaaactcaaaaaatccgccaaatttttcatgccttaatttaatttggagaaagaagatcactgatggttaatggcatgccaaaaaatcattttctgtaaaaatgcttatatgagagagattttttaagattactttaaaattttcattcaaaatttagatttatttcgaatgattaattcagtagcaatgaatctgtccggtctatacaaattaaaaaaatatatatatataattttttaaaatatttatttgaatttttaaaatatatatttttatataaataatattttttgaaattgatttaccgcaacaacagtcacaacaacaatcgccacagcagcaaccgtcgccgccaaagccgaaaccgccgccgaagaaagcggacacaacacacacaacgctgagcagaacaacaaatgtgctcatgaacaagcaaaattgcctgcttgagaagagacgaaattatgttgaaatatggcaaaataaaataatttaaaacaaaaataaaattttgcttctatttcccaataattaagttaagattttccaatatttatactaacgataaattcatttaattgtttaaaataatttatttatatggaagtgaatttaaaaattaaattaaaattatagcattaactggtgtgaatattaaaaaaaaaaattga

SEQ ID NO: 39675 - DNA, 974 bp, Heterodera glycines
  misc_feature (901)..(901): n is a, c, g, or t
ctttattataagctatttttccaaagccaacaacgccctttcttccctcttttctgttagtcatttctcattggtgttgactatccaacattcagtgtacaaatttgttaaacctctcaacattttaaatcaaaatcctaataaaaatttcgttgaatttcttcgcctcttatttgtgcaaaattttcgaaaaagtaattttctatttaaaattaaaaaattcagaagcaaattcaagaattttttttatttataaatgcattttttaccacatgaattatgtttaaatttttgcgtttcgaattcattttgaaattaagaaaaataaaaattgataatcatttgatcatttttagcgcactttaagcaccgccgttaggcagcgcagttccaaaatttattccatgccacagatattatgggcaggacacgccaagtacctcaaacttgggtaattaaaccgaagaaagaagtgcagtggggaagaatgacgcctaaaatgaaggaaatattcgatgctgtgcgaactctttgtgacccctctctgactctgccaatgcaacagttgtccatttttaccactattttctctcactcatcgtctgctcgtctctcctttattataagctatttttccaaagccaacaacgcccttttctccctcttttctgttagtcatttctcattggtgttgacgatccaacattcagtgtacaaatttgttaaacctctcaacattttaaatcaaaatcctaataaaaatttcgttgaatttcttcgcctcttatttgtgcaaaattttcgcaaaagtaattttctatttaaaattaaaaaattcagaagcaaattcaagaattttttttatttttaaatgcattttttaccacatgaattatgattnaatttttgcgtttcgaattcatttttgaattaagaaaaataaaattgataatcatttgatcatttttagcgca

SEQ ID NO: 39676 - DNA, 829 bp, Heterodera glycines
  misc_feature (46)..(46): n is a, c, g, or t
  misc_feature (50)..(50): n is a, c, g, or t
  misc_feature (91)..(91): n is a, c, g, or t
  misc_feature (94)..(94): n is a, c, g, or t
  misc_feature (100)..(100): n is a, c, g, or t
  misc_feature (111)..(111): n is a, c, g, or t
  misc_feature (113)..(113): n is a, c, g, or t
  misc_feature (115)..(115): n is a, c, g, or t
  misc_feature (117)..(119): n is a, c, g, or t
  misc_feature (130)..(131): n is a, c, g, or t
  misc_feature (140)..(140): n is a, c, g, or t
  misc_feature (143)..(146): n is a, c, g, or t
  misc_feature (148)..(149): n is a, c, g, or t
ttaaatactgaaataagtagtaaaattgttgacatcagtaacaganaggngctaaaaacgcccaaaatgccaaaaaccttcgaaaagaggnggnaaaagnggaaaaaaccngngncnnnaggcacagaannaaaaaaaanggnnnncnnaatattttgtgttaatggaactttaaaaaatatatatgaatttttaatcattattattagtgaatatgtagagaccagcacgggatttatccagtttgcacttgcgggatttgcggtattataaatatttttgaataaatttattcaaaaaggtcctgatttttacgattcgtatttgaaaagtagaaaagttcctgatttttacgatttgtatttgaaaagtagaaaagttcctgattatacgattcgtcctgaattggagaaagacaatatgaaaaatagaaatctcctgatttttactattcgtatttgaaaaatagaaaaggtcccgatttttacgattcgtatttgaaaagtagaaaagttcctgatttttacgatttgtatttgaaaagtagaaaagttcctgattatacgattcgtcctgaattggagaaaggcaatatgaaaaatagaaatctcctgatttttactattcgtatttgaaaaatagaaaaggtcccgatttttacgattcgtcctgaattggagaaagacaatatgaaaaatagaaatctcctgatttttactattcgtatttgaaaaaatagaaaaggtcccgatttttacgatttgtatttgaaaagtagaaaaggtcctgatttttacgatttgtatttgaaaagtaaaaatgttcctga

SEQ ID NO: 39677 - DNA, 936 bp, Heterodera glycines
gatgcgtaatcagaaaaaatggtcagattttatgaccaaggacctcgaaatctatgggaacatagttgtcgcgaatttttcagacaaaaaacttgcaaacagcgaaattgggtcctacttggtcttaaaataaacgcgttttttgagttttttaactttttcatgtcttttaaaggctgtaacttttgcgagaaaactaataatttggtctctgaagacacgtataactcccgatttaattttgggtacaagttttttgggtttctatattagctgaactctatattatgtataacatgctggaagtggtaacatggtgaccacattcatcattgccaattttgttgccaaatttcaaaaaaaaaaattaaaaaaaaaatttttttagtcaaatgccattccaacaaaatccattttttttctttgctttcagtgtccgtcgtcaagtggtcaacatcccatcatttgttgtccgtctcgactcccaaaagcacattgatctgtccgcaaagtcgccgtacgctggcggtcggccgggccgtgtcaagcgaaagaatgcgaaaaaaggtgccggaggcggcggctcgggtggcgaggaggaggactgatcgacgatgatcagttgataatttttttttgttcgacaccccctttttgttgaaacacaatgttgattaaagcgctttgttataacatgttcactaaagacccaaattttgaaatgaactgggccgggcttaccggataaaagtgtgacaaatactatgctgacatgttttcatgacaaacccaaaaaacagcatttgaaaatttgcgggggtaatagtttagatggtacacccccttttttaaaaatttttttcaattttcaaaaaatcataaaaacatgtttctagaggttttcgaggtcgctgatcagcaatccgacatccattt

SEQ ID NO: 39678 - DNA, 1084 bp, Heterodera glycines
caaaattaaaatgttttgttgcatagcattaatgttaatccctccctgagggttttcccgcattattttggattattatacttcctgcaattttacaccgcaacctcccccgtcatccgccaaaaagaaaagatttttaaaaatatttggaataacttcttttttttcaaaattattataaaaaattaatattaaaattattctttgtttaaattatttaaatatttgcatcaacatttttcttttatgtgtatgaaactatttctttatttagtctaaagattaaattttaaagaatcaaactgaattttctccccggaattcctttgaaaattgtttgcttttcttaaaagctaattttgttgcattttttgacaaattccggccctccatatatttatgtgagtatgggataataaaggataaaaattgaaacattcagaaccatcccagccattttttgacttttagcgaaacgctttatttattgtgtgcacaaatataaataatatttatttgcgttgtagagtttgtaaatgtatgaattagtcagcagttttgagcacaaaataaatttcatatgtgtcattttttgataaaataaattttatcaaagttattaaatgtcgtttttttaaagaaaattctattggtcctttttgacttttatttgtttaaaattgtttgttaatttttgttattattactaagaatttcacatctacatatagttttattattgtttgtcctttggaaagtttccggcttaaaatggatatataaataaggctttattgcaatttaggcgtcaaatcaatgatcatctcagtttcttaggctaattactaggtcaatgcttacacggcatcaaatgtaagctcaagtctatataatttattttgggtttttggataaatattttctaggccaaagtccaccgatcaaaaatggctctagtgcactttatgagtccaatttcagttctttggtcattacttttttcttgcttggtcaatacctacattcttggtatcaaatgaaagcttaaagtcccaggaattcataaacacaagaaaagagcaaa

SEQ ID NO: 39679 - DNA, 201 bp, Heterodera glycines
cctttttatttgagagtttgcaatttcctcaaaaattcgaatttcgtttttgcccaatgttttatgggccctgtgcttcttctgcccattaatcatttacaaattcgccttcgcatttgtttttccccctgggaatgtgccaaaacatcccaatggattttcaacttatccaattcttccctaatcacattatcccccctc

SEQ ID NO: 39680 - DNA, 892 bp, Heterodera glycines
gaaacttacaagggaactatcgaactgtgattttgtgactatgtgaattgaataattaaattcaatatattttttaaattatttttcttaaaggcccattttcggtcaaatattttgtcaaagatagagaactttttggtgatcattaaaaaaatatataattataattaatcatcattttagacttgtttatgctttttaaaagtgagcacttttatcgttttttcgcatctttgaccgattttttctgatattttttggcatcggaaacaaagttcacaatagcaactcaacatactctacaagataaatgtgcttttaaagtgagatttgggcaattacagttcgatagattcccttgttaggaaggtaccgtacatttccttttttgtttgcctaccgtggtctcgtactgtgacaattgtttcgctcctttgctgttccgggcaattgccgcaatccgaggatgcttttcgctgtgccacttttcgctgcttccgctcctccaaacacttcacaaatgcactacggtaaaagcagtgtttgacctcggcattcttgctgatcaaattctcgaaaatctgtgcacatttttttaatctgttggcattttgatcaatgcaaaaccaaaccttttccatgatttttagcatgcccctggagtatgacttcggacattctcgcagatgacggaggtccacaattaaaataggaggatatttgtaacgaatggttttttactctttgtactttgaaatactggtgatgaattgccattttctaaaaaattttatcctattttcgaggtattacagtcataatgtccccatttgtctgtcagtggcattgtgccgtgtcacaaaccttcttcagctgtagctattgttgtacc

SEQ ID NO: 39681 - DNA, 968 bp, Heterodera glycines
aaaaaccatcaaatggaaaatttttgacagaaaactattcataatttcgcataaaatagatcaaattttataatctagatatttttcgatagccctaagtgttttctactatcttgcaaaatttttaaaaaattctttaagtttaaaaaaagttgtgacctgagaagctcaaaaacccatggttttttgaacattttcagtcataactttcttgaaacttaacgaaactttttgaaattttgtaggctaatagaaaacacttaggcctatctaatgatatcaagaattaaaaatttagttgcttttgagcaaagttatatcaaaaaatattttcatttgatggttttttgactaacgcccattatgatggtttttgactaacgtcatagcaccgtccaattttcctttggtgtccaaaattccgacggtgtccaattttctggtgtccaatttaccaccccccgatttggacgaacttgaattttacataaacgctcccgattatgtgagtttgttttttcaattcctcattgggtttctcgggttttagttttttttacaacgcacccactgaaaaaatttaaaatttttatcaaattttttataagacttaaatttacataaaagctaaattttaggtgccgatccgtttctgaatttcgcgcaaatggaattttcgataatgaattgtcaaaaaattgtcttaaacgcaaccaaactaattaattcttgtctaagcaggttgataataagtgaatataaaatttggttgcttttgagcttaaagctatgaaaaaaagcatttgcatttggtggattttatattagccaaccaatggtggcagaatttattttataaaaagttaaatttttttttctagttctttacgtccaaaacgggtcggggtcacttcggcgcggaccatttaggcgccgcaaatttgaaatgctataacttttttatttgt

SEQ ID NO: 39682 - DNA, 326 bp, Heterodera glycines
ctaagacagggcttcgatctgtccttatttataagatttgtccttatttggagggtccaaatcttacagaataaaaatgttcggcgctagtttaaaagaggagtcttttgaaaattttttcacttttttttttgcctattttttttgtttatttattttgacgcaaaatgtgttttttttaacagatggtacgaatgacaaaaaaagcaacaaaaaaagtgaaagattttgaattttatcaaaaaccaaaggggagacccttttgtttcgcaaaattttttgaaaaaaaaaatcgagaatatacttttaatcgccataattatgct

SEQ ID NO: 39683 - DNA, 743 bp, Heterodera glycines
tttctagggagcaaaacacgaaaaacttaaacaaaacccttgattttggccatttaaatgaatattaatattttatagtttttcaataaggaaatttttaaacctaaaattttttatcaagaaaaaaaatgaaattttgtgtaacaacttttgataaaatttttcaattcttaatggtatattttctgaatttttttagatcatttcttagggtttattttcccgattttattgaatttttcggaaaaaacgctaaaaaggcaccaattcgctaaaactaatctttggggtttttgaatgaaggcaacacacgttttttggctgcctttttcgatcattttcccaacctatagtacaccgttcaatagaggtttcaatagccctacaattttactcagaagagattttcgtttttttctattaatagaaatagtttattacttttttggaaaaaataaacaaattcaaaaaaatcgaaataaaccgaaaatttttcctcagttttttcgggttttaaccgaaaccgttcgaccgaccctcttttccggtctctactaaaactcatattgactgtacaacaaacaaatttataaatagaggattttatagcatgtagtttaaatggctctattccagtttatgcgtccaatcaatgtttacgcgtccaatgagtgaccaccctcacttttttagatcataactttttttcttactttgtcaatccatgcattcttggtatcatt

SEQ ID NO: 39684 - DNA, 919 bp, Heterodera glycines
aatatcgtgtgagtgtttggtagagccagactcccctaaggaaaatgttggtaccaagtttgcggtcaaatccccaagagaaaaaagagatagccattttttcggcaagaatttttttcgttagcatttcaaatatcgtgtgagtgtttggtagagccagactagagaaggcaaatgttggtaccaagtttgcggtcaaatccccaagagaaaaaagagatagccattttttgggcaagaatttttttcgttagcatttcaaatatcgtgtgagtgtttggtagagccagactagagaaggcaaatgttggtaccaagtttgcggtcaaatccccaggagaaaaaagagatagccattttttgggcaagaatttttttcgttagcatttcaaatatcgtgtgagtgtttggtagagccagactagagaaggaaaatgttggtaccaagtttgcggtcaaatccccaggagaaaaaagagacagccattttttcggcaagaatttttttcgttagcatttcaaatatcgtgtgagtgtttggtagagccagactagagaaggcaaatgttggtaccaagtttgcggtcaaatccccaggagaaaaaagagatagccattttttgggcaagaatttttttcgttagcatttcaaatatcgtgtgagtgtttggtagagccagactagagaaggaaaatgttggtaccaagtttgcggtcaaatccccaagagaaaaaagagatagccattttttcggcaagaatttttttcgttagcatttcaaatatcgtgtgagtgtttggtagagccagactagagaaggcaaatgttggtaccaagtttgcgggtcaatccccaagagaaaaaagagatagccattttttgggcaagaatttttttcgttagcatttcaaatatcgt

SEQ ID NO: 39685 - DNA, 1316 bp, Heterodera glycines
tagaatttggtttgttattctaaattattcacctatattagacgatgattttatagccgattaaattgaatatttataaattaagtatttaaaattaattttctttcattgttgataattaattaaattttcatttgatatactttttaagttgtgaaggagaccaactctattgtaaacccataaagaggaaataacgtaacctgaagttggtcatatgcaccaagaaagttacgattaaaggaattacaaggatttatttatagaaaatttgatttattaaatagcaaattatttcattaaagtatctttatggtgctatttaaaacaactcgtattcgatactcttgtcaccaaatgtacgagagataaaattttagcatttttataaatgtatagaggtttctgtgcaggcgaaatctaagttgatcataagaaataaaaaaccattagaaaatctgaaacaaatatagaagaatttaaaagggaataattaaatggccaaaactgatgttttcatataatattcaatgaattcttaataaaaagtaaataaaagggaataataaaacgcaaaaaatttaatattagccaaagttaattgtactggtgattgttcatatttcttttggtatttcagcgctatcagccataaaattggtattgtatttttgaatttaattaaatattatttttattaatattaatttcctatttttatttattcgtttcacattgaaagatttttggcaatattttatttcaaagatgatttcatcaatcatcaaaaatttgactaatctttatttttattttgttgtttcggcatctagcaattttttctaaggtccaatgctcgttaattctataatctgtccaatgctgcgttaattacataatcattttttatttacattattatttttttataggtttttattttaatttgtgttataatttttagtactcaatattttattagttttggcatctatttttctatgtggagtaatcattgtcgagacgataatgttttttaattttctcgtatcatttttatcaaatttgcatcaggaatattatgttgcaagatatcactattttcatttataagcttctaacatacttataaagtataagaatattactcattctctattatttatatatatgagaccatcataaaaagctttagttacttttttaaaaatgcagtacatttgagcattttgttcattttattttttttgttatgtccgaagataacaaattaaataagtttatttgccgaagaaaaataaataacaaataaatgc

SEQ ID NO: 39686 - DNA, 937 bp, Heterodera glycines
cgggacaggttttttggcctcacccccttaaacgcccccgggactcagacctgcgcaatccccgttccctttaacttcgcccccgcgggggcgcgggggtgaaaatacacccctaagaatggcatattcgtgggataaaagattaaaaatttatacaattttgaatttttttttacccatctttgacaaatttttatgaaataaaattaattctgcttttatttctaaatatatttgtggattattggttagtacttcaactctaacataattttttgttatgagttagataccggttgacgttttcttttgaatttatttttttctgattaatagacaaaaacacccataaaaattgaccattctttgcataatttgttaacaaatttaactcgacttttcaaaaaaaaaattccggtggcgcagataggtgccgccggatgaaaatttcgttgaaattaaaaagttcaattttccttgagtaaatcaggaaaatttaatatattataaaatatttttacaaaatacaaaagaaaacaaaaatgtatcgaaaatcttaatttttttgatgaatatctgttagaaaatagagcctaaattttaaaattcgccggcggcgcctatcggcaccgcggcccccaaaaacctattttttcttaaaaaattagccagaatccctaaatttggtcatcttttagacaaaatctgtgcaatttattccaaaaggaattgattcgatgcgatacatcgactaaaggaatgtgtagccaaacactcattcataaaaattaattttttgtgagattttttgggagctaattcaaatcaaacccctgcccccgggggcgagtcatttggtcacccccgcccacgcgactctgacccccgccaaccccggttcccgcgaaaagccacccccgcccacaaggctcgaacc

SEQ ID NO: 39687 - DNA, 1013 bp, Heterodera glycines
  misc_feature (121)..(121): n is a, c, g, or t
  misc_feature (186)..(186): n is a, c, g, or t
gagaaatttatacgttacaaatgctctcgagcatgatagaggggcggtgcgcaatcgccatttatttctcagagaatttttaaatttatcttatatcctagaaattgactatctcttattntgagaaattttatacgttacaaaagcgctcgagcgtgagagggagggcggtgcgcaatcgccatntaatttctcagagaatttttaaatttatcttatatccaagaaattgactatctcttattttgagaaattttatacgttacaaatgctctcgagcttgataggaagggcggtgcgcaatcgccatttaatttctcggagaatttttaaatttatcttatatccaagaaaaatgactatctcttattttgagaaattttatacgttacaaaagcgctcgagcgtgagagggagggcggtgcgcaatcgccatttaatttctcagagaatttttaaatttatcttatatccaagaaaaatgactatctcttattttgagaaatttaatacgttacaaatgctctcgagcatgataggaggggcggtgcgcaatcgccatttaatttctcagagaatttttaaatttatcttatatccaagaaaaatgactatctcttattttgagaaattttatacgttacaaaagcgctcgagcatgagagggagggcggtgcgcaatcgccatttaatttctcagagaatttttaaatttatcttatatccaagaaaaatgactatctcttattttgagaaattttatacgttacaaaagcgctcgagcgtgagagggagggcggtgcgcaatcgccatttaatttctcagagaatttttaaatttatcttatatccaagaaaaatgactatctcttattttgagaaattttatacgttacaaaagcgctcgagcgtgagagggagggcggtgcgcaatcgccatttaattctcagagaatttttaaatttatcttatattccaagaaaatgactatctcttattttgagaaatttta

SEQ ID NO: 39688 - DNA, 853 bp, Heterodera glycines
gccttaaatcaaaatgggaagaatgattaaaatttgaaaatttaattacaattgcctaccatttcggcatttgtcccattgttggcattggcaccgctgtcgctcatccccgctgccgccaccttaaaccaaaattggaaaattattgatcaaaattcagaaattaatcacaattacttaccccttcacaattggtccgattgttggcattggcactgtttgttccgccgttgttcaccgccgccgccaccttaaatcaaaagggaatattgatcaaaaattcaaaactttaatcacaattacttaccccttcatcattggtcccattgttggcattggcactcatttcacaactgttgatcacattatccagttccttaaaaacggaaaaaaaatttaattttgaattttttaaaaatttgagtaaacccactttattcgccgttcgctcatcttcattcaattcaacattactttcagcttgaacaccttaaatgtgagcgggaaattattacggtaatagttcgaattcgggttcggggttcgcaaaaatacctgtcgttttcgtcctcgtcgaacatttgtctaaaatgggaaagggaaaatttattttcgaaaatttatttttttattttttttaccgagtgccaggtgtttgccgctgttgtttctgtgcctcccggtgtgaaaatctgttgaaaaaaaatcgaaataattttggacataaaaaaaaagtaaacttttttaaacaattcgctggccactcttgctgcgattcgtttttcatgacaaggcgcaccaccagtgcgcctcgcaaagtttttttgcatctcaaaacaagaacaaaaattag

SEQ ID NO: 39689 - DNA, 1173 bp, Heterodera glycines
aatttgagccacaaatggaattaatgttttaacttttaaaattgattgacaattgtaatttattccattttgtataaaaaataagtttttttagaacttttcccatcccataaagaacattaaattttcattaatttttgatctctgctgaataaatagtactgaagtgatctgataaaaattttatttggttgaaatggaaaaaagaatattgccaacttccattttctattcgatgaccaattaatttttggcctcattacggttgaaattcaaaatgaatttgcgttttttgatggcatttgccattccgtcactttttcttttgggcggtgactcgcaaaatgccctgcagcgtcagatgcgatcggatggtggccgtgtccacgtcgtccggcagtttgtagctgcgcttgatctcgcggcttatcgagccgtgctcatccgaccgttcttcgtggtgacaatagacgaacagatggtcaccggccaaactgatctaagcggaggaaaaaaagaagaaaaaaatggtacaaaatattggatttattaaaccaattatttttaaatgcctcaatttcgtcgggtcgaaaaaaggccgcgtctaagccgacctcccagcggtcgtggccattgtcgacacgcacaacgccatccttgtgcttcaaatgggagagcatttagggacggagacaaatccggcattttagcagagcaatgggttctagtcggttttacgcgtcccatgacactttacgcgtcccatcatattttacgcgtcaaaaaatgtttttcgaaccgtcaatcggaaactttataccttccgaatagtctaattgttcttgtttgtatactttgatcatcgaaatgtgcaaaagcaactctaagcacacttaatgatgtcaacagaaattcaactaatataagaaaaaagtttacaaaagcctaagcttaggcctagtctaaccataagccattgttcgagttgcctgtgtataagttgtcatgataaccttaggtttaacaacgaaatctttagttaaaaactttactgaatacctgacaaaaaaaaagtttttctcttagttattaggacaactattataccatgagaccagggatggcacggaattccgaaaatttttggggcctcggaatgccatccccgccatg

SEQ ID NO: 39690 - DNA, 893 bp, Heterodera glycines
agggaaactgcgtacggctcattacaccagctataatttttttgaccttgacttcttacttggataactgtggtaattctaggagctaatacatgcaccaaagctccaatctccccagagcggagcgcatttgttcgccacaaaaccaagcgccctccgggcgtccagtgttgactcagaacaactaagctgatcgcacggtcttgtaccggcgacgtgtctttcaagtgtctgccttatcaactttcgatggtagtgtatctgactaccatggtgatgacgggtaacggaggataagggttcgactccggagaaggggcctgagaaatggccactacgtctaaggatggcagcaggcgcgcaaattacccactctcaacgcgaggaggtagtgacgagaaataacgagaccgatctcttatgaggccggtcatcggaatgggtacaatttaaaccctttaacgagtatctatgagagggcaagtctggtgccagcagccgcggtaattccagctctcaaaatgcatagaattattgctgcggttaaaaagctcgtagttggatctgtgctagccgtccggtgcacactttgtgtgttactggtttggttggcttttctgccggtctctccccggcgttggcctttaccggtcggcgtcggtgggctggcgagtttactttgaacaaatcagagtgcttcaaacaggcgtttcgcttgaatgttcgtgcatggaataatagaagaggatttcggtccgattttattggttttgctgaccgagataatggttaacagagacaaacggggccattcgtattgctacgtgagaggtgaaattcttggaccgtagcaagacggactacagcgaaagcatttggcaagaatgtcttca

SEQ ID NO: 39691 - DNA, 382 bp, Heterodera glycines
tccaggggcgtatctagaaatatttttctggtggggggggacccgacctgaagaccttcttttttttttgctatttaaccaataactttttttccactgctgggtaacaactgcactttttcactaaaaatgaccaaattttggccgttttaaggcaaaaaacttgtaaaaatagtggaaaatgtaggtccggcggtgccgataggcgccgccggaaaaaatttttggaaatttagagttgctacatttgttactgaaatcttcgcctatataaagcttttttttttttttcccccccccctaattttcgtttgggggggggaattcgaaaaaaattcactttatttgctggaaaatttttaaaaattttcatttcgggggg

SEQ ID NO: 39692 - DNA, 1197 bp, Heterodera glycines
aaaaaaatataaatattcaaaaatttttgaactattgaaaaaatatttattgtaaaaatccaaacacaaaaacaataaatattaaatgaatttcttttttccaattagcgcaccgatgccgaactaatttatcaaaaacatcggccaaaagtgagcttgcccgctttggctatgaggtcaaattcgacacagcaaaatgcggcagcaaatgcacaccggcgcagttcgtccatggccgatttgggaggtgcaaaaataaatttgtgattgattaaaatttttaacatttaaaaatatttatgtaaataattttaaacggagaaaatgaatgctttcagcaaattttaaaaacatttttgtaaatttttcaagacttggtaaaacaatgaagcaaaaaaaaaaaaattagacattcaaatttattaataaataatgctaaactaattttatctaatttgaatatttttttaattattaaacttaattactttttcgctcgaatgaaatcggttggccatgcaatgaaaacggcggcggaagatgagttacggtatgaaatcattcgatttgccgcccgaaccacagcacatggcattccgatggtaaaaatttattatttttagagaacagcaaaaaaaattaaaattttaaaattaaattttaaatttgaaataaataaaaacctgaaattctaaatttatcaaaatattatagaaaattaaagacaacgttcttaattttctggcaaatttgggcagtattttgaagcaaatttataaggacaaatcctagttctattaaatgcatacaatcaaagatttaaaagattaaaagatttattaacaaaattttaaggggttcctgaaaagccgagtttaaaatgaatttgaataaaattttaaggctttcaataaaacccgaattttcaggaaaatttaaaagaattatattgatttacttaaacagacactttcagtgaaaattatatttaaaaaaactttggaaatcaaataaaaactaaaggccgcgcatgccaccagaatggaacgcccaaatgaatgtggatggccatttctttggcattcggttggcattttttggctcaatgtgcacgggggtgctgcaaaaaatatggccgcagggaccaaatccccactgttcaggggaaaaggacgtaaaaaaaaatttaaaaaaatt

SEQ ID NO: 39693 - DNA, 776 bp, Heterodera glycines
ataattataatttaaatacaccaataagttaattagtaaaaaatggtaaaagaagaaattaaattattagtatgcacgaaatattaataagctaataagtcaatttcatttatccaagctgcagcaagatgcggcggatcagaagattaaaaaagataaccaaaatttaacaaacaaaatttagctttttacattgaatttaattaaaaaagcaactagacggctctgagggcatgcgtgccgagtttagagtgccgagcctagccgtttataaacggtgaaccgtcacggtctagaccgtcgcggttgttagtacagtagcagttaatggtgcgtggctggctgttcgtgcagcagcagctacaggaacatgcgtggcattcgcgtttaatttatttaaaaaatgatatttaattttaaaaaataataataaaaaaagcaattttttctcgctgggtggttgggagaatggggggcatcccttttttcgccgaatgtccgcaatttcataagccaatccaattggcctgattattttaaatattttttaatttaaattcaactgtttgccgacccgcaatgtcatgatcagttggatggctttgtggacaattcccaggcggggcaaacccacaaaatgttggcaccggagcatcgccaaaaaaaagaaagggccaaaaaagggaaaattggtgaaacaaatgaaagggaacaaaaaatttataatacccggagaaaatcttgccttggatgaaaaaaaaaaatttaaaaaattt

SEQ ID NO: 39694 - DNA, 1284 bp, Heterodera glycines
gaaaaaatactcataagaatcgacactaaattttcaagaatacatctatatgaaatgaaaaattttctcaaaattcatctaaaaaatttattaatttatttcatgacaaaattagattttaaaaattctttatttcaatactgatttgggttacttttggtgatttttgagtaaaatcttacgctcttacacctaaattttggcttttttagagcgtattttccattttaaatgcctatttttgagggtttttaggactaaaatatacctttttgcgatttttagagccgaaaaattgcatccctaatcattagggttggatttatatagttcaatattgataagatttcaaaaagctaaaatgaagagaaaaataggggcgaaacgacaacaaaaggacacctctgttttctaggcagaaactaattgagggtgtagcataaacaacaaagtaaattaccaagaatagttaatttttaattcctaagaaatcgaaattcgggtagccctttaaataaaaattaaaaaatttgtttttataaaaaaataatcttacaagaaatcgtctcgaaaaataatccaaaagtccagttacggatcaaaaagcaaaagactgtgtacatttgtaatttttaacttttggttttttgattatttttattttttaaaacttagtacgacttgttataggtccaaaaaaaaatatttatttttaatgattgttaataaaataataatctcaataatttaagatggaaattaaaaccaaatcaaactgtacaacttctaatactgtctacaatattaacaaaattgatgaagcgtaatttgaaattatttttaacaaactataacgccaattattaattaatgtgagaagtttcttgtttttatgttggcaattgaagtggaaaattctttcttaaggattcaggaaaacattaaattaacattaaagttctcatttttatgcattttgcaaatttgataaacccagttttgtcatttaaatgccaattaggttttaattgatgtgtgaatttttgttttttttatgcttgcacaaaggtgcatcgtcattccttcgcattggctgcccgtactgaatccgttggtctctgtgtcagtgactttttgtcgttttttagagaataaaagaataaaaaaaataggggaaaagcgacaaaaacgccctactttgtaggctaaaaaaaattagggtgagccttaataatactacaaattaccaagaataagtctgaatttttttcttaataaatcatg

SEQ ID NO: 39695 - DNA, 1050 bp, Heterodera glycines
gcgctccaccgtcacggttgtagctgatcatgaacttttttgccatgttgattaagtcaagctgttgttgctaaataaggcgagaggcttttttgataggtctgattgtcactaatcagcctattttgatcactattttttccctgacaagcccattgatcactaaactatttttgtcactgatcagcccactgatcactatttttgtcactgatcagcccattgatccactgcttttcgctaccttcttttgttgttgttcgcctcctgcttctacccgcatcttctgttgctgctgcttcccacgcttaatcatctgctgctgatcagatgccgctgctgctgctggcggcactatttgccaatcacccccggcggcacgcttactggccacaaaatggcgtgtcggtatcccaaacagtgccgggatggaaaagcgaatgtgtgccgtgggttttgtggtgccagaatttcccgcattttgttccagttcctgttagtaattaattactaattaattaatactaattagatccgcaataatttactgacgcctgctatactgaaatctttatgaacttttctgtatgcttttatggataattgcatccctcaaaaattgtctaattcctgaaattcgtaaattctaattagttaaatcaacccgggttttttttggcacaataattaattaattacctcgatggcggcttcttctctttggcggttgttttcctccagcatttgcttcaccgcacccgccaccattgcctgttcacgttgccactgatgagaaaagaaaaattattaattaggcaaaaaaaaacgcatgcatacagtaacccgagcaaaataaattattgctctacagtaactcaaataattactgctcgttcccggttaaataattagtggtcgttcaataatcccaccaaaataattagtgctcctacagtaaacccattaattagtattcgttcccgttaattaattcgtgctcatacaatagtaccacataataattagtgcccgtaacgcatacagtattcc

SEQ ID NO: 39696 - DNA, 920 bp, Heterodera glycines
ccccggtacaggactaacttaacctgaaaaaatgacaactctacccagattttaaatttttttagaaattctgagtttttaactgtttatttattttttgcaaaattaattcataaatattttttcagaaagggctctgaaacgcataaaattttatgtacaagttaaataaggctctctgatgcttttactatcaaaaagggagatgaataaaatttttaattgctttttaaacatgccaaaaagtttaggcttaaattaaaaaaattttcttcggttctagctctttcaataagtaataaaatcgtaccaaattttattggcatactccccggtacaggactaactttacctgaaaaaatgacaattgtaattgattttaaatttttttagaaattctgagtttttaactgtttatttattttttgcaaaattaattcataaatattttttcagaaagtgctctgaaacgcatcaaattttatgtacaagttaaataaggctctctgatgcttttactatcaaaaagggagatgaataaaatttttaattgctttttaaacatgccaaaaagtttaggcttaaattaaaaaaattttcttcggttctagctctttcaataagcaataaaatcgtaccaaattttattggcatactccccggtacaggactaacttaacctgaaaaaatgacaattgtaattgattttaaatttttttagaaattctgagtttttaactgtttatttattttttgcaaaattaatcataaatattttttcagaaaatgctctgaaacgcatcaaattttatgtacaagttaaataaggctctctgatgcttttactatcaaaaagggagatgaataaaatttgtaatttgctttttaacatgccaaaaaagttaggctttaattaaaaa

SEQ ID NO: 39697 - DNA, 934 bp, Heterodera glycines
atttgcaccccgcaatgtgcctggtattcggacgcatcctccagggaattgcgcgaggcggccgctcgcgaagtgcgcagagcactcaccggcgcaattcctgaagatttgaaggcatcgttcaagaataatgcttttaaaaaatctcattttatttatttttttaaatttttctcttttgttcaatgtaataagtagggatgatatttgtaattgctaaaaatctgccaaattagttagtttttagtttctaaaaaaaaaacccccaaaatagttgaattttatccaaaaagcaacaaaattaacaaaatcagtattgagataaataatttttaaaatcacaaattcttgttaacaaataaataaattttagagatgaatttttgagaaaatttctcatttcttaggggtgcatttttgaaaattttcgggtagatttttagaggtgttttttttgaaaaaaaatatgttttttttcgtgcgtttcaggccacgaggaactaaagaaaaataataatgaaaaactaaaaatcgtagccctagtaataagagatgctttgctaatttattgtaatttttaattgggttttaatataattaaactcttttttcgaaattccatttttaaaaaatgccaaattcaattttcgccgcttttcagaattgtgtgaaccgtgccgaactgatggctatgaaacggctgatcgccgttggccaactctccgctttgggctcctccgcctcggcgagtgctgctcctatgccttctctgtttgcggcccagcaacagtcttcaatgttggcacagaagcagcgcgtccaaatgccgtcgatggcatcgggcggtggcacggccaatttttcgtcgctggctcaccaggcgatgttcaaagaccatcatggaggagcagcacaaatggcacagatcccatta

SEQ ID NO: 39698 - DNA, 949 bp, Heterodera glycines
ccccgcgcccataagcctcgctttgtcctgcttcagcttcggtttgttggacacaggcaaatcgacgaagggaggcgtttcgaagccaaatgatttgcagacctttcaaaaaatgattctgtaaatttccttaatgtttcgggaaaactcacctgaacgaggtccaatgtgttcacattgtaaatctttttcagtgaatgtgagtcatacgcccgaatgtaaccccttaaacaatctgtaaaaacgaatcgacaatccgtagccaaagggcacaattttcaaattaggggggggggggaggaaaagcaaaatttaccgggagttaaaggaaaaccgtttgactgagaagatttcgccaaaataccagttgtactaggatttttgagtacaaatttaaaagtagtctcggatttctattattttcacgatccctatccgtttttgtccaaacgaaaagatggcggcttttccccaggctacggcattcgttgtagcccacttgtacgcctctcgggccgatttgttcaagtaataatttcgcgatatcacttcctccagttgaggttgaatattggccaatttattccacgagaattcgtactcattaagagtcactttcgctgcctgtcaataaaatttgttttttaaattttccattgccaactttgagaaagcgaaggaagccaagctcttccggcctcaaaatgagcagagcgtgtcctgtgcccgtgtcaccgcgcgccgtccttcccacccggtgaatgtactcacgaggctcatctggcggatcatactggcaaaaaatgggataaccaggcccataaccaaggagaggagaacgggcccaggaccccaactttatttttgaaaattgacccaagaatggcaaaaatatgcattttattttgtttattttggcaaagaacggctgcgaatttctgcttcttct

SEQ ID NO: 39699 - DNA, 951 bp, Heterodera glycines
tataaaacgtccaattaaaattaaattttaaaaatttaaaaacttttgcgatgcaatttttggaaataaaaataaaaatatgtgaagggaattttgttaatagatgaaaaattttaacaaatgttgtagtctttgaaacaaaaaaataaaattttaaaaataaatttaaatttaaatagacaaataaaaaaacatattaccttaagttaattaaaataaattaaaaaaacatattaccttaagttaattaaaataaattatctcaataaaattttatataaacagagaaattaacacaaattgagaattaaatttaaaaagaaataaaatcaatttaaaacaaattcaaccaaatcaacagtaacctgggaaatcgaaatgtgtgattaaatagaacaatcaggtgaaacataataatcaaaaatatttacaataatatttgtaatatctgatataaattcagtgattaatcaaaaacaaaagtaaaattaaatatgtaattatataaataaaaagaaaagaatctaaaatttatttaattatttaattatgcatagtttataatattagaagccattcaaaaaattgaataggaaaaggcaagctttaaaattttagacgacattaattcaaaattttagaataattttaaatatatctatgattagggcgagaaaaatgtttacaaagtgtttaaatttattttaatatatttttattaaattaaaatttttaaataaaaatatatatatgtgaaaattaatagacagtagcgagttactggacagattgtaatttacattaaactattaattcaagaaggtgcaaaaaaattactttaggacggactaaataataataatacaatagtaatcttcaaaattgattaaaaatggattatatcactgaaaaagataacctctgaaatattaaaagtttaaattttattaa

SEQ ID NO: 39700 - DNA, 841 bp, Heterodera glycines
  misc_feature (386)..(387): n is a, c, g, or t
cccccccccccccccccccccccccccccccctttttttttcttttttttttttttttttttttttttttttttttttttttttctcctagtcggtgcgtatagtctgcttcacgggggggcggggggggggggggggggggggggcggggggcggcggggcggggggaccccccctctccgccttttttttttttcttttttgttttgtttgtttgttttttttttttttaaaaaaaaaaaaaaaaaaaaaaagagaaccccaccccgcccgccctcttttttttttttttttttttttttttcctccccccccccccccccccccctctccgatcggagggcgggggggtggggggggggggggggggggggaagaaaaagcanngatttttttttttttttttttttttttttttttttttattaaaaaaaaaaaaaggggggggggggggggggggggggggggggggggggggccccccccccccccccaccctcccccccccccccccctttctcttttttttttttttttttttttttttttataaaaaaaaaaaaaaaaaaaaaaaaaaaaaggagaagaaagggaagagaagggagggggtgtggttttttttttgttttttttattttttatacataaaacaccacccacaacaaaaattttttatttttttttcctcccccccccccccccccccccccccccccccccccacacaacaaaaacaaaaaaaaaaaaaaaaaaaaaaaaagaggggggggggggtgggggggggggtgttttttttttttttttttttgtgagaggaaaaggaaaaaaaaaaaaaaaaaaa

SEQ ID NO: 39701 - DNA, 532 bp, Heterodera glycines
ccccccccccccccccccccccccccccccccccccccccccccccccccgccccccccgccccctcttttttataaaaaaaaaaaaaaaaaaaaaaaaaaaaaaaaaaaaaaaaaaaaaaaacaaaaaacaaccccccccccctcccccctctctttttaataattttatttatttaaattattattttattatatgtggagggggggcggggggcccgccccccccgccccccccccccccccccccctcttctctttgtggtgtgtggggggggggggggggggggggggcggcgccccccccccccccccccccccccacaccaccccccttttttttttttttttttttttttttttttttttttttatttatttaggggggggggggggggggggggggttttttttttttttttccccccccccccccccccccccccccccccccccaaaaaaaaaaaaaaaaaaaaaaaaaaaaaaaaaaatttttttttttttttttttttttttttttttttttttttttt

SEQ ID NO: 39702 - DNA, 926 bp, Heterodera glycines
tcgatttatgggtgtacaggatgtttgtcgaaaccccctcgtcaggcctttaagatagacctgccattgctattcccgcaaatatggagtctagtcagcccaatcgattgctattcgaatggtttggggtcattggcccaaacaaaagttgtgctgcttcttgcaaataagactgagccaactgtaaacagcaagccatccaaatgcttcaatgtaaaaaaatttacatttggatgcaacctttatttttcctcgcctctcttttcgaaaagaaaagctattagcaagcgtgtttggaccaattctaaaacaaatcggggtaattaatttaatctgactttataagataaatgggaatttaagcgaaggattcatgcaaaataatgatctatagaaattctcaaaaaagtagttcctcgcagattcgggaaccgtttctataaagctagagacatatgcgctaaccataaaaaagatgaatcattttttgaaaaatttatatagttcgactaaatttgctaatcgatttatggtgtacaggatgtttgtcgaaacataactcgtcaggcctttaagatagacctgccattgctattcctgcaaatatggagtctagtcagcccaatcgattgctattcgaatggtttggggtcattggcccaaacaaaagttctgctgcttcttgcaaataagacttagccaactgtaaacagcaagccatccaaatgcttcagtgtaaaaaaaattacatttggatgcaacctttatttttcctcgcctctcttttcgaaaagaaaatctattagcaagcgtgtttggaccaattctaaaacaaatcggggtaattaatttaatctgactttataagataaatgggaaatttagcgaaggattcatgcaatataataatctatagaaattctcaa

SEQ ID NO: 39703 - DNA, 243 bp, Heterodera glycines
cggtgtcatctatgttactagatcggggatcgatccccggtcggccgctcgagcaggacctgcagaagctagcttgatggggatcagattgtcgtttcccgccttcagtttaaactatcaagagagggaggtgggtggcggaagaagaaaagggtggggggagtatgagtatgatggtcaatatggagaaaaagaaagagtaattaccaaatttttttcaattcaaaaatgtagatgtccgca

SEQ ID NO: 39704 - DNA, 1200 bp, Heterodera glycines
  misc_feature (417)..(417): n is a, c, g, or t
  misc_feature (497)..(497): n is a, c, g, or t
  misc_feature (508)..(510): n is a, c, g, or t
  misc_feature (512)..(512): n is a, c, g, or t
  misc_feature (521)..(521): n is a, c, g, or t
  misc_feature (645)..(645): n is a, c, g, or t
  misc_feature (649)..(661): n is a, c, g, or t
  misc_feature (909)..(909): n is a, c, g, or t
  misc_feature (916)..(916): n is a, c, g, or t
  misc_feature (919)..(920): n is a, c, g, or t
  misc_feature (922)..(922): n is a, c, g, or t
  misc_feature (928)..(928): n is a, c, g, or t
  misc_feature (934)..(934): n is a, c, g, or t
  misc_feature (965)..(965): n is a, c, g, or t
  misc_feature (994)..(994): n is a, c, g, or t
gggggggggggggttggggttttatttttattttttttttttttttttggggggggggaaaggggggggggggggggcgcccccccccccccccccccccgcgggggggggggggggggtgtttttttatatataaaaaaaaaaaaaagagggggggggcggccgcccctcccccccttttttttttttttttttttttggggggggggggggggggcccgcggggggggggttttttttctccccccccccttttttttttaaaaaaaaaaaaaaaaaccccccccccccccccccccccccccccctttttttgggggggggggggggatttttttttttttccccaaaaaaaaaaaaaaaatttttttttttttttttttttttaagaggaaaaaaaaaaacaaccccccctgntggggaaaaaaaaaaaaaaaaaaaaaaataaaaaagagaccctgtttgtttcccaacaaaaaaaaaaagggtccttttantatctactttnnntnccggggggncgccccccccccttttttgggggggtgttttaaaaaaccatttttttttgtttttttcgggggggtttcccccggggaattttttttgggagggggttttttttttttaaaaattttttttaangggnnnnnnnnnnnnnatttttttttttttttaaaaacttttggggggccaaattttaaaatccttaaatttggggcaaaaattttttttcctttttccgtcccacccttttaaaaattgaattccctttttttcaaaaaaaggaattttggaaaaaaatcggttaaaaaaaatttaatttggaataattttcatctttttccccaatttttcagtttcttcaagaggttttaccagccgaagaaaagattggcatttatcagnttcatgncanncngatttncgtggnaatttactctcaattattttacccatgaaantttcgagtcattggcgaatttggacattngggacaatttcgatggacatggaagaaatgtccgaatttgcaaaagaaccaatgaagagttacagattaagtgatgataccgtatacataaaggggttttcttggaaaatattggcacaaataaaagcgaagactaaaagcactgacaatgagaaatgtttggccattttcctttggtgcaatggcccgagggaaggtagaacaaa

SEQ ID NO: 39705 - DNA, 237 bp, Heterodera glycines
aaaaaaaaaaaaaaaacccccccccccccccccgcggggggggggggggggggggggggggggagaaaaaaaaaaaaaaaaaaaaaaaccccctttttttttttttttttttttttttaaaaaaaaaaaaaaaaaaaaaaaaaaaaaagggggggcggccccccccccctcctttttttttttttttttttttttttttcttttaaaaaaaaaaaaaaaaaaaaaaaaaaaaaaaaa

SEQ ID NO: 39706 - DNA, 852 bp, Heterodera glycines
tgatgttaaattatattatacacatgaaaacgatgaccattcgaatcagttggataaagcaattgaggctatggaaaaatggtcaaaaataaatgggttagaaatttcaactgaaaaatgttttgttttatatttagggaaaaataatatgaaaaaagaatattttattaactcacaaaggatttcagaatcggataatgttcgtgacttgggaattataattgactcgaaactgaatttttcagaacacataagcaaaattatacgaaacgcatatcttagaattttctaaattttgagagtgttgaaaagcagggaaataaaaactctaacagcagcctataaaacttttgtacgacctcaattagaatacgctaccgaagtttggaaccctaatttaaaaaaagatatagacaaaattgagcgggtacaaaaattttttacaagaaaagcacttagaaaatgtggttttgtgtacaaaaaatatggggaaagactaaaaatcacgggtttacacaaattggaagaaagaagaaaaatcaatgatttaacaacagctttttaaataatcaaagggttcaccagcctcgatgctgggaaaagtttctttttctcagaaaggctcaggaggcctttatttttgcgagtaaagcgccacacggccaaaacacaaaataatttttttcataggatagtaagaaactggaataaccttccagtggtagcggtgcaaattaataaggcaaaggaattcaggggtttactaaaagcaatgagttctgagtaggattttccatgttgccatatttacactatatttttatcacctgtgaatttttaacatttgattta

SEQ ID NO: 39707 - DNA, 380 bp, Heterodera glycines
  misc_feature (139)..(139): n is a, c, g, or t
  misc_feature (376)..(376): n is a, c, g, or t
ggggggggggggcgccccccccccctcttttttttttttttttttttttttattttttttttttttctttcccccacacacaacaaaaaaaaaaacaaaaaaaaaataaaaattttttttttttttttttttttttttnttttgtttgttttttttggttggaagcaaaaaaaccaaaaaaaaaaaaaaagaaaaaaaaaaaaaaaaaaaaaaaaaaaagaagaaggggggggggggggcggaggggggggggggcgggtgggggttttttttttttcttttttttttttttttttttttttttttttttttttttttctaccccccccccccccccccacaccaaaaaaaaaaaaaaaaaaaaaaaaaaaagaanaaaa

SEQ ID NO: 39708 - DNA, 780 bp, Heterodera glycines
catctggagtgcctaaaataacttgcaaataaaatcggttcggggggaatgccccgaaaacaaaaaatcgattttttcaagtgtcctttggggtactcaaacaattatggggagcaaaaatccaacgcagaattaaagtacaggctatagggaagctattcccgagggattcggtctccccataaatctgggcgcatcggttcggggggaatgccccgaaaacaaaaaatcgattttttcaagtgtcctttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaaagcagaattaaagtacaggctatagggaagctattcccgaaggattcggcctccccataaatctgggcgcatcggttcggggggactgccccgaaaacaaaaaaatcgattttttcaagtgtccgtttggggtactcaaacaattattaaaaatttttagatttttattcatctccctttttgatagtgaaagcatctgagtgcctaaaataacttgtaaataaaatttggtgcgtttcagagcagtttgtgaaaaaatatttatgaattaattatgcaaaaaacaaataaataatgaactctcttccttaataattttcctgcaccga

SEQ ID NO: 39709 - DNA, 910 bp, Heterodera glycines
ttttaatataagcaatgaaaaggaaaatcccttcggatgaggatgtaataatcagctgaaagcggattaattacgcatttttttattaagggatgatttcaaaattaaaaaaaattatttaagtagcattgaacagcgtacaatttttggtgataaggtcaaaaacatccgagtgatgattgttctgtttgattgttaatcggctcttcgatttcactttttgttcgtccgtcattctcttaatttcttcttgtcttttcatgttcgtttatttgtcttttttttttgttcggagtttgtctttgtcttttaattaagtagggaatttcgaattaatttataattttgaatttattattgctgaaccctcttattctcattgaaaaaatgacaattacgatttacacagttagattaacaaaagaaatcataagttctatatgctcatcagcagaaaatctgcaaagccaaagctacaaccaaatcgatttaatcaatgactcatctgatatactgtatgatcatgtcaagaacaaatgtcgaagaagtctcacccattctactataagcgcatcatcatgcagaagacgaacaagacgtgatgacggtgggccatgcatgttccccttctgattcaagcagtgaataggtcacgttttacgcgctccaaaaattcccggtttttcagcccgaaaaggtcccggtcccgctcaactctaattttaagttgtaaacgcgttcaaagtttgaccttataatttcttaacggagcatataagtaggtagatttttttaaaaagtggcttttttatgattttgggaaattgtttcaaaagctcttttaaatttgtttgattaaaatcccttttccactattaaattggctttaggaacttttccgataaggaaa

SEQ ID NO: 39710 - DNA, 438 bp, Heterodera glycines
ggacgacgatggcacaactgagtatgaggtcacatcactggccctgtacgacaaggcgccatgtctcgtctgcggtgctgtgaggtattggtttggataccaatcatgcgatgagacgttcctcaaggatgaggagctgctcgaccacgtaaaattagcgagaacggggatttaagaactgaaatgcattttatagattgggtataccctcgctcgtctgatggaagctgtgtatacccatgcagctgttggtggtgtcatcgacatcgagagggcccgcaaaatgtggggaaattggcgataaatgaacaagtaatagacaaaaaaattttagcgtcatcgcctctgtggacgtgcacgcagaggattttgctttgtttgggttgattggggaagaaaggttgcccttggtaatgatgagtcatgacatgtcaacag

SEQ ID NO: 39711 - DNA, 910 bp, Heterodera glycines
acaattgcgactgtgtttaggtttttttttattggctcgacggaaattgcattggacaagggattttaatagtcggcaatcaaatttttcttctttttttttgcgtattcacagacagaggagagagagagtaaggcagctttagtaaaatcgaattttattacattttactgttggatctttgttaaaactcttgggtttcctttattacgggtgcaataccactcatttttggtttttaacaaagcggcgctgaacatcggctcaatgatcaactccattgtacgcgtccgaggccatggagccgaatgtttggttggtgagccaaaacggatgcataaaacaatgagaattatgcctgcaacttttaggtggactccaagttccaacaaggcattcagacgtgctttttcgccactttggacggctcttttggctacgttcgaccattgaccgagaaaggcaatgatcgcaatttctaattttaatgtattttatttttgcaaacattttaagtattccgtcgcctacacatgcttcaacaggtacaccaacataaaaaaattggctgcaacatcggcttttaaattaactttattttgctttttaggtgatgaatttgcacgtgccacaacctggcgggtgaatccgcgtggctcaagagcaggtataatttgaaaaataataattgtcgaatcgcattttatctatttgtgtagcacggcctcagcgtaccggcacaaatcagcaaatttcgttggccaaaaacattgtggacggcctattagtgatgcaatatttgtatttgagcgtccaggacaagacggatttggcacggaagttgggcaccagtcgttaccaaattattgatggtataatttttttttaattttcgcgaatttgcggaaaa

SEQ ID NO: 39712 - DNA, 1328 bp, Heterodera glycines
  misc_feature (71)..(71): n is a, c, g, or t
  misc_feature (1100)..(1100): n is a, c, g, or t
tttttttttttttttttttttttttttttttttttttttttttttttttttttttttgttggttccgcccngctaaaaaaaaaaaaaagaaaaaaaagaaaaaaaaacaaacaacaaacctcccttcccttcttcctttcttcttaaataaaaaaaaaaagaaaaaaaaaaaaagaaagaagaaaaaagaaggaggggggggcgccgcccccccccccccccccccccctcctttttaatttattttggggggggggggcggccccccccccccccccccccccccccgggggggggggggtggggggggggggggggggggaggagaaaaacaaaaaaaaaaaaaaaaaaaaaatatgtttttttttttttttttttttttttttttttttttttttttataaaaaaaaccacccccgcgccggcgcggggggggcggggggggggggaggaaaaaaaaaaaaaaataatatttttttttacttttttttttttttattggaggagaagaaaaaaaaaaaaaattatttttgcggcccctttttttttttttcttttcccccccccccccgcgggggggggggggggggggggagaaaacaccccacacccttttttttttttttttttttttggggcgccgcctttttctcaaaaaaaaaatttttttttttccccccccccacctttcctccgccgagggggagagaaagttaagggggggccccaaaaaaagagggtctttttaaaagggggtttttaaaaaatttttttccccgagataaaaaaaaaaaaaggcccgccgcggggggggtgtggccacctgggggagggggacccaaaaaatttccctaaatttttttttcaaaagggggggaaaggccaaaattttgaaagcccccttgatatttttcccctggcccccccgttgaaagggggggattggaaacccaatgccaaccttattttttaaattttggcccgcatttttaccaaaaacgtgttttaggccgcagtaactcggctcagagtgaagattaagggacgccaaaagagacgatttaaaagcgattcgaaaattctatcgactgatataatancgatgcagtcgcggcgttgacaactgagatggaaccaaaagttccataatatctttccataaggctggaaaggcagaatttgaatggccagtcgatatttacactgagcacccgttgaagcgggtgatgcgaagccatagcaaactgtatttttaaattctggccgcaattctaccaaaaacgtgttaaagacgcagtaactcggctcagagtgaagattaagggacg

SEQ ID NO: 39713 - DNA, 1209 bp, Heterodera glycines
  misc_feature (959)..(959): n is a, c, g, or t
  misc_feature (983)..(983): n is a, c, g, or t
  misc_feature (1003)..(1003): n is a, c, g, or t
  misc_feature (1023)..(1023): n is a, c, g, or t
gggcgcggagagcaatggccattctattatacagggaatttttaaaatttattctctatgccagaaaaatggttatcttcttttttgtgagaaattttgtaccatacaaatgttcccagcatgggcagaggggcgcggagagcaatggccattctattctacagggaatttttaaatttattctctatgccagaaaaatggttatctcttttttgcgagaaattttgtaccatacaaatgttcccagcatgggcagaggggcgcggagagcaatggccattctattctacagggaatttttaaatttattctctatgccagaaaaatggttatctcttttttgtgagaaattttgtaccatacaaatgttcccagcatgggcagaggggcgcggagagcaatggccattctattctacagggaatttttaaatttattctctatgccagaaaaatggttatctcttttttgcgagaaattttgtaccatacaaatgttcccagcatgggcagaggggcgcggagagcaatggccattctattctacagggaatttttaaatttattctctatgccagaaaaatggttatcttttttttgtgagaaattttgtaccataaaaatgttcctagcatgggcagaggggcgcggagagcaatggccattctattctacagggaatttttaaatttattctctatgccagaaaaatggttatctcttttttgtgagaaattttgtaccatacaaatgttcccagcatgggcagaggggcgcggagagcaatggccattctattctacagggaatttttaaatttattctctatgggcgcggagagcaatggccattctattctacagggaatttttaaatttattctctatgccagaaaaatggttatctcttttttgcgagaaattttgtaccatacaaatgttcccagcatgggcagcgggngcgcggagagcaatggccattctnattctacagggaatttttanatttattctctatgccaganaaatgggttatctcttttttgtgagaaattttgtaccatacaaatgttcccagcatgggcagagggggcgcggagagcaatggccattctattctacagggaaatttttaaatttattctctatgccagaaaaatggggtatctcttttttgcgagaaattttgtaccatacaaatggtcccagca

SEQ ID NO: 39714 - DNA, 814 bp, Heterodera glycines
ttagagaccggaactttgaaatgaacgggaccgggaacttggtgatggaccggaaacggagcattcaacagaaaaataccgcggatcgcgcaccgcggattcaatttcccgcggtcgcggatcgcgcaaaaaaattgccgcgaatcgcgcatttaaaaactcaaaattttccaattttttaagattctctccctcccccttcccttatttgtgagggggtttaaaaataaatcttttgaatgcccggaggcgttattgttttgttttggattaaaacaaacgaatccaatccataaggcggatttttaaagaatatttatttttcttttgacacaaaaaatgtgaaaaaattaattttcagtgcagccgagaagcaccgcactgaacaaacgcagcgggaggatcacaatgaaaattgaaaatgtttttgaatttgctcgagagaataagcgtcgctacagcgatgcagtgaacatccggggattttcatggagaatatgtgcagaaattcaaacaacaatggatgacgggaataaaaacaaaaaatgtttgggaattttcctccattgcgaagaaccggcaaataagggtgaggaaagaaaaaaattgtttctatgtaattaaaaaagaagagtgccacggggaccggaacctggtagcggacaactgagtaccaaggtcccggttttgaccgggactagtcccggttttttcccggttttcccagccaaaaattcccggtttttcaacccgaaaaggtcccggggctctaatgcactttatgagtccaatcgacttttatgagtccaatcaa

SEQ ID NO: 39715 - DNA, 579 bp, Heterodera glycines
aagttaaaaaaaaattggcgattttgtgctcaagccgactccaaccgaatgcaaccgctggcggggagcatggcgatcgcgttagcgatggcacatgagggcgtggccattgccaggccaatgcccatttcagggaccatgaaccctttttagggacatgggcccacattctgtccttatggccattagccacaaggacaaacatgccactggcgcttattgggcgacagcgactatttcagctacacgtcttatcagacgcgtagccaaatctggctccgcacccccaggcaagggaaatgcgtcgcaattgtcgctactcgctaagcgagcagcgagcaaacgcagccggccacgaggaccaaccgcgagcagcgggaaacggcgtcagcgagcaatcgcacagcgtcgacagcaatcgtctttctttatatatgatggaaaataaatgctctatttttcgatggtatataaaataggcgaggaatgagtggcagcggggcgcactgttatgcactatttcccgcgctgctctcgtttcttttctgaccaataaagcaaagttgaatgtactatttc

SEQ ID NO: 39716 - DNA, 933 bp, Heterodera glycines
tagtgctttattcacgctacaacagaagacaaaagttggtgtccaattcccggtagggatataatagtgactttcagagatagccattttttgtcaataactatttttcgtgcgttttcaaacacactattagtgctttattcacgctacaacagaagacaaaagttggtgtccaattcccggtagggatttaatagtgactttcagagatagccattttttgtcaataactatttttcgtgcgttttcaaacacactattagtgctttattcagcgctacaacagaagacaaaagttggtgtccaattcccggtagggatttaatcgtgactttcagagatagccattttttgtcaataactatttttcgtgcgttttcaaacacactactttcagagatagccattttttcaataactatttttcgtgcgttttcaaacacacaattagtgctttattcacgctacaacagaagacaaaagttggtgtccaattcccggtagggatttaatagtgactttcagagatagccattttttgtcaagaactatttttcatgcgttttcaaacacactattagtgctttattcagcgctacaacaaaagacaaaagttggtgaccaattcacggtagggatttaatcgtgactttcagagatagccattttttgtcaataactatttttcgtgcgttttcaaacacactattagtgttttattcagcgctacaacagaagacaaaagttgtgtccaattcccggtagggatttaatcgtgactttcagagatagccattttttgtcaataactatttttcgtgcgttttcaaacacactattagtgctttattcagcgctacaacagaatacaattggtggtgtccaattcccggtagggatttaatagtgactttcagagatagccattttttg

SEQ ID NO: 39717 - DNA, 1662 bp, Heterodera glycines
  misc_feature (1656)..(1656): n is a, c, g, or t
ttgaaaggctcattaaaaaatgaaaaaagaatagtttaaaacttaaaatgattaattaaataataattttttatttgcttttacaaaataataaatttgcgtttttgaaattttgaaatattaaaaaaaaaatttttctaatgatgtttacgcttcaacgccggtgacgggtccgagttttggcgcttcagtcgattcatctcctgctgcagtaggcgctccggacgcgtcagcagcgtcaccgttgcgctgctttcagtgccgtccggtgccttcgcgtacggcgtttgttgctgctgttgttgcgacgctgcacgcactggtggacgcggactgccgcgtggcatcgtgcgaaatgtgcgtcgcgcagcgctaccggcgctactgcagccgcccgcactgcgcgtctcgttgcctcccgccgagcgcatgcttgttcggtattcgactggtgcaacgtgcgtcagcggcgcatcgtcgtccagcggttcaatgctgccgcccactgtcggcgacttcaaagagcgtggtaatttatttacaattaattaatagggttaagagtttggggcgggaaaacgcttttgaaatttgttttcgaccttgttcattgttatcagaatgtgttggaactttgcaggacaatactttgacataagggctaccagctcgaaaaagttcaaattttgtaattaagtaaaaattaaaaaaaaaaattaagttttttgtgaaacttgaaaaactggcaaaaattctgattgttttcaaatcattctgacaacaactgaatatatacataaaagctaggaaatcaatttttttttcaagcccgagaaattttcgtgccccaaattcttaaccctattaatttaatggttaatttaatttttaatttaattatgtcataattttgtaaaaaaaaacatatttctcaccggcgtttcctcatttaaactgccaaattttttgattttggccacattattattatcattgttgctgttgtgattttggataataaaaatgttgggagatgcagaatttttgtctttcatcaattatttaatttattttttatctaaaattaaaaaaataaatatttaataaaaaataattatcaataaatgagaaagaatttattttatttattttacgatggaaataattttaagccaacaattaataaatttctccgattatttataaagtaaattcaaggatagaaaataaaaagtttagaaaaaataaaattatattttttattacatttttaatgtttaaaaattcattttagtaaagaaatctaactataattataatttttttaacatatcaattcagggtagtgaaaaaattgttacaacaatttttttttagagcttggtacccgaaaatcgcataagttttgtgcttggccaatgaaataaatgtaaggcaattggcgcataaattaggggcttcatgtccacaataattagtcgcattattaccgcttaggggagcaattacgcagcgaaaaaattgatttgaagtgaaatgtggaaagtttttaacaattaatgaaattaaaaaatttcttaaaaaatttcttataaatcacgataaaaaaataaatacattataattacatatattatcacccgattgaattgaatntcactg

SEQ ID NO: 39718 - DNA, 843 bp, Heterodera glycines
cgaaagctttttgtaaaacggccaacaaacaaaaaaataatttatattaagtgaaatcttaaaaacatattttaaatttatcaataaaaatcaacctaggcttttgttagcaaaagttatattttttataaaaaaaataataaaaattggtcaacatctacatatttgagattttaacgtaaccatataattgtttaggtattataaaaaacctattattgagatatttttaaaaaggcgtttaaaaaaaatttgcctattgtgcctatttgaggggtttaatacatattttgcgggatttttttcctttgtgcctattttgcgagaaaaaatattttttataaaattaggtttttacttattaaatattaactgacaaatgaaataatgttgtcagataagaaatgtcgatcaagttattaatttttatgaaaaacaaacctttgctaacaaataaacctaggttgatttttatgcaaaaattaaattgataaatttttaactacacccgctacagcacgtcttctatccaatatggagatccagatttttgggtatttaaaaattgaaaaatatattttatttaactcaacaattcatttaggtcgtacaccctcttccagaaataacttccaaaccagtattattttttaaatttattaaaaagttttttcttataattatgttaaagataacataaaaaagttgtggaaaatgagattctttagagatcattagagattgatattagaactcgttttgagcggtttttaaggagacaattctaaagactttctggaaaaccgaaaagcaccaaatacaatttctccttcaaaaatattt

SEQ ID NO: 39719 - DNA, 924 bp, Heterodera glycines
  misc_feature (893)..(893): n is a, c, g, or t
ttaatagaaattacatttaaattgcattaaaaattccattatttcattatattatacaattcttcttgtgattagaatcattttacttgctgagcatcgcttggaacagcttatttggaaatgatcgtcctccgaatgataaaagtgtctttagccccgggtcgtattccttaaaaattaatttaatatttttatgctaattaattttaaccttgcctttaatgaagtaaaccgtccataatatcccttgggatactctgaagtcattgcggtgtccgagggatcataggctctaaactgtcgaatatgaacatttatgataattgttttaaggaattattaaacattcgtaattttatttggatttgttttaagtcttttttttttgttttatttgtgattaaaaatttttgcaaattaatttaaagaggcgaattaattatccgggttttttcaaatgtcagggctcaataattaataatgccacttaattaattggtattatggtaattgactttgcgctaaaatcttcgttcatccacccgaaggagtagaaaaggtgcgtgcacagtccggggatgtactgctcgggctcgaacttggcctgcccctctctgaacacggcccaactcgcgtagtaacaggcgcggacaaagtcggcggaagagacgcccgctgaagcaaaaagtgggaatcaattaaaataaaactaattaaatattatttaaaaaacctaaaataaaagttgccgtggcaatgaaaaatattttaatcgaaaaataggcgataatttttgaagacattaattagggcaaataaattaattaaatctctgaatattatgattattacaatttgataaaaataacattgggcaattcaattatcaccgnaattttttaaaaatgcaaagtcaataatggg

SEQ ID NO: 39720 - DNA, 1451 bp, Heterodera glycines
  misc_feature (1263)..(1263): n is a, c, g, or t
aaagggcgattaagatttttcgaatgggtcataaaaagagatcggaatcacatctgttaatggtcaataaatttgactattttttgcttttcaaaaatgctttttttcggcgcaattttttcaaaaactagaaacaaagaggtccgtctatgccgataggcgccgtccgaattttttttttttgaaaatttttatcaataattaactgaatttgaccaaaaaatgacaaaatgtcacaccttttgactcaattctacaggattaatgtctatccagtggtgtcgatagacgccgccgggaaatttttttgcaaattctaggtgaaatttgagatgaaaattgaatttattttgattgattttatcataaatttattcaaaaattttggcattccgtcttttaaaattttcaaagaatgtatgcggatcctgccggatcccgcacaaaaatcaaatttgcggatcctgttgcaggattggaattaattttttgccggaccggatccggccggattaatcctgcattttccaaaaaatgcaggattgcggacttgggatcctgcctgcaaaatcctgcgcaggatccggtcctgctccgggctctagtgttaatgttatatatattttttttaaataatacaaaatgctcaaattctaagattttaacccaaaaagaaacattttacgatgatttttttttccaacattttttcccgtaagtgctttcaatttttgaatttggcaccaatcaacaaaaaaatcgatagaataacaaaagatacactgaccaacaatttcattatgttatagccaattgaatcatcaaaatttaaaacatttaaatttgatgtcatttttccattatttttttattagtattctcaaaattttccaattttttcggaaaatttttcagtctttaatgaaaaaagacccgcatttttaaaaaataatctagggttaactatttaacttacgttggttgacttctagcagttcgaggaaaaaatatgattttgatggttttcgtatttttcgcaaatcaaaaattttgatcaaaaaatattaattatttttaaattgcttaaaaacccagctaatgttctaccactaaaaatggattgatgaaattaaataaaattaatattatttcaaattttaatcattcacgaacaaagaaaaacaaggattaacaaaaaggcatttacatattattgaacaaaaataagtgctaacaaaaatggctgaaggcggtgccattttnggaattttggctacaaagttttttataaaaatttttttacagattttatagaaaattatgaaaaagaaccataaagaaaaaaacctaaaggcggtaaaccaattaaaatcatttgtaattggtaaatttagagtaaactgcacctttgaaagagttactgcacctttgacttcataatataatagtcg

SEQ ID NO: 39721 - DNA, 685 bp, Heterodera glycines
  misc_feature (9)..(9): n is a, c, g, or t
ttgtgctcncagtgcaaataagtttatttattatttagttatcagaacgccaaaactttgcaaaacttaaattttttagagagttttcccttgtaaaaatagaagagccgatctcgagttaaaaacttagttttctcaaaataaacttggaatcgctagagggggtcaaaatatgggattatgcaaaatttcaagaaaatcggtgcatagggaaaaattttttagcatagcaaatatttaaataattttaattaatttaagccaagtccacaatttaaggccaaaccaaataaaatttacaatattctccagaattttcccttcaaaatgagcataaaatggttttatttgctctagtattcacaaagttataagctaaaaaaaaattcataaaattgtcaatgctgtacgtaaccaacgcgttttgaatatgattttttattgacacgaaaacttttattaataaaaaaataattctgccttcttctttaaaaaaagaaatttaaattaacacacaacataaggaggacttgaacctgagacccctttttgttgactaactcacagaccactaagatgaaaaaaccaacttaattgtacttggagcccaaaattgactcgccgtgttaactaaaaatatgagatgaaactttttggagattgtttaggcgtattgttagtcaaa

SEQ ID NO: 39722 - DNA, 892 bp, Heterodera glycines
ggaaaaaaatccccggaaggaggagaattttaattaaatccattccttcgggggggaccgtgccgggtgccgcggggtaagcagtgctggttcgttttcatcacggcaccgaaccttttggctagtcagcaatcgttgcttaacttgccagatcggacgggtgcgcatgattccactgttccaagcaccccaccaaaagcaaaacgatataaccaaaatataaggaaaaatttttaaaaaatttttttctccatcttcctttttgatactaaagcatcagagtgctaaaattaagttgtaaataaaatttggtgcgctttagagcactttctgaaaaaaatatttatgaaacaaaaaaatcgataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaatgattcggtctccccataaatctgggcgcatcggttcggggggactgccccgaaaacaaaaaaatcgattttttcaagtgtccgtttggggtactcaaacaattatggggagcattcatgcaacgaagaactacaatacaggctactcgctgactattcccgaaggattcggtctccccattaatatgggcgcataggttcggggggactgcccctaaaccattataaatcgattttttctagtgtccgtttggggtactgaaacaattatggccaccacaaattcaacgcagaattaaaaaacagggtatatggatgatattacggaaggattcagtctccgcattgatctgggcgcatcggctcgagtggactgccccg

SEQ ID NO: 39723 - DNA, 783 bp, Heterodera glycines
cttaatcgcttagaaaatgcttttaatatcttttaaacatatatagatttcgaatgatatcattgtttggtcagatcaccgctgaccggcagattttgaattggaaggcaattacaaatcaatctttatttactacaaagggggacgacatttccaggggctccctatcattcgtcactgaaactaaatttaaaaaaatttttggcttaatttcaataaaaattatctttaaagtactaattggtttaaaattctataaaaattgattttgggtaatttaaggtctttccctctaatgccatttggtggcgccttttcataagcagcaaagaaatgttaccaacgctgaaattctttaagcacctcgtttaactaatttcttgatgaatgcatctgtatgatccctgatcttttgttgaagttgaatccaattggttcttttatgaaaaaaaccgaaacttaagtccgcaagttgctggaaagttgatggcaagtatataaaatataaaacaaagattttttaatgttaaactaatattgcgatcacacatagatccaaatacttttgtacattggcgtgtaatttttataagcttacttctattttggtgctttgctttatgtgacgtttcattttgcgcttttcgcgaaatgacttagcaccctctgaattagacctttcgagtggggctgaaaaatagagcactccgggggttctaattcagttcggcgttgcactgttgacggttattggagttgatcggggctcactcgagaaatagg

SEQ ID NO: 39724 - DNA, 1074 bp, Heterodera glycines
agaagaatccccgaaggagagaaggtgctttaatccattccttcgggggaccggtaccgggtaccgcggggtaagcagtgctggttcgtttcatcacggcgccgaaccttttggctagtcagcaatcgtggcttaacttgccagatcggacgggtgcgcatgattccactgttccaagccccccaccaaaagcaaaacgatataaccaaaatataaggaaaaattttttaaaaaattttttctccatcttcctttttgatactaaagcatcagagtgctaaaattaagttgtaaataaaatttggtgcgctttagagcactttctgaaaaaaatatttatgaaacaaaaaaatcgattttttcaagtgtccgtttggggtactcaaacatttatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacatttatggggagcaaaaatccaacgcagaattaaagtacagactatagggaagctattcccgaaggattcggtctccccataaatctgggcgcatcggttcggggggactgcccagaaaacaaaaaaatcgattttttcaagtgtccgtttggggtactcaaacaattatggggagcaaaaatccaacgcagaa

SEQ ID NO: 39725 - DNA, 1055 bp, Heterodera glycines
gttttttgtcaattctttgcctgggttttcttctgtactgaataaatgtaatttgaacttttcgtgccgtttgtcttcaatcgctttcttcaaatcgtccaattccttctcattctgcagtttcggctcacatggatccattttgaaaaattttgctaaatttttcccaaatttagcattgaattcgtcatcgaaataaaaagttgaaatttggtttaatgccttcagcacgccaattaaactttcggccttttcattgacaagaaactccggcttcactacggttttcttctgtgccgtctggaataagtattcatataaaatgtccacatattgtcgaaatctgtggcattctttttgctcattctggtcaaattcttttccaattttttcacatttccaatgatttcgcagcgcaaacagaaagccaagatgagcttggtacttttggatcaaatgctttttcaaatcaaaattgtggaaatttgtcaacggtttcggataaaaattgaccaattctttttctttcttataagtttcatatatttcatcaaaaaatgtctcgcctttcacaaattcgatgaatgctttgtcttcattttgctataaaatatataaaaaaaagttttgcttttaattaaaaacatcaaatatttatatgatgtttaaaaatcccgaaaaaaactaattttattaaacagaattaaattttaataatatttggcacataaatacaaaactcacaggcaatggatttccacttgaaatgggtagtaataaagaataagaaatgattatcgaagaaattgtagcagcaaaataactcattggaatacgctaaatgctttttgttaattggaactaatttcgcatccctaaagattgattgttctctggtcatttttctaaaaaattttcgtttttcacttattaaatatttttggcatttttcaattttttaagtgaaagcttacaaatcaaagaattggaatttttggtacaaaatctgttaactgatctgagcaaacaacaaagaaattcccaccggaactctg

SEQ ID NO: 39726 - DNA, 1381 bp, Heterodera glycines
agccccagggcattttcccggaattgcgcaaacaggaatgccaatgagtacgcgccgctgttggcacgggtcgatggcgctgtacaaacggtctgttgaaacatggcaacggcaaaacggaggagcagcgggactgggacttggagcagagtgagtgagtgggtcaccatccaaattatttacaaaacaattcaatgcgaattacaaatagtggactgtgttcttaggtcccgtatatttcatatatatgtattttttaatttcaattgccgaataaaccctttttatgcggtttttatacgaactcgacctcaactcggctgcctgtgtgctgttgcgcggtctcccattgtgcacggaccaatcggatcgcgaggcgggggttagcccattttaaaacggaattattttttgaaatgcaatttgttcataccgtcaaaggagtggtactatcacttcttggaagcctgtgacacggacccacggacgcggccgttgctccgttacattgacccgtactatgagaccgacattggagagtgtctcgattttatggagagcatattggagccgtgatcattttccccatgcttatagaaagatggcagcattcaatttttcgctcctactttgtgttccttcacagcatggtccgcttccgcacgctcaatttgctcgttcaactgttccacttggcgctcaagttctgcccgaacttcggtcaatgtgccataattatgcaacagctcctctatcaatcgctccacactgtccaaatcgtcgacatcggcacaagcgataccatcatcagctttggtggtggaggacaacaaaatttggttgaacggtgccggaattggacggccaatgatggaagcaacaaatttgtgcaccgattggcggactgtggtcagctctagctcaagctgttgcactcgttcattcgcttcacgtttcaatgcttggaccgcttcaaattgttgtgcatggatttggagctgttcagctgccaacgctgtcgcatcattttcaacatcattcggttgaatttgttgctgctgctgttgatcagattgatcaccagcagtgttcgacagagttgcacaatcagcaacgttagttggagacgatgaatcgatgggaccgctactgtcgtcttccaggttgagtacggtagaggaaatgcactgcattgattctgctgtgaacaaatcgtaatgtaaattacttgacgtaggaacactgaaaaggtggtgagaccggatttcggcatattttgaataattcgagatttggttggcaataaaaacgccaatttacagggaatctaaaatttccgaaatttttctttattttttttgttaaaacaaaatgggatttt

SEQ ID NO: 39727 - DNA, 1481 bp, Heterodera glycines
acctcccggttacaccgcaaagttcaaacatggtgttgttgacaaagatgtccgcgaattttctatcacaaagggtggacattctctgagcatggactcttacgtggaagctgatgggaccaccaaagattggactttgaagtgttccccaaacaatgaagaagcgaagtcgacagtgaaagtcgaccaattgggcccgatcgaaaaaccgcgcatcattttggaatttgaccaaaagaaagttggcaagaacattggaggttgatgtgtacagcaaggacggacgatgcgtatttaattgacaaatgacccgtttaaatatggccacatattctaaatgattttaatttattttcaaaaattacaaaaaacaaattatttgataaatgtggtttttcgcttacacataatttgtttgttttttgttgtttttgggttttgcaaattaatttttgcgtctctttaattagccttgaagcgataagtgaaaagcagagcctttcttttaggactgattaagcgcacctttcaccatttcataaaaattttcattttaacacttcccctctgtgcaaaccaaattgtcgtcgtgaaaaaagaaaaaactaattaaaagttttacatttgtttcctagaattttttttcaaaaaattgattcgaacgaagatacaaaattcaattcaaattgagccgcggtgaacaaaatgtttaagccaacattgctcacttattatcattgattcattcgagatcaacatgcttgtcatgcctcagtgcaattatgaattcagaccggttggcatatgatgtgtttgtgccattctgccagtcccaactaatttgattccgaattaatgtccaacaccagccccgtgccaaaagtttcagcaattcttgcgtcttctcattcacaatgacgaaactttggccgtaatcatagcggctgttaaggctttcatcctctgagcgataatttttctttggcacattgacaaaataattaacaggcgatgtgtcattgatgaatttctgaatgatttcattgattaatatagtaggcggtgatttttaggggtgaaaaatccaatttaggggcctaaatagcggcaaaaaatgcgattagtggcctaaaaattgaatttttcagtgaattttggcttctacattttttctttattcattttctgtttgtctttaatgccccgtttcggtgagtgccctcccctccacctccttcagttgcttgatgctttcgttggcatccaactcggagcaccagtggaaatatttggggcggccgtccgcgcgcggcaaatgaagccaattaaacagtgccacatttgttcgatgaaaggcatcatcaacaacagcataaggcattggcaaatgagcgcacgaaattatgcgaagctcagcacaatccaacagagagacggggaaatcattccaagcgtagtacggagtttgaggatttgaaatt

SEQ ID NO: 39728 - DNA, 1740 bp, Heterodera glycines
  misc_feature (917)..(917): n is a, c, g, or t
tcccttacctacattattctatcgactagaggctgttcaccttggagacctgctgcggatatcggtacgatcaggcaggagattcaaatagcttccctcgcattttcaagggccgtgtggagcgcacgagacaccacaggaaccgcggtgctttacgggcgcaacatccctatctcaggctgagccacttccaggcacgcacaccctaaaccagaaaagagaactctggctcggactccacacgacgtctgcgagttcatttgcgttaccgcgcaaaacagctcttgcgaaccgtcatttccctagcctggcgtgggaatgttaacccacttccctttcggcaaccggatggaccaactgcgcaagcacagaaaagtcgtcatccgtagtgtgttacggcgttagccggtgccttaggatcggctgacccacattcaactgctgttcacgtggaacccttctccacttcagtcttcaaggatctcacttgaatatttgctactaccaccaagatctgcactggtggaagctccggccgggcccacgcccaaagccttcaacgcaaccaccacgaccctcctacacgtcatggccagactacgcgacaagcacgtgtacaagccaatgacggtggagtataggtggcccgctccagcgccatccattttcagggctagttgattcggcaggtgagttgttacacactccttagcggattccgacttccatggccaccgtcctgctgtctatatcaaccaacaccttttatgaggtctaatgagcgggcactttggcaccttaactccacgtttggttcatcccacatcgccagttctgcttaccaaaaatggcccacttggagctcaaacattcaacgcctggtttcagagtcaagcaaccctggcttcatacccatntagagtttgagaataggttaaggacatttcgtccccaagtcctctaatcattcgctttaccgagtataactgcttaacgagctccagctatcctgggggaaacttcggagggaaccagctactagatggttcgattagtctttcgcccctatacccaagtcagacgatcgatttgcacgtcagaatcgcttcggacttccaccagagtttcctctggcttcatcctgctcaggaatagttcaccatctttcgggtctcagcgcatacgctctgtctccgccccatcgcatgcgatcgagacgggactatgttgcgccccaacaccgcagtgccagggatcacacatcagctccgtaagaagccttcactttcattgcgcctttgggttttgaacacccaatgacttgcgcatacgctaaactccttggtccgtgtttcaagacgggtcgaacagatgaccggcttttacaccgagaacgcacaactgagagcccgagctggaccgaactggttgctggtacgtgtcgcacgcgaccgccaccgacccccagctcgagtcaacacggacccgaaaccattgcacaattcacccagagtaaacagcactcccccgatccgggtaccagaccccgaaaggctggcctcaagaccgagctcacgcagctactccgagcatctcagcgcactccgcctgcaaatgccccattcgccactgaacagaaggacagcaaaccccagtctggaggctagcaggccaacgtacagcaacaaacgggtgaatgcagaccagatacgccagctctgtccgtttccacctcatcgg

SEQ ID NO: 39729 - DNA, 1141 bp, Heterodera glycines
  misc_feature (28)..(28): n is a, c, g, or t
  misc_feature (70)..(70): n is a, c, g, or t
caaatgaacagatgagggaatgggatgnaatgacatgaaagtggacaattatgaggagttagaaacatgnaaggaagatgatgaaatggatgagagatagcatttactcttaaaccgatctttgttttttgttttgatattgatgataattaaaaacaaattagtttgtattatgttgcacagaatacacttatttatccaaatttttaaatctccattttgtcatttcatttttggatttagccttgccgtttcaatgttaacattctggtaatcattaatcaacctcttaattttaaagtggttaaatttagtcccacctgtggcacaattctgactctctcagacgggaaggattactgcaagcagttcagctgtggttcttgctcctatacattgccaatttccaagaaggttttggcttcatttattccttttatatatatttttagctgacaagcagaatatacagcaaaaagaaagaagatgagaagataattgggggcaccgaaatgtgggaaaacgcccaagtgacaaatggtctgttaggctcaaagctgagaaaatgcgcatttgtgtgttcagagcgatgcccaagttgttctcatgacaaggcctacttccagcagatacagacgaggagtgccgacgaaccgatgaccattttttatcgatgtgccaattgtggacaccgatggaaggagtaacggatgaaatccgaatttaagtccatgttttttagttagctgcttgttgatcaaatcaaataatattgctataaagggaaatccaatttagcgcttggtaaaatgatgttctaacccagccccttctgatgagaagattcattttttgccattgttaaaaatgcctccaaaagaaaccaatcatatattaattggtaatatttgaaattgatttcccgggaaaaaaaaattctttttggttttggggcaaaaatactgctttcaaacctgagctcagaattttgaatttttggtctgtttttggctctaatgcactttatgagtccaatcgaattttttatgagtccaaacagagtttatgagtccggtcaaatatttgtgaatccacataaatgttaaaattttgattcaactttttgaatcattttatttta

SEQ ID NO: 39730 - DNA, 640 bp, Heterodera glycines
gggggggggcgatgtctgaatgactcacagagagagaaagagatagtccatttccggacagtgccacagtagtagcaatcggtgccatttaacttttgattgtttatattccatcaatttgcagcttcaattttaggacgaaattgccttttcccgatgagatgggggggggacgggagaaagaaagggtgtcattgtcatcgattcaatttcagaaaaagtgaattggggggatctcagcggcagatatatttatttatttgccctgctcaatgaggccaaccaaaaggcgtttccccctttttccatctgacggccgatgtttgggacattctctccctccccctccccttttttccttcccttcgtccgtcgtttcgttcaccttcgcttcgccagcagtgaccccagcaaaagcccccccccccccccgccgattctttcgtccatccgccgccggttgttcgtttgagtttgatttttggaagacaaaaaaagaaacggaggcggcggaggtttcgctttgagaaaagcaaacaaacgaagaaacaaggagatttcaaataatgggaaactcaattaataaattaaagtgtaaaaacgattaaagaaaatccttagttttgtgttactgtaagga

SEQ ID NO: 39731 - DNA, 1014 bp, Heterodera glycines
  misc_feature (979)..(979): n is a, c, g, or t
  misc_feature (994)..(995): n is a, c, g, or t
gacgatttaaaagcgattcgaaaattctatcgactgctttataacgatgcagtcgcggctcaggtgaagattaagggacgcaaaagagacgatttaaaagcgattcgaaaattctatcgactgatataataacgatgcagtcgcggcgttgacaactgagatggaaccaaaagttccataatatctttccataaggctggaaaggcagaatttgaatggccagtcgatatttacactgagcacccgttgaagcgggtgatgcgaagccatagcaaactgtatttttaaattctggccgcaactctaccaaaaacgtgtttagaccgcagtaactcggctcagagtgaagattaagggacgcaaaagagacgatttaaaagcgattcgaaaattctatcgactgatataataacgatgcagtcgcggcgttgacaactgagatggaaccaaaagttccataatatctttccataaggctggaaaggcagaatttgaatggccagtcgatatttacactgagcacccgttgaagcgggtgatgcgaagccatagcaaactgtatttttaaattctggccacaattctaccaaaaacgtgtttagaccgcagtaactcggctcagagtgaagattaagggacgcaaaagagacgatttaaaagcgattcgaaaattctatcgactgatataataacgatgcagtcgcggcgttggtgaagattaagggacgcaaaagagacgatttaaaagcgattcgaaaattctatcgactgatataataacgatgcagtcgcggcgttgacaactgagatggaaccaaaagttccataatatctttccataaggctggaaaggcagaatttgaatggccagtcgatatttacactgagcacccgttgaagcgggtgatgcgaagccatagcaaactgtatttttaaattctggccgcaactctaccaaaaacgtgtttagacacgcagntaactcggctcaganngtgaagattaagggacgca

SEQ ID NO: 39732 - DNA, 1592 bp, Heterodera glycines
  misc_feature (31)..(31): n is a, c, g, or t
  misc_feature (82)..(82): n is a, c, g, or t
  misc_feature (89)..(89): n is a, c, g, or t
gatcaattacaaaattatttatggacgatcnaattttttgaatttttttaagtgcaaaagtggtgggtgtcttacagcttancaaggcncaattaagcttatttccagaaaatctcgcatgaattctcatttttaaattttttatagatttttaaatatttggatatttttttggcttaccaaaacttcatcgaacctggctctttctattctcattcaaatcgctccaaattttttttacagcttaactaggcccaattaagcttatttccagaaaatctcgcatgaattctcatttttaaattttttatagatttttaaatgtttggattttttttggcttaccaaaacttcatcgaacctggttctttctattctctttcaaatcgccccaaattttttttacagcttaactaggcccaattaagcttatttccagaaaatctcgcatgaattctcatttttaaattttttatagatttttaaatgtttggattttttttggcttaacaaaacttcatcgaacctggttctttctattctctttcaaatcgccccaaattttttttacagcttaactaggccctattaagcttatttccagaaaatctcgcatgaattctcatttttaaattttttatagatttttaaatatttggattttttttggcttaccaaaacttcatcgaacctggttctttctattctctttcaaatcgccccaaatttttttacagccacgaggccgcgaagcggccgagtgagtaccttgggcgcaggaaaattattaaggaggagggttcattatttatttatttttgcaaaattaattcataaatttttttcagaaactgctctgaaacgcaccaaaatttatttacaagttgaataaggcactctgactcttatattatcaaaaagggagatgaataaatattttaaaaatttctaattcctttttaaacaggccgaaaaagtttaggcttaactttttcagcgggtttaaaaaatctagaaaaattagtaagcatttgtagtgctccgatacgtatctctgcaaaatttggtgagcccctgatcaattacaaattatttatggacgatcaaattttttgaaatttttttaagtgcaaaagtggtgggtgtctgcaaaaaattttcaccgggtttaataaatctaggaatataagtaagcttttgtagtgttccgatacgtatctctgcaaaatttggtgagcccctgatcaattacaaattatttatagactatcaaattttttgaaatttttttaagtgcaaaagtggtgggtgtctgcaaaaaattttcaccgggtttaataaatctaggaaaattagtaagcttttgtagtgctccgatacgtatctctgcaaaatttggtgagcccctgatcaattacaaattatttatggacgatcaaattttttaaatttttttaagtgcaaaagtggtgggtgtctgcaaaaaattttcaccgggtttaataaatctaggaaaattagtaagcttttgtagtgctccgatacgtatctctgcaaaatttggtgagccgctgatcaattacaaattattt

SEQ ID NO: 39733 - DNA, 745 bp, Heterodera glycines
  misc_feature (700)..(700): n is a, c, g, or t
gaagaggaagacccacggtccatttggacgatgggaaaagtcgaaaagcttttgaaggggagggatggactcgtgcgcacggcacgagtacacacaaaaggaaaaactctggttcgagcgattaaccttttgtaccctctagaaattaacacttctgcggaggacgaagtcagtcaaattcaagtgactgccattatggattcaccaagtgctgtgatggaaggcggggacccgcaaactgtcacaacggagtcaagtctgcctccagggacagtgatgcaggattcacaaatcgtcacgacagaatcgagtttgtctcctatcagaggaaggaatgagcggcaagctgtgaaagagagaagaattcgaaagagacagccaacggaggaagtcagaggcaaaggcaaaccgaagaagaatgggccatatgatccactgcgaccgggcaactacagaattcctcgccgaaacccgttctttccgtcacaagtagcgtacaatgagcaaacacgcacgtatcgacgacgacgggtaggacgattgatctttcgggattgaggaagttgttcgctggattggggggcactgaattcgtgagacgagagctgtaagagaaggctaacccggctctaagagatgaaaggctgcaaaaaataaagtcaaatcatggaagatgacgccagcgcgtcgctgagcgtgnaagaaagcagcagaggagaaatggaaaatcaatgaaggattctca

SEQ ID NO: 39734 - DNA, 904 bp, Heterodera glycines
ccgatttgggaaattttcgtgccaaaaagtccgggctctaatgatcacccccgaggattggtctgattgtggtagtgcaatgatttttgatcagcatcaaaagttgtactagtaaaaatttcatttttttatcaaatgcacaaaaaattaaatgttcttcaatgttttgtacttaaaattttgaagcagaaaatttaggccaattttcgaaaaagaattcataaatctttttttttaatttttcgatttttgtgtgcttcttaagaattaggggaaagttatgcttggtaaagtgatcaaattcaccaaaaatggattcaatgataaaatttaaaattataaaaattttattcattttcataatgtcactgtccaattgttcgcttctgtctaaatgtccgggagttagtcggtatttccattgtttcaaatcgttataatttcggcctaataagcctacataattcctcaggctaaaaaatctccgttattcgttggcacaaaaaggattcggatcggtagacctggaaaaaactcgcggaaatcattattcgggagagctaaagaaattcccagaattttctgtaggcacggaaacaaaccggtagggtcccaactgcgtcccgccaactgcgtcccaaaaaaactccattatatttttaaataaaaatcgaaaataataataactatgactaaggctatgtcatatacttttatatattttttctactcctttgctacaaagaaaggagctgaaaaaatacatttatatgttttgatttggtgaagggttaatggcattttgctatttttttgcaccctaataaaaacatttgtccccctaaacaaaattgaacccgggaataaatgcaccaactttaaattgcctgaaaaattttgaaaa

SEQ ID NO: 39735 - DNA, 813 bp, Heterodera glycines
agatgtcattgaagcagatgccggcgctggagatgctgcggttgtggtcctgaaaaaccaaaagataattttgccaaattatttgattgctaactgagtcagcgtcatcacagatgtcattgaagcagatgccgaggccgaattcttttgctgcttgggcttgttgtttgaccccttggatgcagatgctggagatgctgcggttttggtcctgaaaaaccaaaagataattttgccaaattatttgattgctaactgagtcctggcagataccggcgctggagatgctgcggttgtggtcctgaaaaaccacaagataattgccaaagtatttgcttgctaactgagtccgcttcatcacagatgtcattgaagcagatgccgagttcttttgctgcttgggcttgttgtttgaccccttggatgcagatgctggagatgctgcggttttggtcctgaaaaaccaaaagataattttgccaaattatttgattgctaactcagtaaacgtcatcgcagatgccatcgtaccagataccggcgctggagatgctgcggttgtggtcctgaaaaaccacaagataattgccaaagtatttgcttgctaactgagtccgcttcatcacagatgtcattgaagcagatgccgagttcttttgctgcttgggcttgttgtttgaccccttggatgcagatgctggagatgctgcggttttggtcctgaaaaaccaaaagataattttgccaaattatttgattgctaactcagtaaacgtcatcgcagatgccattcgaccagatgccgaggccgaa

SEQ ID NO: 39736 - DNA, 760 bp, Heterodera glycines
ggggttttaagtgccgcaccccctcattttctaaaattgctccgtctcacttgagacaaattgggggccgttgtcagttaccaaacattgtggtgatccaaaaaatgcgaatacttctcgtaaataatttacgatggcaggtgaatgagttgagttcatttgacacacaaatggatacttagaatatgcgtcaacaattataagaaaattcgtcccccaaattggacccgcgaggtctgcgtggacccgttcgaatggatatttggcctcaggccatttatattcggggtccacacgcggttcatttgacgcatttcgttgacaaatgtgacactctttcacataattttcaacttcctcagaccaattaggccaccacactaagtctctggttcgggctttgcatctcacaatgccaaaatgtgcccgatgaatcatttttaaaaccctttttctcattttctgtggaattattatttgtcttcccaactttttccgaattattttcccatcgaggtataatttatctctctctctaaagtacggcatcaactcatcatcatcgatcggttccacccagcttgcctttatctgtgacagtactcgggacagtatactatcttcaaatgtctctttttctatagtttttcgatgtaaacctatttcttcatcaacggtcaatacaaaaggaatgtcctctctgctttttccttctatttgttcccatttaattgcaactctcgataatgcatctgccact

SEQ ID NO: 39737 - DNA, 1248 bp, Heterodera glycines
tgtttggcattttgtcgctaattgccaattttaaatttttttttaattccattatgccctaccatttgttgtttgctgttgcgcatgacggcgcatggcacggaaatggccggcctgcaatgagcagccaaaagtgcctttcttgcccgatttttgctttttgcgctgcttcgaacggtccgtttggcctcggtagctgaggccgaaaaatttttccgggccctgaaaaaatttaaaatgggtacgatttagcaaaaaaaaaaataattaaaaatttttctagttttatttctttttatgtcatggattaaatgccgaactcggtctcgagaaagtttggttctctagcagctttactattgagtcaattagatgcccttgatttattaccgtactgccaccgtcttcctcatcgtcactttgctgttgtccgtcatactgtacaccgttttgtgcctcctcttcctcctccacgtcatcgtcgtcgtcctcgttgtccatgttgatgtccaactgttcttcgtcctccattttggcactgttgctgccatgggacagcgcaaagccgcgtccgcgttgcgtcagctcggtgatcagtcgggcgccaattgagcgcgcgctttgctcgaacatgttcaactgtacttcgggctcgaccgctggcggtgtactgtaaaaagaagtaatggtattacaatgattagtgagattattaaagaggttttattgatttttaaaaatataaacttaaatactgttttagtttggtttaaagaggttttaaaaaatacgaacaaaaaaccaaaattcggtatattgtgaaacagaaaaggaaatataatagaatattgaaatttaaaatggggattatttgtctcaattaaggcttgtatttaaatgtgatttaaaaatcgagaatttctgaatttggaaaacttatttgtttgtaccatttcaaagaattaaaaagtacatacggttttctcaaaagtttaaggtaattttcaatatctaatcaaattggcatttttattttttcttttatgaaatttttatttttttttgaacagaaattatctattcgcaaatattacgtcattgctggagcgacgctctgttggtactgaactggctggactgaagtggaaatgccggatgccaatgtgaccgcaaccgacggcattgcctttgttggcttctcatccacgggcgtaagcgtgccactgtccgtgctgttccctcctcgtc

SEQ ID NO: 39738 - DNA, 1404 bp, Heterodera glycines
  misc_feature (9)..(9): n is a, c, g, or t
  misc_feature (39)..(39): n is a, c, g, or t
  misc_feature (75)..(75): n is a, c, g, or t
taaaaaaanaattataaaataaaattttactcgtttttntgagctaagtccgctcaacaaatgcaaatctccatnttccacatttgtcaagctttccttgaatgccaacattaattgaaactcctcatcagtcatggcctctgtaaaatcattttcttggcttaattctgatgatgatgatgatgatgatgatgataatgacgatgttgttgcttgagggtgtgttgttcgtgttgttggtgaatgcgtttgttgttgttgtggtggcactgattgtggtgaagaccattggttggccccagctgttgttgtcggaaaatcagacaataagttacctttaaaaaaaaaattcgaattttaaagatgacaacaataaacagtataatgccaaaaattctgcggggttactgtaatataaaaggttgttgctgatttgcagtaatcgaatcaattaggacagttttatacctcatttatcgcttttggaaactactttatatatatttatttttacaataaatgaaattatattcataatctaatatcatttgaaagctctatgtgttctccacatttaaatgtcaaaattgaatggaatcattcaaaggtaataactttcggcgccaaaaaagccaatttttgagggttttagccataagttttttgcaaagtgacgatgattttttttaaagtttttgctggataatagagaacattccataagagctatcaaatgatttaaaaattttgatttggttgatatcgaaaaaagttgttagcaacggcgccgaaacggccggcgccgaagtgggcggtttccttcgcgaccctccccccccttcttcagcggcgacccccactgcattgtcataaacagatagcgacctagacaaccaatggttgtacatgatgaactttttggacttgaagggcgagatttaaccaaaggacgacgtacttgtgctaattgcacccggcatcgtcggagccgttcatcgttagggctgccaggtgatggggatcagaatgtatgtgaagaaggagtaattactggacatcttacctctgcagattgcgcgaaagttagagattccgccagcacgttatgcagtaaggaaaagtatgatgtaattgatgttcatcattaagggtcggctcgagtttagcgccactctggtcatggaccgacttcccctccgcataacaatggggattgtttcgaattgtgactactcgggcacaatcacgcggagcccgttcgctctcaaacacgactaatgtgcgggaaattgcaatcatcgccaacggccgctgctacacacaaggcccttacgatgtgtactacagagatggtaaatatgtgagcgcttaaaacggtacgaatgaggcggtcgggttcccaaa

SEQ ID NO: 39739 - DNA, 1293 bp, Heterodera glycines
tattcttattgcgtttttatttctttttgtaagtatttcaccaaaatttttaaaatttgccaaatttttagttgaataaaacattaataataaaatattatggaatcttttcttattacagattttatttttgtagtgacgtcacattttgtcttacaacaataaaaatgtcagacaatcaaatggaagcggaaaaaaagatgaaaagacaaatgtaaattaaaaatatccaaatttagccaaaatagactttgtttttaaattaagttcaatttgcaatgataattgtcttaaagtgttcgaatttctctcgccttttaaacttggcattgaaatggcatttgtcagccgccgatttgacgctttggtggacgaacattttaaaacacgcaaatggacattgggctttctgaaaattgaatgccgtaaaattggagataacggcacaaccgaaatggaaattgtaaatctgcagcagcagaaaaaaatgccaatgccgcaaaaaccgttgccaaacaaaatcatcgctttcagaatgattattctcgagtaatatttgatggtagtaaaattggtgccggaacaagctcaatattttttatccggctcatagttctttttcaaaaattttccaatcggttcttaaagataagtcagaaatatctgtctattacgaaactttcagttgtttcgaccaaaatgtcatcgactttcttcaaaattttcgtcaaatttttgcctctggcacaaatttatgcattggttactatgatatcaaagatgacattgtggaatttgtcgtccgcaacatttggccaatgctcaaagacaatatccgcgggattcattaccacattgaaaacaaacagtcccatcagttacaacaatttgtcacttccattcttaacgagtgccaaactcttcgctttctattcctatcggcactttccctgtttttcgaccgatgaaagtgccaaaacttcgattgaacaagctctggtcagttggcttttgacgccacgttctgatggaattccaaagttgattgtgtgcagtcaaattcgagaacaccaatggaggccgaaaattataagcattaaatcggtgattagcaacagaaactgaggtggaacggaacatatcaatttttgcgtataaattaattgtcatcgactaaaaattggctcagaaacctataaaatttaattatcccgaatttattaagaaaacacttaattttttctgttcgcgttccacctcatagttaattgctaatattaacctttttttccg

SEQ ID NO: 39740 - DNA, 946 bp, Heterodera glycines
tgactagagcaattgaacgctaacggacgacctaatggaaaaaaatccccgaaggagagaatttaattaaatccattccttcgggggaccgtgccgggtgccgcggggtaagcagtgctggttcgtttcatcacggcaccgaaccttttggctagtcagcaatcgttgcttaacttgccagatcggacgggtgcgcatgattccactgttccaagcaccccaccaaaagcaaaacgatataaccaaaatataaggaaaaattttttaaaaaattttttctccatcttcctttttgatactaaagcatcagagtgctaaaattaagttgtaaataaaatttggtgcgctttagagcactttctgaaaaaaatatttatgaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggctcggggggactgccccgaaacaaaaaatcgattttttcagtgtccgtttgggtactcaacatttatggggagcaaaaatccaacgcaaaattaa

SEQ ID NO: 39741 - DNA, 730 bp, Heterodera glycines
  misc_feature (83)..(83): n is a, c, g, or t
tctcgcccttcactctttccacttttccatactttttcttcctcgttccctctcttcccctactcccgaccctctcttctctntctcgtcccctcatcccaattcgtccacttccatttctcatcttccctttcccctcctctctcccccttcccaatttgttcctccttctcgacagcccttttcgtctgttttctgtcccaatttctcacattaaaaggtgccctttgtgtgatttcttcctctttcccttccctcagggcattgctaattgtaatacctttttctttccttttcttccctttgctctccactttttatttcctgatcaatccgcgtttttcatttaattggttccgaattcattcattttccaataccaaatcagaagagcttgtcttctatcttcttatttattcgatacacatattttgaatatttattttttattattatttctttttttgcccctcccccctcattaagcaaattgctatttccaaaattggacctcacgttaacatttgttgggcaatacattaagtgtgctgccgctgctatgctcttttcgactttttccctttttagcacttaaaggcttttacccgccggcgttaataaataaatcccgcattcatttcattcaaattggccaacccttggcaaatccgtccattcatcgccccaatttccaattaaaattctggaaaacacgaaaacgccaagtcgt

SEQ ID NO: 39742 - DNA, 1222 bp, Heterodera glycines
  misc_feature (17)..(17): n is a, c, g, or t
  misc_feature (92)..(92): n is a, c, g, or t
ttttatgataatagggncccggatttatatggacaaaaaaacccaaaatatagattataatatggatgaaaaaatcgcaaaatatggacganatatgaacaaaaacgcagaaatattgacaaaaaacacgaaaatatggacaaaaaaatctctgaaaatttgtttgaatttagaaaaaaaatcataaacccataaatttttaagaaaaaaccatttttcatgaattacagaattccacaattgggaactcctggttatcatttactgaaaaatattgaagttgtaaaaaattcaaaaattagtaattttttctaagaaatcatattaagcgaatgttgctaatgaaattttttgcacaatttttgatatttaatcaaaaaatttttgatttaagggacgtgttttccaaaaatttccaataattttccatgtgcaaaaaaatatgtaaatccataaaaatccgggccctcccggacttttcgatagctaaggacatttcgaagcaaaggactttatttatttattccaaaaaacgtttattaaataccgttttaaaaacggagcataattaggccattttgctggcaataatcacttaagagactttttgtgacatttttaatattgtagcatatttatttgttaattgttttgtcgaaatttttaagttttcatttcttaaatcatgttaatattgtaaatttggaattgctaatttgccccgaattcactatttattttcataatcacaattaatttaagaaaaaattgtcaaaaaaatcaaaaatcattaaatttccagcctagcgtttgtcatcatttgtagtaatcaagcatattaataaaaaattgcctaattcattcatcaaatatcagaaaaattaattttttggcaatttattctttttacatagctaatttccacaatttaaaaaaataagctttgatttaaataaagataaattcaaaaacgatttttataaaatttaattttagagaaatagtgaaggaaatgaaactgagcctattattcctttcaatcggttttttgactgctcaaattaatcaaattgaatttgaaatgaaaaatgaaataaaacaacaaaatagaaaatattcattaaaagaatggcgccaaaattatgccgaaatttgcaagaaaattgacataagttctgcagaaattataagatggaaaaaacaatttggaattcggtgtaga

SEQ ID NO: 39743 - DNA, 910 bp, Heterodera glycines
agtgattaaaagaggttcaactgtgattagaagaggtacaacagcgattagaagagtgattagaagaggtacaacagtgattagaagagtgattaaaagaggttcaactgtgattagaagaggtacaacagcgattagaagagtgattaaaagaggttcaactgtgattagaagaggtacaacagcgattagaagagtgattaaaagaggttcaacagtgaaaagtgattagaagaggtacaaaagtgattagaagaggtacaacagtgataaaaagaggtacaacagtgattagtaaattcattaaattaaaatgaaaatattttttaacaaatttaattaatttattaactcaaaaaatattttaaatgaataaaaattgaaaaacacgaaaaaaatggtagaaaaataatgtacaccgcccggcttcgaacttcgccccccccctcaaaatgatgcctcagaatccccaatcacacagggattctgaggtcttaacgatgtcaaaagtaaaatctgatcacgtattcgtgatcagcggcccaaataacccctaaagacatgtttttggaatattttggtgaaaaaattttttcaatcaaaaaccatgtgctcccccctttggtcccgaaccccaaaatcacttttatttctataacttttttcaaaaaagtgataaaaatgtaaaataaaatttataaaatagagcaaaaaattgcggatttttatattattttacttttccaaaatatcttttcagaaccgagttcagaattttttactgaaaattcgaatttttccagaacttctggaataactttttttagtttcatgatagaaaatctaaataaaacccataaaattctcctgattttttgctatttttaaagctttgttgtatgaaaattga

SEQ ID NO: 39744 - DNA, 791 bp, Heterodera glycines
ccatcaaataaataatgaacaaggcaattttctcattggtaatgcctcaggcaatgacctcttttttcttttctaacgggaatttaggatttttgttttaacctattaaaacattttgccaattcaaaatgacttagaaatcccaacaaaaatcggttataaaactaaatcagggctcgcaagtgtgcttttgtggttatttctccatagcctatttagtaaaaacattttcttttttgggtttgcgaacaaaaatcgggatttttgtttacataaaattttttttgaatatatacccctaaaagcagtattttttcaaaaaaaaaaataccgaaaataatttttataaataataaatatccgtggtgggattcaaactcaattacccttccattctgtggaatgtaaactcccatcaaaactgacataatttctattttggcgtgaaattaaaaaatattttggtaaattttttagggttttccaatgttcaaaactgttaattattattaaatattaccacttgttcttggtgctaggtcaaaattaggaatgtgtgaaaataatttaattaattttcgccaatttgacttctttccaattaaaaacaaattatttttcaaaactcgtgagaacatttttcaactttcgtctcggcgatgaatcaatttgattcccatgcgcaaaacaatgttagtttttttagataacatttcataatgcgtaaacttaattgtatgccttttaatctcagtttttcgagaaggtttttaatttattatctatttttt

SEQ ID NO: 39745 - DNA, 1033 bp, Heterodera glycines
ctgatcattggccttgtttggccaactcatccccccccccctatttccctacgttcaatcgggcgaaggtgtcggtgagttcgttccgctccatccgtccacaggtgccggacgacagtccgctgatggcggacgcgttggagtcgcgttctccgcccgcaaaataagaggcggaaccgccacccagcgaggaggagcgaccgccgcccagtgaagaggcaaacggctgaacaacacgaataatgcgaaaataatacccttataaatgaatgccacggcacattttccacaaaagtctcgagaggaaagccccactcaatgatcaagactctcgattgggccagcacctgtaggttattgtgctgctggtggtccgtgcttcccccgggcgcggacgccgcgtgcggtgtcaaagtgccgccgccctctgccactgtccgtcctccgttctccaatatcactgagccgttctcgccacctccaccagcggcggacaaaagaaaaggctgccgctgtaaaaccttggccgcttcgtaggcaaacgcgtcgattgtgtctaaaattagacaaattaaggggtacgctaattgatacggtatgcactaattggatacgaagggcttattaaggagggggggggggggtgagagcaatgtttaaaaagtgaaacaaatcagcgagaaaatctgtgtgaaaagtaaagaagacagacagttagagaaggacaagaaaaaagtgatcagagtcttactctgtgaaaaattcggcgatacattgaaaggaaagttggcgatctaagaaataaagtgataggaaatgttttaggaatgttcagagccataaatggtaagtagtaattcgtattagttatcaaatttaggaggaaattagtgatcagatcgctgtggttgatcagaaaattagcgaaaagtgatcagaattgatcggagagattggtcagagtcaagcaaacccgaatatttggaaagtgataagaaagggatgaattggcacagcactcagagttagtccg

SEQ ID NO: 39746 - DNA, 1369 bp, Heterodera glycines
aaaaggttggcaaatgccggccgtgttacgcttgggctgctctctgctccgctactgtttgttcccgggctaaatactctagttgttgagccacaactgcagtcagtgggacaaggtactgtaacgatttgtgaggtgtttattattgcaattttaaaatatgttaggtttgctccattggctgacattttggcatttttcggggataagttccccttccccgagtggtgtcatccccgaatccccccattcctccatcccatcaattgcatttttctgcacttggattctaagtaagtgctttgattccgttccatgcttgaaatagttagccctacttaataacgaaagaagaatttagccaattttcgcatttgtaattttactccaaaattttgagtcgaaatcttatttaaaaaatctcattcaaatttttttcaactaaaaatccattaatttgcaatttggttaacatctgtcgagggaatcccatcaaatttaacaaaagtatttaaacatttgatttaaatggcaatcgatttgcacagcttttggattcgaatttggcccatggcttttggattcgaatttggcccatggcttttggattcgaatttggcccatggcttttggattcgaatttggcccatggctttttgattcgaatttggcccatggcttttggattcgaatttggcccatggcttttggattcgaatttggcccatggcttttggattcgaatttggcccatggcttttggattcgaatttggcccatggcttttggattcgaatttggcccatggcttttggattcgaatttggcccatggcttttggattcgaatttggcccatggcttttggattcgaatttggcccatggcttttggattcgaatttggcccatggcttttggattcgaatttggcccatggcttttggattcgaatttggccgatggcaaccattttcaaataattttcagacattacagtagtatatagcgtcaaaaggttgcgggttggttgcgggtgtttcccgcacgagcccgtgcctatgggaggggtgcagccctttgaagttgccgccccatcaaaaaatccacgatggggggtgtttcaaaaccaaaacctattggaccactttgaagttgccgcctgaccaaatccgatttcccaaattgttgcgggtgtttttttcccgcgccgcgcagcgccgcgggaaggtcatcaatcatccacctgtcaccaaagtgacaggtggaggaaattcaatttaacttttgcaaattttaatctcaaaccttttagcgttttattttctcaatcctgaaatttttttatgatgattttttcggatcctgaaa

SEQ ID NO: 39747 - DNA, 1118 bp, Heterodera glycines
catctgcgagtcctaggtattcgggatatgaggttggaatcgctcgcataggaatgctttttggcttttcactaagcgaaaaaaaatatcatgaaaataatttggaatttcttaaaatcattcctagcataaaaaaatttaaaaagaaaaaatttgtgaggttttttggtcaacaataataaaaaaaaaccgtgaataatttgtaaaaaaattttccaatttcctacatcttttggcaccttcaaaatgttaatacatttttaaccgtccgccaatcgaaaagtccattttttccgcttaaaaatggaaatttcatgcgcaagtttttctcgaatttcgtcaatgacgtaactcttcaattttctcaaattttgctcagatttccttagcccattggaaaatttgctgaatttttcgtcaataatttcgtccatttcatcaaataaattgttcttcaattttttaaaatttgtttcaatttgtttctccaacatgtctttgacattgaaatataatgacttttgttggagtttttcaagcacagcatttacacgatcgtactcaatcacttcgccatctcgaaaatcaagtgcataatttttgaaaaaatttggattttttatcacaaatctttgaatttttcctgactaaattaattataatatttgttttactcaaaggacataaaaattttcagaaaatttagttttttgtgtattttctcgataataattaatgtgactttctaattggaaaactatgccaaaaataagtgtccaaaatatattcatcaaaattaatatatttttaactttgttttgtattttttcttctataatgatttgctttgtcatatttagctattttcaagtatttaaatttaattaaacgaatttaaaaaagaaattttgcaaaattttgcccctcaagacatgaccttttcctctcgcacccaaatgtacaagttttctggattgccgcttatcggcgtgtcaaattcgcccatgccgccatgtgatccaagcattgccctgatcggccgctctcctcccacaaacattttaaatctcccgttgctattcatttcaaatttgtttggcgaaaatgtaaatttgtaa

SEQ ID NO: 39748 - DNA, 239 bp, Heterodera glycines
ccatccctttaagattgactaaacgtcttttttactattttaaaaataatgtctccatccctttaccagtgacaaagggatggatccattttaaaaataatgtcttcatccctttaacagtgtctaaagggatgaagacattatttttaaaatggatccatccatttgtcactgccaaagggatggagacattatttttaaaatagtaaaaaagacgtttagtcaaacttaaagggatg

SEQ ID NO: 39749 - DNA, 1312 bp, Heterodera glycines
  misc_feature (30)..(30): n is a, c, g, or t
  misc_feature (1225)..(1225): n is a, c, g, or t
  misc_feature (1264)..(1264): n is a, c, g, or t
  misc_feature (1289)..(1289): n is a, c, g, or t
aaatttttaattaaaataggttattgctcnccgacatttttaaatttctccagccattctcaacaaattttgtcgggcaatttcctccccaatctgcggcttttcttctccgcgaaagtcggagcttaaccctaatttaaatcacgcttaaggcttccaattatatggtgagccatatttttcctggactgtgaaaagccagaaacttcgttttgtttgaatcttctaagatggaattacgtttcaattttccatatttgtccatatttggcaatttgtccacccatattttatttatatattttggtatttgtttaaaatttctgttggaatggccacgatcagttaaatcagaatttttaaacttgaataagtattcagtaaaaaaatgttttttttaaatgtgcccatattttgtaattttatgtctatatttcggcggttttaagacatatctttgttttttaaatcaaattaattagcagccttaagcatgattttcaatttgttaggttttttttattactgcttgatgtagaagcttgatattcatcagcagcctttttacttggttcagcaaaaactgctttattcacttggcccattagtgtcgagacaaaacttccaaaaagtcgtttcccttgaaccacaccggtttcgagcactacaaaataaaaattgcaattcttttcactagagtcctatttttgaaaaaagcctggatttcctggtcaaaaatctaggtccaggaaaaacccaggcttgtcatggccttgttctcaggccatgacttggataaaactgtttgaaaaaatcaattaattgttaggaacacctgtttttatctacttgaataataatgtgtttttaatctatttaatctttttcagataactgaaataaaacattggtcaatctgaaataataaattctaaaatgttgttcaataagtccttgttttcgtgcaaaacctgaaacggattactgggtccaggtccagacgatttctacgtttcacttaatagaaaatcaaatttacccttttcaattgctcctgcttcggcttggacagatgaaataggtgttaaagcttctaattttttttaaatattttattgaaaattattcttttacattataattttatttgaaaatttttaatatattaccctcaatttgaagtatctcttttttatgtgaatcgtcataatccgctaatgacggntcactcgaatctgaatgtttaaaagtaaattaaaatgtncacattttgcaataatgctactgtnttcattgctgatcgtagtcactg

SEQ ID NO: 39750 - DNA, 862 bp, Heterodera glycines
  misc_feature (811)..(811): n is a, c, g, or t
tttccgggaacgggatcgggagttgaaaatttaccgggacgggagtcccgaacgggaatcccgtagaaatcccgctcccgttaaaaatcccgttcaccgaaaaaagcgggactcacgtaaaatcccgcgggagtcccgatcccgccggtctctacctattaagatctttcgaataaaattacctaaatttattgaatgatattttattttggcgccaattttaaatttaaattttcatggttcgatgaaaaagtcaaaaatgagacaaaagaatttgtccaagaatgtaagctttttccctaaattttgttttcattgttcttctactcgtttctttcgttggttaagttcacgcaggaaactaacaattaaaaatgccagaagttgaagacgatgaatttgccgaaatgcgccgttcgagaagatcgaatgtgtcaaaaaagcgacaacagaatgttttggaagaactaaagcaggcgcgcgcaacaggcaaagcctatcggaaaagagtatgtgaacaaaaaagcgtaaaaaatgagagaaaaataatgttaaaatgggaaacaattcaatttggcaaagatcaatgaataaataccctttggttaggtggatgatttggttgaggacctttacatggaagttgatgaagccgaatatgaagccaaaaaacgcgagcaccgttcctttgttgaaaatgatggtttttcatttgttttgcattataatgtagcttttataattaaggtagtcattattacgatgaggaggatgattctgaggacgaatttgaagaggaggagcgttctanaaaattgaaaaaaagcaaaaagggtaattaatttcggattgatcagcaaaa

SEQ ID NO: 39751 - DNA, 815 bp, Heterodera glycines
tccccccccccccccttattgtttcccctcgtttttctgttttctaagaaaaccaaccttgaaaatgatgacagacggaacggcacagactttttgtgccattgaaacttcgggcaatgactccgcgtcgactttggctatatcgaaagcattctgtccgtattccctctgaagttccatcagcaaatcgtccaactgcgcgcaagaggaggcccaaggggcggaaaagtgcacaaaaagcgatcttttgctacaattacaaaaggacaaatggaaggaaattcggagaaatgaacctttccccttcggtggacgaaacgaatgcttcgaattgatttttgttgcctatcactttaagcattattcgttggtcactgtcacaaatttgctgagataaataaatttttggataaattttgggtggtgtccaaaaaatcagtactctggactgaatcatacaactagtaaaaacgcacgaaaatatgaattcaaaagctatgtattgacaggcaccaaaataggtaaatcatcaatttttagtaatgaattttaggtagcaaagcagaaacgattaaaaaaaatatttaattcttaataaatacattattcaaaaaaattaaggcgctagttaaaaagttaccgattttgaattctatcaaaaagtaaaaacaaacggggggacccttttggggaatagtttagatggtacccccccttttttaaaaaattttttcaactttcaaaaaatcataaaaacatgtttctagggggtttcagggccgctgatcacaagtccaacatccattttgaccgat

SEQ ID NO: 39752 - DNA, 1212 bp, Heterodera glycines
acagagtttgcccattccactttaaattgtaaaaaataatgattaagtccattaatccggcaattactagagtagctttcttgcaaactttcctccatagaaacttctagccattcatcaagattttcaaacttcatctaaaattggcattttgtcaatttgcattttttaaaattccttttaccatgaatgttaaatttttgccatcgtcccatttgaacaggtcacggtacaccgctttaattatttccattgctgagcttaattggagccggccttgtgccacacgaaaacgtggcgtcatgcgccgcgaacccgacacgtagccatgggatgccaatgccatcatttgccaaattttacagaactcaaccaaatctttctggcattttttcatagcccagttcttttggcgttttcatttgtccgctctcacaatgccaatcctccaccatatggcgcaaaaagtgcgttttgctcaatgccaacgtcttttccatgtcggctgtctccggttccgtgccgtcttcgacaatcacttcaaatggccaaacaatgccaaaattgctcagcagagcaagcaaagcgtaaatgatgatcagaaatttgggtcggaattggcacatattattgccgtgctgttgcgtttcataaatcgctaaaagcggcttaaataaggaaaatttagggctataccaaaattttgcaatttttcgcatcactttttattttaacatattttgagatttttttagaagacataaatttcttaagaaaaggttaaattttttttgaaaatgtaccccttaaatttaattttttaaaaaagaagatttttaaaatgctttaaacattatctaggcctaacagtattttacggcattttttcttattcacctttttctaaggtttttttttttgtttaaaaaactcataaaattttttaaatattttgtagataattcttaaatcatcatattttgcgatttttcttacatataaaattcccagtcctaattaatcataaatagaattcattattatatgctggtttttatacaaaaattaaggaattcttttttttaaatttcactggcatttatttgtcaatgttcacaatcaccttttttttgccaaaaagcgccatcattgatttatgggcgtccaaagtgcgtggaaaaatgctaatattagtcgcttagaaaattttat

SEQ ID NO: 39753 - DNA, 960 bp, Heterodera glycines
  misc_feature (75)..(75): n is a, c, g, or t
  misc_feature (107)..(107): n is a, c, g, or t
tagggaagctattccgaaaggatcgggtctaccccatatatctgggcgcatcgcttcggggggactgccccgaanacaaaaaaaatcgattttttcaagtgtccgtntggggtactcaaacaattatggggagcaaaaatccaacgcagaattaaagtacaggctatagggaagctattgccgaaggattcggtctccccataaatctgggcgcatcggttcggggggactgcccctaaaacaaaaaatcgattttttcaagtatccgtttggggtactcaaacaattatggggagcaaaaattcaacgcagaattaaagtacaggctatagggaagctattcccgaaggattcggtctccccataaatctggcgcatcgcttcggggggactgccccgaaaacaaaaaaatctattttttcaagtgtccgtttggggtactcaaacaattatgggagcaaaaatccaacgcagaattaaagtacaggctatagggaagctattcccgaaggattcggtctccccataaatctgggcgcatcgcttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctcccctaaatctgggcgcatcggttcggggggactgccccgaaaacaaaaaaatcgattttttcaagtgtccgtttggggtactcaaacaattatggggagcaaaaatccaa

SEQ ID NO: 39754 - DNA, 989 bp, Heterodera glycines
aatagtgtgttgaaaacgcacgaaaaatagttattgacaaaaaatggctatctctgaaagtcacgattaaatccctaccgggaattggacaccaacttttgtcttctgttgtagcgctgaataaagcactaatagtgtgtttgaaaacgcacgaaaaatagttattgacaaaaaatggctatctctgaaagtcacgattaaatccctaccgggaattggacaccaacttttgtcttctgttgtagcgctgaataaagcactaatagtgtgtttgaaaacgcacgaaaaatagttcttgacaaaaaatggctatctctgaaagtcacgattaaatccctaccgggaattggacaccaacttttgtcttctgttgtagcgctgaataaagcactaatagtgtgtttgaaaacgcacgaaaaatagttcttgacaaaaaatggctatctctgaaagtcactattaaatccctaccgggaattggacaccaacttttgtcttctgttgtagcgctgaataaagcactaatagtgtgtttgaaaacgcacgaaaaatagttcttgacaaaaaatggctatctctgaaagtcactattaaatccctaccgggaattggacaccaacttttgtcttctgttgtagcgctgaataaagcactaatagtgtgtttgaaaacgcacgaaaaatagttattgaaaaaatggctatctctgaaagtcacgattaaatccctaccgggaattggacaccaacttttgtcttctgttgtagcgctgaataaagcactaatagtgtgtttgaaaacgcacgaaaaatagttattgacaaaaaatggctatctctgaaagtcacgattaaatccctaccgggaattggtcaccaacttttgtcttctgttgtagcgctgaataaagcactaataagtgtgtttgaaaacgcacgaaaaatagttcttggacaaaatggctatctctgaaagtcactattaaatcc

SEQ ID NO: 39755 - DNA, 1241 bp, Heterodera glycines
  misc_feature (77)..(77): n is a, c, g, or t
gagtgaaattgagatttgagtgtggtgcggaccatcaactgtgttcaacgcttcggcggcaaaagtgcgacacattncgcattgtgtggacactgtgagtcttagttggaattgtattacgaaggccaaacatttttgttttgcttaacaaacaacatgctttcatttgattaaccaaataaacttcgttacgcttttaattattcgttatacactaatgcgcttttatggcccttaaaatttaaaaaataattagtatttaattgatttggtgtgtaaattccggtcaagttataccctcttggtacaattgaaggcgtttaagagcattgttttgttttggatttcaatcaatcattttggagaattacaggtgaagagcgacatcagtggtgaccaaacgcttcggcggattccaagtgaacggacaaagctgattgattggacggacatttgacttctgttggtggacaaagtgaattccttttcctctattaattaaattaaacaaaattaaacaacaaaacaaaaccaaataaaataaaaagggggaattgaaaaaaagggatcaaaatcaaaaattagaaattgcttcggcagcacaaaggcaaagaatttactgaagtttcagtgtgactcctttggttgacattttaaaacgcttcggcgatacaaaggcacaagataatgcaaaataatgcggagcttggtaaaatattttatctgaatacgcttactgctataggttcttcaaatcctttatctcaaatatttgatggtgaaactgcttcggcattttatgagtggcaaattaaatttctggattatgtggatgtctttggatcaaattggtcggaagcagacaaaataaatcgacttaaattacacttaggtgctcatacgcgaacaatttttgaaaaacttttgccaaccgagaaggatacattaagcaatgctctgaaaagcatcaaatcaaagttggatagtccacatttcagggaattagcttataggaaattggctacttgctatcagaaagatggtgagtcagtggacgagttcataaaacggttagttcccctagtgaatacaacgactgaccaatttccatcaggagcgagggaggagatgctctgtagatgtctaatagagaaagtgaggcctgagtatcagcgttcgctttcattagtggctccattaatagggaaaaatgatttcaaaaaactgacgtcttacattca

SEQ ID NO: 39756 - DNA, 1418 bp, Heterodera glycines
  misc_feature (19)..(19): n is a, c, g, or t
  misc_feature (59)..(59): n is a, c, g, or t
  misc_feature (1295)..(1295): n is a, c, g, or t
  misc_feature (1330)..(1330): n is a, c, g, or t
  misc_feature (1387)..(1388): n is a, c, g, or t
tgccgaagtgtttatcatntcagcaattttctgatcacttatttttggattttcttttntaatttgccaataaattttcattttttccattttttctttctccgttattctcttacagcgaattccgaattgtccccaaactcttcgctattttcgaattaattttatcccattcttttgttgaatattttcttcctttttgctttattttttctttaattttataatattttccaattatttctcttttttcttcccattttccaccaaatatttcgtcaaatgacttttgttccaatttatcattagctgtttcatttggataaattagagcaattaaaatgaaaattaaacagactaatataaataatttcattttcttgaatattcttgaaattttgtttaattttctttaataaaacccaaatgattaaattttattattaatgagcatttatttattcgtgaaatcatttctcagaaaaacaaattggattttctagtaaaacaaactataaaacattaaagtattctaatggtcttcaaaaaataaatcagcaaattattatttattttttaattaaaatttctcaaaacaaaaatgccttaatgattttaaaaatagttttttttaggaatattctatgtagagctgggaattataattattcaaaatcccgaaatatttaaataaatatttacgaaaaaatgccgaaatattaaccaaaatattgaaaaaagtccgaaatattaagcaaatatataagaaaaatgagaaaatttggtaaaaataaactgcttataacaccttgcgatacttagacaattttattttattttttcaaaatttctttaaattgagttgttttacatatgttttacattacaatttctaatttaatagatgttttttgcttgctatgattttatgtcattatcgctattttacacatggctcgttcaaatccggaccaattctttgaagaggtgacatgccttggcattattgtataatattttttagatttatatatatagattttatgtttaggatgttgaatgttgacaattaggttcactttggttaaaaaagcaagctttcgctcataatcgtctagatatttggaccttttgtttaaagcttgttaaaagtttatttttttaaattaataatattttttatataaaatttattatattttttttaccaaaaatacatctttactttttatgataaacatgattaagcaaaatattttcaaaaatttcgttttattttaacgaaataatatatntttcatttttgtgtaaaattcctgtgatagaatanatgtgtacagaaattgtttttattttaaaatatttgtttaatttccaaaatattctnncaattcataccttttttccatttaattttt

SEQ ID NO: 39757 - DNA, 945 bp, Heterodera glycines
aataaattctatactcatgtattttccacttattagattttgcaggcttattgctgcatgttctgattttgcaggcttattgctgcatgttctttgacacttcttcaaaataacctatgccctttattcgttcaaaacagcatctttgttgtttcgctttggattaacaagcccgatgataaatagctcgagcgcaaaacgcgtgcatgtttggaaagtatcgttcataccaataattgagggtttatttttaaatgaaattttatgataaaccttattatctcagaagctatttaattgattcgaatgtttttatcgcggttaattagagcaacgaaaattggtttgaatcgtgaagtttatcatttctaactcacttctcaaaattgttgataaattgcaaatatatttttccaaaagtctgtggacactttctgaaaataaattctatactcatgtattttccacttattagattttgcaggcttattgctgcatgttctttgacacttcttcaaaataacctatgccctttattcgttcaaaacagcatctttgttgtttcgctttggattgacaagcccgatgataaatagctcgagcgcaaaacgtgtgcatgtttggaaagtatcgttcataccaataattgagggtttatttttaattgaaattttatgataaaccttattatctcagaagctatttaattgattcgaatgtttttatcccggttaattagagcaacgaaaattggtttgaatcgtgaagtttatcatttctaactcacttctcaaaattgttgataaattgcaaatatatttttccaaaagtctgtggacactttctaaaaataaattctatactcatgtattttccacttattagattttgcaggcttattgctgcatgttctgattttgcaggcttattgctgcatgttctttg

SEQ ID NO: 39758 - DNA, 815 bp, Heterodera glycines
acaatagaagtcgaccctggctttatccaatgataccaaccatatttataaccacttttcttactaacagttcgcgaggttcccttgttagccttttatgtgaaaaccaaaaacggccaaattaatagaaaaactgctaaatctgaatcgatcagggcttaatcacaaattcaggcaaaacaattgctcagttaaaatgttcacgtaccaacagatggccacaccaacagtaccagcatcggtcattttcgtccgcaatgccatcctcgcggtaagcactacacgggcattcttggcaagcttaacaaatgttgctcctctcattaattaatttctatttcattacctccttctccgctggtggtggccattaattttcgctttttattttctttaaaattcctaagatatttgaaatgaataagcaacgaaaaatgtgaaggtacacaaacactttcagttttaattctgaaattgatagataggcaattaattaattgggtggatggaactccccgccattggtggagggaggcaaataaatgttctatttacggaattaagtggtaaattccccccatttttgtgtgttttttgccaacagattatctctcctcttcagtcccgtgacttttagtaaataaaagggaaagaaaaattaaaggttgtattaattggtctttttagtgatggaagtcgggacgaaggcgtggagaaagtggaaaaaagggggaaggatgggaaagaaaggggaaaaattggggaaagttgaaaaaaagggggggggggggggggggaaagaggggaaaaagggg

SEQ ID NO: 39759 - DNA, 1317 bp, Heterodera glycines
tttttgaccattgttacctccttctttgttttatcttcgtcttcctcctctttaggggttttctttcctttctgctttaactcctttttgcccttttcttccgactcttttttggccattttggtctccttcattgctatttgttcttcgttctcatcatttccgctttctctttcctctttttgtcttttgcatactttttcatatgcaaaattttcgattgttaattcctttaaatgttcttcaatgcgacttgtcccttcaataccaaatgctgtgactaatctattttgctcttttttagcattttcaggtgaaaaatgcactgttacttcgcaatttgcttcttcttttgctctctgcctcttccttacttttttcctccttccatccactaaaattatttaaatttataaataataatttaattaattttaactcttttttccctttgcaatgagaaagaactcaccacagaaagaccttagcttatgaaaagcattcaaattaaatgaacataaagaactgtattaaaaagcaacacagcaaaacgttgttaaaatatataaattattaaggaatacgcacaaatagatttttttacaaaatatttttttcaaattacacccaccaaatgattctgttgcttcaaattggcattcatctaaataaaaatggattaaatacaaaaatcattaaaaataggcaactaaatgctcttaatcagtgacggggcaattctctcccaaacgaaaagtttaaaatattttaaagtgacaatggcatactaactgatgctgcacatgaaatctgttcattcatcaactgctgtactcccaagatgtgctcgtcttccccacaatgaatacggccaattgtgagagaagaagaagcagggaggggagagggggggggatggcaatccgacccctcgaaattagcttcgacttgaaaataagggtgttcactctcgacgaacagactgtactaaaaatacactacgacacagtaatagagcaaattttacgttatggttccgatgaccccgctgaccccataagtggtacatatccccattatattcatcctaatcttatccaaggcaaagtgattactcattccctcacaaagcattatcaacccatattcacaaaaggtattattaatgattcattccaagtcctcgaatttggttatcgaaagtgattgtataatttatttctgtgtatattagatttcttattgaacacttattatatataacccatgttgagacgaaatgacccctgaatgatcctctctaacactccaagccat

SEQ ID NO: 39760 - DNA, 1021 bp, Heterodera glycines
  misc_feature (6)..(6): n is a, c, g, or t
ctactncgggaaatttctataaaattaagcctgggcctccgtctaggcggcccaggtccacaggacaaggcaattttttgcccgttctggatttcctggacttgggtttttcaacaaaatccaagcccaggctaaatataaaacatagacccagagacccaggcctttttcaaaaaaccaaagctctaattcagctggctttagggttcgtcgtctcgggtcccgagttattgtcatttcctcagttcttcgtggattatttctcggttaaatcattgcttatagactaggcttgactgtgccagcaacaaagctcaattttgaatttaaaaattcaaatttaattttaattgttttcagattttttgtctaagtattatttggtcgttcccataaatattgtgtcctcattaaaataaaattgcacatttttcaattcctattttgcttttattttcttgaatgttttgactgatgagagttatattcataagacgatgtataatattgccccgatagtttaatttttaatagttaatttttacaatctctccaaccctcgacacacatacaaaattcatatttaaatggtgccactttactttaaaatcaatcaccttgctgctgctgtcgagagaatttttgcccacaaagttttgcatttccaaatcacacttaatcacctaagcacctccccccccccactgtttctcccttagggcgaggggaactgggaacatgacagttcggctaatttaatgctcctttatgagtcattttcacttgcaactctcgccaaataaaacaactatctataccaaaagattttttttgaattggattaattcggcaaattgcataaatttcagctattttttgtcaccccccccccccccattttttgaacagcgaataaattgtgcaaaattgcatcagttcgccaaatcgatttggcgtaatgtgtgctgatgagtgctgctgactttgtatgtgtggaatgatgaactggtttatttatttt

SEQ ID NO: 39761 - DNA, 1074 bp, Heterodera glycines
  misc_feature (29)..(29): n is a, c, g, or t
  misc_feature (868)..(868): n is a, c, g, or t
  misc_feature (912)..(913): n is a, c, g, or t
  misc_feature (1040)..(1040): n is a, c, g, or t
aaaaaaaaaattttcttcaaaaaaggggnggggggtaccattctataaggtataccggatgctttttaaaatggttgggggagaattttgcaaaccgacacggtcccttattcggtttttcataatcttcggaaacatctctcaaaacaacgaataatttttttttcatgttttagaaagctttttctcactcaaattttggccatttgattgagctgacaattgaccaaatgtcacgcaaagttttgtcggttactcattacccaaatcacaacaaaagtccgaatggggaattgcaaatcgatgtgagggtaaaacaaatcagagaaatcagtgggtaagacgtaaatcattttactaagctaacaaaaacactttataggcctgaaacgacttcatatttacaaagaattgaagaagagaaaagggcaagacagcacggggccacccaggacaacaggtcgaattacagaattacaattcaaacatttctaaaattggtcaaagaaattttgtgagggaaagtgccattctctgagatcaaatggcttcacattatcccctctaatccctttcaggtcttttctgcaaaaatattggatgtatttcgtaccggttattctttttatggtaagtaaaatatgcgtttaatcccacaaatttatttaattcttttcatttgcatgttttgtccaatgccctcaacaccgacaaccaagcccaagaatgacaatccggtttttcttttttccttcattctgtcatgttgaatcctggaaaaatttttgttttttatttcgggagggggcgggggcctggctacggacctgaagaaaagtgtgcgaatcgatgttatgctaatttttanagggtccaagtaattatgagacaacctagtaattctggaattanncaaacatgtcgtttaagtgattgattcgcattattgttgcctggagcttttgtctcatttttgtttaattgtaaaataaagtacctaattggtgtaaatttcagattcggttcgcgatttgcatccnggaaccccccatatataccaaattttagctaaaa

SEQ ID NO: 39762 - DNA, 1424 bp, Heterodera glycines
acgtaaatccgacgatgttattttctgtgtatccaatcgcatgaatgagttttagcagaatgtcaatcactacttaatttttttttaattaattttcatggaaatccaagggatttgtgggttcagtcacagtgagtgagtggttttgcccataaaattttgaaaaaaaaaaagtttttttttggaaaaatcaatgaagggcacattgaattgcagagaattagtcgttgccaaattgaaaatcgtggcgcagatccatttgaagaaatcttagctcaaattgagggcccatttaggtcttcgaaataattttggccctagtttttgcgatttttgtgcctcctttattgcttttttttttaattcaaacccgtacaccccaaaacaggaaagtaccaaaaaatttagccgcatggcctttcatccaatttatttgcacacatttttaacacgattttgtgcgtcgatccgccatttttgggtgccattttggaatccacgggaattccaaatttccaacaatttcggcgcttgttccacgaagtccccaattttttcgaattttatttattatgcctttgcttcgtttttcgattttcaacccgttttttccagaaatttatcgccatatttaaatatatatacttttttgcccggccggccgctgccgccagaccaagcgaagttgacaatgccaagaaggccatttggtggcaaaaattcgtcaccctccgcctcctcgtacacttcggtgccatccgcggacccgaacccgtaccagaaccatcatccgcttgtgcacagtgccagcttcaggacagggggcagttttcggtatactcagttttttcttggggataatttttttttttgaaaaatagctttttatggttgtccaccaagaaaaactggcattttagggcatccatggctatggcccttgagttttggtcaaaatttgttttttttgagcttcagacctataaaatggtctccaaaaatgctcatcttcagggtcaccgattcccaaaaatcctgaaaacgtttttgccaatttttttaaacaaaattcccattgtgaattcatttcgtttaaattcttggtaccgcttatattaaaaacggggtttgcaactttttgctgacaattttctctgtgaaaaatgtttttcttccacttttgtttttcatcttcttcagagcagggttgaaaaataggaattgtgtgtgtttttcacaaaaatggcacttaaatttgccattttgggagtcaaatttacaaaaaatgatatggtaaaatgggggacccgtcggtgatcggaccgggtcgaatgggcgacgccaaatgggcgctgccaactgggcgacgcccgaatgggcgccaatcaaacgggcgccagtccccttttctttccctacaattt

SEQ ID NO: 39763 - DNA, 1203 bp, Heterodera glycines
gccttggttccagcaaatgataattgggattggtcgcagtcggcaaaatgaaagggcaaattgacttagtgaattcttaagatacaacaaaagcattctctgctgtctggtgtttgactgtgttgaacagaagcacatttttaggaaatttcttgatacaaaatcacaaaagtaaaaaaaaagaatcagtcaatcttcatcttgtcagtcataatacctttcgcgcaagagacagttgccagcaaatgtgtgccctcgcatttttcaattgcatttgaatcacccaccgatactcaatgttcaccacgcacaaacaccaataaatatttgcgtcgctaatgccaaaatataaaaattttgaaatttttcttcgaaaaaagggcggtaccatcggtggtattactttgtcgtaattgcttctaatgatatatttcaccgacaaagagaacatatccaaaatttcagtttttttttgttacccaattgaagattattttaattcatcatcttaattcaccgtcaatttcttcgcacatacataaatgtgtatttctctccaaaattgcctcaagccgaaaattagtctttgtaatgggcggagaatgaatgaattgatgagcatgacaaacaccgaaaagaaacattaatccgcagcagcaaaaatttggtatttaagcagtgcaaatgcctctccaactgctcattctttctcccaaagtccattcatttgccattttcactgcccttttttaactacaaatttccaaggcatcgaaacatttcagaaaacaagtaaatgtctaacaacaaaaacactctgtcgcttcaaaactccgaaacttcctcgtccgcttcttcttcctccccccgtccaacgtcgccgaacggaattatgaacgaatacgtcaagtgagttgggcatgaataaaacaaacattgcccattccaacggatgaatgaatgcctttcagaagtgctactgagcggatgatccatctgagtgtgttggaggtcggccgcgtgggcaacgacggcgttggcattgtgcaactgcacaacactttcgacttcggcgcgtcggacgcgcggcggacctgcgcttgttgtgccgttctgtgtgcttccgggtgcgggtgcggccgtttgctggcggaaggcaagtgccatggcatcggaagatgggctaatgctttaatccatcaa

SEQ ID NO: 39764 - DNA, 646 bp, Heterodera glycines
ctttaaggtacattgatcattccgtcgtcacatttttccgtgccaaccagcaaatttttgacataggcaccaatttggatttgtatatgaatgacaacaacggcattgtccagccagtttggaatgtatttgcccgtgaaatttggcccatttttgcgccaaacattcgccatttgacccttccaaatgaacatttggccaatttgcgtcgtcacatttcaccaacaattctcaccgatctcaaccaattgaattcaatcaattccgattatttgttgcccgattcaattgctgatgatgtgccaaatgcaactgctggtcaagcgctgtccaaatggttgcacattccgacaacaaatgaacaaccgaagcgattgtattgtagaaattatgaacacgcagcacataattcaggaaccacaggatgggtcaacaatttcaaaaaggtgtggccatattttcgtaaaacatttggattaattgccatttgcttttcgttccaattttatttaggcatttctccgtgccgccactccttctgtcagctacgtaattcgacttgaactttcttataagtcaacgcgaattgagtcgtttgaattggtgaacgaacggaccaacgaaatgctaaaattggagaaggaag

SEQ ID NO: 39765 - DNA, 672 bp, Heterodera glycines
tgtgtgggaaaagggaagaggtgagaaaaataaagacgttaatagtgcactgtctgactgtctggctaagcttctgaaaaatttgacccaaaagggggatacaaacccaaagagtaccggaaaatccccaataaattttaagttttgcaaaaaattttaagtttgcaaagttttggcgttctgattactaaataaataataaacttatttgtacttggagcccaaaattgaatcgccgtgtgcagttttttaatcagatttgaaaatgtctaaagaatcgacgaaaaccggtaaacaacaactgagcggagggaccgattttaaaatggtaaaagtagaaattcagtaatgtgagcactctttttcaaaaataaaccaaatttacctatttaaagatattgttttagagattctcatgatttgataattcgattctgacatccaggtcggaatagatgtcagaatcgaaggtaattctgtagtttgtccccccccccttttgggaaaaaaaaatttcaaaattttttttgccctaaaaacaagtttccaggggtttttggggtcgctgagcacgaatccggcatccatttcggccaatttcgaatcccctacccgaattcgaacaaaaagtcgaaaattcaaattttcgaatttcgcattttttggtctaaa

SEQ ID NO: 39766 - DNA, 954 bp, Heterodera glycines
  misc_feature (878)..(878): n is a, c, g, or t
  misc_feature (921)..(921): n is a, c, g, or t
  misc_feature (924)..(925): n is a, c, g, or t
atttgttcatatttaattaattgacaagtaaccgacttagaaaagaaggaatggacacaaaaaaagcaatttggcataaataccgccaaaaaaatcatccattggaccaaatgatcgaataatttgggtgggcggaggaagacttacgatgcgttaacagattcttggtttgtttggttggtgatttgcttaacttggcgggatattctcgacacattgcggggggggggggtaattggggagcaaaatacgctaattaatggtaataaaatacgtcactaattgacaaaatgcatgaacatgaacaaaacagaaaccacagcaagcaggattaagattgtataaagtgacgatggaaaaaaagagaagaatgacgaagaacgaacaatggacggattaattgcgggggtggggattagagaaaacaggggaaaaatggggggggggggaatttgtaaaggaaagaccgacaaaggaattaattcccttcattaagaattaattgcacttcattaaagtgctgagaaaacgacgaatttcgattggaatgattgggatttgcaatcagcaaaagatgccttcttcagctgcacttgtgagaagtgttcttcgctttttggtgcctttgacatttccaacggccaaagattgaagtgaaaacaaaaaacaatgctttaactttctttaattgatttgtggattaccgtactcggcgatcactcaaatacttttgttggcttcctgtttctttaattgttcttttgcccttaaattttatctgtacgattgcatttccatgctttttcaccccccccctttttttctttttttatcatttccataaatcgctcatttgcattttgaataaaataatcggncattttcccgccattccaaaatcatccaacaatttgttttccngcnnacatacaatttggtcaaaaaggacccccc

SEQ ID NO: 39767 - DNA, 1663 bp, Heterodera glycines
tcactattttggcgttttgtcactattttttcactttcgacattttttggaaaattccttaacaaaaatgcaataaaaccaaaaaatacacccctaagaatcgacctaaaaaaatttcaaaaaaatacacccctaagaatcgacctaaaaaaatttcaaaaaaatacacccctaagaatcgacctaaaaaaatttcaaaaaaatacacccctaagaatcgagctaaaatttttcaaaactcctatgaactggaaaaaaaaatttctcaaaaatttacttggcaaaaatttttaattttaaaaaatttttaggtaactattttgggttttttggtcttaaaaatcccagtcctactcatttgcaactgcaatcagtgaataaaaattattttggcttattttttggctgaaaattatgtcactattcgtcactatttcggactttgtgtcactatttcttcactattttgagatttttactcactattttagttaactatttcggtatttttcgtcactaaaagttgcggccctactagtatatttattattattattattttgttctttcttccctttaattgtgaaatgatgtggcccaaatttttgcttcttccacataattgataccggttaaattgtttcataattatatacagtaattattgttttgttttttttgttcatttatgggtgacaggattcaaaaaaaaagatttttttggctaaatttccaatcagtatgatcggttcctttctgatcgaatcttctgtctcggtctctgtccgatcaaattgacggcacaaatggtcttgggctctatctctgatcaaatgaactgaatcccgatcaaatctcgatcacgccccagcaatggatcacacaaaactttcttttggaccgatttccccccgtctgtctgtcagtcaacctcatcatcatattagtcaacttaactttaatcatattgatgtgttaaatcactcgctactcactgttctccgcccattctccttgcacttgcatatttgtgacttacatttaaagtaattattttatttttataaacattataatttaatgggacaaaaaattagaattttgtgaaatattcatttttagttggtcttttacatttttatttggaaatttccgattttggatttcatttatttcaaattaacaattcttttgtccctcattttcttcacacttttcaaatttttgttgcaaaatttccttgaaagaacttataaatatttaagcatttgctttacatggaaaattgaatttttgtttaagcctttaaccaatggggattcatttacaaaactgaaaaaatctacctttgtaaaaatgccaccattttttaaatccatgtttaatgaatgggtgatgatggactgagaagagagataatccttaataaattgcccgttcttggcactaaatgcgtgccattttcatcccctcgggggtggcaattattttcatacatcaatttcaccacacattcatttgaccattttccattcctattcaaatatctttctcttttacacggttagataattaattgccggatattttttataaatttaaatgtaaattaaaattttctcaaaaatttttttaattattttcatttcgttaatcctcctcc

SEQ ID NO: 39768 - DNA, 1678 bp, Heterodera glycines
  misc_feature (982)..(982): n is a, c, g, or t
agacagtcggatttccccgagttcgtgccagttctaaactggtcgttcagcgccaaccgaagtgcataccctgacgagcatacacgcagctgaagcgctccacaagcagctctcaccactagtccacgcaccatccccgaaagaacagcacgcagccacgggcaaaagccgcctgtttcacgcaacagcccggctgacccgacctttagagccaattcttttcccgaagttacgaatctaatttgccgacttcccttacctacattattctatcgactagaggctgttcaccttggagacctgctgcggatatcggtacgatcaggcaggagattcaaatagcttccctcgcattttcaagggccgtgtggagcgcacgagacaccacaggaaccgcggtgctttacgggcgcaacatccctatctcaggctgagccacttccaggcacgcacaccctaaaccagaaaagagaactctggctcggactccacacgacgtctgcgagttcatttgcgttaccgcgcaaaacagctcttgcgaaccgtcatttccctagcctggcgtgggaatgttaacccacttccctttcggcaaccggatggaccaactgcgcaagcacagaaaagtcgtcatccgtagtgtgttacggcgttagccggtgccttaggatcggctgacccacattcaactgctgttcacgtggaacccttctccacttcagtcttcaaggatctcacttgaatatttgctactaccaccaagatctgcactggtggaagctccggccgggcccacgcccaaagccttcaacgcaaccaccacgaccctcctacacgtcatggccagactacgcgacaagcacgtgtacaagccaatgacggtggagtataggtggcccgctccagcgccatccattttcagggctagttgattcggcaggtgagttgttacacactccttagcggattccgacttccatgnccaccgtcctgctgtctatatcaaccaacaccttttatggggtctaatgagcgggcactttggcaccttaactccacgtttggttcatcccacatcgccagttctgcttaccaaaaatggcccacttggagctcaaacattcaacgcctgggttcagagtcaagcaaccctggcttcatacccatttagagtttgagaataggttaaggacatttcgtccccaagtcctctaatcattcgctttaccgagtataactgcttaacgagctccagctatcctgggggaaacttcggagggaaccagctactagatggttcgattagtctttcgcccctatacccaagtcagacgatcgatttgcacgtcagaatcgcttcggacttccaccagagtttcctctggcttcatcctgctcaggaatagttcaccatctttcgggtctcagcgcatacgctctgtctccgccccatcgcatgcgatcgagacgggactatgttgcgccccaacaccgcagtgccagggatcacacatcagctccgtaagaagccttcactttcattgcgcctttgggttttgaacacccaatgacttgcgcatacgctaaactccttggtccgtgtttcaagacgggtcgaacagatgaccggcttttacaacgagaacgtacaactgagagcccgagctggaccgaactg

SEQ ID NO: 39769 - DNA, 1356 bp, Heterodera glycines
  misc_feature (1079)..(1079): n is a, c, g, or t
  misc_feature (1096)..(1096): n is a, c, g, or t
tgtggtataccgctcagtgctgcacatgtgaaagcctgtgtatggctgctgcgtggcaatgtgtcggtggcgggccgcctcgcttggctggttcgctgcgccaatgtgggatgcacgctcgtggggcgacctaacggctgtgctggcgtctgtgcgtcgttgagcggttgttgtggcaggcacataacacactgactggggatggtggtttcgttcccggtcttacgtgccgtaactagcggtgtgtttgtgcttgctgctacgtccgtggccgtgatgagacgacgcggtagggcccgtgcttggcctagcacgtggcttaagactcaatgagtgtcagctcgggcaccgccagctttttctttttttttcattatttttttttacacttctgttgaagaatgaattctagtcttatcggtggatcactcggctcgtggatcgatgaagaacgcagccaactgcgataattagtgcgaactgcagaaaccttgaacacaaaacattcgaatgcacattgcgccattggagttacatccattggcacgcctggttcagggtcgttaccataaaatgcactgcttgtgcgttgcttcgtgggatcatgtacttgtacgtgttcttacgttacttgctcagctcggctgtggtgttttggtgtgctggcgcgaacttgtggttctaattcgcgttttacggaccgtaactcgggcgcaccaatgctttgcatgctgtggcggagtgcctggattactggcattcctgctttgatttttcgacctgaactcagacgtgaacacccgctgaacttaagcatatcagtaagcggaggaaaacaactaacgaggattcccgtagtaacggcgagtgaactgggaatagtccagcgctgaatcgcagctcctctgggttgcgaggtgtagcgtatagaccgtgagcttgggttggcccgcttgttcaagtttcccttgaccggggctccagagaaggtgcaagacctgtccaactggcggtgcctatccatctttacgtgtcttggagtcgggttgtttgggatcgcagcccaaatcaggtggtanacttcatctaagactanatacggccacgagtccgatagcgaacaagtaccgtgagggaaagttgcaaagcactttgaagagagagttaaagaggacgtgaaaccgatgaggtggaaacggacagagctggcgtatctggtctgcattcacccgtttgttgctgtacgttgtactgctagcctccagactggggtttgctgtccttctgttcagtggcgaatggggatttgcaggcggaggcgctgagatgtcggagtagctgcgtgagctcggcttg

SEQ ID NO: 39770 - DNA, 1189 bp, Heterodera glycines
cgcaagcgcttttgtgaggtataaaatttctcaaaaaaaagagatagccatttttctgggatagagtataaatttaaaaattccctcaaaaataaaaggtctattgcgcaccgccctccctatcatgctcgagagcatttgtatgtgtataaaatttatcaaaaaaagagatagccatttttctgggataacctctaaatataaaaatcctctgtgaaataaaatggcgattgtgcacagccctccgtctcatacgcaagcgcttttgtgaggtataaaatttctcaaaaaaagagatagccatttttctgggatagagtataaatttaaaaattccctcaaaaataaaaggtctattgcgcaccgccctccctatcatgctcgagagcatttgtatgtgtataaaatttatcaaaaaaagagatagccatttttctgggataacctctaaatataaaaatcctctgtgaaataaaatggcgattgtgcaccgccctccctatcatgctcgagagcatttgtatgtgtataaaatttatcaaaaaaagagatagccatttttctgggatagagtataaatttaaaaattccctcaaaaataaaaggtctattgcgcaccgccctccctatcatgctcgagagcatttgtatgtgtataaaatttatcaaaaaaaagagatagacatttttctgggatagatataaatttaaaaattccctcaaaaataaaaggtcaattgcgcaccgccctccctatcatgctcgagagcatttgtatgtgtataaaatttatcaaaaaaagagatagccatttttctgggataacctctaaatataaaaatcctctgtgaaataaaatggcgattgtgcacagccctccgtctcatacgcaagcgcttttgtgaggtataaaatttctcaaaaaaagagatagacatttttctgggatagagtataaatttaaaaattccctcaaaaataaaatgtctattgcgcaccgccctccctatcatgctcgagagcatttgtatgtgtataaaatttatcaaaaaaagagataaccattttttctgggataacctctaaatataaaaatccctctgtgaaataaaatggcggattgtgcactgcccttccgtctcatacccaaagcgcttttgtgaaggtaataaaatttctcaaaaaaaga

SEQ ID NO: 39771 - DNA, 1416 bp, Heterodera glycines
gcgcaaagcaagcgccaattttgaatgttggccaagagctctaattaaatgtttggaattatgaaaaaaacaattaaattttttaaatttcaattttggtcgatcagactgaaaaattaagaaaaatttaatattttaacataaatgaagcattattatacataggaatatgtcctctgctgggaaaattttaaaattccgccacattgggtttgggtattttttttaaatttggaatcattcgattgcccaaaatgttttctttattagcttgcaaaatttcaaaaatttcgtataacaaactagctaaggccttgttctcctctttttgtcaggaatttgtccaaaaatgacaaatttggtgggttttacccgccgaaaaaacaaaaaatcaattttccgattggcaatttttgaaaaataaattcgaatttgacttgagacatagcaatctctttttacataattttgcttcgttcaggccaaggaatgtttgtgaccgcatgtcttaccaacgtggtgcgttccgtgctccgtgtggtcggcttccatatgatttgttggggcccattttggtgggttcgcttaaacccgaaggaggggtggcattgtctttgattttgatttttgggaaacaataaattctggcgttctgtcagaaattattaacactttttggtgaaaattcttaaatttttttagaaaattttatgagttgtccatagaatccgaaagggagtggggggtgggggggggagaggggaggggtgaaaaacaatcaacaaggatttctattttgggaaatacattaaaccaatttttcagggtcttcgtcctcatcccaatcattgaatacttccaattgtctcaactgccgagggcattggactccgaattttcacgaaatattcgaatggtttcgaggcgagaattttttaaaatgaattttcaaaaaccatttaacacttttttaatttacagtttcttgccttatttgaacagtgctggcaattggatattttatgcagcaatgaacagagaaatgaggtgggaaaactgtgcacacccaaaaacacgaagaaatttaaaaaaatatataattaaaatcctttaaatttttgtttgagaaaaaatagcaacatgaaatgcaactaacaaaaagaccaacttattgatgaaattagtgatattccggaaaatcaagcaggggaataatttaaaaaaaattgcaccaattttacaataaacaaataattaattaaaatttaattatttttctattttgagaatttaagaagaagggggggggggttgtgctttaagaaataaaaaagtgcattttttgtataaaaacattagaattttgcttatgtagatttaaaacttcaatcttccctaatgcaaaaacaaaaaata

SEQ ID NO: 39772 - DNA, 1224 bp, Heterodera glycines
ttattcttatcaaataaaatataattttaatttctagaaaaagaaattcagcaatgaaactgtgcatattattcttttcaattgcattatttttaattgctctaattgaaattggagcggaaaagaaaaaatttgagcaaaaaacatttgacgaaatatttggagaaaaatgggaagaaaaagaaaatgaacagaaaaagaaagaaattattcacaaattctacaaaattaaagaaaaaatcaaacaaaaaggaagaaaatattcaacaaaagaatggaataaaattgaacagaaaatagcgaaaaaattgggaacaaatcgaaccaaaatttataaatggatcaaagaattaaatcttccagaaataaaatcatataaatcaaaaacggatgaacaaaaaattgaaattgtgcaaaaatttatggcaatgaaaaatgagtacaaacaaaatggaagaaaatattcgagaaaagaatggaagagaaattatgccgaaatttgtcataaacttggagttggctaaggagtaattaggaaatggaagaaacaatttggaatgggtgaaagaataaatgagaaagaaaaaatggaaaaaatgaaaatgtattggaaaatgaaaggagaaaatccaaaaatgagtgacgagaaaatttcaaaaatattgaaaattagtcaacgaaccgtttttatttggaagaaacaatttggagaagtaattaagaagaactgaaaattaaagagatattctttgatcgcctttttcttacgatatttgttgatttgctttttgtactttttgaaaataaaaaattattttaccatttttataattttaaatttatttaaaaactcaagtacaaaatattaaatcattattgaggataagcattattagagcccagacagggcatgatcttgtacaggattttcccagaccctagtctggctcctgtttttctttatttaaaaaaactgttaagcccttttaatctggaatcctgcccgggttcatcttgggtttccgggtcctgttttttttcaaaatttcgtgctatagtttttggccgctgaattcagttgaaaagcctgtgtggtttaccaagaagctttcaagaaattaaaacgccctcatttccgtaatccttaatctcagtgtccaaaaacgccatcatttcccaaatgcgtaattgcgccttgcgcccatcccgtgaaagggggatctg

SEQ ID NO: 39773 - DNA, 1186 bp, Heterodera glycines
taattcaggagcagacagtataatccagtccacacggcaaaaggaactgcacagaaactggccacttcatcaattttgttgaaagctaagactgtagatatagctgtgccgtatatgtagccatagaccataatctaaatttacatatgtatgtatatcagcagggctcccattcgtacttggatgctaagtacgcacttggcttttatgcttggaaattttaactgtatttatttccaagattgtacttggaaaccagaattttggcatatgaactgaaaaatgtcaattttacggaaaaaagtttaaaatttttggaattatttcatgaataatcattaactttttttgttttttaattttcaaactaagtcggtaagaaactgcttttttattgtgtttcttgtcaaaaacacatcattgtcgaatcgatgggagtttcggcaataggtctgtgttcaaaatttccaattttttcctccagggcgcctatctgcgccgctggacccccaaaacccttatttttctttaaaaattggcacaaagtcgcaaacaatttctgttttgcttcgactcattttttgctttaaaaggggaaattaatggaatccaaaaagttggccatcacataaagttcaacttttcgaagtaaaaaaatgaattgatactaaaacgaattatgctgaaaggaatcgacctcaaaattcccaatctttttcgagttgaagatggtagcgagacagctgaacatgttcagtccgtaacagctaagagccatggcagtgtttgtatttccgaagcctaaagtagtttttcattgaaaatagcaagaataatttatttttgtttttttttgctgtacagttgaagcggtacacttagtacgaatccgcctatacgaatgggtgcgaccttatcagggctggacgtaattacggattacggaaattacggggtttggagttatggattggacttttccgtaattttgatccgtaactggcttttttagattatttttcgaggcgacttctcgcaagatgttttttataaaatgaatttagctaatttttattaaaaggctacccacatttcgatttaatttgacttattcttggtaacttgtagtattattagcatacatataagggggggggggggctagcgaaggggaaaaaaggaaatg

SEQ ID NO: 39774 - DNA, 1282 bp, Heterodera glycines
tcgcggcattttccatctttccccaatcaacgaacgacacaacccccggggggggggggggggggggggggaaattggaaattgatgggatcgccgggtcttttcttttcatccgtcgccctgcaaattgccttttattgatcagcaaacaaatccattacatcagcagggaaattgggcaaattaagctcaaaataaaaccaaaaaatatttcaacaattggattgaattttaaattaatcatcaaatctgccaaatattttaggatttgtcattgattgtttctgctcatttttatgcataattggcattttcttaaaacaaaagggatttcttatttgtttgtcctactttaggggtttttggggtccgacgtgcctaaaaaaaatcaggattttaatgaatttgtaaagaaaattagctagtttttcataattttttcttttcctcttcgccgacaagccctgcacccttacgaccaataataagtgcttaaaatgcggtgttttttttttgaaaattttagggggatttttagggttggccaacgaaaaaaaattgggattttgaaaggattttgtgagaaaaaatccaagtatttccataaatcttttcatcgcagccgcgctccacccctactgctggtgagtaataatctaacaaatctttaaaaatattcaaatttatcccggcctacttctccacaaaagtattcaaaaaataaaatgtttttttgttaaaaattaacaaaaacaggatcagttgtcgcattctgttaactttctgacggtgtcgcattttccggcttccccccccccccgtagacttttttaattccaattttaacctctcaaagaggggcgttcaaaacttttagccctttcaggctaggtaaaaaaataatccaaataattaattaatattatgattcgaaattcacttttttaaatatttcatcggtctcatttaattgctttacttggaattttaaacccatgtgttacaaaaattagggttaacacaaagtggccttcgtgtaaaaagctgttcatgtgagggagggaatttatttccattcgactttattaattcaaattttgtcatatttaaattagttaagcaatttaaaatttgacttattttgaattttaactagagttgagcgggaccgggaattttgggcaaacccgggaccgggaccttttcgggttgaaaacccgggaatttttggctgagaaaacgggcaaaaaaccgtgactagtcccggtcccggtcaaaaccg

SEQ ID NO: 39775 - DNA, 1364 bp, Heterodera glycines
tgtgcaaatgccaatgttttaccagcaaaaaaggggtgaggcccaatgccgggcgaatagcagcagattcccaccccaaccttatgtgattaatagggctaggatttttatgttttaacatattttttttgcggcttagttatggcgagagaagcccaaaaatagcattttctccgaacaatttttggtttagagcgacttataaaaacataaaaacacatattttggcgttttggcacataaaatatgttagcacatattttggggtttggcacatattttgcacatattttggcatttttgagaaaaattgcaataaaaatacaagaaaattgaaaaatacacccctaaaaatcgacttttttcctaattattaacataattttcaaattaaaaaattttttcttcgattgtagaaactaatgaaatctcgaattcattaattcgtcattggatttcgaagttctctgctggaactttccatttatagaaatgatttatcaaaaaaagacaattttaccccaaacacttcgaaatgtatttgatttgcgttgtatgggctaaaaatgataaagaatgagatttttgggaatttttatgcaaaaacacacttattttttcaatttttaacacatattttagcacatattttggcatttttgggggtttttagcacatatttcagcattttttagcacatattttattacatatttcaggatttttagcacataaaaatcctagccctagtgattaatgctttttcatttgtggacagcatttgtgaattttccaaggcataatgccaacgcgttaaatgccaaaatgccaatgccaaaaacgcccctcccccctagcgcgaggggctaataataaaaggcataagccatgctaaatgaggaaaaattcatttcgaatacaataaaaaaaaaaagaattccttatttcccctcaacggctttatacagatggtgccaatggatatttctatgcttttggaaatgcagcggattttgggtgccggtgccaccgccgctacaattggtgatcagagcgcaaacaacggcgaggtaattaatgaatgggttgggttgttaatcagtttttatgatcatcgttcggtgaaaactgccgtgggcattaattagatgatattttcggcatttttcatcaatttcactagtcggcttaaggcataatcatttatcaaaaaacactctgggtcactctttaattaaaatgcccttaatcacggattaaaaataggcattgctaatagaagcacattttcatcagtttgacagctgatgatcacaaattgtttattactccaagccatattttagggcttaaaattctgatca

SEQ ID NO: 39776 - DNA, 929 bp, Heterodera glycines
gaaattaagttgaaataaataagttagctcttgtttaaaagtgtaaagttatttttcaatacattctttttgagatttattttaataaattttttcatttctatattttttttatctaaaagttcagaaatatgtttttactaattgatcatgttttaacgatttctgggtgcctttttgaatcaaacttcaaaaaatagaaaggtcccggtggtgccgatagtcgctgaaatgtccactattgtttctgcttgccgtgggttggtacagtggcgaaaaagtgttttttaatgcctttaagcctgaaaaaccttggaattcgaatatttgagttataattattcgattttaattaattagacttatattttaaaaattttcggcagcatttcagtcttttccctaacaaaatctgcgtaggccgcaaaggataattttgtaattagttaattaattttttatttctaatttttatattttccatttagttttattatttttaattatcattggctgttttttgagtttgactttaaaagttgcatttatttatattcttttaaaaggccttctaactaaaatgatttatcttcattagcttcgatttttttaagcgacgtcaaattttcggtccattaggtggccaatcagtaagtaagctttaccatttgcattggatgttcatgctggataaaatttgaaattaactgctccaatattttaatgtctgttctttttacttatttatccacgtatgttctgtgtttatttttaaagatatttttgagttattttttgttagattttgtaataatagatgtttttttgactattttttgaatgttatttatttgtctaattaatttaaattctttaatttttttcttaggaattcagttcataataatttaataataacaacatttagt

SEQ ID NO: 39777 - DNA, 1023 bp, Heterodera glycines
  misc_feature (79)..(79): n is a, c, g, or t
  misc_feature (98)..(98): n is a, c, g, or t
  misc_feature (144)..(144): n is a, c, g, or t
cagggatcgaatttaggtgcaagcctaaaaatatttgctgaaaatggacgaaaaaggacaaagattgttcaaacagccnatttctctctaaatatgtntaaattgtgtcttaaatatttgttatacaattttttttcaaatttntaagcaaatatgaagaaattttgggaaattatacccttaatttggaaaaatttatgtccatatttatgcaattttatgtccatatttcgcgatttttggcccatattttgagattttatatccatattttttgcagccctactgataatcagaggagcatatttatttttactagaaaattaagcagaaataacaaaaataaacatgaattttttgttaaaatattaatttattaataaaaaaaagcaaaattataatgttgttgttcatgtgtcgcaaaatacgcacacataaaattgtcagtcaataggaaaagggggtatggatcagggatggagttccgaggcactaaaaattttcggaagtcggaagtcggaattccgatgccccaaaaattttcggaagtcggaagtcggaattccgaccccaaaaatgtcggaagtcggaactcggaagtcggaatttttcaaaaaaaaatataataaattttttaaaaaaatatttaataggctaaatttttaaatttttaaccatgtaaaaggtaatttcaaactgtttttagtttatttctatattttttaaaaagatcaaaatattttaagtattacattattttggatttttttttttgggaaagttacaccctttttttgcggcgcgctttatctaaagagaatttgagaaactgtggggaaggaagggtccggcggtgccgatatgcgccgccgggaaaaattttgtaatttttaatgtaaattgttaacaaattttgtccaaaaaatggaaaatttagcgattttgagcagattttcaagaaaattaagttttttttgagtcctgcagtgccgataggtgccgtcggaaaaaaaaatgaaaatt

SEQ ID NO: 39778 - DNA, 1077 bp, Heterodera glycines
  misc_feature (50)..(50): n is a, c, g, or t
  misc_feature (54)..(54): n is a, c, g, or t
  misc_feature (77)..(77): n is a, c, g, or t
aaaaattacgccaaagccgccggcgccgcctgaaaaaatgcaaaactganaatntcattattatatttaaaaaaatntattattgacaacaacttgcctgtgaaagcaaagcttttcgccagactgatcgtcgaatgttgtcacttgaaaatgattaatttttaattaacgatagtgaattttttgtatttttcaaatgtctcattaggcatataaatgcaggattaatcatagtaatcccacaatttcagccccgacccatcagtgatctcgcattcctagattaatcctccacagtttaatgataatagatcatatgcggcgattatgtaaatgggatcccatcccggaaggattttgggtccaaatccatctagtccagcaatttgatcatttttctccgataaaattaaagatgattgatgatcccctgcgcattttgtttttgttgttgtaccctcggagatgatcactgcgttcgcccccttgtccaacaggtcggcaactcggatttcggagcgcagtcgcgcaccgtcggccggaaacggtgcgtacagttcaatgtattgttcgccgtgaagcacccggctcagatcaaattgaatgccaggccaatccgacttaaatcgatgtgtgatcagttttaaccttctagatgcgtagagatgatcaaaattttgggacagaatggatttggctgggggagcggagatttcggtgccaaaaatcccaaattttggcaaaatgccaattttcttaaattccttgtgattactttagctgtgggatcggctgattttggtgccaaaaaaccctgttttatgggtcaccaaatccggcagaatgccgaacgatgatttctgatcaattttctgatcactgatcagaccatgaaaggaaatgagtaatgaatcagatgacgcattccaaaaatgcttttggcactttcttcgattggccaacagatcaatttctattacattggcctttaaaaacagaccaatgaaacggccaccatcccaggcacaacagcaaaggtagaaacacttgaaagtcgggatggcctggacgggaaaa

SEQ ID NO: 39779 - DNA, 993 bp, Heterodera glycines
  misc_feature (900)..(900): n is a, c, g, or t
atattttggtccatatttggccatttttgagctttttagtccatattttatgtccacatttcgcgttttttagtccatataatttacatccttaaaaattacaaaaaaaaatttcccagcgcaccaaaaataaaaatctttttaaaaaagggccgtaaaaatatgttttaaaaataaaaaaggtcgatttacctggcttgaccaaattctaggctaaaataaagattaccatttttttcaaaaattttataatcaaaattccacaaatttgcggcgcctaaatgcaccgccggcggttcctaattttttcatattttttttttgcaaaatttgatcccaaattaggaccacaaagtttgggtgcctcatgttggatcacaatggtcaaaggtctcacaaacggaactttatctgagctagtaagggatggaaatcacggctagattttcccaaagtccaaatggacagtttgtaagtgaatatcgatcgaatccctggcccaattattatgatcactctttctttgatcagaattgatgaaaatcgtatattatgtattgtgtttcgtttagtctcttcaacgcatggcagcaaagaactgaaaaagttgcgcattattagcattaattagcggaaaatatgaaaaaaataataaataaatgcaatagattttaatttgaatttacaaattctcattgatcgcaattcgtcagcagtggtgttggcacaagtgccacaatgggacacaacttcaatggacgataggagcactttgttgacccagtggggccactgctaaaattcgaaaatgccaaaaaaacatgcaaaaataattatttttaacggtataaaactaagacaaaatttctgtttttgacctaagtattttaaaatcttaangaaattgatggtccggcactgctggtaagcgccgcccgaaaaaaattgacatttttaaaaaatttattaaaaaaagcatgaaatttgaatttt

SEQ ID NO: 39780 - DNA, 1102 bp, Heterodera glycines
tggttaaaaatgttgccgtttaagggtttcgacagattttgctaaatattttcatagtcgattttttggagatatcgtgaacttaaattcccatccctactcataattagctttaaaatgagttattaaatgtactgagaaataatattttagtttttacgtttaaatttcattattggccggagtgtgggttcaaacccgcttggctgcgggttatctgccgtaatttgttaaatttaaaaaatcattaaataaataaaaaccaactttccaatacatttaatagctcattttaaagctatttaacaacacattcataaaatttgggaaagaatgacacttgatagcccttgtttaaatttacatgaaaaattctttttaaattaattacagatggcccagtgaatcttgaaacggcattgtccatttgtgcatccattgcttgaacagtgccaatgcaacatagaataaatgtgtgattgatcaaatgcaaaaaatgaggcgccggcagagaaaaatctctaaaaaattaaataataaaaaaaatcaaaaatttaatttaaaattactttgtcagcaatatttatgtagcagccccacagctgtattagcatatacgaagccaaagcgaacaacacaaatttctgcaaaccacgtctcatttttgcttagatgaagcagttaagaataaaatgaagatgttcacatagtatttaattacgcataaaattaaatttaaaaaatttataacatataaaattaaatttaaaatttttaaaatagaatatgaactcaaaaattagcttaagcttaagttaaaccttccgcgacgttgggcgctaccgactatgcgccgggtgtctttttgggcgccaagtcaaaaattaaaaacctaaaaaagagcatatacttaaaaaaaaattaaactttaattagaaaacttgtacaaaaattatcaaatatttacatttttgttgaggataagttggacaaatcgccacaaaatacaaatgaaaaatttaaattaatgaatacaaaaagaaaaaaattttcactaacatttgcctatttcttattgtactatgacatgggaagttaattg

SEQ ID NO: 39781 - DNA, 1099 bp, Heterodera glycines
  misc_feature (1017)..(1017): n is a, c, g, or t
  misc_feature (1039)..(1039): n is a, c, g, or t
  misc_feature (1072)..(1072): n is a, c, g, or t
gtgtattttttaccctagaaaaaatgtaaagaaaattcttaacgttatttttcgtcgggacaccaattaattctccagtattaccttattaggtatactgtaagatgtttttatatgttgaattctgaggacattgggagatgcagaggatactgcttcttttacttttgattaatttgtttatttctttctttgtggttcgcccacttcccatcatccgatcgcgctgaaatttttaccagcagtttgttgatggggaaaaacatcatacacaaaaaaattacaaaaatcggctaacgtaaaaaaatttccaaaaatttttcgaaaaatttgggtattaaacaattataacaacactactttgaagacatgtaactttttctatagggtaagaaaaaatctgaaaaaaataatgttagcataattttcatgctgatcaaaaaagtcctttgctccacagtgatcagaccattccttcggggtgatctgaaaacctcaaaatggcttaaacaagatgcaaaaaaccgcatgtcgctacacttctgtacgctcagattccgtacgattaatatcgaagtgatcaaagctactgtaaaatgcactgttttcttaagaattacagtacttttttgctgttcgaaattaaaatttgcttagccccttaggaattctgcaaaaattttcccgataatagccattttgaggtttttagaatactaatgaacagggcttccaagtgcgcttatttctaggatttgtgcttatttcagcattatgtgcttattttttgtttgaaaattaaaaaaaatacaaaatttgattgtttgggaccaggctgtttttattgaagcgaatatatgaatgaattcgattttgaaaaattagaaatttttcattttcttgagtgtaagataggtacccaaatttcagagaaaatctgttaaatgatcaaaatttcagtcatttactcacaaacaataaatctctatgaaagatcacttaaaacacaatgattanatgggtaattcattcattccancactgttccgctgactgatcattttcactgatngagtgccaattcgtctaatatctgatg

SEQ ID NO: 39782 - DNA, 651 bp, Heterodera glycines
atgaaagggaagcgaagaacaactgacgagagggagggaggaacagcagcggggatttccccgcccctccccccccccctccccgtctcccgccctgcttttccgccccttttccctctcccctccattcattcccaacaaacgtttcccttctggccactttcttccgcccgtcccacccctttcgtccgtctcttctccaccgattgatcgatttgccggcatttcattcacttcattcctcagcatcggatggatacacattccccccccccctccccccttttttgttttgtctcccaccaaatcactcactgactactcactctttcacctcatttagcatttgctctgcctttaaatttacagtaccgagtttttacaaattataatttgaaagacaacaaattgatgagacagtctttgggtggagattatcagagaaattatcagcactgagtcatcgccaataaacgacgttaaaacaaaacattacgaatcggtcacccgtctgctgataaagccaaaattggaaaggaggtgagttatgggaagaggggttgagttgggtgggaagaaggcttttggtttaaactcaaataaacaaacggagaaaattggagcgataagaaaagagagagaggggggggg

SEQ ID NO: 39783 - DNA, 962 bp, Heterodera glycines
agtgtagagactcactacaatacatttacactactctcctaaagtctatataagcgcagcgaaattgcacatccgcagtcacttttacaggtgctatagtgtagagtgttctatagtgtagagtgtaggtgtgttctatagtgtagagactcactacactacactctacactactctccaaaagtctatataagcgcagcgaaattgcacatccgcagtcacttttacaggtgctatagtgtagagtgttctatagtgtagagtgtaggtgtgttctatagtgtagagactcactacactacactctacactactctccaaaagtctatataagcgcagcgaaattgcacatccgctgtcacttttacaggtgctatagtgtagagtgttctatagtgtagagtgtagattctgcatttgtactgtttctacttgtgttgattatataaaaaaaataaaccttcaaagtctataaaagggagtgaaaaatcgcttcccggatcatttttcgaaaaacctagcgtaggaatcctacgctgactaatgacttagcgtaggattcctacactagcctttcctacactaggctaatgtagttatcatactcgagctcaaagtctataaaagggagtggaaaatcgcttcctcggatcatttttgaaaaacctagcgtaggattcctacgctgattaatgaactagcgtaggattcctacactagcctttcctacactaggctaatgtagttcaaatgcactagcgtagagtatccagtgtaggatatctacaagacattgtgttgatgctacatttttttatatgtttagcaaaatatttcgttgacagcgaaattatatttctattccatccgagggcagcacagtcagatggacaacacccacaacaacaacatgtcttctaaacaaattccatccgagggcaaccagccaaccgatgtccaat

SEQ ID NO: 39784 - DNA, 679 bp, Heterodera glycines
acattagcgccagcaagaactgaactgtcccgagattgcattcccttccccccccccccccccctctcgcgtcacttttggcgcctttttgcgcttttgtcgataagatcattcattcattaccccctcagggaaaggggagggggcggtgacgaaaaacgccggaaggggtctttttcaaagggatgggattcaattttagaaatttcacagaaagggtaagggaggggtggggaaataaaaagggggggggcaatgacgaagaaatgaaaaaaagggagagagatggacatgacaatgacaatgagaggacgcaattcaaattggcaaattgggtgatgggactttagccaagggcaaacaaaagatcgatcaaaaaaagtaaaaagcgatcgattgattgggatggatccgatgatcaatttgataaaggcgaattgacaaattgggggaatataaatgaaaaattgcatttggaatgactcatcggcagacggaaagggcagagaaagccaaaaagacaccatttgtgtatgaatgaattaaagttttttatgtgtttcctttgcaaaaagaaacagaaaagtcaaaaatagcaaaggaaaggggccaaaaaaggggaaaaggcacaaaaaatggccaacaaatggcgaaatgtcaaagagacagcgagaggagg

SEQ ID NO: 39785 - DNA, 1440 bp, Heterodera glycines
cgtcctttcgaccattccgaaccccggacaagagaactaactaactgtatgaaaaactgagtctattttttttatataaatgagtattttcaaaagaaaaattgtcataaatttactcagtcggtagcaacaaattttattaaaaaatgatttttgtatatttaaattaattatgtagatctatagagaaccccactgattgattggtaaaaaattatgacaatttttgatgattaatgcctatttggcgattataccctttttggcatagtatttcaaaaatcaaaaaccggaaatggacaattgggcgacagcatttggtttttcgatctttcataatatttcgaaaattaattgatataaccccatttgccgttctctatattaacctccaaaattgcaccaaaaaaaaaaaaaatcaaaagttatgttaaaaatatttgaaaacgaaggttttaaagttttctagtccataatttttttggaaatgaatgaatttttttgaaaattttgtaaattaatgaggacacttagagctacctaatactatcaaattcataagatttgaacaacaatgtaaggagttagagttatacccaaaaagccaggctgttgcccaatgtctgtctgtcccccactgatcaaaacattttgtgttttacgatgcttttcgaattttgattgacttgcattgcacacataacaagttgctattgtttaaattcttgtttcttttttaacaaatgcatgttttactgagtgatttcgctgtttttttcttattgttagtcgtaaaaacatttttttttgaattatatgggggcgcttgaaaagtaacgcatgaaaaatattgatggatgggattaaatattgcggattttagagccagtagttttggaaaaactcggacccggacctcagaatttacgagatggaaccggaatgattgggcacacaaattcatgttttacaatagtccggttcttgttcaactgtatgttgacccgggtcctgtacaggattggattttagaaattttttagtgtatttaaaccagggttcggatcgaaaaattttcaaaatcagaacatcgggtccaaaaaatcagattttggggtcgaaaatcagaacattttgcaaaattgcttcaaatcttttatttttacaatttattcgatcaaaaatgtattaaatattatatttttcacctcccatgatcatctttaaaaattttggtgaggaaattaacaaatcgtaaatttcagtgcactcgggatcaaaaaatcagatttttaagaattttttgcggcgcatttttccaaaaaacttttaggaaatgggcgagggggagggtccggcggtgccgataggcgccgccggaaaattttttgtaatttcgttctgatttgttaactagattttcacctaaaaaatgccaat

SEQ ID NO: 39786 - DNA, 1233 bp, Heterodera glycines
ggggggggtcagaaattcctttacaaaaaagaaatttcccccatcaggggaaaatgaaaaaaaaggctcaacatttttttaccctttttttgcgtgcgcgcttttccaaaaaatttgccgaaggggggcgggggggtccgcgggtgcgaatagacgccgccggaaaaatgctgcatttattaacagattattttcactaataaatccaaattccataaatgatgaagaggataatatgtgggcaaacagaattgcagattttcaggccgctccagcggatggcataagaggtccacacgaccgacggaaggcaaaatacatacggcaagacaacaacctgcaagctttagtcgctaattttgaccagcgtgatccgcttgaataccttcgcgcatgtgcctaccacttacacttttaaaaaattaagaaaatcattcaaaaatatatcacaatttaaactatgtaattattttaacaaaggtattccaaatatttgtgcgataaataaactcatgaaattaagtggaattcggttagaatacatatgctataatgttagaaaattaaagatagaaatccacttgaggcaataaattactcgggttttttaaggtctcgtttcaagtttcatgaaatccgagagacaaataccgtaaaactcgaacaccgatattcacgaacgcgagcatccgattggcaattttaaacatattttatgtgtttttttgacaatttttctttacttaacattcgtgttgatgtaaaaacattttaatttaatgagaaaatatgagtgaactgaatttttaattggagagataaatattttttttcaattaaatttttaatgaattttatgcagaaatcactagagatcgacattttgaaaaatgcctggacctggattccatgttggacctggacctggatttcctggacaaaaatccaggaaaatccaggtccaggaaaaatccaggctcctcgagacctggatccaggcctggacctggattttttgaaatttattttaaaaatcaaaaaaatgttgaaaaaattatttatttgagtagaagcatctaaaaatatctaataaataaataataataaataatgtgttttttaatattattgatttaatcctgttatttgaaaacattgaaaaatacattcggtcaccttgaataaaataaaattctaagattttgtcagcggaaaatcccaggttttttccct

SEQ ID NO: 39787 - DNA, 1056 bp, Heterodera glycines
agaaggcaccccgggactgccaggaccaccaggtgaattttgctgggaaattgtgaacagtggacgacaaactcctctttttagggcctccgggtgtgcccggctcgcctggttcgtgccaacattgccaagggggtgggtgaatgacggatgaattcctgctagaatttgtctttttgctcaaggcggaaatgccgccggcgttgcccttccggcccctccgccgcctgcgtccgttccgcgtccgccctcctcctttccatccacgcccggcccaacgccacttcccccgtcggaggcgtttaaaccattgcccgacagcaacaacaattaccagttgaactacgcgggagaacgggcggacgaacgcgagctaacttcgcacgaattagccgaagcggcggcaatgtcgggggaggaccaaaggcagcaaaccgaaacgaaaccgcaacaacagcaggtggaagggggggggggagaagggcaggggaaagtaaaaaattgggggacggaaaaagggagggggagggcatggagacggaacagaaccaacggaaacacaacaaagaaaatggaaaggtagggaaaatggtggagacgaatcagaacgagaagtagcacaacaagccaaggaaggggataaagagaataaaatatagggagggggatgaagacagaacagaaccaatgggaacacaacacaggcacatgccccgagcattttgccggagagtgaacgcgacgtgggcgcaccattcgcagctgcggcggcggtgggcacggcgtacggccaaagggccgagccgaagcagcgcaaggagtacttgtggatcaactgaacacactttgatgaaagcattcttatttaatagcatttaataattaatcacaatttaaaacaattaatgatccctttgtctgcccattttttaatttttgtttcgcttttggtccttccatgtgattaatgcccaattatttcctatttttgcgcgcgttaatctcaaaatgcgcataattcgtcatacaaattcacaattattcattatacttgag

SEQ ID NO: 39788 - DNA, 942 bp, Heterodera glycines
atttctctaattcgacttttcagtttatccttattaaattgtttttcacatattatgtgaatacctaattattttatctttatttattaaataatatttaaatgggctcatcaaataccaaaattaaggtaattaatcacttaattaatctgaatttttccctgtccattgttttcacgcataaatgtggtcaaattgaggacgcggaacagatccgaattgactcggcaccgcttcactgtccaatttgtttgggcattttccgaaaagcgcccgaagtgctcccgtgcggtaaattggtgagaggggaagtgatttgatcggtgtttaggccattcccactgcaatgactgtctccggagggtggagagttacgcgcgtagggacagcccatccagggacagccaagtcagtacgaacgatggccgacttggccattttgtaagagagtcaaatgtcaaatgttttcagatttccatcgaatgttcactttgtcgcgcgcgctgccctttgaaccgacaaaggaccaaaaactacgcaattgaggccataatcgagtcattaagcacaataaacgaagcggacgatcctaccaacgaaataattgctgggaaaaacattgctgtgagttttatggatgagttttcagggattaaaattggaaaccctttcaatattagcgagggaatgattcgctaatggggggcacccgagtcaatgcttttttagtccatttctgctgaatatttcagtccctaaactctttctccgactttcagatcaaacggttggagcaaaatgagcgcgaattggaaggacaaatcaaagaattggaggcaaaagtcgagcggacgacgcggacggcccttttggtgtttggcctggcaattgcctattttgggttgagagtgattttatgggtcactcagtcgggcgttacaa

SEQ ID NO: 39789 - DNA, 1267 bp, Heterodera glycines
ctgacctgtgtgctgctccaccgattgcctagccgctttttcctctttttttcacgttcaatttcgtctgctgctgccgcctttgatgatgatgtgggattcatatccaaatgaactgttgctgctggtggtggaggtggtgcgggtggtagccaaaaatccaatgaaaatgttgctggtggtgttgggggaagtggaatctgatccaaatcaactgttgcaggtggtggtggtgacggtgttaaaaatgagaagtgtttgtgaaatggagtaggaaatggtggtggtgtcggcggtgtaaaagttgtaaaagttgatgctgctgctactggtggtggaggtggtgttttggcaggacttcggacaatttctgaaaaaaaatctaaaattatcattttaaaaaaacttttttttttaactttaattttttaaaaattattttgaaactttaccttttttggtggcatgatcctgctggcaatttcgaagcgaacaatttggaagcgacaatttggcagcgacaatttggaagcgacaatttgtttagaagtgaattgtcttttaatcaaaaaggaaaataattttaaatttaaatttaaatgaaaattaaaataattcatcaaaatactttcataattatgaagagaataaatatttacttttacttcattttattaattgattttgtaatccttttccccttctgcactctccctcactccccccccccttcgttgacccttatctcattctgctcatcattgatcctccaacacattcaaaaaagagacgctgtgaatgtgaaacggggttgctgagggcaataaatttaaattattataatttattagttattttttattaataatttttacatttctgtagcataattatacctaaaaagagcgtgaaaaagtattccgaaactttgggttttcatttgaaaaaattatattactgtacccccaccgcaaaaaaaatgcgcgagaatttggtccctaacatattcgttttaattagaattgattacggtaaccctctgaaatttcggctccacaccttttggtttttttttttaatttttattacggtagccccctccccccaagtgcgcgaaaatttggtccccaacctttagtttttaatgggagaattacccgtccgcaaagtgcgcgaaaaccaggtccttaacccctacgacgtgccggtttcacccaaaggtgggaaacttcccaccggacgcggaccggtaccgtgggataactac

SEQ ID NO: 39790 - DNA, 1351 bp, Heterodera glycines
  misc_feature (101)..(101): n is a, c, g, or t
ctatcatcagagtcataataataacaataataattataattatcatctgctaattgggaatcgatcatccaccgccaccatcaaaatgcacattggcatgnatcagatcgccaggtgtttggcgtgagaagattgctcgcaaaacgaaaatttaaaaagcttatgggtgtgctacgtgccccgcccctcccgcccttttttccatatcgttccactctcccaaaaatttttaaaatttcttatagaccaaaaagtttatttatttttttaaactcggattttttgaaaagacaaatttttttttgaaaaaagcctggtaataattttcttagggtctcgagaatttttatgattcgtctctcttctcttctgtattatgtagtattgcgaccgatatcggcaaattaataacaatcctcgagataatttagataagtctcgagtagagttgtgctcataatcagattcaagagaaattatgaattttgactcattaggaataaaaattttgtgtattttcaaaggaataaaaaaaattttcttttgaaataattaacattgtagattgacaaaaaaaaatttatttaatttcccaatttgtcttttaggctagcagcagaagaagcgcgaaaggaacagcaacgacaagcccaggaggggcttatcgggcggaaaaccacccttggtggggctgtcagggaaaaggtggaaaaaattgtaattttttttttaaatgaaaataagttaggtcaaaaaatcgagattccgatcgtaaataattcgggaattctcgtctactaaacttcacttttaaaattataaattgaccattttgggtaaaatttattattttgcacgattttttaaaaaaaacaatttttaaaaaattatttattaatttttaatttacctattatggttcttttgttattgacatataattcagggcccttcctcgttatacatattcagtgaagacaatgtgatacggaaaaatgcgtaatttaataataataaatatattattttaatttaaaaaataaatatttgcagtcgtgccatcattgaatggggaccttttgaatttttcattttgctcacaatcattttgaactgtgtggtgcttgccatggaacaacatttaccaaggctggaaacaaaaagaaaaaaattaaaaacttatatatttttttaaatttcagaaatgacaagaagcctttgtcagaaaaattggtaaaaataaataaataaaatgttttaaaaatataatttttattttttatttatttacaggagaaaactgaaccccatttttatggtcattttcttgcattgaaatgcatttttaaaa

SEQ ID NO: 39791 - DNA, 995 bp, Heterodera glycines
  misc_feature (29)..(29): n is a, c, g, or t
  misc_feature (41)..(41): n is a, c, g, or t
  misc_feature (57)..(57): n is a, c, g, or t
  misc_feature (79)..(79): n is a, c, g, or t
  misc_feature (95)..(95): n is a, c, g, or t
  misc_feature (138)..(138): n is a, c, g, or t
gtaaaataaataataaattttacgaattnttcgcgagaaantaaattagacgaaatntaatattggcacttaaattatntaataaaactgaccanaggcatttgttagagtcaatgccaaccattcgcacataatccnaaagtgttcccgaaacaagtccatctccagccgaacacacctcaaaaatgctaataagcaacgaaaaaaagacatattttcctaagaattaaccctgaaaattttaaattttttcttcatatgataaaagaaattatcggaaaatgttcccgaaaaattagatatttttttaactattttaagcggaaaacggcaaaatgaaaagtgaaaaaatcgaattgtttagtaaaataaaaagcaccaactcaactggacatacaaatattaccaatttaaaaaaaaagtaaaatatatttatttattttttggcattctcaaggcttacaagaaaaaatgcaacaacatacgaaatttagtaagcaagccaaagtttttttcataaataaatgacataaatgaatctatatttaaatgcaaacaattgattaaattttattgttaataatgcgcaaataaatgaaatatattaaaaagtaaaaaaaaaatttaaaatataaaaaaaaattagaaataaaaaaactctacaaaaaacaacaaacacctctctgaaacgcacgaaaaaacatgtttttttgggctgttgttaagctatttttcgagttattatgccaattttctaggtttttatttttagaacctaaaaacctaaaaaattttgaaagaacctattttggcgttttgccaaaaatttgttaacaaaaatgcaataaaaacgaaaaatacaccccctaagaatcgactcaaaaatttctgaaaaataaacctcctaagaaatgaaaaattttctcaaaaatcgtctttaaattttttttggaacaaatttttgaatttaaaaataatgtaactaaatactgagt

SEQ ID NO: 39792 - DNA, 1580 bp, Heterodera glycines
  misc_feature (1481)..(1481): n is a, c, g, or t
  misc_feature (1515)..(1515): n is a, c, g, or t
  misc_feature (1573)..(1573): n is a, c, g, or t
agtaaaaacccgcaaaatttacagcaaaagtcatagagaaggcagcgctgaatcggatggcattgggcagaagaggaagaagagccaacagcagtcaaattattcgtcgaaaaaagctccataattcttaaaaaaatagttttttattcacttgtttaacaaaacaaaatcaattaaggaaaataatttaaaaattgaaatcaaattgactactcaactcaagaacgaggaaaagcgggaattacctaattacctcgtcagtcgcaattgcaattggtttagcgggaattccaaagtgacattttttggcgtttattttaatttcaaaatttgctgcttcaattaaatcaaaatcattaaatttcttgatcaaaatttaatttcctcttccttttttcttgacaattcaattttattattcagagagaaatgaccgataatacaaattgtaccaatggatgtattgctaaattggaactcagtgaacaattttcacagaaattgaatatccaaatttctgcagcagaaaatcagcaacacaataaagatttattggattctgagcatatccatcgctcatttgacgtcgaaatccgattgacaaaggccaagtaaacaattaaatatctaaaaatccatcaaagttcttcttagtgctcttcaaaattgcgaagattttttcgactctctgtcagaatgttttgtcaagaaattggccgacattcgcaattgtcgtccattctttcccatggatggtgaatctccgcaaatggttgacagagtttcggtttcgtgttcatctgttggcgagggattggtaatttcaaagtttcgttattttatatttaattgcccttttagcctctgaactgttctatagatgaattgaaggcggcacgttaccattcgtatgttgccaagaaatttggggcaatggctgaggaaatttcgctcgacgcagcgaacggcgacgaagggacggtggcatcacatcagtgggaaatgcccagtttggaattcgagaacttttgggagactttgatattcgacggtccgattaaaaacgaggtggattggacgggttggctaagaaaattaatttaatgaaatgctttgaaatttgcattattccgcctggttaggtccgtttagccattttaaaaggcataattttgtctgtccttctcctctttttagtcttgttttgtctttttttgttagacggacaattcccgtgtaatagacacacttttagcttcttgtctatgccaattctctgcttgaaatttcctatgccggtgccgatttatccattttgcctgtcaaccgactcgtcctcctccacggtaaacagttgctttttgttggcacaaaatgttccgcttgtaaaggtcctccgggcactggcaaaacgacactttgcaaggcattggcacaaaaattggccattcggacgcaaaaacggtataaaagggcgattntggtggaagtgaatagtcacagtctcttctccanatggttttcggaggtaaggggaaataaagaaactccgattgctaattttttattattnttttgag

SEQ ID NO: 39793 - DNA, 1028 bp, Heterodera glycines
ttttcagcttgaaaaccgttccacttcgctgatctctgccgccgtcatttcccatcaacttttaggccgggaggacgacccggactacaaagtgttggagcaatgtttgaaccaggccaacctgttgcggcagttcaaggcggagccggccgaattttggcacgcacttttccacaaatggttggccaacaaaaactgtgtgtatgtgatggcagagccaagcgaagaaatggccaacaactacgagaaaatggtcgcattttgtgtcaaaattattattttttacttaacaaaaaatggggtttttaggaagccgaacgaatacagaagcaaatcattgcaatcggtggcgaagaaggactgaagaaatacaagaagaggctggacgatgccattgcagagaacacggttggttggtcaattagaacttggcaaatggactgttaaaacgacaattaaacggcacaattagccaagagagggggggggggctttttgtcagactcatgaacactaataaatttaaatgtcggtcccatgagttttttaaacctaacccattcccccatcagcgcgcacatccatcggacgaggagttggccgacctaattgtgcgcgacttggagaagttcaacatgattggcgtgtccaccagcacaaatgtggcccaacaaccggacggttttctcagcaaattccctttcaccgccgcccttcacagcgtccccagcaatttcttcgacgtaattttttaaactgttttggacattttttatttttatgcaaatgtttaggcaaacattgtgttcgacactgacggcatcccggcggaagaccggcatttcatgcttctgtggtaaataaaagtttttaattctataaacatttccaaatgatgccaggttcgaactgatgtttcaatcaccggccatcgtcgagggcaaagagctgagctacgaagaggtcgcaaaactgtccaccaaagacttggtgtcgcactcggtttctgtcggcatttcgggcgtcta

SEQ ID NO: 39794 - DNA, 267 bp, Heterodera glycines
tttttaattcctttttaaacaggccaaaaagtttagagcttaacttcctttttcagaaacttatcagaagcgccccaaactttgcagggatactgaaaggaaaagaattaacctgttttatcacattagcttgtcatcagtttttataaaaaattttcaaaattctgagtctcctattattttatttttttttcaaaattttgaagggcgggggggggggggggaacatattttcgtactgcttataaatgattaatataaaaatgc

SEQ ID NO: 39795 - DNA, 1795 bp, Heterodera glycines
  misc_feature (52)..(52): n is a, c, g, or t
  misc_feature (1747)..(1747): n is a, c, g, or t
ataaagtaaaatagataataaattagacaataaattgcttatgatctaagtngtcattatttttaaaacattgtataaccgtaatgtaaagcttaaaaaaatatataggtttaaagtgatgggcgctgcttatctcttcagctgactggctgggtgcaggtcatggcacagttgaacaagttcagcagcgtaatgttctgcaatttcggctgccgaacgcagtcttccaccagttaaatcaatgtaaaaaattcataaataaattgatgaattggcatttatttgcatttattttggataaatgtgaaagaattaattaaaaccatgatgctataagaaaagaagaatttaataaaaatttaataaaattatataataaatgcaataattttaaaaactccaacatttttataaagatttttcaaacaaaaattttaagctagttgttaggcatatctttaatttttgtactgctcgagtaattgataaaagtaagttttcggatattaaaaacttatactctcaaatagggttaaggcccgagccctcggggcggggaactcggaaggcgacatgtcgggggtcgggtcggggggaagctcaattgttgggggtcggggactccggtcgggtgatttcttaaaggatcaaaatctttaaaaaattaacttctcattgttaaaaaattttaattattttattttattaaaaacaataaattaaaaatactaactttatcgaaaatatctaaaaagtttaagataaatgaaacaatgagatagttaataatgaaaattattattctcaaattacttcgaactattttatggattgattgaattttgtaatcatttgtttaaactagagtagagcgggaccgggaattttgggcaaaaccgggaccgggacttgccgggacctgagaagccgggaccgggacctcggtttttgtccgggaccgggaaccgggacaaaccgtgaatttttaaaaattcaaaaaaatttaaaaaaattcaaaaaaattcaaattttaatttatttcatgtgaaaaaatacaaaattaaatttttcttttgttttttatttaataaaatccaaaagttaaagctaaattaaattaatgaaaatttttaaaccaaatttatttcagttatttcaaacaattaatcactttttgactcaaatgatcgaatattattagaaattcagatttacttttcacataattttttcggcgcgctttttctaaaaacttttgggaaagaaaggggtccggcggtgccgataggcgccgccgggggaaattttaaaaatttgggtgcaatttgttaacaaatttcaacaaaaaaggctggtttttgggattagtaggctcaatttgtatggattttcatttaaaaaatgataaaatatgtgttgattaaaactatgagtaatcatattttgtctataggaaacccacgagtatacaaaaagagcattcaaaataatttaatttctgtagagggattgaaccacgagaaacaagaagggaaagtcaaggatactagccagtaggccatttgcgcactcggcagtgttacttttaaagaatatattaattattattttttatttttttcctttgactctaattttcatcactaatttttcactcagacccccattcttaccagtgcttgtttttcccggttcccggtcgccctaccgggaccgggacctgagcttttcaaaatccgggaaccgngacctcggatgaccgggaattcccgggcccgtcacggcgcactctact

SEQ ID NO: 39796 - DNA, 994 bp, Heterodera glycines
  misc_feature (26)..(26): n is a, c, g, or t
gtgtctactaaaatggtcggacttcntggagtacaaccaactcaattctttcctcacttttgtcaacctcagtggcttttgtcatgtcatccagccaccgacgcgatcttgaggccttcaacaaggtgagattacaataatggagccgcccgttttggtgcggacattttaaaattcgtcactttttcataattaattccaattataagttttaactaaatcgacatcaaattcaacttttcatatttttcgagcccaaacttttttgtcaatgttcagtcacttagtgattgcttaatgtaccgcgctgtccgcgccaaaccgaccccgactctacagtatggcttctggactagtcagctgaggacaacttagctgacacaactcagctgataagactattcggctgatggacaactcagccatacaatataaaattacaaaagcctcgcctaaagcttaggcctaagcctaagcaattttgcctttgtacgagttgtctgtgtacaagatgccatggcacctgggaaattgttaaattaaaaaaaattaatctttatccttaactaaaatttaaaaaatatttatagtttttaatttatatttttttaatttaattatttttcaatttttataatttttgtcaattctcgtaaagctgagttgttattcatcggaattgtcccatcagctgagttgtcctcggctgaattgtctaggctgagttgtccccagccgacttatcctgacgcgtacagtatgtccctaggcgacccaactataaatatggtttattagggaagctccgctcttaagcggatggacccgcgcattttcactgccgttgacctaactgttgctgttccactcggttatgccgcctatcgagtctataaaaacggaggaggttaatatttaaggaatattaagtcaattattgtgtaattctgtgcccattgattggttatccttatttgcccgagaaatataaaaa

SEQ ID NO: 39797 - DNA, 1232 bp, Heterodera glycines
ggggacgggacgaaatctcgccgccggaatctcgccggccgaaatctcgccgagacaaaatctagccgccgaaatctcgccaccaaatttttttttaatttttttcaaatttcaaaattattcaagaaaaaataaaaataaattccaattttgattaacaatttttctaacattgcacaataattaacgggtcaacaaatttaattcatctcgcaataacatcaataaaattcccgttctattttgccctttccattcttttttcgacatttgagggtcgtccattgcctttccgcatccccaaaacaaatcgtgtggggagctctcaaccaaaacatttgaaccggtttttataagcatttctttgagcggctcgttctgttggaatttttttcgaaggcctcgaatcatcagattttcacagacacctcgccaaatgacaatattgaagcatttaatccggttatttttcccgagttttttaatttctgccggagtttttgccttcataattgaacaagctgcttcaaagtcgcggaaaaacaaagctttttgatgctgataaaattgttcagtcgacgaataaatgatcccatccaattcaaaagaaattgagtaaaaatttgagaaagcatatgaagcaccccaaaaacaaagtaattcattcccgacagcttgtggaaatggcggaccagacgtcgacaatggcattgtgtcatggtagcgggtgatcagcaacccatttccaaaaaaacaaaatttcacatacataatagcaaagtaaagggcagggacagaaagaatttttgcaaaaacaccttgactttccaccgaagaaatgcgaacggagttttttggtgctggagccaggagaaaaacgcactacaaaacggtcatcagataagcgtttaaagtcagccaagtcagcggattgaactccaaacgatgacaatctttccaacaaaaaaggacgtaaatgtgcatccaaaagattcttgaaattcttcgaagtgatgagcaacaaatctccagattccataaatgttagagtccggtaaaaaaaaatttccgggaacggggaacgggaaacgggaatcgataaagagcgggacgggaaacgggaacgggattcccggctttttcccgttcccgtaaaaatcccgtccgggcaaaaaagacgggaacgggattcccggcttttcccgcgggattcccgttcccgccggtctcta

SEQ ID NO: 39798 - DNA, 1626 bp, Heterodera glycines
  misc_feature (41)..(41): n is a, c, g, or t
gacaagcacgctgattttgccagtgtagcgcgcgtgcagcnccggacatctaagggcatcacagacctgttattgctcaatttcgtgcggctgaacaccgaaaatccctctaagaagttgtgcccacagaagcaatgagccaactatttagtaggctagagtctcgctcgttatcggaataaaccagacaaatcgctccacgaactaagaacggccatgcaccaccatccaccgaatcatgaaaaagctatcaatctgtcaatccttacggtgtccgggccgggtgagtttccccgtgttgagtcaaattaagccgcaggctccactcctggtggtgcccttccgtcaattcctttaagtttcagctttgcaaccatacttcccccggaaccggaagactttcgtttccgggaagctccccaccagggcgaataaatccgccggcggatcgctagttggcatcgtttacggtcagaactagggcggtatctgatcgccttcgaacctctgactttcgttcttgattaatgaagacattcttgccaaatgctttcgctgtagtccgtcttgctacggtccaagaatttcacctctcacgtagcaatacgaatggccccgtttgtctctgttaaccattatctcggtcagcaaaaccaataaaatcggaccgaaatcctcttctattattccatgcacgaacattcaagcgaaacgcctgtttgaagcactctgatttgttcaaagtaaactcgccagcccaccgacgccgaccggtaaaggccaacgccggggaaagaccggcagaaaagccaaccaaaccagtaacacacaaagtgtgcaccggacggctagcacagatccaactacgagctttttaaccgcagcaataattctatgcattttgagagctggaattaccgcggctgctggcaccagacttgccctctcatagatactcgttaaagggtttaaattgtacccattccgatgaccggcctcataagagatcggtctcgttatttctcgtcactacctcctcgcgttgagagtgggtaatttgcgcgcctgctgccatccttagacgtagtggccatttctcaggccccttctccggagtcgaacccttatcctccgttacccgtcatcaccatggtagtcagatacactaccatcgaaagttgataaggcagacacttgaaagacacgtcgccggtacaagaccgtgcgatcagcttagttgttctgagtcaacactggacgcccggagggcgcttggttttgtggcgaaaaaatgcgctccgctctggggagattggagctttggtgcatgtattagctctagaattaccacagttatccaagtaagaagtcaaggtcaagtaaattatagctggtgtaatgagccgtacgcagtttccctgtctggcaggttaaacttacacatgcatggcttaatctttgaaatgaacacatcagttcaggcaggatcaaccagatagctgctagcgagcgttgccaagcgccgctattacagccgtcttgtaaagacggatagtttcagcagaaacaactccgttcagcgcaagagtgcgcatgggcggcgaaggcgaccgagcaagtggtaag

SEQ ID NO: 39799 - DNA, 913 bp, Heterodera glycines
taaacttaactcctgccgagttataggcccgggactcaaatgtcccgctcaggccaaaatttttttctatttccgggaaaaaatcgaaatttttccgaaaaaaataccagtcgatagagctcgaaaaactatgttttggaagtggtctccgtttctctgggaaaaatcgttaaaaaatcctaaaattcaaaaacccgaaaaccgttttttaggcctaactcgaaaaattttgaaaattttcgaaattttaaaatttaaaaaatcgagctttcaaagctctacaataagtccgctggagccccctcgctcagatcaaacgctgacgcggtattcacctgggactgaagtggacaaagttgatactgaatttctcctattttctgcagcccttcctactataggtagaggcctggaattttttttgacttttagacaacacttcaacttaggttcctaccagcggaaagtttttgattcgagttttacagaaaaagttaggggccgtcaaacgcacgaaaaaatgagaaatcagtccctggtactcagttggcccttggaccggaaaacctatatttttcccggatgctcctcaaaaagttgtaagacccttccaccactttcagggcgctcccggccttcggccgggagaaaatggttttagcaacgaaactccttgtcaatataacatatatagtaactagcgggtgcgtgaaccgtcggctatttagctgggaaaaagcgcttcgcgctttgggagcttcgctacctagactgtgaagcgattcaaattgaattagaagaggtacaacagtgattagaagaggtacaactgtgattaaaagaggtacaacagtgattagaagaggtacaaagtgattagaagaggtacaactgtgattagaagaggtacaac

SEQ ID NO: 39800 - DNA, 775 bp, Heterodera glycines
aagaggaagataaagtggaagataaagtggaagaggaacagaaagtggaagaggaacagaaagtggaagaggaacagaaagtggaagaggagcagaaagtggaagaggaacagaaagtggaagaggaacagaaagtggaagagaaagtggaagaggcacagaaagtggaagagaaacagaaagtggaagagaaacagaaagtggaagaggaacagaaagtggaagagaaagtggaaggggaacagaaagtggaagataaagtggaagaggaacagaaagtggaagaggaacagcaagtggaagagaaacagaaagtggaagaggaacagaaagtggaagaggaacagaaagtggaagaggaacagcaagtggaagataaagtggaacagaaagaggaacagaaagaggaagataaagtggaagataaagtggaagaggaacagaaagtggaagaggaacagaaagtggaagaggaacagaaagtggaagaggagcagaaagtggaagaggaacagaaagtggaagaggaacagaaagtggaagaggagcagaaagtggaagaggaacagaaagtggaagaggaacagaaagtggaagataaagtggaaggggaacagaaagtggaagataaagtggaacagaaagaggaacagaaagaggaagataaagtggaagaagaacagaaagtggaagaagaacagaaagtggaagagaaagtggaaaaggcacagaaagtggaagagaaaacagaagtggaagagaaacagaaagtgga

SEQ ID NO: 39801 - DNA, 692 bp, Heterodera glycines
cacccaggaatcggcttcgcccttcggtccccaacccaaacactcacgcaccaggctgcgcattacaataatgagcagctcgtccaccttcatctcagatggatggcctggagtgctggggaggatcaaccaggggtcattccgtccttgcaatgcaaatataataaatgaatagattaagagaattaatagaattagagaagataggtttggaatgagagcttacattctttacaaattgggtttgcgatagccaaattcgagaacttggaaggaattattaataatacctttagtaaatacaggttgatagtgtttggtaagggaatgagtaaacactttaccttggatgaggttgggacgaataaaatgggggtatgttacaatgatagggtcaggggggtcttcggagccatagcgtaagatttggtccttaacagtatcgtaatgaattttttgaacagtttgtgcatcaagggtgaaccctcttattttcaaatcgtgttctatttcaccggtgtccttgcgttgcagcttcatcccataattcttgcagccagcgctgatgaactccaagatattgtggtcggggttttcgtctgttagttctccaaaggtgtccctttcctgtcgggagtgggtcgttccctccagggtgcacgtagatgacgctgtcggtgtcgtaataaagg

SEQ ID NO: 39802 - DNA, 963 bp, Heterodera glycines
  misc_feature (916)..(916): n is a, c, g, or t
  misc_feature (938)..(938): n is a, c, g, or t
  misc_feature (954)..(954): n is a, c, g, or t
tttttctctttcagcacatgggcgtgaatcagatgctaccctccgtctcccgttcacttacaatgtcacgaccgttgccatttatggctatgccgccgctttgaagcggtaatttgtttgctgaacagcagcgacaatgcaattgtttgttgcttttagtttcgcgccgaacatcaaaataatccattttcttggcaagcaaaagccttgggctctgctctacggggacggcgctgcggggatggcattcgtttcggactatcacaaggtgaaggggatgccttatattgaacgcattcttttcaaaaagggtgcacttcacttacaccccgccggttccccaccttcccgaaatttgaaaaaaggttatacaaaaaggtttagattttttcttgaaaaatttctgtttgaatattttttcaaaattttcggccgggtaacgacgtgtaagactccgtttcaaaaatacgacatatttggtgtttgttcgcatgcttttcaatgttttaacccatttcagcaatggtaccaactctacgcaaacattgtccagcaacttctgcctccgtcctcttcggtaatttcttcttccaccccttcttctcttccgtcctcttccttctctattattcaacatccgttgacttcgttcgaaaaccgtcccattgtcgtaagctgtgcagtgttttatgtgttcttttttaactattattagggaattttttgctgcttaaaattgcggttttagtgcagcatatgtgtccctttttgcgtcccgttcaattttatttacggtattattcgtaagcggatcgccactagtaaacgcatacagatttatgggacaggtaaaaatcatgggacgggttaaaattctatgggacgcataaatgggcattttgactgtaatactaancatttcatgtcttattgctgtngtaacagtttccattntttctttta

SEQ ID NO: 39803 - DNA, 1128 bp, Heterodera glycines
cagacgacggacttttcgtcggagattcgtggcggacgaatgcggcgcgtgggaagagacgtcgtgcggaggagcgatgaccaactccaatttggactcaattatggcatcttcgacgccaattgaatttgcggtaaatggacgtggcgaaggagcggcgaaggtgccatttggaaaagggacaacggacggaatggcaaaaataattacagacggaaagggacacttttgtgggggcggacgaatggacgacggaggacgacgcggaaaagcgggggacgacgggcagaaggaacagaaacaaattggagttggacagaacgtcacgaccctcctcagtgcacacgttcgatgggaagggaatggcaaacgaaacaatttgcgaagctttttcagttacaattccatcgtaatcatcgaatattcggacagcccaagtggcgaccagcaaaaatgccaacgcccttcagtcagactttcgtcgtaagccccattttgggaggtaacggcaaaaacacccaaagcatttgttggcacagacacgaagaagtggcatcaataagtgccagaaattcggtggaaaggcgagcacaaccaaaggaaaaagaggagaaagcggaggaggaggagaaggaaaagcagggggcgatgagcagggaacagaagagcagactgatcaaaacgaagagttgcccagcggaggggggcagggcaaaggcgaggggaccgaccgcaacaggtgggggaggggagacagggagcaaggaggggaagggaggggggaagagactgcgatgaacccgaaacggacatgaaaaaaagcatagagatatagagagagacaggagggggagagggagggcgagagagagaggaagggcgagagagagaggaagggcgagagagagagggagagagagagaaagggagagagagagagggagggcgagagggagggcgagagggagagagagagagagagggcgagagagaaagggagagagagcgagagagagagagggggggtgggaagagagaggaagggcgagagagagagggagggcgagagagagagagagggagggcgacctaaaaggatagagagagagggagggcgagagagggaga

SEQ ID NO: 39804 - DNA, 1229 bp, Heterodera glycines
  misc_feature (59)..(59): n is a, c, g, or t
  misc_feature (67)..(67): n is a, c, g, or t
atagaaattatttatagttaattatacgtttgaaatatttataacaatttctaaaaatntaaaaaanaatttgaaaattcttattaaattgtaattttataaataatttaaatacataaataattttacaattgaaaattgaagaattaattttcgttcaaaattaataaaattttgatatgaaaatagaaacaaacaaacatttaaaggtaattaaaacaacaaattatttaaaaaaaacaaattctcaaaaattttaaattagcttgaatcagttttaaataatttattatttaacaaaaagctttcgttgataacaaaattattcaaataaattataatcatttaaaataattgaaacactcaatgtatttatacgaaaactagaaatcaaattttataaattgttccaaatctaaactaacaatatataataaaaataattaactaaaaaataaaattataataaaaatatatattatccaacgacatgaaaaagaaagcattttttaatctctaataaaaaaacatcgcgtactcaatagattgctgcaaagtgacgttagataaattaagcaaaattataaaaatatgaaaataaatttatcgaaattaaactaatgattatgcataaaagtacataaaacaaagctaataaccatgtcccgccgcaacaacatggtcgacgtaagctcaacgcgagggataaaaggtattaagattttaaataaaaattatactgtaataataaacatttaaaaaattttaatatagtaataataacacagaaaaataattataagggcaattctcaaaaaatttaataaataaagtaatatcttcattatatggacttttattcgatcaataataaatttaaaatcttaatacaataatgcttatttaaaaaagaaatggatacataaaaatggattttataatattaaaaagtatagttgaataatttttatcagttatttttattagtaaaaagtattattcttttaatttattatttgcaaatgagcttatgaaaattagaaaataaactataattagtaaagaaaaatatattattaacaaaattgcttaattataaataaacgtttaaagaagatataaatgaaaaaattttcaaaagacgataaatcttatatataattgaatttattttaaagttaaggtgataatttcttttgttgttttttttcaaatggacttgaccagtg

SEQ ID NO: 39805 - DNA, 486 bp, Heterodera glycines
  misc_feature (396)..(396): n is a, c, g, or t
gacaaaacgaggttaaaactaagatttggccccaaaaataagattaaaaaacggctttttacattgtaaaaacagggctaactgaaaattttcaaaaccagcatttagccaacaagaatcatcatttggggtcaaaatcagcactttggaaattttagtcaaaatgaaaaaaacatgctttttttgtgacgcgctttttccgaaaaatttttttggacacaggggccggcggtgccgataggcgccgccgggagaattttttgaaaatttgagcatttttctcacagattttcaccaaaaatgattgcgcgattttgagtgaaaaaaggaagatttacgagcatttaaaaataaaaattgagtttttcgttaaaaaattttgttgatcactaccgnatcgggggtccccgacccccgacaattgagctccccccccgactcgacccccaacattttgccccccgagggctcggggcttaaccctag

SEQ ID NO: 39806 - DNA, 937 bp, Heterodera glycines
ttttttcttttaaaaatttcaataaaattaatcagaaatttattttttttaatttgattaaattattaatttaacaaataaattttttgcttttaggcattaagttgaatgcaataataagaaattgaatatatatttgcattttaaaaatccaaagaaaaaattgtaaattaaataattagtagaaaattataaatatattgagtatatttagtaatttaataattttgatacttgattattgtaaaaaataatatatattctgtatcaaaatgaaatggtgtccttataataaccaaaagttaatttgcatttattcgtaattaagtaaatataaaaataaagaaatttttatttttagtgaaatatggtatttatttttgtttaaagattgcaacaagagatttactttctaaaatgtatgattttttgtaaaattttttttaaatttttatgcttattttgtgcatcatcaatttaaaaattgcgattagtaattgtgcttattaattgtttcttttatttttttttcaataattgtaaattagttttaattttatattaatttaaaaattggaattttttaattgtccaatataaaaatcataaattagatctaatcaatattcacttcccctattattttttgaaatttaattaaatataaatatatttgacatttcgattaaaataatggtttcagaatgtgactttatataaaaaaagtaatggattataaagtctttttcgcatgaaaacaaaggtttttctctcataataggcttttgaatgtctatttttatagatttactaactttatgataataaattcatcggaattgaatgtattacgatttaataatatatttgtatacctaaaaatttaatgcaattccgtttgtttatataatgaattaatattttttacttattgtaa

SEQ ID NO: 39807 - DNA, 1277 bp, Heterodera glycines
  misc_feature (6)..(6): n is a, c, g, or t
tttttntatttggttttccatttccaaatgatcattttttcgggtcccctaacgccggtgtccgatcataaattgttggagcgcggaaaatgatcagcacacagcccaacaagcagaccaccgtgaaagtgatctgtgccgcaatgagaaaaattattattttttaattttttcccccaaaaaaagcttttaatgagagtgaaattctgaccaaaaagatgcgatccaacaccaccgacacgtatttccaatcctcaattatctgtaaacaaaagtggcatttagaaagaaaaatctggcgattttcaaaatttgccctgcggtgcccacactgatggacaaaatcgctaacaattcaaattggcaaattgagtcccctccttaaaaaacgagactttttcaagactcgagactctcgaagaccctttttaatttctgtttgaaattttattatttttcgggttggggtggggtggaaacatagtgcaccccgtcgaacaccattaattgcctaattactgctcaaacgcgcgcccgcccgcccacctgttggtcctcctcctcgcgccggaagtgttccgcgatgaatgtgaccgattcgaccgcactgcgcaatgggctgtgctcgcgcatgtccgactcgtcatgcgttgtcgttgacgcccgttgatggcacatcagcctttggatgccgctggtggaagtgatcaggccgaagtcctggatgggaataatttggcaatattttgatatcggatattttgccaattactattttaaacctggacttgaatcccggggtcgggattcaaatccaagcaaatccgggatttaaatccattgtaatcctatccctttctggttccaatcccgaatcctatccctgcgaattgaggttgggaccctgatgccatgccgacatttttacacggaattttgtcatttcattggtttttgaaaaatttgcattttatttatatgagttctagggcaaaaatcttggtctgcttcatagatttcatcatagtttaaattttccagtcgccaacacagtctgtggatgacagatctcctaaaccatagcattagacggcgtagggatttttttatgaaaatggaaggaatttcgagttttcctcccccctcccttcggccgttattcccaccctttcccggagggatgaacggcctcggcttggccccgccacggtgctcgccaagctgctccgttcacggcgacgtcgaagcactgtcgatgttgttgagccgggcatcat

SEQ ID NO: 39808 - DNA, 1487 bp, Heterodera glycines
  misc_feature (56)..(56): n is a, c, g, or t
  misc_feature (62)..(62): n is a, c, g, or t
  misc_feature (149)..(149): n is a, c, g, or t
aattctggaatacttttttccttttttagatagaattccaaataagtccataaaanttctcntgatttttctctattttaaggcttatttcctgtaaattgatcacccttttcgatttgttatgaattttcaaatattaggccaaatcnccgagggccaaaaaattgccaaaaaaataaagaatttttaaaatattccaaaaaatctgaaacttaaaataaacatcatatttgtgctcaggaccctaatttaccccagaaaaatatttttcaccctctttttcaacccaaaaaaaatttttgaaaatttctagggggcctagctcgaaaatttttgaaaatttcctttcatatagtacaccattcgatagcatttaaaatgctctacaaaaatgttctaaggcattttttggctaaaaccgacccctgacgagttatgggcccgggactcaaatgtcccgcttaggccaaaaattttttctatttccggaaaaaaatcgaaatttttccgaaaaaaataccattcgatagagctcgaaaaactatgttttggaagtggtctccgttttgccaggaaaattcgttaaaaaatcataaaattcaaaaacccgaaaaccattttttaggcctaactcgaaaaattttgaaaattttcgaaatttttaaatttcagaaaatcgagcttccaaaactctacaataagtccgctggcagcccttcggtcagatcaaaccctggcgtggcattcatctggtactgaagtgtactttttgagcacgcttcagttgccattttttacaggccaggggtttgctcaaaaaaatttttaaaaaataccaccttgtagaggacccttaggcggagtgccctttcagcgggcactttttgattcgagttttacaaaaaaagttaggggccttcaaatgcaaacaaaagtgagaattcagtccctggtactcagttggccctcggatcaaaaaacctatagttttccctagatgcgcctcaaaaagttgtaagacccttccaccactttcagggcgctcccggccttcggccgggagattttgtttttgcaaacgaaactccttgtcaatataacatatatagtaactagcgtgtggcgcagtaattgctcggtgtagacagtatgctttgcacagtaattgctcggtgtagacagtatacttttggtatatatgggcgggcgctgacatgagcgcttcgcgcaaaggacttcgttgctagtgcatgcgcgtttgataagtgatgagcaagtgcattcggccgctttgcggcctcagacgggccttgcgcccgttttttaattttgcgggggacattcggccgcttcgcggcctcaggacgggcgctttgcgcacgttttttaattttttgtggggcattcggccgcttcgcgacctcaggacggggcgtcgcgcccgttttttaattttttgggggacattcggccgcttcgcggcctca

SEQ ID NO: 39809 - DNA, 1140 bp, Heterodera glycines
ttaaattatgcttaattggcagatctggctttaaaataattcataattatcaaaaagaccaaataaaattattgttaattgtgagtttggctttaaattttattaaatgttatacagaaaaccaagggttagcccgaatggtaataatttcattctattttatattagcaattcttcagtgtttgaattttcctttgcacaatgatttaaatttggctttctataagaagtataaaaaagattttttaaaattttttgaaaaaattaaattttcaaaaatttatttaatcctattctagcacaatatttaaaatcattatttggctaattgttcgacaataatattccaattttcgtcaaaatggctgaagcatcttcaaacggcaccgaaatccacggcactatcattttcgctgcttatgccatggcatttttggaacttggcacatttattccgacaattccaattgtggcattctgcgcttcaattttgtacaaaacttccattcttcaccgaaaccttaagggcattctgttggcccaactgtttagcataatgatgaatttgtggccacgtgcctttatgttaattgcccaaattttcgtgacgaaaaatatttttttgttgccaccaaattttatttctggcgcagcgactgcggcattgacattcaacaacatggcaggccatgtgctgattgtggagcgaatatgtgcaactgtttatgtgggcacttatgagagctaccgtagttggacatttacggcactttggctgtcaattacggtaaaatttcattttcatttatttatttctgtagtattattttattcattaatattcttaataattttttaataaataaattcacctaaaattttttaaaaatatctcttgtttcatcatcattgagtaattaactttgatattaattaattagaaatatttcaaattaattaattattaattaaattaattaattattatccgtatttaaagatcatcctttgtttggcattaacaatttatcaattgcttgttttggattcatcgtttgcatttacaaatatttttgtgggtctgtacatcggagcaatgatcgccagtttaatcgaaatttttgtaagttaaaaatttaa

SEQ ID NO: 39810 - DNA, 1774 bp, Heterodera glycines
  misc_feature (826)..(826): n is a, c, g, or t
attatctataataagtaaaatcaattatctactgtaatttatataagaaatttattaaaattatgcgcacactccaacacattccaattatccccccaataaaaacataatccaattttatatatgtgttgtgttattttggagatttcaaatatgaaaacacagaaagctactgtaatgatataaacaataatttaattttaagacaaataaaaattattgatgaaaaattattgatgaatataaattgaaatatttgaaatttttgactatcaacgattaagaaataattggagcaataccgggggaattgcatcattattttataaaaaatttatatatttaaatattaaatgtaaattaaattaaaataaatataaaatgaattaaatgaagaaaatacgcaatcaaataataaatatcatgtcgccggaatgtcagctacaccaacaaattgccgtcgcaagagtacccaaaaatatttataaaaacaatataaaaatattcaaaatgttatgagatccattaaaaaatttttacaacataaaataataaatgattaaatgtgttctcatacatcaaaaaccttcgcgaaatttcaaaaaaaaattctcaaatcataaaatgaaaatatatttcacttgtgctgtgattggaaaatttattttgataaaaactatttatttacgatgtttgagataattgaaaattttgttattatttgaaaaaatggaaataattaatatttaacaaagattaattaaaaggatatattcaacgaggcaataaaattattgccgagaaaagagcggagatcctacatttnaaaacatagtaatttaaatattttaggacaatatttcttcaattacataaatctaattttctaaattactaattccacaaaacatttcaccacttaaataacatgaatgtagaaaagaattaaaaatattaatatttataataaaaaataaagtattaaatcagtaatttaatttatatatctaatgggacggtaacgaattgctctcggtggaaaaatggcagaaaagatttttttcgtcaagagtttaaaaaatatatttatatttgcaataaaaaaaaaattataaattaagtcagtaaatttatttattgagaaaaataattaaaatacaaatgattaataaactaattacatattttaatttctttaaatagttctttgattgacacaaacaatcataaaaaaatcaaatgattaataaaaattaaatcatatatcaaaatcaataataaaaggatatcctacaagctagtcagaccaagagcaaatgcataattgcattaaatctctattatattagaaaaattaaacaaatttaataatttttttttaatttgcgattttttaaatttttccatttttttgaatatttgtaatcaaattaatgaactaagctatttcaaattcgaaatttacaaaataaaattgtaaagaaaattttttttttaatatttagttaaagtaattcgaatataaatctgaataaattaaatttgtttttatttgagtctattttcttctcatgttcaaatggtccatgagcttgcttgcggcgcgcagcgcttatcaataaatatgcaatatcattaggatagaacagatttttgaaaacaacctttattatttagatttaatcattcataaacaattatataattatattttatttataaaattattctttttgcatttttttgcgttgttgtgaaaagaaaaatcacataa

SEQ ID NO: 39811 - DNA, 837 bp, Heterodera glycines
aaaataaaaccccgggggaaagggaatgggaaacatgaattcaaaattttcaattttttatagtttaattttactcaaaacggttcagaattcaataaaaataaccatcccggtgcgaaaaatgggctttgaaaagtttattggggaaaaaaagcctttacaaaataatacccctgggagaagggagtgggaaacatgatttcaaaattttcaattttttttagtctaatctactcaaaacggttcagaattcaataaaaataacattcacggtgcgaaaaatggggtttgaaaagtttattggggaaaaaaagactttacaaaataatacccctgggagaagggagtgggaaacatgatttcaaaattttcaattttttctagtttaatctactcaaaccggttcagaattcaataaaaataccattcccggtgcgaaaaatggggtttgacaagtttattggggaaaaaagactttacaaaataatacccctgggagaagggagtgggaaacatgatttcaaaattttcaattttttctagtctaatctactcaaaacggttcagaattcaataaaaataacattcacggtgcgaaaaatggggtatgaaaagtttattggggaaaaaaagactttacaaaataatacccctgggagaagggagtgggaaacatgatttcaaaattttcaattttttctagtctaatctactcaaaacggctcagaattcaataaaaataacattcacggtgcgaaaaatggggtttgacaagtttattggggaaaaaaatctttacaaaaataatacccctgggagaagggaggggaaacatga

SEQ ID NO: 39812 - DNA, 903 bp, Heterodera glycines
  misc_feature (857)..(857): n is a, c, g, or t
  misc_feature (872)..(872): n is a, c, g, or t
ggtcacaataaaataaaaaatggctagtatgtaaaattggcgtccagaaatttttagactaatccgaagcaaagcacgaatgaattaaagaggcgaaagaattcacagtatcgtttctaatagggaaatattgacaggatattccgctaaaaacgggtttgatcatttttagcgcatttttaggtatacatttgagacaattgggcaggacaagaaaagaatgaagttgatgcctcatgaaactcggaattggttatgtttagtcgaaaatatccttacataatactcataaaaatacaaataattcaacccacctattctatgaccacattctgaaaaaaatcccagaaatacgaggaaagatatgcttggtcacaataaaataaaaaatggctagtatgtaaaattggcgtccagaaatttttagactaatccgaagcaaagcacgaatgaattaaagaggcgaaagaattcacagtatcgtttctaatagggaaatattgacaggatattcggctaaaaacgggtttgatcatttttagcgcatttttaggtatacatttgagacaattgggcaggacaagaaaagaatgaagttgatgcctcatgaaactcggaattggttatgttttgtcgaaaatatccttacataatactcataaaaaatacaaataattcaacccacctattctatgaccacattctgaaaaaaatcccagaaatacgaggaaagatatgcttggtcacaataaaataaaaaatggctagtatgtaaaaatttgcggtcactaataaaataaaaactggctaatatgtaaaaattggcgtccagaaatttttagactaatccgaagcanagcacgaatgaattnaagagggcgaagattcacagtatcgtttcta

SEQ ID NO: 39813 - DNA, 558 bp, Heterodera glycines
attaataatataattatgtttttttaaataatttttggttgcatgtttcaattctatccatccaaatgattattgtcaaattttatttcatgcgtttaagccgattttgaagattgactttcgactttttgttcgaatccaggttcggggttaaaattaggtcgaattctcttttcggcttctaatacgaatggtcggctccgcaggaaatacttgaaacatataaaattgaatagattttcacccgtggcacacattttatccaggtcctagtctaatcgaaaaaatccaagttcatgctggaatttaaaaaataacaaaatgacaattacggattaggagaaagaatctatgagagccatgtcgcttcccaatcaaaatgaacagttacggattaggagaatttttgagtgccacgtcaattcccaatcattctgtcaaattgaccaccactattcatttcctaacacttaaatttgctgctgtattttgaagtaagtactgcaaaagttgccccaacagttctatttcatctcatgcctaaatgtactactatat

SEQ ID NO: 39814 - DNA, 1720 bp, Heterodera glycines
atgaactggatgaggaacatattttgataagctatgagacaaagaaggagtgggttgaggagcacgactgctccacatcgggtaaaaattttctatagcttttaatagtattggttattttcttaagtcatctcattgtggacaacatcggcagctcgcctcctcttgctgaaggcgatgcagatggttgtgcggactccgggctgtgtgctgctctacacggacaccgacagcctgatctttgcccaccttatctgagcgtgcccactccagacgggccctcatctaggacaattcacggacgaatatcccaacccgagcattaaggatgggagggtcacttcatgccccctccaaaaaatttacaaaccatttgtcggtaaaggtattgtcggagccgactttaaaattttcgactttggtcacactttgtaactgttttgttcaccattcattgtatctgctctctttctctctctcatataacatacacccacatacacacactcacatgtactctttgttttattacttgatttctgcaattttatctcttttttgttattttattcatgtttttagtaaaaatgtatgcataattaacgaatggaagatgaaatttgaaaataattaagcgttggaagatgtaacttttaggtagaaaaagtgcataattaaggattggaagatacaatttaaaaaaattaaggattagaagatacaagtttttaagccaaaacataattaagcgttgggagtatttgtttttaggtgaaaaaatgcatagttaagaaaaggaagatataattaacaaaaaatatgaattttgtggcaaatttgggtgtatgtggtgtgtgtttgtgttcaccagtacgtgtgtgctgatgatgatgatggttggctgcactcaccacgcccagtgttggtaatttcgtcaatgctttcataccatttgcagcctttaccgttaaattgtaaataggaagagttggaagaatgtgaagcttcacttttggtgtcctcctcctcctgctcctcaatttcagtgaacaatcgaccaaataatcgccctccctttttgtcgtcgacaatttcaagcagttccatcggataataacggtcctcaccacgcgtaaagccttcaatgatgcatggcacataggggtagtgcaatttgacacggtgacgagtataaaaatgcgctgccacgttaatgttgaacggcttacgcagacgtccatatgcgggttcaaatgccgcgcctcgttcagtcattccaccaacgaggaaagatttgcgcattccattccgatccttgtatgttgtctggacctttttcccaatcaattgctgcaaaactcggactcggtcctctggatggttcagtcgatcgcgaagtgactttgtcgggcaggagagaaattgagcacaaaattcgctgacgagaaccatttcagattttttaatgtctgaatgaagaaattcgagcggcttttataccggtgttccaactcaaatggataagctccgcccctttttattttatcgtatgcataattaatgaatggaaaataaagtacgaaaataattaaacgttggaagatgtaacttttaagtagaataatgcataattagtaggtggaagacacaattttgaaaaattaagaaatttgaaaatataattttaactgttcaacattttatttagcattaataatga

SEQ ID NO: 39815 - DNA, 1041 bp, Heterodera glycines
aaatactcaagcattattgcttattctgacctattcaattcattcaaaaggagtgacccattaattaattaatccttctttttcagcacttacctttcggcttaatccaaactctgtgcctcaaactgtgaaaatctctcagtcctcagctgagtacaccgttttggagaatgtgagagtcgtcgaatggcaaagttcgtcgttggatcgaccaggtgacaaagcacaacaaaattagccgaatcaatcattttgcgttgtcagaattgttgactgtttgggtcagaaagtgcaatttcgcctgtttgaatctgctgaaagagaccaacggaaagtcgccccgttttatgctaatcggaaatccgcaaggactttttgacgagggcgaactcagcgcagatttggaagaacgaggcgaaggcacagtttcggaaaacagtggcagagcagcggacagaatggtccggacgcattatgtgatggtgagagacgagcagcagatggggacttacagtaccactcttacaataaaatgaaattacagtatgacaacgaccgactgctgagaagcaccgattgtcacgagcttttcgggagggtggcagacgaatcatgcgaaaatgagaaggaaacggacggaaaaggaagaacggaccaccggtggttaaagtgacatccgtcgattgaccttttgtacatctttataaacgccattagcatttaaatttgaagaattttcttaaaattataaatattttcaaaaatttccgtgccttcggcgccactcactgagagatggacgaactttgacaggctctaatgcactttatgagtccaatcaattgacaatcccgggtttttatacaataactttttccatgttcgaccctatctttttggtatcattcgaaagcgcaaagtctgaataatgtaataatacgagaaaacgagagaattctaacagtttctgaaagttacaaatgaaaataatcagcaattacttaattaagcaaatcttttttggaaattgcctgaacgctg

SEQ ID NO: 39816 - DNA, 937 bp, Heterodera glycines
acgtcgaatcaacgaattatgtcgcagaagcactacgcaattcttttgttaaatttattttaaaattgctgtgaaatttcttaagctgaagagccccctaaaaaatcctgtttaaaaaaaacaaaacggacaaaagagaagcgagtcatcaaatttagcggtgatattaattttgacaaaactgcttatggggtatatattaatcggactacgagaaggagaaccgggcaaaatcggacgaatttcattgtgagtttggccaattataaaaatttgaataaaccgaaagaatttctaatttatcgaaactattttcagtctcttgccttcgacagtctttcaattgattcttctgaaatcgacattgacaatggaattcgtttgccaaattgtgatacgctaattaaacccgcaattgtaagtttttttaaaattttatttattttaattagtgtaatttcagcgtcaaaatccaactttactcggaaaaaaacttccaaaaataaaagaagggattacaacggatttttatcgcattataaagcgcgccttatatttgaaaaaagtcagtgccgaaaaccaacaaattccctcgttgttggtctcgcgccttttgcttaccgattcgatgctgtcttcattggaaggcgacctttttcgaaacatggatctgatgaagcttgactatcctcggatgccaatgtgagttttgtttcgaacattcgccgaagaattaccgggcgaagacatatccattcaaattcaggtggtttttggagacattggaccattggtttgatgacaatgaattaacttttgtcaatggaggagtttttctctattcaaaggcaagatttactagcaatttctctggtaaatcaaacatttttagattttcatttccctcggattggaccttcttttttactacgccgac

SEQ ID NO: 39817 - DNA, 1694 bp, Heterodera glycines
gacgagttatgggcccgggactcaaatgttccgctcagcccaaaattttttctatttccgggaaaaaatcgaaatttttctgaaaaaaataccagtcgatagagctcgaaaaactatgttttggaagtggtctccgtttttctgggaaaattcgttaaaaaatcctagaattcaaaaacccgaaaaccgttttttaggcctagctcgaaaaattttgaaaattttcgaaattttaaaatttggaaaaatcgagctcaccgagctctacaataagtctgctggccaccctgagctcaggtcaaagcctaatgagttattcaacggggactgaactgggcaaagttggtactgaaaagttgccaatttctgcagcccttccaagtataggtagaggcctggaattttttttgaaaattagaaaacacttcaacttaaaatcctaccagcaagaattttccgctccctgtcctttaaaaaaagttacgggccttcaaacgcaagcaaaagtgagaaattagccgccgggactcagttggccaccggagcaaaaaacctatagttttcccagatgcgcctcaaaaagttgtaagacccttccactactttcagggcgctcccggccttcggccgggagattttgtttttgaagacgaaaccccctttttctgtagagtaatataaactagcgtgtggcgcagtaattgctcggtgtagacagtatgctttgcacagtaattgctcgtgtagacagtatacttgtgagagatgaaaagaatatgcattacatgagcgcttcgcgcaaaggacttcgttgctagtgcatgcgcggttttgaaatgaatttatggatgtgataagggattttggtctacaggcatcgtgaggacgcattcataattttctggaggactttcggccgcttcgcggcctcaaagggcgctccgcacttatctttttcaaaattttaaaggcgacatttgaagcttcgcggcctcagacgggcgcttttgcgtccgtttcttaattttgttgggcttggacgggcgcttcgcacccgatttaaattttgttggggccaaacgggcccttcgcgcccgttttttaattagaagctaactatgtcttcttttgacgaatctaagacgatagaaaagagctcaagcgtgagagggatggcgatgcgcaatcgccatttaatttctcacgagaattgttaaatttatcttatatccaagaaagatgactatctcttattttgagaaattttatacgttacaaatgctctcgagcatgataggaagtgcggcgcgcaatcgccatttaatttcacagagaatttttaaatttatcttatatccaagaaaaatgactatctcttcttttgagaaattttatacgttacaaaagcgctcgagcgtgagagggagggcggtgcgcaatcgccatttaatttctcagagaatttttaaatttatcttatatccaagaaaaatgactatctcttattttgagaaattttatacgttacaaaagcgctcgagcgtgagagggagggcggagcgcaatcgccatttaatttcacagagaatttttaaatttatcttatatccaagaaaaatgactatttcttattttgagaaattttatacgttacaaatgcttctcgagcatgataggaagtgcggtgcgcaatc

SEQ ID NO: 39818 - DNA, 695 bp, Heterodera glycines
gaattgacaggcttactgtaccaagggtaccctcattggctagatgcccatgaggatacaatccatacaaaatttttaattttatttttgttcgagttcgggtcaggggttcgaaataggcaacccttggtacagtatatgcggatgccggactcgggcagcctgagcatgtccagatctggagacccgaagacctgtcttttgtaggacatggccccgctcaaggaccctccgacaagtccagacccggatacctggtttttgcaatatcttgccccactaggtggaagcgggctcttagaatgtaaatacccggatcggaacccggaaggtacggacccaactttgcacaaaaacacactagaaagaatggccttccgggccaaattttgttgacaaaagtttaaggaattgaatatttgtgaaaaagtgaatatttactttaatacatgtatttataacatgtgtctgcggtctagtggttagcctctatggaaaatttacttcctctcactgggtcaatacactcgcatagcccccagattttgcccaaataaccggtggcgtggactacgttacatattcaatgaacgcgagaagattaatacactttttcagccagcaaatttttgttttaaggtctcaattacaaacgattcacagaaaagagcttaaaaaagtgattgaccaaaaaa

SEQ ID NO: 39819 - DNA, 1081 bp, Heterodera glycines
  misc_feature (66)..(66): n is a, c, g, or t
  misc_feature (130)..(130): n is a, c, g, or t
ttttaggacaatttttctatctcgtaaccccgatgctaatccgttccggagagcctcttcaaaatntttccattaccctaagagctgcggaaattgtgaattaattctcagaaaaatggttatctctttntaggacaattttctatctcgtaaccccgatgctaatccgttccggagagcctcttcaaaattttttccttaccctaagagctgcagaaattgtgaattaattctcagaaaaatggctatctctttttaggacaattttctatctcgtaaccccgatgctaatccgttccggagagcctcttcaaaattttttccattaccctaagagctgcagaaattgtgaattaattctcagaaaaatggctatctctttttaggacaattttctatctcgtaaccccgatgctaatccgttccggagagcctcttcaaaattttttccttaccctaagagctgcggaaattgtgaattaattctcagaaaaatggttatctctttttaggacaattttctatctcgtaaccccgatgctaatccgttccggagagcctcttcaaaattttttccattaccctaagagctgcagaaattgtgaattaattctcagaaaaatggctatctctttttaggacaattttctatctcgtaaccccgatgctaatccgttccggagagcctcttcaaaattttttccattaccctaagagctgcagaaattgtgaattaattctcagaaaaatggctatctctttttaggacaattttctatctcgtaaccccgatgctaatccgttccggagagcctcttcaaaattttttccttaccctaagagctgcagaaattgtgaattaattctcagaaaaatggctatctctttttaggacaattttctatctcgtaaccccgatgctaatccgttccggagagcctcttcaaaattttttccattaccctaagagctgcggaaattgtgaattaattctcagaaaaatggctatctctttttaggacaattttctatctcgtaaccccgatgctaatccgttccggagaggctcctcaaaattttt

SEQ ID NO: 39820 - DNA, 1034 bp, Heterodera glycines
ttgacttttattctttaaatttaacaattttattatctaatttgcctcatttctgtccaccagtgaattaattattactaataaggcatttgatgggggggggggggacggggggcgcccgtgccccgccatttccttgacccaatcacacccatttaaattccgttgcaaatttaaccgacaaaatgcaaaaatcacaatgccatacccctttagacccttttgccccatttctcccccacctcaaattcgccacaaattcattctgcactccatagaaagatactaataaccaactccatccctccccatttattcacatttatcaatttcatttatcgatttttgtaaaatttcaaaaaattttctcagaaagatgttgacaattgaaaaggagcagcagcacagaagagagaaaagaagcccaaatcacgtccattagcagcagcaacgctttctctcttcgtccatctcacagttatttaacccaaagcatcccaaattttgtcaattgttgcaattcaaattcgaaacgaactcatcgctttcgacagtccatttttatcttatttatcacctcatttgtcagcagcatcatagtcgttcattagtgttcaaagcaatcaatacccatgcagaatctgaccacctcctccaactttcaaatgttttccaaaggttcgactaccggattttaatttattaaatttatcaaaaagcattgcatttcttccattaatttacgttgcattatgtaggcttttccaaattcagtgcaccatgatgccgtcccttcccacacgcaacagtcgcccagaacgaatgcctcagtctctgccggggacattggtgaacagcagggaaaaggccaacacggtcagctgtcagccgctgatctgcaccagatgatgctgaaccagctcgatcaggtcggacacccccccccccccgagaaatttagattcagtagaagcaattcaagccacaccttgaaaattcatgttgtcgagattttaattaagttttggcataaa

SEQ ID NO: 39821 - DNA, 1670 bp, Heterodera glycines
  misc_feature (1653)..(1653): n is a, c, g, or t
cggggcagtccccccgaaccgatccccccagatttaggggagaccgaatccttccgaatagcttccctatagccgtacttttattctgcgttggattttgctccccatatttgtttgagtacctcaaacggacacttgaaaaatcgatttttttttttcggggcagtccccccgaaccgatgcgcccagatttatggggagaccgaatctttcgggaatagcttccctatagcctgtactttaattctgcgttggatttttgctccccataaatgtttgagtaccccaaacggacacttgaaaaaatcgatttttttgtttcataaatatttttttcagaaagtgctctaaagcgcaccaaattttatttacaacttaattttagcactctgatgctttagtatcaaaaaggaagatggagaaaaaattttttaaaaaatttttccttatattttggttatatcgttttgcttttggtggggtgcttggaacagtggaatcatgcgcacccgtccgatctggcaagttaagcaacgattgctgactagccaaaaggttcggtgccgtgatgaaacgaaccagcactgcttaccccgcggcacccggcacggtcccccgaaggaatggatttaattaaattctctccttcggggatttttttccattaggtcgtccgttagcgttcgattgctctagtcaatttttcaaaatttttgttgaaatatttgtcgtgctctgaagggcgtgggaggggggggggggggggggcgaaggcccccacgagccgcgaagaggccgagtgagtaccttcggtgcaggaaaattattaaattttaaaaattttttaattgctttttaaatatgccaaaaaatgtaggcttaacttttttagtgaaaattcgatcactcatattttttgctaattgagcagaagcgtaccaaactttgcagggatactccccggtaaaggactaacttacactgaaatgagcgccgagctagctggctcaaaaaaatttttcgaaaatctgagtctttcgtttttatttatttgcaaaattaattcataaatattttttcagaaagggttctgaaacgcaccaaattttatttacatgttagtttaggcactctgatgctttttctatcaataatggaggtgaataaaattttaattgctttttaactttgggaaaaagtttaggcttaactttttagtgaaagtttgatcactcatatttttttagtctaatctactcaaaacggttcagaattcaataaaaataacattcacggtgcgaaaaatggggtttgacaagtttattggggaaaaaaagactttacaaaataatacccctgggagaagggagtgggaaacatgatttcaaaattttcaattttttctagtctaatctactcaaaccggttcagaattcaataaaaataacattcacggtgcgaaaaatggggtttgaaaagtttattttgaaaaaaagactttacaaaataatacccctgggagaagggagtgggaaacatgatttcaaaattttcaattttttctagtctaatctactcaaaacggttcagaattcaataaaaataacattcacggtgcgaaaaatggggtttgaaaagtttattggggaaaanaaagactttacaaaata

SEQ ID NO: 39822 - DNA, 657 bp, Heterodera glycines
gcaaatttgaaatttgtcggtggctagaaatgatgaaatcgttgtaattttttgacgaagtctatcaaagagccggcggatttaattcttcatttactctttttcgctttggcttattttctcttacttttgtatttaggtgataatgaatagggttcacatttttaggtttttacatatttttttcctgagctccccgtggccctaaaacgcacgaaaaacatgatttttgagctgatgtttagctacttttcaagttattagcgcctattttctaggttttatttttagcacctaacaaacctaaaaaaaataataaaaacttatttacaccgattttgggagttttttagaacttaaaacctacttattttggcagatattagcacctatgattttcatcgtttttttttttgctaattcaagcatgaaattgcctttatatttattttatgcgtcgctaaatgcataaatcaggcgattatccctttttagtcactatttgattacaaggcaaaaatacgcatgccggtattcaaaaatatgtttgatctaattctttcgttcgaatactttttctttttcaagatttttagaatattattacaatttcttcctgcctttctttctttctttttaaattttttgcttgacgcc

SEQ ID NO: 39823 - DNA, 933 bp, Heterodera glycines
  misc_feature (856)..(856): n is a, c, g, or t
tcgacgggtcgcccatttacggctcgaggcattctttcgccggcatttcgttcctctccaatgcccctcccccctttttttagcgtcggcgatttgcgcaaatttcgcgagggaagcaccggcttactcaaactgaacactttcaacgggtcagtgttctttccattttatcctgtgtttgcttattttttgtctcctttcccattggcttttctctttttttcctcccatgctttccctcccctctgattttgtccctttcaatgcttttcctcctttccatgctttccccccccccccgctcagaatgcgtcttctcccctttgactcctcccagtgccgttcttcctccgattgttccgccgttttcgtcgccggggacagtcgtgtgaatttgtttctgggcctcacctctttccaccttttgttcaccagggagcacaatcggtgcgtttcccccccccctttttcccctttttcgattattttccctttcctaaagaatctcttctcggcttcagcaattgaatcctcattgggtgcgtttatttacgctattttggctcattttgtgctccattcagaatggtgatcggctgttccaagaatcgcgaaagattgtcggcgcgataattcaggtcactcagtggggggtggacggaccaaacggtactaagtgaattgaagtataattaattatggtattccctcattaatgtttgttttctgtatcgttccgctcattacagtatcccatcccatcccttaccgtatacactcactccctttgcaattcatttgtcccattatgtgttgcattcattcattcaggcaatttgctaccgcgaatatcttncccaagtgttgggctcgtccttcgccgccacaagtgcccccccccaaaaaagtgccaatttctgtctctccgtcctt

SEQ ID NO: 39824 - DNA, 919 bp, Heterodera glycines
tcatccaaaaaaggataaccaaatggtaaaaatgcaaagaatttgattatgcacgagatttgagataatttgtttttgtttatgcaattttggaggaaaacaaaatttggcgaaggaatggacggaattggaaatgaatgaacggaagaggaggaatttgttagaaattttttaataatgagatttgttgggaagaattcgatggaccaaatgaggcaccataattataattaaccatcggatggaccacaagcaattaggcaaagcaattaattacacagttaattatgtatgattccagcagtgacaaatatttggtttttgtcttctaaggcaattaaaagggaaaataataaaaaaaaacacacaaaaatgacgattggtcataaggacacaaaaggggggggggggggaaagaaagcaaaaagcactttcgattattgggaacgggaatcttttggaaatgtgcaaaatgagggagggggggacatcacgccaccggcgcgttgcagcgcattactgcgactgtttggcatggcaattcacttccaaattggtcctaattgctcctctccgtctctctctcgctttttttctctttgcacatcaatcagtcggtcgatcagtcggcaaatcgaatcgaatgaaaatgagaaattaataatgaatacctaatgagtgagtgagtggggggggggggggcgtgggaggcgtaaaacgaacgaacgaattgttttggtgcgtggcattgttcagtgattgtgattatcatttgattattagcactccattacacatgattaagtactatcattttatcagcaaaagtcatgtgagaaggcaatcctttcggtttaagaacaataaaatgggagtctaatccgaaattcagagagtggattaaaattaaaagtgaaaa

SEQ ID NO: 39825 - DNA, 1340 bp, Heterodera glycines
  misc_feature (19)..(19): n is a, c, g, or t
  misc_feature (30)..(30): n is a, c, g, or t
  misc_feature (58)..(58): n is a, c, g, or t
  misc_feature (76)..(76): n is a, c, g, or t
  misc_feature (402)..(402): n is a, c, g, or t
gttgagtttcgatcagatnccattcgtcgnccatttccaatttctttgctgttaatgnccctttttcaaatccaanttgatgtccatgtgtgagaagcggactgctcgtcggttcggtgttttgtcttcttgaaagcatggtcaccgcgaagcggatgacgtgagcagctgttgctctgagacgattccaattgagaagcgctcaaattggattgcaggtgtgaattcttcgcgctgttggacggcattattccattcgacaatgggaggttctgtcacttctctaatttcttcgccaggggtgtaagtgacgtttgattctggctattggttaactttggttagccacgctgggccaaatcgccaaagcaatcacgattggagactctgtgggtctgttcnccgtgaagcgatgtcagccggattttcatccgtgcgaatgtgtctgactttgaaacaagcttctctgattttcttcagcctattgttgacgaatctgtcgtatttccgttcctctttgagccgttcgattgagcattggctgtccgtccaaagtatgacttgttcgtcggtgaaattgagttgagtttgtacgaactttgtcactttgacttccaaagttaacgcttgcagttccaatttaggaattgttgaatcgtggtcggccactttgagcggtttgatatggcttttgccaaaaatcaagttgctttccttttttccgtaggaagtgtccgcaagctgataaagcgcgacaccgagtcccgatttgctggcatcgcagaagcaatgaaattcttcgctggaacttgtcgcgatgtgacgagggaattccaccctgaagttgaagccgaatccgtcccacgcatgcattagtttgatccagtcaattgccatcttttccggcagaggatcgtcccatttgaaattcaaattttggacgatttgcaaaaaatgcttggcgggcaacagtgccggtgaaataagtccaagtgggtcatacacttttgcgatgtgtgacaggatcttccgttttgtggttggactgctgaagactggcattttgaagatcagctgatcgtgtcttggcttccattcgatgcctaacacctttgtgttttcgaggtctttggccaattcggatgagtcaagctcttttagctcgtcgatgtgacttccgaaaaattcgcggatccgtattccggcagattcaaaaatgatttttgcttccgtgaccatttgagtgatgctttcacttggtttgacttccaccatgatgttgtccacataaagattgtcactgatgcgttgtgcaacatccgtttcgtaaagagccaggt

SEQ ID NO: 39826 - DNA, 786 bp, Heterodera glycines
ctcctcctccccccccccccccccggccctcatgtcccaccgttcggtcggcacttccctcccctccaccgtcactcacccgttgcactgtcgtgccgttggcgtcctctcccgagacggtggtgccgtcctcctccgcctcttccgtcgccgcttccatccgcgcgcgtgtccgcctgcccatcgcggccttcgaatgcggccgatcgccggtcacccaatggtggtgcaacgcgtcgctggcggacggacgatggtcgggcgaagtgtccaaaagtgtgtccacaaagtgtttggcctgctccgagccggaccaaaactgcggataatacacctgagcaaggggcatattcagcaccattccccccatttcatgagcaaattggcacgagagaattaacaatttaaatttaatttaaaaccgtctaaaaatttgtgaaatccaatcgaaattcttttaaaaaatcaaaggtgaaaaaataaaaagtggtgcaaaatgtgacccattcacccaaattttcctatttttccagtttaaatttgttttgcggcccaatttgtggtttcaaatttcattaaaatctctctcccacataattggccgtgatgatgtgtgtgtacagccgagaacggcagtcgtcgtcgaagggcataatgccggacatcaaaatgtacgcttaagggggaaaaagatagggaacaaaatggcataatttttggggtaaatggatggcaaattcaaaaaatggcaattcgactgattgattaaatggtggtcaatgtgtc

SEQ ID NO: 39827 - DNA, 1406 bp, Heterodera glycines
aatttttaaatttacccccttcccccgttttctgcttttgctcactttgtattcgcgtgggccgtgcaccacatccttcacttcaatgatgtgatattggcactcggagggctgaagaagcaatgcaattcaaaacaatgaacaaattcgcagtttaatgacccaaccataatttacaccgtctctgcgttttgagctaccgtacccaaactgtattgacatctgtggctcagcgggtttcaagagatagtaaaaggaaaaggagggaggttcgagtccgctccatgaaaaaaaaaattattttctttctctcctgaattaaaaacaacaattttcaaaacccgttttaataaggcataggaaataaatgcatgtaacaatgttttgtcaaggttggacccaaataggtagcgtataggccggtacaccaagaatactaaaccccaccaccaacaaccttttctttgctgatacacggcatgaacacgaagcagccagtgacagtgtcacggaagcgctcaaactccagcttggccaacagacggagcattgacggactgagcgcaatttgaatcaaattatcctttttgatcggtggcgaaactggcaaaacaaaatgacaaatttcaaaaaaaaaatttcaaaattccttaccacgttcctcctttttgatggaatcgtccagttcaagcgtctttattgcctgtgccaaatcattttgtttctgatggacaaagccaagtgttggtgactcctcttcctgaaaaaaaaattgttggacactcaataaaaaaatggaaacgacatttttgtaatttttcaaacaaaaaaaaccgaatcaatttttttttgaaaaatgcacacttcacaaaaccttggcttcgatgtagctgaaccagctgacaatgtcctggtcgttcttcacattttgtgtcggcaaaattttgtcaatagaataatcgccgagccgacggaggcgcagccgccgcttcagccacaaatgttgaaaagactcggcctccatcacgtcaccaatttggtcgatctgtacaacaaaaaaattggactaaatttagggagttcgtgtgaaagttccagaattttacaaaaaaaaaaaatccaggaaaatcctagcaaaatactacccaaaaaaacgcacaaaaattgtcgtcgagaatttggacggcagcccagggtagttgacccggacataaaagccgatcaccgcctgccggtactgttcaatgtccagcagttgaaggcgtttcaactggccttgggtgaggataagacgcttcatctcctcgggtgtctgaaaacaaaattcttggttaaaggttgcgggttgatcggtttccattttcccgatgccctagtccgagtattgtatatttttcaaaaatgca

SEQ ID NO: 39828 - DNA, 1231 bp, Heterodera glycines
tttttgtattttacacgctttggagtcctcaattccccggaattagtgtcgggagtcggggggcaaaaagtgggagccggggacctcggggagagcgagcgaggaagtcggtggtctgggcggggaataggcccacaaaatgtcggggatcggggttcggggttttaaccctcttcattaaatcatcatttacaattaatcattggcaaataaaattaaaaattcagttaaaatgatactgtaatagcgaaaatgttgatccaatttctaataatattgacatatagataaatataaattaatcaaatcagaggttcttatttttcagaattcgaaatattataaaaaaaaacagattaaatttttgacttaaaaataattgtttatttaaaataataatgcgaagttctttagcagcagccacagttttcccacttgagaccctcgattaatataaaagccaggaaaaatatttaaatattaaaataaaattacatttatgctataatctatcattgtagaaaaaaaaatttaatttttatagaaaaaataataatagtttgtgaaataaagaaaaaataaccattaattaatgttagcgaaagcaaataaaattaaaatataccaagtaaaaacaaatgttttgataaaataacataattgaattatcgacaaaaaacagtgactatattaaaaaaattcaattttatgatttagattctaaagaaataaatgtttttagcaaaaaatatattgaaaactttccttgaatttcaataatatttgtaaaaattctggcaaaataattatggtgcaaatatgtcgaggggaaacggacggattttcgtagacgcacctggtggcaagtgataaaattttatattttaataaaacaatgaacgaaataaataattaaaactttaaaaactgattatatttggcttaagaacatggagcaacaaatcatataataaataataatttaaaataaacttcttaaaagctcttatttcttaattttgatataatcttcagacaaatgcttcataattcaaacataaacatattgtggtctaccgagtgaagattactcaaaaaattaaaaataccaaaataatttataaaaattgaaaataaaaaaacaataataatttgtatttaaaataatgatttcatttaaactaagagcaaagttaatacatttattattcaagttgaaaacgaataataa

SEQ ID NO: 39829 - DNA, 576 bp, Heterodera glycines
atttgacgggatcggccaatagcaacgggattttgatgggattggccaatagcaatgggatttgatgggattggccaatagcaatgggatttgatgggattggccaatagcaatgggatttgatgggattggccaatggcattggcaattgatgggatttgattggattagccaatggcattgtcaattgatgggattttatgggattggccaatggcattgtcaattgatgggatttgatgggattggccaatatcaatgggatttgatgggattggctggcatttgatgggatttgatgggattggccaatagcaatgggattttgatgggattggccaatagcaatgggatttgatgggattggccaatagcaatgggatttgatgggattggccaatagcaatgggatttgatgggattggccaatggcattggcaattgatgggatttgattggattagccaatggcattgtcaattgatgggattttatgggattggccaatggcattgtcaattgatgggatttgatgggattggccaatagcaatgggatttgatgggattggccaat

SEQ ID NO: 39830 - DNA, 1038 bp, Heterodera glycines
  misc_feature (991)..(991): n is a, c, g, or t
  misc_feature (1011)..(1011): n is a, c, g, or t
  misc_feature (1016)..(1016): n is a, c, g, or t
aacttagttttaaccaaaaaaataaatgaatttatattttttaaatatgagaaatatggtaaaatacatatttatattgaataaattaccacgtccacaatgaattaatcttttttaattcctttttttgatgtaaattaggtatattaattttaaaataattatgtccgaataatttatgccatcaataaaacggagtaaatataattatacataaatattcataaacattaaaaaagaaaaagcaataaaactacttcatcaaaatatcctatttaaaaaatattgaaaaactgaaataaaactttatcaaaaagaacttatactcaaaatatatattattaaatttaaatgattcactaatttataaacaaaaccaaagtaaattaattgaaaaattaaattttgaatttaattattcaacatcacccgcagtcgggagtgtcgcgaagagtgcgaaaattaaaactctaaaaataataataaataatcatgaaagatttaataaattcatgaaaaaaagtttatgaaaattaataaattgtagaaaagtggctataaattttaaaatgataattggatgaattcaataataaaagaaaacgcatgaaatgttgaattaaaataaaatatttaaatcgtaaattacagaagaaattaatttaaaattttatttatcaaaattttgttcaattttatataaaatttttatatcatcttataaaggtaaattttaattaggaacgatcaaataaaaaaagtgatctcataaaaaattaagatttttgttcttgcctccaatttttcacaaatttacttacgttctaaagagttgcatttaatggttcctttataataaaatttttaaaaaatttaaaaacatttattttaatctattctttgtattaggtagtttgaataaataattctaaacaactttagattttacatgaaaagaaaaaattacattagaaataaaaaactcgtttanataaaattcacatatgattntctanaaaagaaaactttaagaattga

SEQ ID NO: 39831 - DNA, 536 bp, Heterodera glycines
taccgtatttactcgattatacgccccccccctcgaatataagcccactttggaggggggttgaacaatagaagccccggggcttataatcgaggaaatacggtactttaaaaacacccctgatgttcaaaaaataactacagtgaaagaaaagggggctggcgcccatttggcggcgcccattcgacccccaccggtatttcggcgagtgacaaccccctgctgacgccgagacaaataatatacaaaaaagcttcatttttaggcgcatcgaaagcgagaaatatacaaaaaaaaggggcagagagaaattgagagacgaatgaacacaaaaaattaatataactatataaaataacgatgaggggaaaaataataaaaaatcgactattcaagctgggcgcggcaatctttcgattcattggcccctaatttttttttattttttaataaaattctggaaacacatttctaaggctaatttgagtcgctgagtacgaatctgaccaccttttcgaccaatttcgaatcccgaa

SEQ ID NO: 39832 - DNA, 716 bp, Heterodera glycines
  misc_feature (64)..(64): n is a, c, g, or t
  misc_feature (102)..(102): n is a, c, g, or t
  misc_feature (104)..(104): n is a, c, g, or t
  misc_feature (137)..(137): n is a, c, g, or t
  misc_feature (146)..(146): n is a, c, g, or t
  misc_feature (170)..(170): n is a, c, g, or t
  misc_feature (194)..(194): n is a, c, g, or t
  misc_feature (210)..(210): n is a, c, g, or t
  misc_feature (216)..(216): n is a, c, g, or t
  misc_feature (222)..(223): n is a, c, g, or t
  misc_feature (232)..(232): n is a, c, g, or t
  misc_feature (248)..(248): n is a, c, g, or t
  misc_feature (254)..(254): n is a, c, g, or t
tttttcgatttctaaacaattaatttgattttttggtcttacatgaggtaatttttaaaaatanttttatatttattccaccttttaaaggttgttaaaaantnattttgaattaaaagagtattaggaattttgantagagtgantatgggtattggttaatttttagnaaaaaaaggggaaggggagttggnagggaaatgagaaganggaganagggannaggagaagnaagaaaagaggggaanaggganaaaaagggaaattttaaaaattaaaaaaaattttaaaaatttaaaaaaaaattcaaattttaatttatatcaagtgaaaataatacaaaattatttggttttttatttaataaattaaattaatgaaaattttaaaataaattttgttgaattattttaaataattaatgatttttggagtaaatgattgaatattaatagaaattgagatttgatttttagatgagttttttttggagagatttttaaaaaaatttttgggaaagaaggggtaaggaggtgaagataggtgatgacgggggaaattttaaaaatttgggtgaaatttgttaagagatttttaataaaaaaagggtggtttttgaaattattaagatgaattggtaggattttgatttaaaaaatgataaaatatgtataaatttaaaaaaaattatgaggaataatattttatttatagga

SEQ ID NO: 39833 - DNA, 855 bp, Heterodera glycines
acccgagaatcgcgacggagttggtcaagccgattggggtaccagccggtgtactggtcaccccgaatgtcctcattcagaattggcaccgggaaaagctgccaaagttggaaaccaaaaaatgggaatgcttattcctcctttacctttatctctccatttgtgtcctcaaaacggaggtacagctcgaagaagacggtctcactgtgaacactttcgatccaaaaacatttttgtcgaaagaaagtgccaaaacgcagtgccaccttggcggcccaacctttccattgggcggagggacaccgaagcagaaaaaccctttcgaaaggcatttggccaatgaaagtgccattcagcgaatatgccatcgcaacaatgtccaagcgactgttcctcatccgagagaccacctcgtaaatggcatcaatggcactggcacggaaaatttcaatggatgcgtcaatatgggcataaaacaattgggggacaacggaactgaaaattaatgccgaacaattttttcaaatatttataaattatgttttaaaaatgaaaaatcaaaattaaaaaatggcctattaattaatgagttgactgtttttgataataaaaagggtgtcgaattggtatttgatcaacatttctgttttggtattcattcggccctttctgtccggctaattcgttaattagccattaagttattatttttttattattgtatttaatttgctgctcaccccttctgcttctgctgctgttgttccgtcatttgcaagctattccgtgcactttcaagtgcattgcatgcgcccccgctgacacgtgcataattctgaagtgcgcacaaattag

SEQ ID NO: 39834 - DNA, 1153 bp, Heterodera glycines
tatttatgaaacaaaaaaatcgattttttcaagtgtccgtttggggtactcaaacaattatgggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctactcccgaaggattcggtctccccataaatctaggcgcatcggttcggggggactgccccgaaaacaaaaaaatcgattttttcaagtgtccgtttggggtactcaaacaattatggggagcaaaaatccaacgcagaattaaagtacaggctatagggaagctactcccgaaggattcggtctccccataaatctaggcgcatcggttcggggggactgccccgaaaacaaaaaaatcgattttttcaagtgtccgtttggggtactcaaacaattatggggagcaaaaatccaacgcagaattaaagtacaggctatagggaagctactcccgaaggattcggtctccccataaatctaggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcgggtctccccataaatctgggcgcatcggttcgtggggactgccccgaaaacaaaacaatcgatccccgccccccccccgcccttcagagcacgacaaatatttcaacaaaaatttttaaaaattgactagagcaatcgaacgctaacggacgacctaatggaaaaaaatccccgaaggagagaatttaattaaatccattccttcgggggaccgtgccgggtgccgcggggtaagcagtgctggttcgtttcatcacggcaccgaaccttttggctagtcagcaatcgttacgtaacttgccagatcggacgggtgcgcatgattccacggggagaagcaccccaccaaaagcaaaacgatataaccaaa

SEQ ID NO: 39835 - DNA, 1273 bp, Heterodera glycines
aaagcatgttttttgcccaattccgcacctcaggcgtatttttctgggcattacatggcattagagaatgaatggcatcaattttatccattttttgcttgtgctagactaaagtaacttctttttttgccggaatcccggatttttttgataaaaatttattaatccaaaattagtaaaatttaaaaaattggccaaaaatgaacttttggtattttaccattgcattattaaccaaaatcagaaaaattttaatttgtgatcaaagtaaacaaaaagtttaataataataataatatttattttcaaatatgtaattttaaatattaggccttgtaggacaactttacagtgatgggatggcatataaatattttacttgacactgaaattttttatttaaattaccaggaatttgggttttacctatgagttttattttcgaatttaagcatttttataaatccacagttatttttattaaattttcgattctcgggaaatttacatttataaaataatatgtatatacgtatttttgctttatttcagcaaagaaatcggtgttctttccttcaattgaattgatcgagtttacgatcaatttgctcgggttcagtcccgagaatgttcaaagcgaatggaaccctttgatttatgaattcttagacaaatatatcaaaggtagatgtacaaaaatcaaatattgacccaactatttaaacaacattcaggtctaattgttcaaactatgcatctagaaaaaagacaggtgtgttgtgtgaaatctgaataacagcccagggcataattacggattacagaaattacagcgtttttcagctcccataataaaagatttcgagttttcgtaatatagaaaaccacaattcttttatcagtaatatttgtaaaggggtgaacttaaatatgtattaatggagagtcaatatttaaattatttttattatgattaatttttacggattggaaaaaaagttcgaaaaacagaaactcaagctttttgaccctaacgttttaaaattaacaaaacgagtgttttgcttattttaaatattatttgtcatggaaaagtcccaacattaaaataggcgtggttaaaaatatattttgtattctcagtggatccaaagcttttaaaaaattaacgattttttccaaaattccttcaattagtttaaaaaatgttttatatcgaaaattcaaaataaatttaatttaatgcaagtcgttggcctctggccattttttc

SEQ ID NO: 39836 - DNA, 1013 bp, Heterodera glycines
attagtgaccattgacccgtctccgtacggcggtgggggcggtggcggcggcatggacccggttcctttccaattcgggcggttacagtgcaatgagcagcttattccaaacggattattcacagcaccgatttttgggtgaaaaatgataataatattaatgctaatataatcaacatttattattacattaaactttaaaaaaattattttgcttaaattatttttgaataatttttgaaactgttacatttaaataaaaattaatttttttcagggcttatatactaactttaattaaattaattgacttttaatgctttaattttaatatttttcacagaattatttggaaaaattaaaaaaaaatcaaacaaaatttatgcaattaaaaaataaaattattttattcaaaaaaattttgttttttacaagaaaacacaattaactttattgttatttcatatttttattcttaattaagcttgtatagcttcttttccattttaattcattcgaacaaattttatggacttaattcaaaaaatttaaatttttcgcaatttttccaataattgtcctcccactaattaattagcttggcacgtgtccacactgatctgtcttatcattgcgatcactgccggagtgtttgccatttttgcgtgcctttgcgtgtttttcaccagttaaaattttacattaaaattaaaatgaatttatttgaaattttagccctttgttctgcggttgccgctttgttggaatttgtggcctgtaaattttattaattttaaagttttaattttctgattttctaaagaatattaattaataattatacaaagtaacatattttgtaattttaaaattattatttaattttattctttcgcatatttattttaaagtaagaattaaaattaatttttatcaacatttatacataaaataatgagttaaacacttgaattttttaattaatatcattttaattaattactttttactaa

SEQ ID NO: 39837 - DNA, 884 bp, Heterodera glycines
aaatggtggtccggttgttcccattccgttgccccgcttgccagcagcctcaattgttcgtccaatgccgacagcgattgctaagccaacgagcagcaagtgcaacgagtgtggtcggcgatggcgcaaacaaatcatctgtaaacggacgcgtggctcttcatttggcccatctgctgcaccggtgaaggaggaacagatggaggaagaataattttagtgctgatcagcaacgggtgatggttagggcctggatttttaggacccaaaagttgcaaatgataggatttatgactaaaaataaaaataaattacagaaaatttaaatttttggagcatgaattggattgaccaaaaaaatttttcaattttatattaactatttgttaatttttcatcaatttattgagaatttttttttgctttaattctaaagtatcttgatataacgtaaacaaaaaatccagcggaagctcatgaaaatcctaaaaatccaggccctagtgtttgtgaggtccgtagtggtgaatttttcacttaattaaagtgctaaatatatagtaaaaatgaccggttacacgagccttatttggcggaaaaagtttgtgatttgtaataaattgttatgacattagattgggtggatgatcaatcatatctcgccaaatcatttttttttacatgcccccttctagtgtcatagcttttgatcagttaattgtgataatctttcattttaatacatagtcttcattgtgctattttgctagtctctgtattgtattgtaaaattgcttgtcatataaatttgctagttcagttctacaaatttacagaattattttttaaagttggttgaactttttatcttaatttcacatttt

SEQ ID NO: 39838 - DNA, 1274 bp, Heterodera glycines
tggatacaaatataatttttaaataataatgttaaaatgagacttttagagattttcaaattttttcaacgagagctttttgaattagagaaaaatgccctgttttttcaatccctcggtaccagtgagctcttccggggcattatttaaatttggcctccctgttcgttagtagaatctgccaaaagttaaaaaatgattaaattagtaattgtaataaaaaaaaattagtttcgcgctagctttgcttacgtcagtcattggtattcaatatgatgccacatttttctttgttaatgtcttcatcccctatttgcgcgtatttcatttatgggcatggcatttttataaaaatatttttttatttatgccattatatatctatttttacatcagatcattattaacacataaaaatttttaaattttccatagtaagaaactgctttcagcaccaatgcatgggtttggcctttttctgtcgctactggcggcaataaatttgtcgagaggtcaaattggtccaaaggatgaaagcaaaaaaggtttgaacaatattttcaataaaattttaaatattattttgttttgttttaggtctttttttgatggccaacgaatttctcgagacagggaaaatgcttctcgacgaattcccaggaaacaaacaggcggagaataaatctgatgatggactcaattcacaaaaagcgaatggaaaggcattggaagagaaaagtgacaatttccagcaaaaagcctttgagtttttgtgtggaatcgaaatgaaagcaaaaaatgatgagaaaggaaatgacaaaacaaagaaagatgacaatttgttagcttttaaagaattagaagaaaagcgactcaatttttgtcaaaattggaaaaatggcaaaagcatttggaaagggttgaaagaggcagggatttcaatagtaacatcagtgaataatttgaaactgaatcagcaaatatacggagaaagtgaacaatggcgaaaatggaaattttgaacagcaaaaacaaaaaagaatttgaaaattttgcgaaattaagtattgatttggtaaagaaagtaactgaaattcttaaaggtaaccaattaagttattctaaataaagaattttatcccaaatggggtaattaaacatttaattgaagatgcgagaatagttcactggctctggctgatcagtctgatcatgaccaacggaaaggcaacaacacatcacgacgaaagaaaagggcttttcatgggattttt

SEQ ID NO: 39839 - DNA, 1371 bp, Heterodera glycines
aaattatgtcattatggacttttcgccactatctttgccactattttggcatttgtagtacttttactgtcgattttgtttgtttttttgaaaaaaattgacggcatataattttctgaaaattctatttatccccctgggggatcattggagattgggggattaatggagattgggggataattagagcaaatacggtatacggtggcatctgaaaatgtatgttaaaagtatcatgtaaaggaaacaagggcaatctttcggaattgtggtcccgaaaattttttaatttgtatggcactttttctaggcttaaaaatatgctaatcacgaatatgaactcggatttgcccaattccgaaccccggacccgaattctaataaaaacttgaatttttttttttcaaaaatatacgttaaaatcgatcaaattttggcgtaaaccgcggatttttatccaattaacaatttgaatggaagttttatccgacgaagaagaaggaatggcattgtccgatttgaaagagacagcaaagaaaaacaacgaagaagccaaacgccgagaatttgaccggcgactgccaatcattcactcatatttgggcgatgtcaaccaaggggaattgtctggtcaagaaattaaacaaaggcaatttgaggaacctgggaatacaatcaaaatttcgggtaagaaaaaattaattattgggcaattggtaaaaaagataattttgtttttttagtttttgttataaacgaagtttgtctgtttccgggccagaaaatgccaatccaattccaccaaaggtcgggcatccaatttgtgcacaatgcacaccgtcagcaaaatatccttgcccttttcactgcggaagaccctaatttcgaatttcacaatgctgaggaattttcgtccgtgccatgccaccaaattggcacattgtttcaggtagttaatttgtatttttctgtcaatttccgctttcgatggctctagatgcaaaatatcttggaaaatggtgagaatgatgtccgacgaatgaccatccaagtgatcggtcgtcagcggtgtcggttcgttcgttggccgcttcaacggcaccaaattcacagtgaggaccattcagtggtcatttgcgaccaaatcgacgtggtcgtcctcgatgaaaaggttcttccacagtcgcttttcccattgaacgaatgctgctcatttggcagactgaaagctgatcaggtaaatctcgagcagcacaataaatccttaagttttagcagtcctttgtacaatcccatttaaatttcctgaaattttagagggtcaaattaaacgctgcgctcagtgcccacagtgaattttcgctgaacaat

SEQ ID NO: 39840 - DNA, 1039 bp, Heterodera glycines
accccgatgctaatccgttccgcagagcctcttcaaaatttttccattaccgcaagagttgcggaaattgtgaattaattctcagaaaaatggctatctctttttaggacaattttctatctcgtaaccccgatgctaatccgttccgcagagcctcttcaaaattttttccattaccgcaagagctgcggaaattgtgaattaattctcagaaaaatggctatctctttttaggacaatattctatctcgtaaccccgatgctaatctgttccgcagagcctcttcaaaattttttcaaagaccgcaagagctgcggaaattgtgaattaattctcagaaaaatggctatctctttttaggacaatattctatctcgtaaccccgatgctaatctgttccgcagagcctcttcaaaattttttccattaccgcaagagctgcggaaattgtgaattaattctcagaaaaatggctatctcgttttaggacaatattctatctcgtaaccccgatgctaatctgttccgcagagcctcttcaaaattttttccattaccgcaagagctgcggaaattgtgaattaattctcagaaaaatggctatctctttttaggacaatattctatctcgtaaccccgatgctaatccgttccgcagagcctcttcaaaattttttccattaccgcaagagctgcggaaattgtgaattaattctcagaaaaatggctatctctttttaggacaattttctatctcgtaaccccgatgctaatccgttccacagagactcttcaaaatttttccattaccgcaagagctgcggaaattgtgaattaattctcagaaaaatggctatctctttttaggacaattttctatctcgtaaccccgatgctaatctgttccgcagagcctcttcaaaattttttccattaccgcaagagctgcggaaattgtgaactaattctcagaaacatggctaaattgtgaattaattctcagaaatatggctatctctttttaggacaatattctat

SEQ ID NO: 39841 - DNA, 1423 bp, Heterodera glycines
tcccaacctcaatttgatcacttttgctgatcaacaatttcccaactgatcagttttcgtgccgctgatcaaaaaatggcgtcctcaaacggtccctccttcgccacctctgcttcacaaaatgccgttcaaaatgcatcgaaaagcggcacatcctctggaagcggctggcatcaccaaaatcaaaatcgtccagtttctgttgtcactaatgtgtcgcgcttcaccacttttgtttatgctcctccaacaccggcaacaacagcggcggtgccgagaagcaattctcagatgacatcatcatcacaatcggtagcactaagcccttgaatgagcctaaaaatttgatcaagtcttccgctgatcaggctctctgatcttcttaattttcattttctccctttttcccactttatctaactacacgtatctttgtctcctcattgtctcacactctctctatctctctctccctctctctcgctatcttacactctctctcattttctctctctctctctctcactctctcacactctctctatctcactctctcacactctctctatctctctctcattttctccctctctccctctctctctttctcgctccctctctctctctctcgcactctctatctctctctcattttctccctctctctctctctcattttttccctctctctcgcttttctccctctccctctctctctctctctcgctctctctcgctctctctcaattcttccactttcaagagatcgcattatcaatggtctgaaagaaatccaattcgatacgaaacacagtgccaaaaaaaattgaagctaagaccgagaatgaaatgttttattcaagttataaagaaatatgaaaatgtaaaagtgcctaaaaagagaagaaatgtaacgaagcgaacttttgattagtcgtaagcatcattgaattttcgcgaattaggtttatccttggcacaaattctcgaaggcgaaaaaaaaacaccgtattttttgtcaactaaaatgaagataattgtaatcttatatatacacacatatgtgatctcttctttctgttcctatcggcaaaactgattatcacttgtatatctatcatggaccagcagcaaatctcagcagatcagatttatatcagttaatcaaacgctttttgctgctgatatcatctcgtctctcctcattcctccccctcctttccctctttctctctcgcattttctttttgtctaactttctgcaaacaagattttggtcgaaattctgactgatctggcactctttgatcacaccttattctgtttatcaccctgatcactcttttgtcagagtactaatggttgtatctcaccgcccactgtctcatcgtcgtctttctcttcctcctcattgcgcaaaaat

SEQ ID NO: 39842 - DNA, 1019 bp, Heterodera glycines
tgaagttattggtaagccaaaaaaaatccaaacatttcaatatctataaaaaatttaaaaatgagaattcatgcgagattttctggaaataagcttaatagggcctagttaagctgtaaacaaaatttggggcgatttgaaagagaatagaaagaaccaggttcgatgaagttttggtaagccaaaaaaaaaaatccaaacatttaaaaatctattaaaaaaataaaaatgagaattcatgcgagattttctggaaataagcttaatatcgcctagttaagctgtaaaaaaaatttggggcgatttgaaagagaatagaaagaaccaggttcgatgaagttttggtaagccaaaaaaaatccaaacatttaaaaatctataaaaaatttaaaaatgagaattcatgcgagattttctggaaataagcttaatatcgcctagttaagctgtaaaaaaaatttggggcgatttgaaagagaatagaaagaaccaggttcgatgaagttttggtaagccaaaaaaaatccaaacatttaaaaatctataaaaaatttaaaaatgagaattcatgcgagattttctggaaataagcttaatagggcctagttaagctgtaaaaaaaatttggggcgatttgaaagagaatagaaagaaccaggttcgatgaagttttggtaagccaaaaaaaatgcaaacatttaaaaatctataaaaaatttaaaaatgagaattcatgcgagattttctggaaataagcttaatagggcctagttaagctgtaaaaaaaatttggggcgatttgaaagagaatagaaagaaccaggttcgatgaagttttggtaagccaaaaaaaaatccaaacatttaaaaatctattaaaaaaataaaatagtgaagttttaaaaattaataaaaatttttaaattaagagttactggcgttagcatcatagcggtgcttcagagcagtttctgtaaaaatacttatgaattaattttgtaaaaaataaataaataatg

SEQ ID NO: 39843 - DNA, 79 bp, Heterodera glycines
aatgagctgcgccagcatctgttccacctttggcacaattttactgatattttatgcctgcttcttctgctgtagttag

SEQ ID NO: 39844 - DNA, 1153 bp, Heterodera glycines
attaaatatgatttctgaaaaagtccctgaaatctcttttttttctttccatagcttcttgtagagctcgagctgctctttccaatggtcttatcccggtctcgatccgtgcagaactcaaaaagttatgaagtgaaatgtgaaatatgttttcaccacacgggattttttctgaaacccatcggaaccaaaaatctagggtttggtataagcgttttagaaattgcggagaaaaaagcttcgatattgagaaaccaagtcaagtccagaaaagaatattttaaaacgaattcgttttggtttggcattatgataccgaataacattcggaaattatggaaacaaaattggagaaattcgaataatttttgacttcaaatttttcccagttttgattgggttttcaaatagtagtttggttcagaattttcccctctacaaaaaaaatttataatagaattttttattattaattcgaaatcgttaatttatttgacaaatccaagacttaaaattgggagaagcatggggctgtggctgaggaaccaaaatggggccccattggggaattaaacatgatttctgaaaaagtcccagaaatgtcgattttttctttccatatcttcttgtaaagctcgagctgttctttccaatggtcttatcccggtctcgatccctgccgaactcaaaaagttatgaagtgaaatgtgaaatattgttttcgccacaattgggagaagcatggggctgtggctggggacccaaaatggggccccattggggaattaaatatgatttctgaaaaagtccctgaaatgtcgattttttctttccatagcttcttgtagagctcgagctgctctttccaatggtcttatcccggtctcgatccgtgcagaactcaaaaagttatgaagtgaaatgtgaaatatgttttcaccacacgggattttttctgaaacccatcggaaccaaaaatctagggtttggtataagcgttttagaaattgcggagaaaaaagcttcgatattgagaaaccaagtcaagtccagaaaagaatattttaaaacgaattcgttttggtttggcattatgataccgaataacattcggaaattatggaaacaaaattggagaaattcgaataatttt

SEQ ID NO: 39845 - DNA, 1817 bp, Heterodera glycines
  misc_feature (46)..(46): n is a, c, g, or t
  misc_feature (82)..(83): n is a, c, g, or t
  misc_feature (95)..(95): n is a, c, g, or t
  misc_feature (1152)..(1152): n is a, c, g, or t
  misc_feature (1786)..(1787): n is a, c, g, or t
gatgctttagtatcaaaaaggaagatggagaaaaattttttaaaanaatttttccttatattttgttatatcgtttgctttnnggtggggtgctnggaccagtggaatcatgcgcacccgtccgatctggcaagtaagcaacgattgctgactagccaaaaggttcggtgccgtgatgaaacgaaccagccactgcttaccccgcggcacccggcacggtcccccgaaggaatggatttaattaaattctctccttcggggatttttttccattaggtcgtccgttagcgttcgattgctctagtcaatttttcaaaatttttgttgaaatatttgtcgtgctctgaagggcgtgggagggggggggggcggaggggccccccacgagggccggaagaggccgagtgagtaccttcggtgcaggaaaattattaaattttaaaaattttttaattgctttttaaatatgccaaaaaatgtaggcttaacttttttagtgaaaattcgatcactcatattttttgctaattgagcagaagcgtaccaaactttgcagggatactccccggtaaaggactaacttacactgaaatgagcgccgagctagctggctcaaaaaaattttcgaaaatctgagtctttcgtttttatttgttttttgcataattaattcataaatatttttttcacaaaatgctctgaaacgcaccaaattttatttacatgctagtttaggcactctgatgctttttctatcaaaaagggagatgaataaatttttaaaaatttttaattcctttttaaacaggccaaaaagtttaggcttatcttttttttcagaaacttatcagaagcgccccaaactttgcagggatactgaaaggaagagaaataacctattttaaatattatctagtcagttcatttaaataatttttatccaaaaaatttttttttgggttttcggggcagtccccctgaaccgatgttaggcttaacgttttttcagaaactgatcagaagcgcagcaaactttgcagggatactgaaaggaagagaaataacctattttaaatattatctagtctgtttttttaaataatttttatccaaaaaaatttttttttggcttctcgggccgtcccccctacncgatgcgctcagatttatggggagaccgaatccttcgggaatagcttccctatagcctgtactttaattctgcgttggaatttgctccccataattgtttgagtaccccaaacggacacttgaaaaatcgatttttttgttttcggggcagtccccccgaaccgatgcgcccagatttatggggagaccgaatccttcgggattagcttccctatagtctgtactttaattctgcgttggatttttgctctccataattgtttgagtaccccaaacggacacttgaataaatcgatttttttgttttcggggctgtccccccgaaccgatgcgcccagatttatggggagaccgaatccttcgggattagcttccctatagtctgtactttaattctgcgttggatttttgctccccataattgtttgagtaccccaaacggacacttgaaaaatcgatttttttgttttcggggcagtccccccgaaccgatgcgatgatttctcatttttaaattttttatagatttttaaatgtttggattttttttggcttaccaaaacttcatcgaacctggttctttctattctctttcaaatcgccccaaattttttttacgagatgaactaggcgnnatattaagcttattcccagaaaatctcgca

SEQ ID NO: 39846 - DNA, 1322 bp, Heterodera glycines
gatatggaaagcaagcccagacttgctttcgcctagagatgcatgtgaatggcccgctcaatggtggcgccatgaattctttacagttactgaacatcatccggtgcgaagccggtcccgctcttcgtctagtccattcgactggtgagaaggtagcgtcggaaatctgagttcatcaaaattaatgtggcctgccttatgaggattgtggttcaatggccagtcccttaaaggattgtagctctcagtatcctgatctttcccatacttgggaacgattcgtcaaaaaatgcataatttttatctacatttttaatgggatgtgtgagctatcaatttatgcattcaatgcccttcgtgcggaattggacatgttttattcacagcgtcagcagagtggaaaacaaggatgttgcatcttaatccttcacattttagtgttttatcgtaatattcggtatatatctgtttatttccttgtttaagacaccccttatcccgttggctcccaaaaattgtggtgagtaggaattttgaagtgaattggacatcgcccgatgatgttccctacgacggactgttgaaagtaaaggtcattctataaggcaaagtatgacatcgtcattgattatgacaaaattgccttcttgtgaaaattgtggtgttgatcagccaaatgtgaaatatttggtcaaaaatgcccgataaaatgtattatttcatgaaattaacaaaagcagcagatcgccaaaaatgtccctcggagaatgtttaagctgtctacaagaaatcctttcacctgggtttcgtaaaattgatggcatcactgagcctttttggtacatttgacgtcgtcttcgtcacacttcatttggaagatttaaaccttagaagcgtaaatatcaattaaagtggaactgctaaaatttggtacttagaattaaattttgctttaaatatgttaaatgtttaaatttaaatttctatgcaaatatttttaaaattacattataatcattttaaacccatgctttttggacaaaaatgcagcagccactccaaacccgtcgcggattcaatttgccgcggtcgcggatcgcgcaaaaaattgccgcgaatcttggtcgcgcattttaatttttataatcatttaaaaaatttttttttaatttttttatataaaaattaattaaaatcacgatgcatataaaattttggggggggtggactgataagaggggcggggggaaggggggtggaaattttgcaaaggttcccagtgatgcaagccagggatggcattccgaagtgccgatagacgc

SEQ ID NO: 39847 - DNA, 958 bp, Heterodera glycines
aatgaattttcaaatcagttgtaaatttttatatattccttgacaaaaattgaaaatttatatcccccccccccccggtctctccgccgtaacaccgcccaaaataaaatctcagttccgcgaatttgttgccaaagagtcgaagactaatccttcctgattaatgcaatgaattaattattaatttcagcccctaattaattaattaaactcttagcaataatttgtttagtttcgaactgcaaaacgacgagctgtgaaacaattcgaactctgagcatccattcggtcgcacccaaagttgttgtcggactgatcaacgtcgtttgttgcttcggttttctgcttatgctccgctcttttgggatgccagttaatttggtagttttttaataataattatataaacaggaaattaaaaatttttttctagaaaaatcgtgttgtcaaaatggcgatttttactgaaattttctttaacactttaccagcattgggcgcacttttattcaactgggtcagttttataaataattaattatattttttattatatgacaagtgttttttttcaatttttatattattgtatttaaatttgtttttatttttttaactagttttgttgttactttcagagcactgggctggtgatggcaaattacgttggtgaactgagcatttcggcatgccccgtggacgcgttcatttgtgccgtaatttattggagaaatttggtgaaaagaggtggcgttgcccaacagcagcagaacaacattaatttgatgacggtggccaaaccgatgacgacgatggccaacagaaatgtggacagaagactgaccatccgatgaaaaaatgaagggaattttgaaaaaaatatgtaaagagaattttaatttttgaaatgaattcaaaaaatatcattaatttctgcaaaaaaattacaaataattgt

SEQ ID NO: 39848 - DNA, 1437 bp, Heterodera glycines
cccccccccctaaattaggacttctctgaaatgaagccctcaccccctctttgaggggattcaaaaataaagcccctgcggggatttattttaggaaatacggtaaattttagattttcctgaaaacatttttcggaattttctaccatttcagcagtttacggaaaatatccctttttggctctgatttggtcgcaaatccgtttttttccggaaatttactaaactttttcatttctggaattgaattttttttttttcaatttagtccaggccaattttctgaatttattggacaccctttttggtttccggaatatgtgcttaaatttctagaatttactgacaatgaatgagcccttttttcctaaacaaatttattaatttttcgggagttttcctgcaatttaatcgcatttatttcattcatttttaatcacttttttttaactttcagcaaaaagtccagcattgttctgttcggtggaaaaatgttaaaaattcctttttattcgctgatgccatcccgggcaaagagcgccgaaaattggagtcacagacggacgaatgccgacttcgcagttcactgcttaccgacaaaattacggtagggccatataccgtagtataccgtatatgctctaattatagcccatgggggattatttctcgacctcctcagaaaaggggggataattagagactgggggggaggattatgatagagggattatttttcaaaacacctcgtagactgggggataattgaagactgcgggattaatagagactgggctataattagagcatatacggtaattaatgaattaggtgccaaaaacacgctcaatttgctgcattaaggctactgaacagaacaaagagttggcctgttttatttggcgatgattaattttaatgaataagtaaaatttaatcatattaaatattattaaacaacacataaaaattcatgattatttaaaaactgaaatcactacttcttcgaataattcatctccaattttttttttacatttctataattctctgtttgatttttcaataattatccaatttccatagtattcaaaagaaaaattcattcaaatttttttttttgctttttcatttttcgtaactcttaaaattttcaaaatttaactcaaggttttttttccacggtctcgttaaccctgcacaactgttgcgacgacagttgctgataaaatgcgcgacccgccgatcgctgtttttgtgcctccatggcgaggcgctggctgtagttcgctaacaaaataagtgtgccaaaacagtgtttattgtttattcgtaaaaataaaaaaaaagtcatcagtagggcaccgatttctagtgaaaaaactctttttttgccttattgttttgaagaaaggagctcaaaaaaacgcatttctg

SEQ ID NO: 39849 - DNA, 1577 bp, Heterodera glycines
tcatcatcatcaggcgaagaaggaagcggaacagaagaggagcaccagcagaaggaggaggagggaaaggagaagaaaggggacaaattgggaggaaaagcatcggcagaaagaaaagaggcaaaaggggggggggaaatgggaaaattaggcaaaaggagaaaaatatgggaaagaggggaaaagtaaaggaaaggaaaattgggagggaaagtgtaagggtagccgggacaaaggtgacccatgcgaacacttgcaaatttcaaccgaccaattcgaaatggtcattttgactgcgattgccaaataaaaaatgctaagaaataaaaaacaaattcaggtggagctgaaaatcgacttggactccaaaacggtgatgttggtcggtccgccgcacggcggacggcgctattcgaccaccgccgtcctttcgtaccattcgcccgcaaaaccaaaattggcaaaaagtgtggggaaagaagtgtgaaacggcggaaaatataacaaattattggctaataatttacacatttcatttgaaaaaagcaaatttaaagaaaattggaaaagtgaattaattttttaattcggaaaaatattcgaattcataatgaataaaagaaggaaacaaaccatcaaatgtaaagttttgtttctttattgaaaatggaaaaatgaataataaatgtatatatataataagcacaaaagagtgattaaaatgcaaaaagtaattaaaataataattaaacccgtcagggggatttttataagaaaatataatatagatataataacatttaaaacttatttaacataaaattttgttccttttatggctttcattttgcatatgcattatatgcgtgttggctgtatatccatccgtaaatgtcctcctgggacggcgttattcggctcatcggcaaagccgcgccattcgcactgttcgaacggctgcgcggcactgcaccgcccctaaaaatgattatttcggttttaattttgatttttttaaagcatgtaaaatgcaattagaatggcttttggtttagaataatggcacagcccacccatcacccattcgttcgttgctttgcccattaattattcattcgttcgttggcttcgcttttctccgcttgccttggcattgtgccgccactgtctcccagcggagttgcgctgtaaatcattccgttcagttgcgctgctcttgccgccactgctgcgctcatgtacgcgttggagctgggcgagtgttgcaacgaatgaatgtccgacgcgcgaccggcggaaaacgaacgaatttggcgcctttaaattgaaaatgaatttttatttttaattatatttggtttactttttagcaacacacattcccacaaagacggcgaacatcacaactccgacagtgcccaagcaaattgcgataacagctgttggcaatggtttgcctggacaacaattaattaattaattgcctattagtcgaaaatgcgatttgtctaatttatttattattttcattttccttttacccatgcttttttgtctgctgttccccatgttcattg

SEQ ID NO: 39850 - DNA, 1038 bp, Heterodera glycines
  misc_feature (44)..(44): n is a, c, g, or t
  misc_feature (1008)..(1009): n is a, c, g, or t
tagaaaagaaatgggctaaaaatatttcatcaattagtcgtganccattacaagatttctatagcagggccatattggcaaagaagcacacgtagagcaggctcgaaataagggcaaatgccgaaaattttaaaaattcttgttttattagacccactctgctttgactggccatatctcgccagggagtggcggtagaccctttgttgatacatttgaaagggtagagcgcgcctagctcattcgaatagcatcaaattggtttgcatttgtcccgaaacaacccgcttatgacacgtcgaaagaaaatccattaaaatttgcattcacaaaactccattttttcattggcaaacgtctaaagcaaacctgaaattgataggaaatatatattgctcataataaaagtacaatttttatttgtcccacgccattttctgggaaaactttttcgcgaaaagccgaaaaattttccatcggcctcttccaactgcaacagatgcgtttcaaacaattgacaatataattatgattgaagtcaaaaagcctctttagaaaatgcttaaaaaatttttgttataaatgttcacaaaatattttttttgttactgacaattcatttccattcaatttaaaagcgataaataatgaattgagatatgaacaaacatctagaaaaattatctcaacaatctgtcagaaacagtccaggaaaaactttgcgcgagaagccgaaaaattttacaactgcatcactgttcatttgatagggtcaatcaattcaaaaacataacttaatataaaatattgataaaaaaattattttccttcatctttagaaattgctcaaaaattgttgttgtaaatatactcaaatattcctaaaacaagctttatttttactgactatctttttccagaaggctataaaatgcaataaacaattcgcatgcttggatagaaaagaaatgggctaaaaatatttcatcaattagtcgtgaacattanncagattctatagcaggggcatattggcaa
